United States Patent 7,833,706 (GENETIC POLYMORPHISMS ASSOCIATED WITH RHEUMATOID ARTHRITIS, METHODS OF DETECTION AND USES THEREOF) - sequence listing, part 12

SEQ ID NO: 21241 - DNA, 201 bp, Homo sapiens
aatcagtctcaggtgagctgtgtttgaagccaatgtcacattcactgtaaagaaagagaatccattctgataattaatcaatataatttcattctattaayagccaaacaggaagacaagtgtttcacggacataagaaatttaaagtggaagcactttctagagcacacaaaacagcctccctaacacatgagaagtcac

SEQ ID NO: 21242 - DNA, 201 bp, Homo sapiens
ttccctctggcccatagagcagatagtcagatctctgtgggatatctggctgcctgaatgtccatggatcacacgcttgttctgttcagaagaaatcagtytcaggtgagctgtgtttgaagccaatgtcacattcactgtaaagaaagagaatccattctgataattaatcaatataatttcattctattaacagccaaa

SEQ ID NO: 21243 - DNA, 201 bp, Homo sapiens
acacatgagaagtcaccagcaacacagaaatcaccaacaagtaggtcaccacatttttaaagatcataggaaattgttcacgccaacaaatctcagtgaayctcagctctcagccttgaaaacaaggatggctgtactactcacttttttcttcttcttccctaaccagatcactggggaatgggcagcaggaaatcaaat

SEQ ID NO: 21244 - DNA, 201 bp, Homo sapiens
atgtcacattcactgtaaagaaagagaatccattctgataattaatcaatataatttcattctattaacagccaaacaggaagacaagtgtttcacggacrtaagaaatttaaagtggaagcactttctagagcacacaaaacagcctccctaacacatgagaagtcaccagcaacacagaaatcaccaacaagtaggtca

SEQ ID NO: 21245 - DNA, 201 bp, Homo sapiens
accagctccctgacaggagttccctctggcccatagagcagatagtcagatctctgtgggatatctggctgcctgaatgtccatggatcacacgcttgttytgttcagaagaaatcagtctcaggtgagctgtgtttgaagccaatgtcacattcactgtaaagaaagagaatccattctgataattaatcaatataattt

SEQ ID NO: 21246 - DNA, 201 bp, Homo sapiens
cagcaacacagaaatcaccaacaagtaggtcaccacatttttaaagatcataggaaattgttcacgccaacaaatctcagtgaacctcagctctcagcctygaaaacaaggatggctgtactactcacttttttcttcttcttccctaaccagatcactggggaatgggcagcaggaaatcaaatcattatcttttaatca

SEQ ID NO: 21247 - DNA, 201 bp, Homo sapiens
acctcctattgccagaatatcacactcatacccactaaacacccagcccatggttctgcatctctgggaagtcaggataaatttggctgtatggggtcagwaagagtcctggtaaccctaggctttgtgtgcctcctgatgtgatgaatgtgcggtcacagctcctcctgtaaacattgctgccaaatgtttaacccagag

SEQ ID NO: 21248 - DNA, 201 bp, Homo sapiens
agtgtgtcacaaggccctttttttagagaaggccctggtgcttcagagtcaatggcagccattctgtatgctgctattgctactgtcattattattagtaktagtagtagtagtagtattctctgtgtcctttggtgcaagaagaagacaacatcagctgcagagtccaggtgagaaaacggggcagtggctggagatgga

SEQ ID NO: 21249 - DNA, 201 bp, Homo sapiens
ctcagtgtgtcacaaggccctttttttagagaaggccctggtgcttcagagtcaatggcagccattctgtatgctgctattgctactgtcattattattaktattagtagtagtagtagtattctctgtgtcctttggtgcaagaagaagacaacatcagctgcagagtccaggtgagaaaacggggcagtggctggagat

SEQ ID NO: 21250 - DNA, 201 bp, Homo sapiens
ctttggctatgaatgtcacaaatttctgggaggaaaatgccatgcagaccaagacacactattgccctgtgcaggcagactacatgcaaaagctatggtgwtatctgaaattctggaggtatcagaaaaacaggtactgtgaaagtagtgggtcctcctatagaagcctgaacctggggtgggcattaggcaggaaaggaa

SEQ ID NO: 21251 - DNA, 201 bp, Homo sapiens
agaaacaatggtaaggaaacagaccagatccctttatcaaagaacatacatttcagtgatactgactgtaatggttaattttaggtgtcatattgactggrttaagggatgcctagatagctggtataacattatttctgggtgtgcctgcgagggtgtttctggaagggattggcatgtgagtgactgagcggggaaaat

SEQ ID NO: 21252 - DNA, 201 bp, Homo sapiens
ttttcagttttagttcttgagtttaggtctttgatgtttttcttagttaattttcatatgtggtgtaagttagggatccaacttcatttttttttttttttggcatgtgaacatctggttttcctagcaccatttgttgaaaagatgcactgactctttaagacccttgccaccagcccaccccaggggacaccaactggt

SEQ ID NO: 21253 - DNA, 201 bp, Homo sapiens
gcgcccagcccaaccccgccctgggttctgtaagcgaccgcactgggtcctttctctttcttttccggacccagcagtggcgcctaaagtctgcgaggagraagtcgcctctgtgccccggagttcagaggtctaaggcgagtcctgaggaagaaaacgtagttgatggggcagagcagaaggggctggaggtggggtgga

SEQ ID NO: 21254 - DNA, 201 bp, Homo sapiens
tcttgaggaagcatcatactgtttttcatggtcgctgtaccactgtacactctcaccagcagtgtacaagtgttgtgacttctccacatcttcgccaacayttggactagtgaagttcagcatattttcatgtgcctattgcccatttgtatatcttctttggagaattgtctattcatgttgttcactcatttttgaatg

SEQ ID NO: 21255 - DNA, 201 bp, Homo sapiens
tggcacttcactagcagtgatagaaggtttgaagttagggcctccctcaatctttaccctctctctaatgcagaggattgcggcctgttggcagaagagtrgtgtcttgggccccagctgacctgatgaatatcaacatccaatgccctgtaatgaagtcatgtgtgcacatatcatcacttctgcatgcagtctcatggg

SEQ ID NO: 21256 - DNA, 201 bp, Homo sapiens
gcgcgctcccccttttctgggctccaggtcccgccagccaaagttctccaggtctcctgaccgctggaacgttccccttctgagtgtggccccgccctccmagctcgtgattggccctaagctgcgggcgccagttttcattgggtgagcggtcgctggggtggggccaggtgacaggaaatttctggtgggccttcgcgg

SEQ ID NO: 21257 - DNA, 201 bp, Homo sapiens
tcctgaccgctggaacgttccccttctgagtgtggccccgccctcccagctcgtgattggccctaagctgcgggcgccagttttcattgggtgagcggtcrctggggtggggccaggtgacaggaaatttctggtgggccttcgcggctccgctgggttggcagccgcttgagccactgcgaggaaagcaaagtctgggcc

SEQ ID NO: 21258 - DNA, 201 bp, Homo sapiens
tcttcctgcgacttctctcatccccagctcattctcccctggcctcccgctgccggggatcctctcttgtcttgcatccttccctgctactattaactccrgtgatctaaggacaccagattccctcccacctcctcccctgccctcagggcaccttgggtcctgttgccctcccagctccctgttaccccttcctatctg

SEQ ID NO: 21259 - DNA, 201 bp, Homo sapiens
tgaagttggcttctataaagtcaaagaataagcagtaagtgtaaaataaacctcaggaatccaaggaaattctacctttttacctagaaatggcctcacartgcgtcgctgaagggagagggtcccttccaggaaccccatgatgtaggggtttctgctgcagtcccaaattgagttgtcccttctctctaactgcaggtc

SEQ ID NO: 21260 - DNA, 201 bp, Homo sapiens
gcacaaagaaatctccccacctcccccacatctccccaccagttctcggtgatggacagattcacagcaacacagaaagggctgggaagggatggagggggacatctgcagccagtgtttaggggctgaccctgtgggaagacacctgccttgcagaggacctctgcatcttgcagatgcagagctgaagtctgatatgag

SEQ ID NO: 21261 - DNA, 201 bp, Homo sapiens
ggttcaagagagaaggagaggtctgtcttgatgccttgacacagcacaaagaaatctccccacctcccccacatctccccaccagttctcggtgatggacagattcacagcaacacagaaagggctgggaagggatggagggggacatctgcagccagtgtttaggggctgaccctgtgggaagacacctgccttgcagag

SEQ ID NO: 21262 - DNA, 201 bp, Homo sapiens
ctggttcatgggtgatagctggggtagcagggatctctctttttgtctcatagttttctgtatctaaggtaagcgcatactaatatatttttaatgaattmatgtactttttccctaaattagtaacagggctaattagtcttttccttgggccaaaaactacattatgtaaaatttggtatcttaactattttaaagtat

SEQ ID NO: 21263 - DNA, 201 bp, Homo sapiens
aacaggtaatgccattctaaaagaaaaaagatgggttgattgttatagattgtaggtaattaaagaaacataaccaaaggcaacgagtggacattttaagraaacaagctataaaaaataggtacaaaaatgtactgaaagaagtggagatatttgaacataaaaggactttaaataatattatggaattatttattttct

SEQ ID NO: 21264 - DNA, 201 bp, Homo sapiens
aactgtaaatacatagttgtgcaacagatctctagaacttttcatcttgcaacactgaaactctatgcccattgaacaaacattcatccatccccctcacygagcccctagcagccattagtctactttcagtttagacacctcatataaatggaaatgtgcagtattgggttttctttgtgattggcttattttacttag

SEQ ID NO: 21265 - DNA, 201 bp, Homo sapiens
atggaaatgtgcagtattgggttttctttgtgattggcttattttacttagcagtgtccttcaggttcatccctgttgcagcctgtgaccaggtttccttyttaaggctgaatgatattccgttgtcgatatataccacattttcttcattcatgtgttggtgtgtgttgtcttggctatcgtgaataatgctgctttgaa

SEQ ID NO: 21266 - DNA, 201 bp, Homo sapiens
cagtattgggttttctttgtgattggcttattttacttagcagtgtccttcaggttcatccctgttgcagcctgtgaccaggtttccttcttaaggctgartgatattccgttgtcgatatataccacattttcttcattcatgtgttggtgtgtgttgtcttggctatcgtgaataatgctgctttgaatatgggtatac

SEQ ID NO: 21267 - DNA, 201 bp, Homo sapiens
ctgaatgatattccgttgtcgatatataccacattttcttcattcatgtgttggtgtgtgttgtcttggctatcgtgaataatgctgctttgaatatgggwatacaatgtttttcttttcaaaccttccctcactttggtggaattaatcctttagtagctacttctgacagcacatatttaaagtatgtttgtatggttc

SEQ ID NO: 21268 - DNA, 201 bp, Homo sapiens
gacaaggtgtgtctgcagctgtgctcacacctggaggaaacctcaatggtgtgagtaaattgtaaatgtttacttattatgggttattttattatttatgragtatgtattttgatttcattctactgacaacacaataaaccaggacatgatgaccctagcagcacatcctctttcctgtgtcaagaagcatcgtccggg

SEQ ID NO: 21269 - DNA, 201 bp, Homo sapiens
gaattgaagaaccagggagaaccagatgggctgggcaggtgggttttcacctggaacctggaggatgagcaatgacatctctccaccctgagctcagcccsggcatccacctcctgggctcatgagcagtgcagtggtgcctcctagtggtctctgctcttccttttccagatcaagcacaaacctgagatccaactgtcc

SEQ ID NO: 21270 - DNA, 201 bp, Homo sapiens
agatcaggaagccagcagcaccaggggctttaggcatttctacacatatgggaagctcttcctctctcccaacctggagactcagtaatggacagtgcccyggtcctccagagctcagactttggctatgaatgtcacaaatttctgggaggaaaatgccatgcagaccaagacacactattgccctgtgcaggcagacta

SEQ ID NO: 21271 - DNA, 201 bp, Homo sapiens
agatagaacaaaaaagcagaaaggagtcaaattttctctctctctctctctcaatctgggacacttttcctgcccttggacatcagaactccaggttgtayggtctttggactcttgagtgttgcaccagtcaaccctttatcctcccacctcctcctctggcccctcaggcctttggccttggactgagccaggctactg

SEQ ID NO: 21272 - DNA, 201 bp, Homo sapiens
catgttgttcactcatttttgaatgagattgtttgtttttctgttgttaagtcatagttctttatgtattctggatattaattctttatcaggtatataaytggcaaatatttcctcccattctgtgcattttcttttaactctcttaatagtgtcccttgatatataaaaaaggtttttaaattttgatagtctaattta

SEQ ID NO: 21273 - DNA, 201 bp, Homo sapiens
ctcctcctgtaaacattgctgccaaatgtttaacccagagctacataggtccttaggaggcatagcagttagaggaaaaaagttaaaggcatcaggggaamtaatatgataaattcagtgtggagaagattccacaggtatttggcctcatctctgaaacaggtaatgccattctaaaagaaaaaagatgggttgattgtt

SEQ ID NO: 21274 - DNA, 201 bp, Homo sapiens
tttcagtgatactgactgtaatggttaattttaggtgtcatattgactgggttaagggatgcctagatagctggtataacattatttctgggtgtgcctgygagggtgtttctggaagggattggcatgtgagtgactgagcggggaaaatcctctctcgctgtgggcagccacaatccaatcacctaggggcccagatag

SEQ ID NO: 21275 - DNA, 201 bp, Homo sapiens
aattcttttgggtatatgcccaaaagtggaattgttggctcctatggaaattgtgtttttactttcttgaggaagcatcatactgtttttcatggtcgctrtaccactgtacactctcaccagcagtgtacaagtgttgtgacttctccacatcttcgccaacacttggactagtgaagttcagcatattttcatgtgcct

SEQ ID NO: 21276 - DNA, 201 bp, Homo sapiens
aagattccacaggtatttggcctcatctctgaaacaggtaatgccattctaaaagaaaaaagatgggttgattgttatagattgtaggtaattaaagaaayataaccaaaggcaacgagtggacattttaagaaaacaagctataaaaaataggtacaaaaatgtactgaaagaagtggagatatttgaacataaaaggac

SEQ ID NO: 21277 - DNA, 201 bp, Homo sapiens
tcccatgcagagaagaggctctgactgtaactgcacctgtggagaggtgaggacctgtcccctctacaccgatggccagagcctccagagtggggccaggyttttccctcagctgtgtcctgtcaggtttatctaggcctcaaagaatagaccctggacattgcctctggcaatgtgagctggacacacacccagatgtaa

SEQ ID NO: 21278 - DNA, 201 bp, Homo sapiens
attttctttcattctgggggttgctttttcactgtgtttattgtgtttttaatgaacttttttattttgatgagtccaatttatcaattttttctttgttkttgtatctttggtgttatatccaagaaagtgctatcaaattctatggcatgaagataattccctatgttttattgtaagagtttttcagttttagttctt

SEQ ID NO: 21279 - DNA, 201 bp, Homo sapiens
ggacattggggtatttgggaggggaatgggagccacatctccatctacacccctaagtcctgcccaagccagggctgggccacggccctcaaatgtccagyggtggcctcctcctgctgcaggtgaggagtgggcagcagggagggctgtggcacctgctctgtccccatcctggtctctcttgtttcttgggctcaccac

SEQ ID NO: 21280 - DNA, 201 bp, Homo sapiens
cgcgcgggcgcccagcccaaccccgccctgggttctgtaagcgaccgcactgggtcctttctctttcttttccggacccagcagtggcgcctaaagtctghgaggaggaagtcgcctctgtgccccggagttcagaggtctaaggcgagtcctgaggaagaaaacgtagttgatggggcagagcagaaggggctggaggtg

SEQ ID NO: 21281 - DNA, 201 bp, Homo sapiens
cattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgtgtct

SEQ ID NO: 21282 - DNA, 201 bp, Homo sapiens
cattggaaggccaaggagggtggattgtctgagcccagaagttcaagaccagcctgggcaacatggcaaaatcctgtctctacaaaaaatacaaaaaaaaattagctgggcatggtggcatgagcctgtagtcctaggtaccccagtgtttgaggtgggaagattgttcgagcctggaaggttgaggctgaagtgagctgt

SEQ ID NO: 21283 - DNA, 201 bp, Homo sapiens
gcattccctccaggagattagggtttgtgagatcaggaagccagcagcaccaggggctttaggcatttctacacatatgggaagctcttcctctctcccarcctggagactcagtaatggacagtgccccggtcctccagagctcagactttggctatgaatgtcacaaatttctgggaggaaaatgccatgcagaccaag

SEQ ID NO: 21284 - DNA, 201 bp, Homo sapiens
cagcagcaccaggggctttaggcatttctacacatatgggaagctcttcctctctcccaacctggagactcagtaatggacagtgccccggtcctccagarctcagactttggctatgaatgtcacaaatttctgggaggaaaatgccatgcagaccaagacacactattgccctgtgcaggcagactacatgcaaaagct

SEQ ID NO: 21285 - DNA, 201 bp, Homo sapiens
gcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgtgtc

SEQ ID NO: 21286 - DNA, 201 bp, Homo sapiens
tgcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgtgt

SEQ ID NO: 21287 - DNA, 201 bp, Homo sapiens
atgcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgtg

SEQ ID NO: 21288 - DNA, 201 bp, Homo sapiens
aatgcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcatgt

SEQ ID NO: 21289 - DNA, 201 bp, Homo sapiens
caaatgcattacacaaaggttccagtttcgcaacctgtttgccaaacttgatatttctgtgtgtgtgtgtgtgtgtgtgtgtgtgtgtgtgtgtgtgtgtgtgtgtttgataatagccaaactaattggtgtaaagtaatagttcattgtggttttgatttgcatttccctaatgactgctgatgctgagcatcttttcat

SEQ ID NO: 21290 - DNA, 201 bp, Homo sapiens; identical to SEQ ID NO: 3431

SEQ ID NO: 21291 - DNA, 201 bp, Homo sapiens
tcttccccagagccccacagtctttgttacaacctcacggtgctgtcccgggatggatctgtgcagtcagggtttctcgctgagggacatctggatggtcwgctcttcctgctctgtgacaggcagaaaggcagggcagggccccggggacagtgggcagaagcagtcctgggagctgagacctgggacacagagactgaa

SEQ ID NO: 21292 - DNA, 201 bp, Homo sapiens
caggtggggtgagttgagaatcacgtgctgattgctgagggcctggatgatcatggcttcagtgggagtaaatagtaaaggcggctgtgatctggggaggrgctagaaactggagaggaatccgaggagaggcggtgcccctagtctcttcctctctgcatccctctctcctgtttctccagccatcaggaggacaccaag

SEQ ID NO: 21293 - DNA, 201 bp, Homo sapiens
tctcaaaattcctgctttcaatgttgatgtccaataaagatgttcataatttcagctggatattcttaataggatttcctccaataccgatgctgtaaagyatattgaatggaacaggaattcaaatttgaaactctctctctagaagggtccatgtgggagatggtggctgtggctgtggcaatccccaggtgcagagtg

SEQ ID NO: 21294 - DNA, 201 bp, Homo sapiens
ggctggagaccagaagcctgaaggcaactccgtcctccccagcccacagcgccgttattccgtttctatatcagcaaacacttgtagaccagggcggggtracgggtgatctcagtcctcgcagtgaactccgggccgcaggcttgaaaacgcgcgcgggcgcccagcccaaccccgccctgggttctgtaagcgaccgca

SEQ ID NO: 21295 - DNA, 201 bp, Homo sapiens
ttctatgaatttgcctattttagctgcatcacataagtgaaatattatatttgtctttttgtttctggctcatttcacttatagtgttctcaaggttcatscaacctgaatttcattcacttttaaggctgaataatattccatgctatgtgcaccatgggtcgtttatctaatcatcctccgatggacactcggttgctt

SEQ ID NO: 21296 - DNA, 201 bp, Homo sapiens
cccagctcaatgataaactcttctcttcttcaaataaaagcacatcctggcttacatggccatcacttctttgtacaattttatatttttatcatctaaarttatagtttagttttacctttaagagtatatttttatcctcatttattccatagattcctgcttgaaatttatattgtctggtagtttcctgtcctttgc

SEQ ID NO: 21297 - DNA, 201 bp, Homo sapiens
actgcacctgtggagaggtgaggacctgtcccctctacaccgatggccagagcctccagagtggggccaggcttttccctcagctgtgtcctgtcaggttyatctaggcctcaaagaatagaccctggacattgcctctggcaatgtgagctggacacacacccagatgtaaggtagccctgccaagtatcctggggttgc

SEQ ID NO: 21298 - DNA, 201 bp, Homo sapiens
cccggctaatattttgtattttaatagagactgggtttcaccatgttgaccgggatggtctcaatctcctgacctcgtgatctgcctgcctaagcctcccraagtgctgggattacaggcgtgagccaccacacctagctggtaattcattttttaatttttggaggaatcaacacactgttttccataacaggtgcccta

SEQ ID NO: 21299 - DNA, 201 bp, Homo sapiens
gagtcaactttcctgtaaagcagaacaagcacgagattggaccatgttagaggaggaatggtgtcatctccacttctggagagatccctgtccccgtgttygggggaaggaccaagcctcactcccatgcagagaagaggctctgactgtaactgcacctgtggagaggtgaggacctgtcccctctacaccgatggccag

SEQ ID NO: 21300 - DNA, 201 bp, Homo sapiens
accagcccaccccaggggacaccaactggtccatccacctccctacttggggcattgccatgccactctgaagcccacaccattgcttctccctgggatayggacctcgtagaaaacgtctctggcaccacagcctacctgcccctcctgcctcacagccaagtctcccttgcccccaccttgtccatgttgagccttcct

SEQ ID NO: 21301 - DNA, 201 bp, Homo sapiens
tgatgaccctagcagcacatcctctttcctgtgtcaagaagcatcgtccggggaggtgagaagaagacagtcctccctagaattgaagaaccagggagaascagatgggctgggcaggtgggttttcacctggaacctggaggatgagcaatgacatctctccaccctgagctcagccccggcatccacctcctgggctca

SEQ ID NO: 21302 - DNA, 201 bp, Homo sapiens
tcctctatcctcccaccttcccagttttccttgcgtctgaaatcctcattcttgtccctttgcccgtgtgcatttcctgcctcctcaggaaggtcgggacrgcagacctgtgtgttaaacattgatgtgaagttacttccaggaagaagtttcatctgtgatttcctcttccccagagccccacagtctttgttacaacct

SEQ ID NO: 21303 - DNA, 201 bp, Homo sapiens
ttagtctactttcagtttagacacctcatataaatggaaatgtgcagtattgggttttctttgtgattggcttattttacttagcagtgtccttcaggttyatccctgttgcagcctgtgaccaggtttccttcttaaggctgaatgatattccgttgtcgatatataccacattttcttcattcatgtgttggtgtgtgt

SEQ ID NO: 21304 - DNA, 201 bp, Homo sapiens
taaacattgatgtgaagttacttccaggaagaagtttcatctgtgatttcctcttccccagagccccacagtctttgttacaacctcacggtgctgtcccrggatggatctgtgcagtcagggtttctcgctgagggacatctggatggtcagctcttcctgctctgtgacaggcagaaaggcagggcagggccccgggga

SEQ ID NO: 21305 - DNA, 201 bp, Homo sapiens
gtcccgggatggatctgtgcagtcagggtttctcgctgagggacatctggatggtcagctcttcctgctctgtgacaggcagaaaggcagggcagggcccyggggacagtgggcagaagcagtcctgggagctgagacctgggacacagagactgaagacttgacagagaatgggcaggagctcaggaggaccctggctca

SEQ ID NO: 21306 - DNA, 201 bp, Homo sapiens
ccccggggacagtgggcagaagcagtcctgggagctgagacctgggacacagagactgaagacttgacagagaatgggcaggagctcaggaggaccctggmtcatatcaagggccagaaaggaggtgagagtgggcagtgggcaagagtaatgggagaggccttttccaggagagttgggggcagagagcaggacctgtct

SEQ ID NO: 21307 - DNA, 201 bp, Homo sapiens
acactattgccctgtgcaggcagactacatgcaaaagctatggtgatatctgaaattctggaggtatcagaaaaacaggtactgtgaaagtagtgggtccycctatagaagcctgaacctggggtgggcattaggcaggaaaggaaggcctcaaggccagggctgcctcatctgcctcccagcctgcccatcctggagagc

SEQ ID NO: 21308 - DNA, 201 bp, Homo sapiens
actgaagttggcttctataaagtcaaagaataagcagtaagtgtaaaataaacctcaggaatccaaggaaattctacctttttacctagaaatggcctcayaatgcgtcgctgaagggagagggtcccttccaggaaccccatgatgtaggggtttctgctgcagtcccaaattgagttgtcccttctctctaactgcagg

SEQ ID NO: 21309 - DNA, 201 bp, Homo sapiens
ggcctcctccctataccctgagggggcctgtggctgccctgccctggcacctggcctacaagtttgccatccccattcccccttcttctgttcctcagtcycctcctctatcctcccaccttcccagttttccttgcgtctgaaatcctcattcttgtccctttgcccgtgtgcatttcctgcctcctcaggaaggtcggg

SEQ ID NO: 21310 - DNA, 201 bp, Homo sapiens
gcatggccaccaggattccccgaggagaggagcagaggttcacctgctacatgggacacagagggaatcacagcactcaccctgtgccctctggtgagccwggggcaactctcaagggtttcgacctagggaggtcaggccagggtggggatagcagggacggctgtggctttgcgtgctcagtgtgtcacaaggcccttt

SEQ ID NO: 21311 - DNA, 201 bp, Homo sapiens
aactgaagttggcttctataaagtcaaagaataagcagtaagtgtaaaataaacctcaggaatccaaggaaattctacctttttacctagaaatggcctcrcaatgcgtcgctgaagggagagggtcccttccaggaaccccatgatgtaggggtttctgctgcagtcccaaattgagttgtcccttctctctaactgcag

SEQ ID NO: 21312 - DNA, 201 bp, Homo sapiens
ggacacacacccagatgtaaggtagccctgccaagtatcctggggttgccagtagttctgggtgctcagtgtctggagcggagggtgggaaggaggcttgrtgcagaacaagaaccatatgtcacatactattttattctttattagtgtttttgtcataaaaaaccccacgggtaccataaaagataaaagatctaaaaa

SEQ ID NO: 21313 - DNA, 201 bp, Homo sapiens
ctctcccctctggcaagaccttccttccaccactgccttcatgctcctcccttgaacctgcagggcagccccttccattggcctcctccctataccctgarggggcctgtggctgccctgccctggcacctggcctacaagtttgccatccccattcccccttcttctgttcctcagtcccctcctctatcctcccacctt

SEQ ID NO: 21314 - DNA, 201 bp, Homo sapiens
gcagaacaagaaccatatgtcacatactattttattctttattagtgtttttgtcataaaaaaccccacgggtaccataaaagataaaagatctaaaaatrgtgccctttaatcaaaagtaaacaccctttaaccatcagagagagggagaagtttggcagctgacctagaagccccatcaactgccccagctcaatgata

SEQ ID NO: 21315 - DNA, 201 bp, Homo sapiens
ccttcagaaataatggattttatatatatataaatatatatatatacatatatatacatatatatacatatatatacatatatatgactatacatagtacyacatatatataactatatatagtactactatgaaattatatatatagtactatatatagtagtcatactataaaagctagtagtaatatgtatatttttg

SEQ ID NO: 21316 - DNA, 201 bp, Homo sapiens
acattatttttgttatcatttgattatattttaatatattacatatgcggtcattgtattattattataaatgagatttatgagtgagtgtcctggttacrgctccttctggggagcccaggaccagctttcctggcaccttgaggtcccctcaccctgtcacactctcatgcattacctcatatctactatgtcttcata

SEQ ID NO: 21317 - DNA, 201 bp, Homo sapiens
aggaatgaaatactgatacatgctacaacattgctgaatctcaaaaacatgataagtgaaggaaatcagctacaaaaggatacatatttcatgaacccatytttgtgaaatcttcagaagagaccaatctatagagaaagaaagcagacttgtggtgacagggtctggtggcaggaggaaatggagggtgactgcttaatg

SEQ ID NO: 21318 - DNA, 201 bp, Homo sapiens
cctgtgcaccacagccatggtggtcatgggtccctctgagcctgggtcccttacagtttctgctctcccctctggcaagaccttccttccaccactgcctwcatgctcctcccttgaacctgcagggcagccccttccattggcctcctccctataccctgagggggcctgtggctgccctgccctggcacctggcctaca

SEQ ID NO: 21319 - DNA, 201 bp, Homo sapiens
tggttgggtggatgaaaagcgttagtatatatgaggggtttgcagctgtgccacattatttttgttatcatttgattatattttaatatattacatatgcrgtcattgtattattattataaatgagatttatgagtgagtgtcctggttacggctccttctggggagcccaggaccagctttcctggcaccttgaggtcc

SEQ ID NO: 21320 - DNA, 201 bp, Homo sapiens
ccagcctgcccatcctggagagctacctcctagccccacgacccaggagcccacccctgacaaccctctcctcagcatcaaagccggagtcccagagtgtraggccacagtcctgaggcccatcttccagcaagcctaggggaattggaccccaggtaaggaccgatttgcagaaggtctggggtcagtgtgggtttcagc

SEQ ID NO: 21321 - DNA, 201 bp, Homo sapiens
ggcaggaggaaatggagggtgactgcttaatggtgcagagtttcccctgaggtgatgaaatactctggaactagagagtgatgatggctacataacattgygaacctactaattgtcactgcattgtacacctattgtacaatgggtacagtggtaaattttgtgttcatgtatattgtatcacagtaaaaaagaggctga

SEQ ID NO: 21322 - DNA, 201 bp, Homo sapiens
actaggatgattcatttggagggaaatgtttgaccttatgttaggaaagtcatttgctttcctaaaaaggatcctgcttaccagtgagtatataatttttktatgcccggggtggagttcacagcagaggaactaacaatagctctaggaacaccatacacctcatgcgtagctgactcacccatctgcctcccccagctg

SEQ ID NO: 21323 - DNA, 201 bp, Homo sapiens
agcccacccctgacaaccctctcctcagcatcaaagccggagtcccagagtgtgaggccacagtcctgaggcccatcttccagcaagcctaggggaattgraccccaggtaaggaccgatttgcagaaggtctggggtcagtgtgggtttcagcgagagtcagaacaatagagaggaccagtcctgttccctgcatctccc

SEQ ID NO: 21324 - DNA, 201 bp, Homo sapiens
tgggattacaggaatgagccaaggcgcctggcccattttgttgttctctatgtatatatttttataggtatctttattgtacaaggttgcattcatatgtyatgggttatcttgaatgttgctttttgaatgtattattatacaagtagttttccatgttgtaaactctgtataaagtttacatgcttttttggccggcat

SEQ ID NO: 21325 - DNA, 201 bp, Homo sapiens
aatatatatataattatagtatttttatgtctataaatgagataatcagtattttataaattgatggtattcttagcattgacttcattgctcagctaaaygctgtaaccaaaggatgagtcatggagtggaggaagaatatttttctactctctggaggtgccataatcggcatttctgccctatggatttcaaatgaga

SEQ ID NO: 21326 - DNA, 201 bp, Homo sapiens
gaagattttatgttctcagggactcatattttcatctgtggaagggaaaaatccatctcgctgtcttaggtgtgatggtaattttacataaatatatatawaattatagtatttttatgtctataaatgagataatcagtattttataaattgatggtattcttagcattgacttcattgctcagctaaacgctgtaacca

SEQ ID NO: 21327 - DNA, 201 bp, Homo sapiens; identical to SEQ ID NO: 3430

SEQ ID NO: 21328 - DNA, 201 bp, Homo sapiens
gaactaaagctcgtgaggaatggggagagtggcagaacctcctattgccagaatatcacactcatacccactaaacacccagcccatggttctgcatctckgggaagtcaggataaatttggctgtatggggtcagaaagagtcctggtaaccctaggctttgtgtgcctcctgatgtgatgaatgtgcggtcacagctcc

SEQ ID NO: 21329 - DNA, 201 bp, Homo sapiens
tgcagagctgaagtctgatatgagggagaggacagggagtgctttggactttcctgattaagaagaatagagatcagtctgcttctggggttaagtgaccmctggggagattggactgaattaatgaagaataaatgaactgggaatgaggatgagtaaagcaagtatcagcatctcccattatcagttcagactgattgg

SEQ ID NO: 21330 - DNA, 201 bp, Homo sapiens
gtgaatctgattttggagtgactgaggagggagaaatcctcagggagtaaaaagcagcactctgcacccaggggagcatttattggtttctctattttctscagagcacgtgagcctgcaaggcccggatcaacgcccggttgggacaggagaccaccagggcagtgcacagctgggatttcagtctctggtgtcaactcc

SEQ ID NO: 21331 - DNA, 201 bp, Homo sapiens
catttagtcctgcggccctttcagtccctacagagtgcatagtgggcacagggcaagtgctgatcttcatgaagtcatgggaggggactggcaggggctgrgaaaagtgccataggagggagaaaaatgtgggagcatcatcttccctcagagaaagggtgaatctgattttggagtgactgaggagggagaaatcctcag

SEQ ID NO: 21332 - DNA, 201 bp, Homo sapiens
ggtatttgggaggggaatgggagccacatctccatctacacccctaagtcctgcccaagccagggctgggccacggccctcaaatgtccagcggtggcctyctcctgctgcaggtgaggagtgggcagcagggagggctgtggcacctgctctgtccccatcctggtctctcttgtttcttgggctcaccacggtgcgtcc

SEQ ID NO: 21333 - DNA, 201 bp, Homo sapiens
tttcttctggagtcttgtcatttagtcctgcggccctttcagtccctacagagtgcatagtgggcacagggcaagtgctgatcttcatgaagtcatgggargggactggcaggggctgggaaaagtgccataggagggagaaaaatgtgggagcatcatcttccctcagagaaagggtgaatctgattttggagtgactga

SEQ ID NO: 21334 - DNA, 201 bp, Homo sapiens
cacccctaagtcctgcccaagccagggctgggccacggccctcaaatgtccagcggtggcctcctcctgctgcaggtgaggagtgggcagcagggagggcygtggcacctgctctgtccccatcctggtctctcttgtttcttgggctcaccacggtgcgtccaggtggggtgagttgagaatcacgtgctgattgctgag

SEQ ID NO: 21335 - DNA, 201 bp, Homo sapiens
aggcttgagaggaggggagggcactgagtttcttctggagtcttgtcatttagtcctgcggccctttcagtccctacagagtgcatagtgggcacagggcragtgctgatcttcatgaagtcatgggaggggactggcaggggctgggaaaagtgccataggagggagaaaaatgtgggagcatcatcttccctcagagaa

SEQ ID NO: 21336 - DNA, 201 bp, Homo sapiens
gcggcggggcgtttctgggggtccgggtgggtagcggcgagcgctgtgcggccgaggcggggctcaggtgcgctgtcgggggtgcggggagtggacgcggmccgttcccgccacacctcaaccctgcttccacgtctcttttcagtcctcctcgggatcgctcatcacccgccccctgcattttctggtcttgtcctgcac

SEQ ID NO: 21337 - DNA, 201 bp, Homo sapiens
ggcctcctccaggagctgtcttgggggtatcatgtcctctgcatcactggaggttcccaccacatggccctgcctccctgagtttctgtgcagatgttatrgaggagtatataagcagacatccctgggccatttgggaagcaggaaccagctccttgtcagggcagctgtggtccctgttttcatcatatgtccaagtgt

SEQ ID NO: 21338 - DNA, 201 bp, Homo sapiens
atagggagaagaagaagatcctctgtgggtgtgagggcagtggcctgggtggaatccctgctaggaaccagacaggaaggccttgcagcctcaccaagcarcagccctggggtggagctggatttccagggatgagtggaccaggcaggagcagggcatcccaagtgcaggtcatggacctgggtgtcaagggaagcagag

SEQ ID NO: 21339 - DNA, 201 bp, Homo sapiens
attctattttactctctgtttctatgaatttgcctattttagctgcatcacataagtgaaatattatatttgtctttttgtttctggctcatttcacttayagtgttctcaaggttcatccaacctgaatttcattcacttttaaggctgaataatattccatgctatgtgcaccatgggtcgtttatctaatcatcctcc

SEQ ID NO: 21340 - DNA, 201 bp, Homo sapiens
taattttcgtttgagaggctcactctgcctttgtgtgagtaatggacagtgggcatgagaggcagcaggcagcccagctggaaagcccttctggtttacarttcttgagagggtggctctcgggtggtggcaggagaggagtgaaaagtgattggatttagtgttgatatacttgttaatattgtggtaaaacatacatac

SEQ ID NO: 21341 - DNA, 201 bp, Homo sapiens
tgctcagctaaacgctgtaaccaaaggatgagtcatggagtggaggaagaatatttttctactctctggaggtgccataatcggcatttctgccctatggrtttcaaatgagaaatttgctttaggctgaggttggaaggagatctgaacttctttgtattactattattttagatggggtcttgctatgttgtccaagct

SEQ ID NO: 21342 - DNA, 201 bp, Homo sapiens
ctggggaaagagggagagaaaggccttgtgtgtgacccagcccaggcctggaagtacgtggagccagggcctctctctggggaggcctcccactgtgtccragctggccaggcttgagaggaggggagggcactgagtttcttctggagtcttgtcatttagtcctgcggccctttcagtccctacagagtgcatagtggg

SEQ ID NO: 21343 - DNA, 201 bp, Homo sapiens
aggcctcccactgtgtccgagctggccaggcttgagaggaggggagggcactgagtttcttctggagtcttgtcatttagtcctgcggccctttcagtcchtacagagtgcatagtgggcacagggcaagtgctgatcttcatgaagtcatgggaggggactggcaggggctgggaaaagtgccataggagggagaaaaat

SEQ ID NO: 21344 - DNA, 201 bp, Homo sapiens
ctgtagtcctaggtaccccagtgtttgaggtgggaagattgttcgagcctggaaggttgaggctgaagtgagctgtgatcatgccactgccctccagaccrggctacagagtgagaatttgtctccaaaaataaataaattcatagactactcaagtgataaatattaaaccagagactgctttaaacattttaaagcctt

SEQ ID NO: 21345 - DNA, 201 bp, Homo sapiens
caataaaatggcttttaaaatatatcttctttgagatttgtactttgcttatgtaaaacaaaacaaaacaaaaaccttgtttttgtgcccaagagacacascctgacacatcggcaggtagaggcttacgtgtgtatatatattactgtatatttacagattcagagagagagacagagataaagctatgttaagaatatt

SEQ ID NO: 21346 - DNA, 201 bp, Homo sapiens
agggaggggtccttcctggtccgagttcctcacttggactggaatggagaagtcactgctgggtaggggcaggcagccttgcattccctccaggagattasggtttgtgagatcaggaagccagcagcaccaggggctttaggcatttctacacatatgggaagctcttcctctctcccaacctggagactcagtaatgga

SEQ ID NO: 21347 - DNA, 201 bp, Homo sapiens
gctgtgatcatgccactgccctccagaccgggctacagagtgagaatttgtctccaaaaataaataaattcatagactactcaagtgataaatattaaacmagagactgctttaaacattttaaagccttattatactgtcatactgtgattgtactgacatatttattcatttaacaaatacttactgagagctatttac

SEQ ID NO: 21348 - DNA, 201 bp, Homo sapiens
actctatattttaaatgttattctcttcttcaccttttttctcctctttccttcctctctcttcccttttttcttcaacacgctccccccacccccacccyccagccatccttccctactttctcccttctctgcacttgatccccggtgtattccagcctcgaggccaacacacgtcaccgcgtccgcctggggcaggtc

SEQ ID NO: 21349 - DNA, 201 bp, Homo sapiens
gactacatgcaaaagctatggtgatatctgaaattctggaggtatcagaaaaacaggtactgtgaaagtagtgggtcctcctatagaagcctgaacctggrgtgggcattaggcaggaaaggaaggcctcaaggccagggctgcctcatctgcctcccagcctgcccatcctggagagctacctcctagccccacgaccca

SEQ ID NO: 21350 - DNA, 201 bp, Homo sapiens
tcatctgtgatttcctcttccccagagccccacagtctttgttacaacctcacggtgctgtcccgggatggatctgtgcagtcagggtttctcgctgaggracatctggatggtcagctcttcctgctctgtgacaggcagaaaggcagggcagggccccggggacagtgggcagaagcagtcctgggagctgagacctgg

SEQ ID NO: 21351 - DNA, 201 bp, Homo sapiens
gaatatcaacatccaatgccctgtaatgaagtcatgtgtgcacatatcatcacttctgcatgcagtctcatgggaaggtgggttcctggaccccaggttamaggcctaagcactacaggcatacagatggagctccagggaagggagagatgactggggtgggaccacacttttccttcagggtgtccctcagttcaagga

SEQ ID NO: 21352 - DNA, 201 bp, Homo sapiens
aggctgaaacatgctgaaatggagggtttactgctttccttgctttaaattttgctggctcacaatggcttatgtttattgcataagggggccacagggarggttgcttgctcacataaggagcccctggttttcttcagaaacaagttcaaattctccacttagagccaaaaaaaattaattgcaagatgttcaaactga

SEQ ID NO: 21353 - DNA, 201 bp, Homo sapiens
tgttaagtcatagttctttatgtattctggatattaattctttatcaggtatataactggcaaatatttcctcccattctgtgcattttcttttaactctsttaatagtgtcccttgatatataaaaaaggtttttaaattttgatagtctaatttattgtttttcttttattggttgtgcttttgctcaccagccaagaa

SEQ ID NO: 21354 - DNA, 201 bp, Homo sapiens
ctggtgggaaaattgctcctggatgagaatacttgtttgagaggtagagacactcaggagctgggcctgtagagggaaagtgatccggaagtagatacaaagcagagtggggctggagaagacaggaagggagtctaggtctggaggggcctggcctgatggttgaaggtctggagctcagaacctcagggtatggggaac

SEQ ID NO: 21355 - DNA, 201 bp, Homo sapiens
tggggaggtgggatagttcctgaccctgttgtgaggttccttttaactttctggccttggggcacagatgggtggtgctcttcttggtcagggtagcctcrgctccactcaggtaaggcagtggtggcagggagagttaggggatcacctgtgaaacggaccaaggcagggatgggagccctctgtgcagcaaaagtggat

SEQ ID NO: 21356 - DNA, 201 bp, Homo sapiens
tgatcttcatgaagtcatgggaggggactggcaggggctgggaaaagtgccataggagggagaaaaatgtgggagcatcatcttccctcagagaaagggtraatctgattttggagtgactgaggagggagaaatcctcagggagtaaaaagcagcactctgcacccaggggagcatttattggtttctctattttctcca

SEQ ID NO: 21357 - DNA, 201 bp, Homo sapiens
tacactctgcagccagatggccagaattcaactccctgcccaggtctcaccagcactttcccacttggtgcctcagtttcctcatctatgaaatggggaarctaacagcatttatttcttgtggttgggtggatgaaaagcgttagtatatatgaggggtttgcagctgtgccacattatttttgttatcatttgattata

SEQ ID NO: 21358 - DNA, 201 bp, Homo sapiens
cacatgcctcactggctctgcccttttgtctccaatgacccccacagtgaatgagatgcacagtggggccttagaaggcaatgtcaccatgatgtgctggyctccatcttctatccctggaatatctctctgacctggcatcaggatgaggcatctttgagccaggatgcccagcagtctaggggtgtcctgcccaatggg

SEQ ID NO: 21359 - DNA, 201 bp, Homo sapiens
ctcatcccctgcccccgccaccgcaggtccctcctgcctcccttatgggcctttcctagaagcagccttaacccagggctgcccctatgcctcccactccyaactctccctgaccctaactctctggtgccgccttttgtcccagggtcttccctccgtcccactcccctctagaccacccaaggggagccctagtgctaa

SEQ ID NO: 21360 - DNA, 201 bp, Homo sapiens
aaatttaccctttaagtagacatttctggtctgtgttttatttcaagtgtctgggaagggatagagtatgaggttcaagagagaaggagaggtctgtcttsatgccttgacacagcacaaagaaatctccccacctcccccacatctccccaccagttctcggtgatggacagattcacagcaacacagaaagggctggga

SEQ ID NO: 21361 - DNA, 201 bp, Homo sapiens
ttcaagtgtctgggaagggatagagtatgaggttcaagagagaaggagaggtctgtcttgatgccttgacacagcacaaagaaatctccccacctcccccrcatctccccaccagttctcggtgatggacagattcacagcaacacagaaagggctgggaagggatggagggggacatctgcagccagtgtttaggggctg

SEQ ID NO: 21362 - DNA, 201 bp, Homo sapiens
gtgcagcccctttgaggtccccttgtaacagggagggtcctgagtgcacacagccatctctgtccactttgcagctccccatgggcctcctccaggagctrtcttgggggtatcatgtcctctgcatcactggaggttcccaccacatggccctgcctccctgagtttctgtgcagatgttatggaggagtatataagcag

SEQ ID NO: 21363 - DNA, 201 bp, Homo sapiens
tggggtgggcattaggcaggaaaggaaggcctcaaggccagggctgcctcatctgcctcccagcctgcccatcctggagagctacctcctagccccacgasccaggagcccacccctgacaaccctctcctcagcatcaaagccggagtcccagagtgtgaggccacagtcctgaggcccatcttccagcaagcctagggg

SEQ ID NO: 21364 - DNA, 201 bp, Homo sapiens
tgtttctccagccatcaggaggacaccaagaaaaagacccacgaagcccagactgggaggcctgcctgtgcagcccctttgaggtccccttgtaacagggrgggtcctgagtgcacacagccatctctgtccactttgcagctccccatgggcctcctccaggagctgtcttgggggtatcatgtcctctgcatcactgga

SEQ ID NO: 21365 - DNA, 201 bp, Homo sapiens
tagcccccaggaacacagtccccaggaccatgttttttggggcacccacagcaggggcagtgcaggtctggttgctcctgctctcacctgcagcatctccygtagaggaattgtcagttctggttccctgtgggcagtaaaggtttccttgtaggtcactggggcattggccagaaaaaggttgtgaaaatcacatgctaa

SEQ ID NO: 21366 - DNA, 201 bp, Homo sapiens
ctgaaacatgctgaaatggagggtttactgctttccttgctttaaattttgctggctcacaatggcttatgtttattgcataagggggccacagggagggktgcttgctcacataaggagcccctggttttcttcagaaacaagttcaaattctccacttagagccaaaaaaaattaattgcaagatgttcaaactgaagt

SEQ ID NO: 21367 - DNA, 201 bp, Homo sapiens
agggcctccctcaatctttaccctctctctaatgcagaggattgcggcctgttggcagaagagtagtgtcttgggccccagctgacctgatgaatatcaayatccaatgccctgtaatgaagtcatgtgtgcacatatcatcacttctgcatgcagtctcatgggaaggtgggttcctggaccccaggttacaggcctaag

SEQ ID NO: 21368 - DNA, 201 bp, Homo sapiens
gaggacaccaagaaaaagacccacgaagcccagactgggaggcctgcctgtgcagcccctttgaggtccccttgtaacagggagggtcctgagtgcacacrgccatctctgtccactttgcagctccccatgggcctcctccaggagctgtcttgggggtatcatgtcctctgcatcactggaggttcccaccacatggcc

SEQ ID NO: 21369 - DNA, 201 bp, Homo sapiens
gggctggataattatctgttatgtgggtgattgggctgacttgtgcactgcaggatgttcagcatccctggtcattccccacaagatgctggtagcacctyctcctcactccagtcatggcaacaaaacatttttccagacatagctaatgtcctctggtgggaaaattgctcctggatgagaatacttgtttgagaggta

SEQ ID NO: 21370 - DNA, 201 bp, Homo sapiens
atagctaatgtcctctggtgggaaaattgctcctggatgagaatacttgtttgagaggtagagacactcaggagctgggcctgtagagggaaagtgatccrgaagtagatacaaagcagagtggggctggagaagacaggaagggagtctaggtctggaggggcctggcctgatggttgaaggtctggagctcagaacctc

SEQ ID NO: 21371 - DNA, 201 bp, Homo sapiens
tgattgctgagggcctggatgatcatggcttcagtgggagtaaatagtaaaggcggctgtgatctggggaggagctagaaactggagaggaatccgaggaraggcggtgcccctagtctcttcctctctgcatccctctctcctgtttctccagccatcaggaggacaccaagaaaaagacccacgaagcccagactggga

SEQ ID NO: 21372 - DNA, 201 bp, Homo sapiens
aagcagagtggggctggagaagacaggaagggagtctaggtctggaggggcctggcctgatggttgaaggtctggagctcagaacctcagggtatggggamctaaagctcgtgaggaatggggagagtggcagaacctcctattgccagaatatcacactcatacccactaaacacccagcccatggttctgcatctctgg

SEQ ID NO: 21373 - DNA, 201 bp, Homo sapiens; identical to SEQ ID NO: 3432

SEQ ID NO: 21374 - DNA, 201 bp, Homo sapiens
agtgagctgtgatcacaattgcactacagcctggacaacagagtgagaccctgtctcaacaaaaagtacaattgtttgaaagaatgtatacatgttttttrctttttagtgaaatatattgtttttaaacattccttggtagagagaatttttttgttggataaaagggaggtatttttgttaaggatatctgggcaccct

SEQ ID NO: 21375 - DNA, 201 bp, Homo sapiens
catatatatgtatgtgtatatatgtatgtatatatgtatgtagatatatgtctatatatataatgtatatatatgtgtgtctatatatatatatatatatwttttttttttcttttaaagtttttgagacaaagtcttgttctgttgtccaggctggagtgcagtggcacaatctcagcgtactgcaacctctgcctcctg

SEQ ID NO: 21376 - DNA, 201 bp, Homo sapiens
cacatatatatgtatgtgtatatatgtatgtatatatgtatgtagatatatgtctatatatataatgtatatatatgtgtgtctatatatatatatatatwtattttttttttcttttaaagtttttgagacaaagtcttgttctgttgtccaggctggagtgcagtggcacaatctcagcgtactgcaacctctgcctcc

SEQ ID NO: 21377 - DNA, 201 bp, Homo sapiens
gcacctgttgtttcctgactttttaatgattgccattctaactggtgtgagatgatatctcatagtggttttgatttgcatttctctgatggccagtgatkatgagcattttttcatgtgttttttggcttattaagctattctttgcctcagtttccttgtctctaaaatggacataataacaggacttaccacatgtga

SEQ ID NO: 21378 - DNA, 201 bp, Homo sapiens
tcaggtagaggtgagtacccagtataatccctcataactaagggagccgagtctggggatctggggctaactagcctgggaaaacgttggttatcggaagkttatcgtagtcacagttcttgttttcatttattcggtaagtatttgcgtgctcacaatggttatatacgctgctagtcaccgagggtacagtgaagacat

SEQ ID NO: 21379 - DNA, 201 bp, Homo sapiens
taattcagacagcttggcttctaatcctctgctgcttctaacctacatggccttgagcaaattattaagctattcttttttttttttaattttttttttttattatactttaagttttagggtacatgtgcacattgtgcaggttagttacatatgtatacatgtgccatgctggtgcgctgcacccactaacgtgtcatc

SEQ ID NO: 21380 - DNA, 201 bp, Homo sapiens
ttatcatgtagctgagggagcatcaggaccacatatgtggtggggagagctggaaacctaaagagtgtgtcgcgtctcctgccatacctctgtatgagagrggtagcacttcttgtttgccagagaatgtcaggatgctttgcacagtatcccagagctcttcatgaaaacagtttcctcttcatgttctttaagtgtaat

SEQ ID NO: 21381 - DNA, 201 bp, Homo sapiens
cttaggattgccttggctatttgggctctttttggttgcatatgaattttaaaatagtttttttctggttttgtgaagaatgttgtcagtagtttgctagraatagcattgaatctgtaaattgctttgggcagtatagccattttaattatattgattcttcttattaatgagcatggaatgttcttccatttgtttgtg

SEQ ID NO: 21382 - DNA, 201 bp, Homo sapiens
agtctgggatttgaggtctgacagcaggaaatgtttcccacatgctatcaggctaacaaatacatgggcataattgtttcttgggacatttttcatctatkgttggaggagaatattaaaatatttgtttttcttttttctttgcagaaactaacagtctagaactatctcaaggctcaggaacttttccttctgggtatt

SEQ ID NO: 21383 - DNA, 201 bp, Homo sapiens
aagccaccacgcccagtctgctttggatttgctttattgttttcactttccatgtgattagattgaggctaaatattttggcaggaaaattatagaagaarttttcctgcaaatatttttacaggaaattatgtttttgtaagaaaattattattgtacaataataattatataattattataactatagacaagtaaatt

SEQ ID NO: 21384 - DNA, 201 bp, Homo sapiens; identical to SEQ ID NO: 3440

SEQ ID NO: 21385 - DNA, 201 bp, Homo sapiens; identical to SEQ ID NO: 3437

SEQ ID NO: 21386 - DNA, 201 bp, Homo sapiens
gctctttgctttctccttgtgactttgggccttagataaggttaaggaagaggaaatgtgatgtttttcctctcaccccaccctaggccattgcaattggygatgttctctcatctctcctctttgaaggatttctttgaagaaaaatgtgcttcttgaatcaactgcagtctctcctctgcataagagctcttaagggta

SEQ ID NO: 21387 - DNA, 201 bp, Homo sapiens
ggtctgtctagtgtgcctcacgcaacatctatttaggtgtacaaatgggtctctcaaatgtcagtgctctacttacagcacagagtcaggtcttttcctgscacaatcctcctaaattattgtcagtagaagcctctagctgggagggacttcttgcattgctgcctctggtcctgtagttcttttgctttagagtctcct

SEQ ID NO: 21388 - DNA, 201 bp, Homo sapiens
atagagtgctgttatttgttactgagaaaggaaacgaagggataaatcactgaagtggggttagccttccccattgcctgggaattgggttgtcctgaccygacaatttaagttacaattcaaacatcattttggaaaggccatccttttaccaactgaaacgaataacagtccctggccactctatactagtggttctcc

SEQ ID NO: 21389 - DNA, 201 bp, Homo sapiens
  misc_feature (1)...(201): n = A,T,C or G, or insertion/deletion polymorphism (see Tables 1-2)
aaaacagtgaactaatactactctgtatgtgtaaagtattagtctaagttgttacttgcctcgcaggcatgtgggtgagaaactgttctcttctgggagantgctggataaatgcttatgtccacacatttcctttggttttgtcttcctttatatttggctttgataaaaacatatgtaatcaggctgggcatggtggct

SEQ ID NO: 21390 - DNA, 201 bp, Homo sapiens
ttcttcaaactacggcttttctgctgtctgcttgcagtgttgatggtggtggtgctggtcatcaatgttactcaggtagaggtgagtacccagtataatcyctcataactaagggagccgagtctggggatctggggctaactagcctgggaaaacgttggttatcggaagcttatcgtagtcacagttcttgttttcatt

SEQ ID NO: 21391 - DNA, 201 bp, Homo sapiens; identical to SEQ ID NO: 3434

SEQ ID NO: 21392 - DNA, 201 bp, Homo sapiens; identical to SEQ ID NO: 3438

SEQ ID NO: 21393 - DNA, 201 bp, Homo sapiens
gtctggggatctggggctaactagcctgggaaaacgttggttatcggaagcttatcgtagtcacagttcttgttttcatttattcggtaagtatttgcgtrctcacaatggttatatacgctgctagtcaccgagggtacagtgaagacatttcttcacttacaggcctttctttctagtgctcacataataagtgtgcat

SEQ ID NO: 21394 - DNA, 201 bp, Homo sapiens
gaagacatttcttcacttacaggcctttctttctagtgctcacataataagtgtgcatggaagaaaagtagtagtaatcataatcacataataatagtaaygataattggacattgtgaaaagtgcaaaaaggaaagggagctattctaggatacctttagagtgatgaaggaaaaacctcttcaaggaggggacctttca

SEQ ID NO: 21395 - DNA, 201 bp, Homo sapiens
tgagtaaaatttgtttggtactatggagaatgtgaagtaattctgttaaagattctgttaaagatttcctattagaaataggcttaaggcataaaagctargtatttcttcttctttttctttgcttaaactgttcttgtgtgttttactatataagatactaccaatcctacaccgatagttccttttacctggaagctg

SEQ ID NO: 21396 - DNA, 201 bp, Homo sapiens
  misc_feature (1)...(201): n = A,T,C or G, or insertion/deletion polymorphism (see Tables 1-2)
tatctgtgttttcctttagaaccacatagcatgtttacacagtagctgtgtaagtaaaatcccttattcacagaacagatagaagttatctaagggtcagntgtggtgactcatgcttgtaatcccagcactttgggaggctgaaacgggaggatcgcttgagcccaggagtttgagaccagcctgggcaacatagcaaga

SEQ ID NO: 21397 - DNA, 201 bp, Homo sapiens
cccaagtagctgggagtactaggcacgcaccaccatagctggctaatttttgtatttttagtagagatggagttttgccatgttggccaggctggtctcaractcctggcctcaaggatatctgcccgtcttggcctcccaaagtgctgggattacaggcgtaagccaccacgcccagtctgctttggatttgctttattg

SEQ ID NO: 21398 - DNA, 201 bp, Homo sapiens
ctattctactctctacttcaacttttttaagttccacatataagtcagtataaggcaaatattgcatgaggttccacatcaaagacatctgtgtgtggctbatttcacttagcataatgtcctctagtttcatccatgttgttacaaatgacggaatttccccaaagaagtatttggttgctgatatgtgctcataaaaca

SEQ ID NO: 21399 - DNA, 201 bp, Homo sapiens
aatggtttgaataccttactacatttgttccaggttggtactgtgccttttgtttcgtaactctttcccacatcagctttgaaataagcagactcactcargtgcctgaagaaaggttatcaggtgaggaaacatatatttctgtgtaggactaaagaggtacccaaaccctggagagatgtgtgacagtttctgatcaat

SEQ ID NO: 21400 - DNA, 201 bp, Homo sapiens
gtaacgtgtggcattttctacaggaggtgttagggcagaaggatgttgactttccctctgaaaggtcgttttgcttgtgttatcaagtgtaactaggttasaaccaggaggtacacattggtgatgtatttttagcattgttcattatatataaagactttctgaaccttttgtataatggagaataatccgttagattgt

SEQ ID NO: 21401 - DNA, 201 bp, Homo sapiens
aaaaataacatttggagcttttatctttggtttatattttttcacttatatcgctgtttataaagttttgaccttcagccaaggtctgagagtgatttacsatgttgaagttcatgtatttaaatagactatttaaattactgttttttattagtaaggaaaaggaaacgttcctatgcccactcctcccactatatcatg

SEQ ID NO: 21402 - DNA, 201 bp, Homo sapiens
gtgacaccctttggaggaaaatgcaaaccatgggctttaaagagaagccaagaaattttagagatgcagggacattactttcaaataataaaaaatatccyttctggttttgcccaaatcttcatatctgcttttacaaccacctctgtttaaacttcttccttcaccagcaattttcaagataaccataaagttgagtaa

SEQ ID NO: 21403 - DNA, 201 bp, Homo sapiens
taatttctaatgtttttctttacttcattttcagtatctttaacctttatatcatatgcatatttttgtttcagcaagaagaattgtatagaaatgtaaamaacatttatgtgtgcttcacatgtggcatgaaaaaaatgaggacctctggtcaaaattgcctgagttcagaatttcatgctggaaggaaagttagacgta

SEQ ID NO: 21404 - DNA, 201 bp, Homo sapiens
agacaattccataccataaaattaatggacaggtttgctgcacatctcaccccgcagccctccctgccccgccccacctcaattcacgttgtgtccttttygtccaactctttctggatgatttagggaaatttatctctctgcctttttctctttcgttttgttccatctttggcccagacagccctcattatggctaat

SEQ ID NO: 21405 - DNA, 201 bp, Homo sapiens
aatgaataaatatataccttcaagaaaaaaaaaaagaaatggttaacatctataaacatctgtttttgagaagtgatctagcacacagtggttaagatcaygggctttgggctcacttgcttgggccaggtgctggctttgctccttactagctcagctctgggaccttggtcaagttgtttagctgttctgaaaggtagg

SEQ ID NO: 21406 - DNA, 201 bp, Homo sapiens
gcagcgtatacttgcagcctgaaaactaagtaatgacaaaatagacattcttgtcagtgtgagccattctctgagtccaaggggagtacataattcaaacyagaattggtcattttggagtttgcactcttagcagtatacagtggagtgaaatttaagaatcaatttaatttcttttcagtttttatgtacataaaacct

SEQ ID NO: 21407 - DNA, 201 bp, Homo sapiens
gtagtgatggcttctctttcatttctgatattaataatttgtgtcctccctctttttttcttagcctgggtagagggcttatcaattttatcaatcttttraaaaaccagctttgggtttcattgatttttctttattgatttcctgttttcaagttcattgatttctgctatcatgtttattatttttcttctgcttatt

SEQ ID NO: 21408 - DNA, 201 bp, Homo sapiens
gaagaaattttcctgcaaatatttttacaggaaattatgtttttgtaagaaaattattattgtacaataataattatataattattataactatagacaartaaattgtatatttttttcttaccataaaagtctaaactcatgaaagtagtttatatgtgctctcttaaaaatcactttatttaagctatgaaatttgat

SEQ ID NO: 21409 - DNA, 201 bp, Homo sapiens
tttattatttttcttctgcttattttggatattgtttgctcttctttttctagtttgctaagatgtaaggttaaattactgattttaggttgtttttcttycctaaaatatgtatagtactatgaatttccctctaagcacttctcttgcttcattctatagtgtttaatgaattatattttcaccttcacctagttaaca

SEQ ID NO: 21410 - DNA, 201 bp, Homo sapiens
ctaggacagtacctggcttaagaagcttaagaattatttgttgaataaacagttttttctgaaattgatgaaataataaaaaatgactgcacattcccatrtcaagaatttgagaagttaacattttatgtttttgtttttggtctaagtacaagagacctagttttattgtgactcagtttctggaatagttgccccgga

SEQ ID NO: 21411 - DNA, 201 bp, Homo sapiens
attctgttaaagattctgttaaagatttcctattagaaataggcttaaggcataaaagctaagtatttcttcttctttttctttgcttaaactgttcttgygtgttttactatataagatactaccaatcctacaccgatagttccttttacctggaagctgttgatgatgtgtctagatattttagaaactcttttttta

SEQ ID NO: 21412 - DNA, 201 bp, Homo sapiens
aatgaaaaatattacataagctgggcacaatggctcatgcctggattcctagcacattgggaggcccaggtgggcggatcatctgaggtcaggagttttgrgaccagcttggccgacatggcgaaacccccgtctctactaaaaatacaaaaaagctgggcgtggtagcgggtgcctataatcctagctactcgggaggct

SEQ ID NO: 21413 - DNA, 201 bp, Homo sapiens
ttttgatagtagccttctttgtggatgtgaggtaatgtataacagtagttttaatttgcattgccataattattaatgatgttgagcatctttctatcatktgcttttggataaatatccaattccggtactcactgtttaacggagttgtttgtttgttttttgttgttgttgagttgtaggagttctttatgtgttctg

SEQ ID NO: 21414 - DNA, 201 bp, Homo sapiens
ccacctcggcctcccaaagtgctgggattacgagcatgagccaccatgcctggcctcagtagcattaagtcttatttacattgtcttggaatagatttccraaaccccttttatctttttaatatctgtagaattgtgtttatcttattactcctgatcactctgaccagagatttgtgttttattgatctttttgaagaa

SEQ ID NO: 21415 - DNA, 201 bp, Homo sapiens
ggcacgatctctgctcactgcaacctccgcctcccaggttcaagttattctcctgcctcagcctcccaagtaactgcgattacagatgtccaccaccacgyctggctaatttttgtatttttagtagagacatggtttcactatattggccgggctgatctcgaactcgtgatctgcctgcctcagcctcccaaagtgctg

SEQ ID NO: 21416 - DNA, 201 bp, Homo sapiens; identical to SEQ ID NO: 3436

SEQ ID NO: 21417 - DNA, 201 bp, Homo sapiens; identical to SEQ ID NO: 3439

SEQ ID NO: 21418 - DNA, 201 bp, Homo sapiens
caaagagctaaaagcagaactaccattcgacccagcaatcccattactgggtatatacccagaggaatataaatcattctgccataaagacacatgcaagsaaatgttcattgcagcgctgttcacgacagcaaagacgtggaatcaacctaaatgcccatcagtgacagactggataaagaaaatgtggtacatatgtac

SEQ ID NO: 21419 - DNA, 201 bp, Homo sapiens
aaaatgaaacctactttaacccttaagaatatatgacaatttatatatatatatatatatatatatatattttttttttttttttttttttttttttttttgagatggtgtctcactctgtcacccaggctggagtgcagtggtgtgatctctactcactaaaacctctgcctcgcaggttcatgtgattctcctgcctca

SEQ ID NO: 21420 - DNA, 201 bp, Homo sapiens
tgtttgtttgtttttgagacagagtcttgctctgttgcccaggctggagtgcagtggtgcgatcctggctcactgcaaacctctgcctcctgtgttcaagsgattctcgtgcctcagcctcccaagtacctgggattacagccacacctggctaatttttctgtttttagtagagacggggttttcactgtgttggccagg

SEQ ID NO: 21421 - DNA, 201 bp, Homo sapiens
atgcaaggagaaaaaaatgaaacctactttaacccttaagaatatatgacaatttatatatatatatatatatatatatatattttttttttttttttttktttttttttttttgagatggtgtctcactctgtcacccaggctggagtgcagtggtgtgatctctactcactaaaacctctgcctcgcaggttcatgtga

SEQ ID NO: 21422 - DNA, 201 bp, Homo sapiens
gtaccacctctaccactacctgcctctacgcttattgagaaactttgccaagtcactctgtgacttgctttcttcatctttaaaaggtatttcgacggccrggcgcagtggctcatgcctgtaatcccaggactttgggaggccgaggcgggtgggtcatgaggtcaggagatgagaccattctggctaacacggtgaaac

SEQ ID NO: 21423 - DNA, 201 bp, Homo sapiens
acaaggtgtccttcagtagtactgcgctctaaacactctccatgtccgacatcttcaggaggccctgtctcccactactggatctgtccttcttctcacasactcgactggcttgcccttattgtgatgtccctaggtgtcccagggatggtcagtgggaggaactttggaaagtttacctgtacctgacaagtcttgagg

SEQ ID NO: 21424 - DNA, 201 bp, Homo sapiens
tttttggtctaagtacaagagacctagttttattgtgactcagtttctggaatagttgccccggatttcgagtgcttttctccttacctccaccctcccccatgttttaatgcagccctccaaaaatatttactgagtgtggactctagaccagggcctgtgctaggatacaaagatgaatgaggcaccacccttatcttc

SEQ ID NO: 21425 - DNA, 201 bp, Homo sapiens
cgacggccgggcgcagtggctcatgcctgtaatcccaggactttgggaggccgaggcgggtgggtcatgaggtcaggagatgagaccattctggctaacamggtgaaaccccatctctactaaaaatgcaaaaaactagccgggcgtggtggcaggcgcctgtagtcccagctactcaggaggctgaggcaggagaatggc

SEQ ID NO: 21426 - DNA, 201 bp, Homo sapiens
tctgctgttgtgaatagtgctgcagtgaacatttgcatgcatgtgtctttatggtagaatgacttctattcctctaggtatacactctgtaataagattgctggtggaatcgtagttctgcttttaggtctttgaggaattgccataatgctttccacaatcgttgaactaatttacgctcacaccaacactgtataagtg

SEQ ID NO: 21427 - DNA, 201 bp, Homo sapiens
ggctttgataaaaacatatgtaatcaggctgggcatggtggctcacgcctgtaattctagcactttgggaggtcgaggcgggcggatcacttgagatcagragtttgagatcagcctggccaacatagtgaaaccccatctgtactaaaagtgcaaaaattggccaggcgtggtggctcacgcctgtaatcccagcacttt

SEQ ID NO: 21428 - DNA, 201 bp, Homo sapiens
tgtcagtagacaaggtgtccttcagtagtactgcgctctaaacactctccatgtccgacatcttcaggaggccctgtctcccactactggatctgtccttyttctcacagactcgactggcttgcccttattgtgatgtccctaggtgtcccagggatggtcagtgggaggaactttggaaagtttacctgtacctgacaa

SEQ ID NO: 21429 - DNA, 201 bp, Homo sapiens
ggaaaaccttttttttttttaattttacttttaagttctgggatacatgtgcagaatgtgcaggtttattacataggtatacatgtagtttgctgcacctstcaacccatcatctaggttttaagccttgtatttgtcctaatgctctccctccccttccccccaaccccccgacaggccacggtgtgtgatgttcctctc

SEQ ID NO: 21430 - DNA, 201 bp, Homo sapiens; identical to SEQ ID NO: 3435

SEQ ID NO: 21431 - DNA, 201 bp, Homo sapiens
taatgctctccctccccttccccccaaccccccgacaggccacggtgtgtgatgttcctctccctgtgtccatgtgttctcattgttcaactcctacttaygagtgagaacatgtggtgtttggttttctgttcctgtgttagtttgctgagaatgatgacttccagcttcatccatgtccctgcaaaggacatgaactca

SEQ ID NO: 21432 - DNA, 201 bp, Homo sapiens
taagtttaattagatcccagttgtcaatttctgcttttgttgcaattgcttttggtgtttttgtcatgaaatctttgcccattcctatgtctgggatggtrttgcctaggtggtcttctagggtttttacagttttggattttacatttaaatctttaatccatcttgagttgatttttgtatgtagtgtaaggaaggggt

SEQ ID NO: 21433 - DNA, 201 bp, Homo sapiens
gacaaggtttgatgtgatgctgaccagtgagggccttcctaggtgtctgtagttgcttgcttcttaaattctaatgatgtagcttggtatttcctttgatygcaaggatcacactgactgttttcatcacgtcccaccatatactttacagacatatcttcacctgataaaaataaagcctgtgtcagtgcttgatctaat

SEQ ID NO: 21434 - DNA, 201 bp, Homo sapiens
gaaatgcaaggagaaaaaaatgaaacctactttaacccttaagaatatatgacaatttatatatatatatatatatatatatatatttttttttttttttwttttttttttttttttgagatggtgtctcactctgtcacccaggctggagtgcagtggtgtgatctctactcactaaaacctctgcctcgcaggttcatg

SEQ ID NO: 21435 - DNA, 201 bp, Homo sapiens
tggaaatgcaaggagaaaaaaatgaaacctactttaacccttaagaatatatgacaatttatatatatatatatatatatatatatatttttttttttttwttttttttttttttttttgagatggtgtctcactctgtcacccaggctggagtgcagtggtgtgatctctactcactaaaacctctgcctcgcaggttca

SEQ ID NO: 21436 - DNA, 201 bp, Homo sapiens
tgctaagtagtagttaggtaggaaaatctagaagagaaacctggaaatgcaaggagaaaaaaatgaaacctactttaacccttaagaatatatgacaatttatatatatatatatatatatatatatattttttttttttttttttttttttttttttttgagatggtgtctcactctgtcacccaggctggagtgcagtg

SEQ ID NO: 21437 - DNA, 201 bp, Homo sapiens
agctactcgggaggctgaggcaggagaatcgcttgaacccaggaggcagaggttgcagtgagctgagatcatgccactgcactccagcctggcgacagagygagactctgtctcggaaaaaaaaaaagcaaaacttagccaggcatggtaatgcgtgcctgtaatcccagttacttgggaggctgaggcaggagaatcact

SEQ ID NO: 21438 - DNA, 201 bp, Homo sapiens
gtttcttgggacatttttcatctattgttggaggagaatattaaaatatttgtttttcttttttctttgcagaaactaacagtctagaactatctcaaggstcaggaacttttccttctgggtattattataaagaccagtggaggcccagaaagtttaagatgcgtcagtttaatgaccctgacaacattacagagtgct

SEQ ID NO: 21439 - DNA, 201 bp, Homo sapiens
atataaccactctagctttcctttgtttgctgttagcaagtatatctttttccataattttattattttttattttttttgagacagggtcatgctctgtwgcccaggctggagtgcagtggcatgaccatggctcaccacaacctctgtctcgcgggctcaagtgatcctctcctctcagccttctgagtagctgggaca

SEQ ID NO: 21440 - DNA, 201 bp, Homo sapiens
tagaattgtgtcctcttgatgaatttagttgctttatcatcatgagttggccttcttcatgcttggtaaaattctttgctccgaaatgtactctgtatgawattatataaccactctagctttcctttgtttgctgttagcaagtatatctttttccataattttattattttttattttttttgagacagggtcatgctc

SEQ ID NO: 21441 - DNA, 201 bp, Homo sapiens
ttgaattcttttaaaacattattgagatttgtttatggcacaaaatatggtctattttggtatatattctatgtgtactggaaaggaatgcattctgcttytattgcatggagtattctataaatgtcagttagatcaacatggttcatggtgttggttgtcttctgtatatctttactattttctgtctacatgctctat

SEQ ID NO: 21442 - DNA, 201 bp, Homo sapiens
catccttttgtttgttttgagcacttccttagtttctggcaccacaagatatttgaggcttgtcttgtattttctttgccttagccttagaaggggtttayagtatttctacttttatttcacttatgaatcctatattttgaagttttttccctgtgaaattgtatttatgtattagctaattaatattcttacaaggta

SEQ ID NO: 21443 - DNA, 201 bp, Homo sapiens
acaaggtttgatgtgatgctgaccagtgagggccttcctaggtgtctgtagttgcttgcttcttaaattctaatgatgtagcttggtatttcctttgataycaaggatcacactgactgttttcatcacgtcccaccatatactttacagacatatcttcacctgataaaaataaagcctgtgtcagtgcttgatctaatc

SEQ ID NO: 21444 - DNA, 201 bp, Homo sapiens
tggaattctaattgtgacttttaatgtctctcattctttcaacatttattagttggaattcttttgcaaagaagagttgtcccttcttcattttaagtatytatatcagtgtagactcatgaaaatttcattccttggaatgaaggaaaaaaaattataatccaatccaattcaatcattattttatttgcttttattttt

SEQ ID NO: 21445 - DNA, 201 bp, Homo sapiens
aggaaagcatatgtcagtgggggtttgtgtacatattatttcatcacccaattattaagcccagtaccctctctgctcctctccctcctcccactgtcctygctcaagtaaaccccagtgtctgttgtttccttctttgtgttcataagttcttatcatttagttcccacttacaagtgagtacatgccgtatttggtttt

SEQ ID NO: 21446 - DNA, 201 bp, Homo sapiens; identical to SEQ ID NO: 3441
  misc_feature (1)...(201): n = A,T,C or G, or insertion/deletion polymorphism (see Tables 1-2)

SEQ ID NO: 21447 - DNA, 201 bp, Homo sapiens
caggagtgttggcatgtgcctgtaatcccagctattcagggggctgaggcaggagaatcacttgaacccaggagttggaggttgcagtgagccgagatcaygccactgcactccagcctgggcaacaagagtgaaactcagtctcaaataataacaaaagaagaaggctgccatggaaagggcagagctaagcaaactaga

SEQ ID NO: 21448 - DNA, 201 bp, Homo sapiens; identical to SEQ ID NO: 3444

SEQ ID NO: 21449 - DNA, 201 bp, Homo sapiens
cttccaactcccacttgcaaccctttctcacctaagaacttgaaaaattatgtgtctatgagccagttgggcagacaggtgagatgccctcaattttgtaytttaaatctctccccgtgtgaatcttagtccctggtgcacctcactgagcctgattccttacctcctgatgatgcttcccgaaatccccttgctcccagg

SEQ ID NO: 21450 - DNA, 201 bp, Homo sapiens; identical to SEQ ID NO: 3446

SEQ ID NO: 21451 - DNA, 201 bp, Homo sapiens
tgagagctcacagacctggatatcctggtacctaggaagtcagaagagggctggcaaaggaagcagtgagacagacatagcattggagcaagtttatctcyaaagactggcagagtgccctggtagaaactgagagcagtggaaagaaagatcagaaaccccaggaagctccctcccctagagtgacacaagacctttcct

SEQ ID NO: 21452 - DNA, 201 bp, Homo sapiens; identical to SEQ ID NO: 3449

SEQ ID NO: 21453 - DNA, 201 bp, Homo sapiens
aggcccctgataccaggccagagaaagacccgccactaagagctcatttccccctggccggagacccaggggtctgtggactgcagcgctagggtccatgsccaggtacccatattcctcagtggcctctgcccactgaccacccccgctctctccctcactgctgaatgtccaggaccttactcgacaaacacccatagt

SEQ ID NO: 21454 - DNA, 201 bp, Homo sapiens; identical to SEQ ID NO: 3443

SEQ ID NO: 21455 - DNA, 201 bp, Homo sapiens; identical to SEQ ID NO: 3445

SEQ ID NO: 21456 - DNA, 201 bp, Homo sapiens; identical to SEQ ID NO: 3448

SEQ ID NO: 21457 - DNA, 201 bp, Homo sapiens; identical to SEQ ID NO: 3447

SEQ ID NO: 21458 - DNA, 201 bp, Homo sapiens; identical to SEQ ID NO: 3450

SEQ ID NO: 21459 - DNA, 201 bp, Homo sapiens
actcccacccccagtgtctcctagcaatgggctccacttgcaagaatctctactatatacaaagcattcattcatgtattcattcattcattcattcatthactcagcagaagatgaatgagtgcttgtcagagttaggcttggagttggtggtagacaaacaaaggaaaggcaggctttggaactagaaagtgccctatg

SEQ ID NO: 21460 - DNA, 201 bp, Homo sapiens; identical to SEQ ID NO: 3451

SEQ ID NO: 21461 - DNA, 201 bp, Homo sapiens
ttggaatgtgggtggagaggggtcatagttctccctgagtgagactcacctgctcctctggcccctggtcctgtcctgttctccagcatggtgtgtctgargctccctggaggctcctgcatggcagctctgacagtgacactgatggtgctgagctccccactggctttggctggggacacccaacgtaagtgcacattg

SEQ ID NO: 21462 - DNA, 201 bp, Homo sapiens; identical to SEQ ID NO: 3453

SEQ ID NO: 21463 - DNA, 201 bp, Homo sapiens; identical to SEQ ID NO: 3454

SEQ ID NO: 21464 - DNA, 201 bp, Homo sapiens
ggagaggggtcatagttctccctgagtgagactcacctgctcctctggcccctggtcctgtcctgttctccagcatggtgtgtctgaagctccctggaggytcctgcatggcagctctgacagtgacactgatggtgctgagctccccactggctttggctggggacacccaacgtaagtgcacattgtgggtgctgagct

SEQ ID NO: 21465 - DNA, 201 bp, Homo sapiens; identical to SEQ ID NO: 3456

SEQ ID NO: 21466 - DNA, 201 bp, Homo sapiens
ggaatgtgggtggagaggggtcatagttctccctgagtgagactcacctgctcctctggcccctggtcctgtcctgttctccagcatggtgtgtctgaagytccctggaggctcctgcatggcagctctgacagtgacactgatggtgctgagctccccactggctttggctggggacacccaacgtaagtgcacattgtg

SEQ ID NO: 21467 - DNA, 201 bp, Homo sapiens; identical to SEQ ID NO: 3458

SEQ ID NO: 21468 - DNA, 201 bp, Homo sapiens; identical to SEQ ID NO: 3459

SEQ ID NO: 21469 - DNA, 201 bp, Homo sapiens
  misc_feature (1)...(201): n = A,T,C or G, or insertion/deletion polymorphism (see Tables 1-2)
ataattcaatcactctaggtttggcaccattttcagtccctgtcaaaatttccttcagtttgttcccacacctttttaccttggttccaaagctctttgtntctgtactggtccaccttcctcagccaagtccctggagtccagacatatacttcctgcccctcagtgcactcaacatacaggcatatctcattttattac

SEQ ID NO: 21470 - DNA, 201 bp, Homo sapiens
  misc_feature (1)...(201): n = A,T,C or G, or insertion/deletion polymorphism (see Tables 1-2)
tccctctcttctgctcactgtcactgtctctagtcttcctgccccttctttagttccctttccaccaccactctccttgcccctttgatgataaccttaanttggctctgtgtaccccaacttttgcttgtcttatgtcctatttccctacacttatacccattctacacctacacctaccgtcataaccacttctgaatc

SEQ ID NO: 21471 - DNA, 201 bp, Homo sapiens
tctcaccttatgcacctcttcctctgtatcctttgtgatatcctttataattcaaaaacctagaggaaatggataaattcttgaacacatacaacctaccacactgaaccaaaaagaaacagaagaacctgaacagacgaataacaagtaaggagattgaatcagtaataaaaagtctcccctgaaacaaaagtccagaac

SEQ ID NO: 21472 - DNA, 201 bp, Homo sapiens
ttcttgaacacatacaacctaccacactgaaccaaaaagaaacagaagaacctgaacagacgaataacaagtaaggagattgaatcagtaataaaaagtctcccctgaaacaaaagtccagaaccatatggctttaccaccaaattctatgaccctttaaatataaattaataccaattcttctcaaactattccaaaaaa

SEQ ID NO: 21473 - DNA, 201 bp, Homo sapiens
  misc_feature (1)...(201): n = A,T,C or G, or insertion/deletion polymorphism (see Tables 1-2)
gaaggttttagtgatctagacagaagatcaaaccagccacaacattcccttaagccaaaacctcatccagagaaagaccccaactcttcaattttatgaangctgagagaggtgaggaagctgcagcagaaaagtttgaagctagcagaggttggttcatgagggttaaggaaagaagccctctctaaaacacaaaagggc

SEQ ID NO: 21474 - DNA, 201 bp, Homo sapiens
tattgatatttttttctgtaatatggatggggaaaaccaggctctggggattatgtggctggcccaggctccacggctaggagttggtggggttgggattytaattcaagcctatctgactctggggcccatgttctttcctcttaaaatacccatcagcaaatagtgtggtgatgaaaattacctttgtatagcctagag

SEQ ID NO: 21475 - DNA, 201 bp, Homo sapiens
tgaaaaacaaataacgctacttaataatccatggctctcatacttaaaaatacttacaaagtatttaaactggatgatcataactatacttacatgcctgycttcctccctcttttgtgctatttttctttccttttcttttttgttgagacagagtctcgctctgtgacccaggctatagtgcaatggcatgatctcgac

SEQ ID NO: 21476 - DNA, 201 bp, Homo sapiens
ccagattaattttgggatctttgtaacaatccccaaatccttgaagcttccatctgtttgctattttcctggcctaattttgtttttcttggtgaataacygtatgaccattataatgaaatgtgtcagcttgggctcctctgaatttctctctgggtgttttacccagatcttcatagctagattatcagctggtcccat

SEQ ID NO: 21477 - DNA, 201 bp, Homo sapiens
ctacaccacagatctggtttttctgcacaaacagaaaagaataagaggagttgcttgatgtgccatctgaaataaagatgcaacaacatccagattaattytgggatctttgtaacaatccccaaatccttgaagcttccatctgtttgctattttcctggcctaattttgtttttcttggtgaataactgtatgaccatt

SEQ ID NO: 21478 - DNA, 201 bp, Homo sapiens
ctatggagaatggtattgcaatttctcaaaagcctacacatagaactccactaccatatgacccagcaatcccactactaggtatttatccaaaggaaagkaaatcagcatatcaacatatgtacccccatgtttattgcagcactattcacaatagccgagatacagactcaacctaggtgtctaacaaccgaggaatgg

SEQ ID NO: 21479 - DNA, 201 bp, Homo sapiens
  misc_feature (1)...(201): n = A,T,C or G, or insertion/deletion polymorphism (see Tables 1-2)
tttccccactggattctcagccctggtgcgcctttcactatgggatgtgccatttctctctaagtattgagaaggaacagcaaaatatgcaggtttcttcntcattcccattactattcccagggccagctaaggggctggagggccatggtttagggacagtccagagtctacacaacattgtggtcagagctggatatg

SEQ ID NO: 21480 - DNA, 201 bp, Homo sapiens
ccatgcgtcgatagccaactgctttttgacaaagatgccaagaacattcactggggaaaggatagtctcttcagtaaatggtgctaggaaaactggatatycatatgcagaataatgaaattagaccttcgcctctcaccctatacaaaaatcagctaaaaatggattaaagatctaaaggtaaaacctgaaactgtaaaa

SEQ ID NO: 21481 - DNA, 201 bp, Homo sapiens
caggccaatattcctgatgaaaataggtgcaaaaatcctcaacaaaatactaacaaacccaattcaacaacacatcaaaaagataatgtggcatgatcaartgggatttatcatacgaatgcaagaatggctcaatgtacacaaatcaataaatgtgatacttcacatcaacagaatcagggacaaaaccatacggtaatc

SEQ ID NO: 21482 - DNA, 201 bp, Homo sapiens
agtagtaaatttagtaaagagatgggtaatttgaacattatgattaataagcttgacttaattaaaatatacagaagtctgcatagaaaaactagaggaayacatttttctcaagcacaaataaaacatgtacaaaaagtgactatacattaggctataaaaaaagtctgaacaaaattttaaagaattacatcacaaagg

SEQ ID NO: 21483 - DNA, 201 bp, Homo sapiens
ttcaaattattgatagagtagtaaatttagtaaagagatgggtaatttgaacattatgattaataagcttgacttaattaaaatatacagaagtctgcatrgaaaaactagaggaatacatttttctcaagcacaaataaaacatgtacaaaaagtgactatacattaggctataaaaaaagtctgaacaaaattttaaag

SEQ ID NO: 21484 - DNA, 201 bp, Homo sapiens
  misc_feature (1)...(201): n = A,T,C or G, or insertion/deletion polymorphism (see Tables 1-2)
cggtgagattcacataagtgtttgcatagatatagtttaggctgctgctggcagactttgatttctggggatagctgtgtttctgacaaggagaatagaanggtaaataaacgcagtttcctagagaacatttttctcaagctgaagcctcctccaagacccttgaacccaggtctcagtcatgatactcctggattcctt

SEQ ID NO: 21485 - DNA, 201 bp, Homo sapiens
  misc_feature (1)...(201): n = A,T,C or G, or insertion/deletion polymorphism (see Tables 1-2)
tgctcatgcaaacattcccacagtaggtagaacagcatatgttatttgcttgacaatctcggtgagattcacataagtgtttgcatagatatagtttaggntgctgctggcagactttgatttctggggatagctgtgtttctgacaaggagaatagaacggtaaataaacgcagtttcctagagaacatttttctcaagc

SEQ ID NO: 21486 - DNA, 201 bp, Homo sapiens
  misc_feature (1)...(201): n = A,T,C or G, or insertion/deletion polymorphism (see Tables 1-2)
ccttccctgacatttggtgaacaaatccctctgcacctcaaccaacaagctcatggcaagaacttggtgctggatttggtcacgtcgcttccttcatttgntaggtggtcatctactttttctaaaattcttcctattcagtctctttttagctacataaaagtcagagggcatttggtgggagatcttgttatgatttta

SEQ ID NO: 21487 - DNA, 201 bp, Homo sapiens
caaatacacacagagagcaccatgaagccctggattcttctactcgtcatgttcatctctggagttgtgatgcttctgcctgtgctgggaagcttctggamcaaagatccctgtgggtggtgtgaaaagggacggggtgctctgcccagtcctgggatgtctattgtagctgatccagggcctgcatgtcaagaatcaggc

SEQ ID NO: 21488 - DNA, 201 bp, Homo sapiens
aacacacataaacacacagaaagagagactattgtagggcatgggacagaagggctagtggagaaacatagtaaatatcttagagctcagacagggggagrgacctatcagtcaaaggcttggcaggctgtccaggaggaggtggtcactgaccttgaatatcatgaaggaaatgaactctcagaagtgaagatgtttctt

SEQ ID NO: 21489 - DNA, 201 bp, Homo sapiens
caggctttaaaggatctctccttaagtagagatattcaagcaagattaggttagatattcccaattcctttaagttttctctttcagctctgaaagcaacrctaggtatgtgaaaagggaacgtatcttttgtctatattccatcagctagcaggaaataatattttccaatatcagaccagtagaggaaaaaccaacaca

SEQ ID NO: 21490 - DNA, 201 bp, Homo sapiens
gaacacatacaacctaccacactgaaccaaaaagaaacagaagaacctgaacagacgaataacaagtaaggagattgaatcagtaataaaaagtctcccctgaaacaaaagtccagaaccatatggctttaccaccaaattctatgaccctttaaatataaattaataccaattcttctcaaactattccaaaaaattgat

SEQ ID NO: 21491 - DNA, 201 bp, Homo sapiens
cacacataaacacacagaaagagagactattgtagggcatgggacagaagggctagtggagaaacatagtaaatatcttagagctcagacagggggagagrcctatcagtcaaaggcttggcaggctgtccaggaggaggtggtcactgaccttgaatatcatgaaggaaatgaactctcagaagtgaagatgtttcttct

SEQ ID NO: 21492 - DNA, 201 bp, Homo sapiens
gttccctttgcttccctcaacatatcacccaacagttcatacatccctcctttatccaaagttccaattactaaccccttagttgggcgtctccatgggcsctctactctcagccaggcccaaggagacctggtatctatctgtctgttcagttggcaaacttcttgggggaaattgcttaaaagtgggtaacttctgatt

SEQ ID NO: 21493 - DNA, 201 bp, Homo sapiens
aagtctcccctgaaacaaaagtccagaaccatatggctttaccaccaaattctatgaccctttaaatataaattaataccaattcttctcaaactattccaaaaaattgatgcggcaggaattcttcttagctcacttttatgaggcccacataaccttaataccaaaaccagacaataacaagacagcataaagaaaccc

SEQ ID NO: 21494 - DNA, 201 bp, Homo sapiens
atggactgagatgtatttgagagactttgggaacatgtactttgggtctgctgggggtggcctgagctgcaatccaggtacacaatgttcttcccagcttwtcagaggatcccacctgcaccttagaaaattgagtacatctggatgggtgaatatcaaaggaaagaatctgtgatacagccaacatgtagtttctgggta

SEQ ID NO: 21495 - DNA, 201 bp, Homo sapiens
gctttaccaccaaattctatgaccctttaaatataaattaataccaattcttctcaaactattccaaaaaattgatgcggcaggaattcttcttagctcamttttatgaggcccacataaccttaataccaaaaccagacaataacaagacagcataaagaaacccacaggccaatattcctgatgaaaataggtgcaaaa

SEQ ID NO: 21496 - DNA, 201 bp, Homo sapiens
ctgccacctgggtccaagtgattctcctgcctcagccttctgagtagctgggcctactggtgcctgccaccatgccaggctaatttttgtatttttagtasagatggggtttcaccatattggccaggctggtctcgaaattctgaccttgtgatctgcctgctttggcctcccaaagtgctgggattacaggcgtgagcc

SEQ ID NO: 21497 - DNA, 201 bp, Homo sapiens
ttctatgaccctttaaatataaattaataccaattcttctcaaactattccaaaaaattgatgcggcaggaattcttcttagctcacttttatgaggcccrcataaccttaataccaaaaccagacaataacaagacagcataaagaaacccacaggccaatattcctgatgaaaataggtgcaaaaatcctcaacaaaat

SEQ ID NO: 21498 - DNA, 201 bp, Homo sapiens
ggagataaaagacttctacattgaaaactacaaaacactgataaaagaaattgaagaggatacaaacaaatggaaaaacttcccatgctcatggatggaaygagttaatattgttaaaattaccatactaccctaaaccatctacagagtcaatgtccctattaaaataccagtgacattcttcacagtaatataaaataa

SEQ ID NO: 21499 - DNA, 201 bp, Homo sapiens
  misc_feature (1)...(201): n = A,T,C or G, or insertion/deletion polymorphism (see Tables 1-2)
agcaacagtgagaattagaagtgcagcctgaagatctgactgaattgctgcaatctcatgagaaaacttgagtggatgaggagttgcttcttatagatgancaaagaaagtggtttctttgaatggaatctgctcctggtgaagatgctgtgaacattgttggaatgatgacaaaggattcagaatattgcataaacttag

SEQ ID NO: 21500 - DNA, 201 bp, Homo sapiens
aagaatctacagtctgatcctgagagctcaaagaagcatgagacatctttcaaactctctcctagtctctgaatagtagaattcagagatgaggatcaacwtgcctcttgtctctccctctcttctgctcactgtcactgtctctagtcttcctgccccttctttagttccctttccaccaccactctccttgcccctttg

SEQ ID NO: 21501 - DNA, 201 bp, Homo sapiens
tcagaggtaggtggggataaaggtcttgagacatgagcttctatttgtggcttgcttggattaattcctagcccagatggtgtcactattcctgtgaggtkgggattattgtttcttttgttcaaataagaaaattgagagggggtgacatgagctgtctgaggttccataggtaaaagggacagaaactaaagatttcag

SEQ ID NO: 21502 - DNA, 201 bp, Homo sapiens
gctgggtacagcctccatataagtactgtgagaaaaggtgtactaaaataatgacttgtgtacgtccaaatcatacatgctgctggacctactgtggaaayatctgcttagacaacgagtgagttggttggggtgggaaggctagggcctgggcatgcttcatcactggtccttaccgactattcaaaagaccgcagccac

SEQ ID NO: 21503 - DNA, 201 bp, Homo sapiens
tatacttcctgcccctcagtgcactcaacatacaggcatatctcattttattacactttgctttattaattaatttttgctttatggatgttgcatgtttyacaaattgaaggtttgcagcaaccctgcattgagcaaatcttttggcactatttttccaacagcatgttctcacttatgtctttgtgtcacattttagta

SEQ ID NO: 21504 - DNA, 201 bp, Homo sapiens
catgtttcatatgcttcaaaataaaatatcaggacacttgatgtgtccaatttcataaaaataatgactacaacataaaagtatagacatatattgattawctctagatggtggaattgctaatgcttgtttatttcctctttgtatttttaattttacatattatataatctgaggatttattgtttttaatcagacagg

SEQ ID NO: 21505 - DNA, 201 bp, Homo sapiens
tctagcagtattgggaaaagacttgccttctgccagaacttaacccaaatacacacagagagcaccatgaagccctggattcttctactcgtcatgttcayctctggagttgtgatgcttctgcctgtgctgggaagcttctggaacaaagatccctgtgggtggtgtgaaaagggacggggtgctctgcccagtcctggg

SEQ ID NO: 21506 - DNA, 201 bp, Homo sapiens
  misc_feature (1)...(201): n = A,T,C or G, or insertion/deletion polymorphism (see Tables 1-2)
tcatggaatccaatgctttggatttatggtgttcctgtcactgtatatcagtattcctccttctttatgcaaagggttggtaccaggaatccagaggcctnctgcaatctatgcccactttcacccacttacctcatccctcacatccctggctgtaagcagataacagagtatcttcatggttcacctgtcttgccatgt

SEQ ID NO: 21507 - DNA, 201 bp, Homo sapiens
  misc_feature (1)...(201): n = A,T,C or G, or insertion/deletion polymorphism (see Tables 1-2)
atacaaagaaacagcctcatggaatccaatgctttggatttatggtgttcctgtcactgtatatcagtattcctccttctttatgcaaagggttggtaccnggaatccagaggcctactgcaatctatgcccactttcacccacttacctcatccctcacatccctggctgtaagcagataacagagtatcttcatggttc

SEQ ID NO: 21508 - DNA, 201 bp, Homo sapiens
cctgggcataatgatgtttcttttgtctgggatcatttagtacacttgagggtgtgcaaaacaggagactaggcatcctcagattcctgaacacctttaargggcaaggggaaagaaagaaagaaagaaaactagagtaagaatgaggccgtgtgaatgaacagatttcaaagctctggaaaacttgggtctagggtggta

SEQ ID NO: 21509 - DNA, 201 bp, Homo sapiens
  misc_feature (1)...(201): n = A,T,C or G, or insertion/deletion polymorphism (see Tables 1-2)
aatctgtgatacagccaacatgtagtttctgggtagaaattaaaaatcggtcacaaccaaaatcaccattaagttcctggcctttgaacattgtttttctnctcttctgcccccagttcgagccccacttcaaacaacttcataataaaaggccagacaaaagagctgtcagccagttactacagacactcaatgcagaca

SEQ ID NO: 21510 - DNA, 201 bp, Homo sapiens
  misc_feature (1)...(201): n = A,T,C or G, or insertion/deletion polymorphism (see Tables 1-2)
aagaccctccaccagcaaaaagatgatgacttgttgaaggctcagataatcattagcaatttttagtagtaaagtattttaaaattatggtatgcacattnttttttatacataatgctattgaacacttgacagactacagcatagtgtaaacatacctttttaatattttaataagtaataatgaaattcatcataaga

SEQ ID NO: 21511 - DNA, 201 bp, Homo sapiens
  misc_feature (1)...(201): n = A,T,C or G, or insertion/deletion polymorphism (see Tables 1-2)
tttaccttcatcaggaaaggatagctttgctagatatagaattattggatacagtatttcagatactgcactgggaaattcttaactaaaatagaagagtntacagattgtcctaaattctgcatagcttgatccagaatcatgagtggcaggagtccttggcactcctgggctactcattagtgactgtgctcctcagct

SEQ ID NO: 21512 - DNA, 201 bp, Homo sapiens
  misc_feature (1)...(201): n = A,T,C or G, or insertion/deletion polymorphism (see Tables 1-2)
tatttcttgaaaggcagacctggtagcaacaaattctctcagtctttgtttttctgggaatgtctttattttaccttcatcaggaaaggatagctttgctngatatagaattattggatacagtatttcagatactgcactgggaaattcttaactaaaatagaagagtatacagattgtcctaaattctgcatagcttga

SEQ ID NO: 21513 - DNA, 201 bp, Homo sapiens
  misc_feature (1)...(201): n = A,T,C or G, or insertion/deletion polymorphism (see Tables 1-2)
acctgcaccttagaaaattgagtacatctggatgggtgaatatcaaaggaaagaatctgtgatacagccaacatgtagtttctgggtagaaattaaaaatnggtcacaaccaaaatcaccattaagttcctggcctttgaacattgtttttctgctcttctgcccccagttcgagccccacttcaaacaacttcataataa

SEQ ID NO: 21514 - DNA, 201 bp, Homo sapiens
ccaccaccacggctggctaatttttcgtatttttggtagagacgaggtttcaccatgttggtcaggctgttctcaaactcctgacctctggtaatccaccygcttcagcctcccaaagtgctgggattacaggcatgagccaccacgcccagctgtgctatttttcatgcatgttacatctttatgttttaagcctatcaa

SEQ ID NO: 21515 - DNA, 201 bp, Homo sapiens
cccctgttgcttaccctgttctcctcaatccattttctacgtctagcagtattgggaaaagacttgccttctgccagaacttaacccaaatacacacagasagcaccatgaagccctggattcttctactcgtcatgttcatctctggagttgtgatgcttctgcctgtgctgggaagcttctggaacaaagatccctgtg

SEQ ID NO: 21516 - DNA, 201 bp, Homo sapiens
caagtctctttcacactctttttcttttccaccagctcagtatagatgacaacaaggttctagagcctagtgaagccaaaaggtgaaaggagcctgggtcsttgacttcttttatcacatgaaaaaaggatacccattgttttagaatactcattttgaattattatttgagcaagaaataaaaagtatattgtatttcag

SEQ ID NO: 21517 - DNA, 201 bp, Homo sapiens
cagagcaagagagtccttcctctttttgcttgcccctggccttgtcgttcgtcatgtgggatagggcttccgcaggaatgacgcctcctcctttcacatarccagtcttgtgttcttgccgatagaatgaaagatatcatttatttctgctttctaattacaaaatgttttatggaaaaaagaaaagaaaaaatatattgt

SEQ ID NO: 21518 - DNA, 201 bp, Homo sapiens
  misc_feature (1)...(201): n = A,T,C or G, or insertion/deletion polymorphism (see Tables 1-2)
gcattcctgttgatgttcttatgctggtgacttgaggtccttgtgcttcggatgtgggcacagtcttggatagaggagttgggaagcaggatgcacatccnagcccactctcccactcacaggatgctcatgcaaacattcccacagtaggtagaacagcatatgttatttgcttgacaatctcggtgagattcacataag

SEQ ID NO: 21519 - DNA, 201 bp, Homo sapiens
ccaaagcccaggctctttctcccacaggggagccacagccctgccctgaagtggcctccctgagagctaggcagcatctgctccagctatgggggctctcrggcgcagagcggggcttcagggctcactccagtgcagtgtctccgttgctgtcatcctttctctgcctcagagacaggaggcagtgggcaggagtggtgg

SEQ ID NO: 21520 - DNA, 201 bp, Homo sapiens
agtgattttccccatgaactgcatctcggctcattaaggaagccggtggctccctgtgtcgccagtatgcctgctgtattttgctgatgggcccagagctsgatggaccatggaggctgctttctcaccctcccattctcatcattagcattccaaagtagaaaacaagcctgatgcttgctgcctaaatatttatggaat

SEQ ID NO: 21521 - DNA, 201 bp, Homo sapiens
tagtgattttccccatgaactgcatctcggctcattaaggaagccggtggctccctgtgtcgccagtatgcctgctgtattttgctgatgggcccagagcwggatggaccatggaggctgctttctcaccctcccattctcatcattagcattccaaagtagaaaacaagcctgatgcttgctgcctaaatatttatggaa

SEQ ID NO: 21522 - DNA, 201 bp, Homo sapiens
cgagtatggtgagttgtccggcaggcgagctggggctgcttggggacagggatggccagatgctgggagacctgagagtgggtggggccctggaccggtcrggggtggtctgtgctgagtgggcctccaggtgatagggtcaaacctcgagcttcatgagtcaggaagagctgcaacaacagctccatagataggtataaa

SEQ ID NO: 21523 - DNA, 201 bp, Homo sapiens
aagggcttgaatggcagcttgcaagagaggcccatgggcagccgcctccaaggattgactcttaaagtggtgactgtcttggtaggatcatggggacattytgggagcgagctacaccatccaggctgttgaatcagaggctgctttctgtttaatgctgggtttggggagaagagaatcttgaggagtattgtgagcttt

SEQ ID NO: 21524 - DNA, 201 bp, Homo sapiens
cctaggctttatggtacagcctatcgctcctatgctacaaacctgcatagcatgggactgtgccgaatgcaatagtaacacggtggtatttgtatatctartggtatatgtatatctaaacacacctaaacagaaaaggtacagtaaaaattcagcaatataatcttctgggaccactgtcttagatgcagtccatggtta

SEQ ID NO: 21525 - DNA, 201 bp, Homo sapiens
ggtgcaggcattggctaaatacacccattccaagagggagaaatcagccaaaacaaaggggctacaggccccatgcaagcccaaaacccagtcactaaatsttaaagcttcaaaataatctcctttgactctatgtctcatatccaggcaacactaatacaaagggtgggctcgcagggccttgggcggctctgtccctat

SEQ ID NO: 21526 - DNA, 201 bp, Homo sapiens
tgggcagcacattccataggggagcagttggtctcttctcttctggagctaaaatctgcttttcaagggtcccagctctgccctgcccacccccgcccccrccgcacccacccaagaggtgggcccctggacatatcttgccctcttgcgtacaatagccacagctctttttcagcacctgcttcactgacctgctgcctt

SEQ ID NO: 21527 - DNA, 201 bp, Homo sapiens
tgtaaatgccagcgattgcccccagcctgcaaccagccttcccctccagcctttcccagccagtgccttccctgaactcctaagaggcaggttcagctttyttccaggaaaacagccctctcagcctcccccagagctgtggtttagtgcttcacagggtaaattctgatacagctttctcagatggctttcctagagctg

SEQ ID NO: 21528 - DNA, 201 bp, Homo sapiens
gagactttgggaaaatcacttcatccttctgagtcttggtttttccatttgtaggctgcagctcagtagcctctttcagtaggccattgtgaggactcagrgagggatcgtgtgtagagggcttagctcagggtctgggctggatgaggtgttctgtaaatgccagcgattgcccccagcctgcaaccagccttcccctcc

SEQ ID NO: 21529 - DNA, 201 bp, Homo sapiens
aaaggcctggttacactgactttctgggagactttgggaaaatcacttcatccttctgagtcttggtttttccatttgtaggctgcagctcagtagcctcyttcagtaggccattgtgaggactcagggagggatcgtgtgtagagggcttagctcagggtctgggctggatgaggtgttctgtaaatgccagcgattgcc

SEQ ID NO: 21530 - DNA, 201 bp, Homo sapiens
ttataaattgtccacatgtagcatattctcactttttattatagtaaattgcactccctgcacagccctggaagctgcctctatttcatctgaaggatccrcaaatgatctgtaatgaatcttcattcccccggggctgtgagcgggcgcttctgccatccacatgaacagggaaggcagttcagactggctgtcgagctc

SEQ ID NO: 21531 - DNA, 201 bp, Homo sapiens
gctggacctgggctctgtatctggctctgctacttagtagtggagcaactccaggtaaggtcagagcctcagtttcctcatgtatggaacggggacacccrtaccaacctctgcaagtgatagtgaggatgacatctaaccatagcccaagatgcaggtgccactgctggtcttgctgcagatgactcctttaggcaatga

SEQ ID NO: 21532 - DNA, 201 bp, Homo sapiens
actacttcctatttctcccaaacatatcatggtctttcatgctttatctttgtggctctcttacctggaacatattttattttattttattttattttatttttgagacagagtcttgctctgttgcccaggctggagtgcagtgtcatgatcttggctcactgaaacctctgcctcctgggtttaagcaattttcctgcc

SEQ ID NO: 21533 - DNA, 201 bp, Homo sapiens
tactacttcctatttctcccaaacatatcatggtctttcatgctttatctttgtggctctcttacctggaacatattttattttattttattttattttatttttgagacagagtcttgctctgttgcccaggctggagtgcagtgtcatgatcttggctcactgaaacctctgcctcctgggtttaagcaattttcctgc

SEQ ID NO: 21534 - DNA, 201 bp, Homo sapiens
tgaggcaggagaattgcttgaaccagggaggcggaggttgcagtgagccaagattgcgccactgcactctagtctgggtgacagagggagactccatctcaaaaaaaaacaaaaaaacaaaaaaaaatggagcaaagaatcgagacaagtagatgtccacgagagtagctatctcagatatcaatcaacaaagctcagctt

SEQ ID NO: 21535 - DNA, 201 bp, Homo sapiens
agcgacgcaggatggatcagcaggggtgccatcaggaacacatggcccactccaggtcattcagaggaggggatttaacatgaggaactactgacaagtgytggcagagttgaggacaggtggagtggaagcagcccagactaacaactgggcagggctggagtgactcccagggctcgagggatgaatgggagagatggt

SEQ ID NO: 21536 - DNA, 201 bp, Homo sapiens
atactacttcctatttctcccaaacatatcatggtctttcatgctttatctttgtggctctcttacctggaacatattttattttattttattttattttatttttgagacagagtcttgctctgttgcccaggctggagtgcagtgtcatgatcttggctcactgaaacctctgcctcctgggtttaagcaattttcctg

SEQ ID NO: 21537 - DNA, 201 bp, Homo sapiens
ggcagcgtgaggccagatatccatggtaagggacatgtgaacatcctgggtgaaaagtggtggaaattgtcagggctccagcaggcagctctacactcacrctcctcctttcagatgacaaagctgataatcttggggtttacatagtgactcttgggtcacagacttgatgttagtgttctgtctcacacattgtaatag

SEQ ID NO: 21538 - DNA, 201 bp, Homo sapiens
agccccgtgtggacagtgccacaggtaagctgtgacagggcagttttttaaggtaaaggcattgctttttcacttaacgttttcataagctataccagatrcaatgcatccaatgacctcgatctatcactttgttattgctgggaaacaaaccgtcccaaaacttagaacagcagtcatttattattttttatgagtcta

SEQ ID NO: 21539 - DNA, 201 bp, Homo sapiens
tagtgcatcttagccccaacctcaaggcttcctaagacaataacctcttgaaccttctaagggaagcacatcttagaataatagtagcaatttttattgayttcttcctgtggaacagaccctggtctaaacactttgcataaagtagcacatcagtcctcacagtaactctgcaaggtgggtattattattactatatcc

SEQ ID NO: 21540 - DNA, 201 bp, Homo sapiens
ttagccccaacctcaaggcttcctaagacaataacctcttgaaccttctaagggaagcacatcttagaataatagtagcaatttttattgacttcttcctrtggaacagaccctggtctaaacactttgcataaagtagcacatcagtcctcacagtaactctgcaaggtgggtattattattactatatccttttctgga

SEQ ID NO: 21541 - DNA, 201 bp, Homo sapiens
cagtgattacaatatcctgtggccccccaacatatgacccttgtttgggtgctggtctctcaagaatcttgcaggtcttaaaaaaggaatttttttaatcttttttttttttttttgagatggagtctcgctctgtcacccaggctggagtgcagtggtgcgatcttggctcactgcaacctccacctcctgggttcaagc

SEQ ID NO: 21542 - DNA, 201 bp, Homo sapiens
cgcccccactgttccccgggctcaggactgcagcctccctcctcctggctctgtggcgggtgcaccttcctagtcccattgctgggctcttctcatctccygacctcaaaacactggcatgtcccatgtccccaactttaatcatctgtcttctgttgtactccttttcttgatgacttctgaccgtctcacacctttgaa

SEQ ID NO: 21543 - DNA, 201 bp, Homo sapiens
ctgctagcatagagctctgggctcagataggggtagcttcaaatttggttctgtcctgttattttgcaagtcacataacttgtgtaagcctcagtttcctyatccataaaatcgagataatcatagtaccacctcccagggttgtggggaggaagcaccaagcatagaacctgggttgctacaggggccccagccctcatg

SEQ ID NO: 21544 - DNA, 201 bp, Homo sapiens
tttagattaagatatgctgtaaatgtacaatacacactggtttagaagactgtatgaatgtaaagtgtcttattaatagtttttatattgattacatgttsaaatgataatattttagacatattgggctaagtaaaatgtggtattaatcggtttctttttacccttttatagtggatgctagacaattttaaattgaat

SEQ ID NO: 21545 - DNA, 201 bp, Homo sapiens
tcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtctccctctgttgcccaggctggagtgcaatggtgcaatcttgattcgc

SEQ ID NO: 21546 - DNA, 201 bp, Homo sapiens
agccagatgtaggctctgccccctccctattgcattctcagtcagtacaggaattagacaaggaacaagtcccaaagggaaaatgcccctggctccaggcraggttcagaggaagggtgatccccatggttggtagaatcagggagcgcttcttagaaaagcaggtattttcagcctgtctgtaagggttgagaaggattt

SEQ ID NO: 21547 - DNA, 201 bp, Homo sapiens
ttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtctccctctgttgcccaggctggagtgcaatggtgcaatcttgattcg

SEQ ID NO: 21548 - DNA, 201 bp, Homo sapiens
aaaccacagttaattaggggatgaaagatacgtatatagctcattagctcaacccacataatttacatctctgaggatattcgaggactagctcagcttargctctcagaaatggtgtcttgaaaggaaacctctcactttggctatttctttgggcatgtggcattagggagggggccatggctgccctctgtctgtcca

SEQ ID NO: 21549 - DNA, 201 bp, Homo sapiens
tgactagtttgagaatttatctatccatccattcatccatctatctgtcaatccttttatactctttctacccacccagccaaccatccattcattcatcwactcatctgtccatccatccattcatccatcatccatccatccatccatctgtccatccctctgtctttccatctacccacccatctattcatctaccca

SEQ ID NO: 21550 - DNA, 201 bp, Homo sapiens
gtagtcatggccccttactggaagacccagagcctttccttctagccttctgcccttggagactgcttagccaaactttcaccgttatggggctggtttgstctcttttttggtgactagtttgagaatttatctatccatccattcatccatctatctgtcaatccttttatactctttctacccacccagccaaccatc

SEQ ID NO: 21551 - DNA, 201 bp, Homo sapiens
ggggaaggtatttgggaacaggagggttttctgggagcccttgtggactgccctgcaccaaagttaagtgctgatctcggccccctggcagtcttggctcstccagtgagggaggcagctatcagacaggctggctccttctccctgggaaactgagggtgggggtggccctgtttcctaggtcctgcacggctcaagtgt

SEQ ID NO: 21552 - DNA, 201 bp, Homo sapiens
agatctacaattgctggggacaaagggcattcattgcctattgaaatgttttgaattatgaaatctgcatatgtgtgcacatacatattagttttatgtartgtatatgaatagttcaaacatgttgtggtgtataattgtatgccttattccttcacaatcccaattatctgcctctagcactttgctttagttccacag

SEQ ID NO: 21553 - DNA, 201 bp, Homo sapiens
cctgcattttgtgatatcactattttttatttaataattgcatggagatatcttattgtggctttaatttgcacttcactgatggtcagtggtgttgaatkttttttatgtgcatgtttgcctatttgccatctggataccctcttcagtgaaatgtctgtccaagtcttttgcctgtttttctaagacgattgcttatat

SEQ ID NO: 21554 - DNA, 201 bp, Homo sapiens
tcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtctccctctgttgcccaggctggagtgcaatggtgcaatcttg

SEQ ID NO: 21555 - DNA, 201 bp, Homo sapiens
ttcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtctccctctgttgcccaggctggagtgcaatggtgcaatctt

SEQ ID NO: 21556 - DNA, 201 bp, Homo sapiens
aggtgtgcagttggctgttccatctaggtctgtgtaagtaccctctatgatgttctcacaatgacacaatcatctaacaacacatttctcagaacatatcyctgtcattaagcaatgtgtgactgcatgtggaatccaaaaaagttgaacttatagaagcagagagaagaagggtgagatgccgtgggccagagtgacagt

SEQ ID NO: 21557 - DNA, 201 bp, Homo sapiens
aaatagttatactctttgttgcttctgtgaatgagatcttcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtctc

SEQ ID NO: 21558 - DNA, 201 bp, Homo sapiens
aaagaaataagcttttaaaaagttggatcatactatatataatgttatgtaatctatttttccccccacacaccatggagctatttgcagttaaaactgtrcttatattcttcctaaacccttacaatgatgcatctagttctttgagatcgataattttttggccacttgataccatctagctccatgtaattaaagcac

SEQ ID NO: 21559 - DNA, 201 bp, Homo sapiens
taaatagttatactctttgttgcttctgtgaatgagatcttcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtct

SEQ ID NO: 21560 - DNA, 201 bp, Homo sapiens
ctaaatagttatactctttgttgcttctgtgaatgagatcttcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagtc

SEQ ID NO: 21561 - DNA, 201 bp, Homo sapiens
tctaaatagttatactctttgttgcttctgtgaatgagatcttcttgttcatttctaaaagtatttttgcctgtgtagaatacagtagaataatcatttttatgtatgtatgtatgtatgtatgtatgtatgtatgtatgtatgtgtgtatgtatgcatgtatgtatgtatgtatttatatatttatttttgagatggagt

SEQ ID NO: 21562 - DNA, 201 bp, Homo sapiens
gcagggctgataaggcttgcaggctgccaagtggtaatgtctgatttattgcatatatactgtcaacttaagctcattaactatgagaatagtgtgaagcsagccctgttctcctttcccagttctttcttgctgaggataggcagtcattcttagcacagtggtcctaggagttcctatttcttttctttttcttttttt

SEQ ID NO: 21563 - DNA, 201 bp, Homo sapiens
tggtcccagctactcgggaggctgaggcaggagaatggcgtgaacccgggaggcggaacttgcagtgagccaagatcgcgccactgcactccagcctgggygacagagtgagactctgtctcaaaaaaaagataattaatgaaatattttgcattctttgttttgtactaaggctttgaaattcaacctcggctttacact

SEQ ID NO: 21564 - DNA, 201 bp, Homo sapiens
gtgcagcatcccaacatggcatatgtatacatatgtagcaaacctgcacattgtgcacatggaccctagaacttaaagtataatgaaaaaaaaaaaaaaaagaaatgcgtcaaaacatgctgctctggggctcatgctcataggacagctacaccccacagcccctagctctgtctctgctatgggcctcaaggacaggat

SEQ ID NO: 21565 - DNA, 201 bp, Homo sapiens
ctctttggctgtgtgattccctcaagccccaggcttgcctggagaccttcttgggagaggtggcttgggataatgcttttcattaaggatgggcggaaagrcctgtcttctgagagtccatggcagtgctgattcagaaccccagggccaggtgcctgtggcttgcacggggcgctttcctgccccgccttggcctctgag

SEQ ID NO: 21566 - DNA, 201 bp, Homo sapiens
gtctctctctgctgatgctaccattggctggtgtttatagggcatgctagggagtaggtgcagagaggtttccaaacagaaattgcctctaatggagtctstttgagtagagcaggggtacctggtaacaactgggtcctactgcttggatcagggggctgcatggaggctataaaggacaatgtgttttctcagagcagt

SEQ ID NO: 21567 - DNA, 201 bp, Homo sapiens
ggagaaggtgcccagctgtaattatacattaggttggagaattagagaggaaggtggaggtttgtgctgatataggaccctttcccattacattgggaagkaatgcattttattgtcaaatttgctgtttgtttttatccagataatgatttcagctgccaataccacagtttgttgtagctataggtagcaaatgcattt

SEQ ID NO: 21568 - DNA, 201 bp, Homo sapiens
ctacagagaccctcctaggtaggggaccgggcagaggccagctggaccctctaccactgattccacccattttactcccagaggaggccattgcgtccagrttcttggcacttccataagttgtctcgcatgctggaggctggctatcctgatgcaggttctgaggggcctcttggtgtctccatatgttgtttaatcatg

SEQ ID NO: 21569 - DNA, 201 bp, Homo sapiens
aggccagaggagaaggtgcccagctgtaattatacattaggttggagaattagagaggaaggtggaggtttgtgctgatataggaccctttcccattacaytgggaagtaatgcattttattgtcaaatttgctgtttgtttttatccagataatgatttcagctgccaataccacagtttgttgtagctataggtagcaa

SEQ ID NO: 21570 - DNA, 201 bp, Homo sapiens
gaggctggctatcctgatgcaggttctgaggggcctcttggtgtctccatatgttgtttaatcatggctacaggttcgccatcttgatgctgaccctaagrgctgggactctggagcaagggcagaaaagcttctttgtctcagtttctactgagtgagtaagttcttccctgcaccatccaagggacagggagatggagt

SEQ ID NO: 21571 - DNA, 201 bp, Homo sapiens
agacaacaatatgacatgggtctccagtccttgctgtatgttagaatcacctggaagctcttaaaaatcccagtgcccaggtcctaccccattctacttamatcataagcccaggtgtgggagccaggcatcagtctattttaaagtcttccaaggataccaatgttcagcaaagttgacaggcattatggggactcctag

SEQ ID NO: 21572 - DNA, 201 bp, Homo sapiens
catatgttgtttaatcatggctacaggttcgccatcttgatgctgaccctaagggctgggactctggagcaagggcagaaaagcttctttgtctcagtttytactgagtgagtaagttcttccctgcaccatccaagggacagggagatggagtctttccttcaggccctggaatctcattcccagaagctgggagtcacc

SEQ ID NO: 21573 - DNA, 201 bp, Homo sapiens
tcaatagggccgggcttagtgttcagtggggtgggtcaaacatgcaaggaatgttgatgattccataaagagagggtatacatgatggatctgggtgtggraaaaggccagaggagggaggcttcggagctcaggagcagggaccagccttaggagaaacttttctcttgagctttcagcacagacagggaggtgtggagc

SEQ ID NO: 21574 - DNA, 201 bp, Homo sapiens
gtcttgagatgatagaccatgtacagaaatacatttggggtgtggatttattctttcctcaatatcatccccctagttttaattaggactaaatttctgcrtacaagagtgtctgatgattgctgaatgcctgtctatcactgctgagtgatgttgtgtccttggctgtggtaaccaacattcctcatttgcccaggacta

SEQ ID NO: 21575 - DNA, 201 bp, Homo sapiens
aattattttttgggggtgaataccacatggttcctgacaacctagccctggagtggcatttcattcccagtgacacttcattcaatgctgtccccacctcycaacccctgctctggcctacctcttaccttgctgagccacctgttcctcaccttgtcactgcatggccctggtccccatcatgattcccactggagtttc

SEQ ID NO: 21576 - DNA, 201 bp, Homo sapiens
ctccactgctcccgcttttgtgtgcaaataggcaggcaggggaaggtttggggctgtgtccaaaagaagggcacgatggatataaaacgtaagaaaaaaaatgctcaataatttggtcatctggaaaatcagccagaggtcatttgggagacaagtgattttgtgacctggtttctggtgagttggccactaggagaactg

SEQ ID NO: 21577 - DNA, 201 bp, Homo sapiens
gggcgcctgtagtcccagctactcgggaggctgaggcaggagaatggcgtgaacccaggaggcagagcttgcagtgagccgagatcgcgccactgcactcyagcctgggcgacagagcgagactccgtctcaaaaaaaaaaaaaaaatagtgggccaggcagtcagcagggctcagggtctttctggaaatgcctacagat

SEQ ID NO: 21578 - DNA, 201 bp, Homo sapiens
attctccccatcaggaaacactctaaggcttccctggacatggcactggctttgagggtctctgggctaaatggtctcactccgaatcaagcagggaggcyggggagaaaccatgggttcagggaggggagtgaaatcagagcctctcaaaggcagaaagggccaggaggcctggaggtggctcccagggtctgatgcatg

SEQ ID NO: 21579 - DNA, 201 bp, Homo sapiens
acctgtactgggggttgctctgcacacctgcatggttgggggtgtgtgtggcttgtacagcctcgtggctgtatcctgcccaagcactgtgtgttcgggggaggttcagcctgggcttggctgtcctcatggccagcatccaagcgaggaccctcacttgcctgccctggtcctcagcaccatctctgcccctccaggtta

SEQ ID NO: 21580 - DNA, 201 bp, Homo sapiens
ccaagaacaatgtttataaaactctgtctcggcaatcatcctgtgtctgccagcttctgtcttgcttctgttcatgttcgttctttttctctctgcaggcygtggagaccaacctggcttccaaggacagccactgggtctttgtgaatgaggtaagggctctagaaatgtgatgagcacggcctggactgagcccctagc

SEQ ID NO: 21581 - DNA, 201 bp, Homo sapiens
cagtggatgcagtgagctgagatcatgccattgcacttcggcctgggcaacaagagtgaaactctatctcaataaataaataaataaataaataaataatwgtggtatatttatatgataaaatactactcagcaataaaatggaatcaattattggtacaagcaacaacatggatgaatttcaaaataattaggctgggt

SEQ ID NO: 21582 - DNA, 201 bp, Homo sapiens
ggcagtggatgcagtgagctgagatcatgccattgcacttcggcctgggcaacaagagtgaaactctatctcaataaataaataaataaataaataaataattgtggtatatttatatgataaaatactactcagcaataaaatggaatcaattattggtacaagcaacaacatggatgaatttcaaaataattaggctgg

SEQ ID NO: 21583 - DNA, 201 bp, Homo sapiens
catggctctgtccctttcctcctctgtccccaccatcctgctcatctttccaaagcccctgagtgctggggaagctgctgtgagctctgtcccggtgtcarccagcactggtcttgcaggcctctggcatcctagtccactgtcccctctccatgacagcactgtcacatccctcagagcctgctgcctcctgaacacacc

SEQ ID NO: 21584 - DNA, 201 bp, Homo sapiens
agaaattagcaacaacctaaaggtccatcttcagcaaattggttaaatatattatgatatttacatgtaatggaaaactctagttccttatgtactgagtrgaagtagttccaaaacatggtgctgttagctgacaatagagaagtgagaatggtgatgtgggtgttgctttgtgtacaagtgagcttctatgtgtgtgta

SEQ ID NO: 21585 - DNA, 201 bp, Homo sapiens
aaagggcactgagggctgtaggaagagtgttctaagcagagggaagaacttgcttccctctttccagaggaaaggtctgggggcaatggagaggaggaaaratcatatggctggaatatgggaattggctagggataagactggagagacagtcggaggaggccttagatgctcaggatccccagaaatctctgggagcca

SEQ ID NO: 21586 - DNA, 201 bp, Homo sapiens
gttgccctctgtgtgtccatgggttctcatcatttagttcccacttataagtgagaacatgctatatttggttttctgttcctgtgttagttggctcaggrtagtggcttgcagctccattccttgatagttttatcatacaagtatgggacccatggttggtttgcgactcatatatgtggaataacacttctgcatgct

SEQ ID NO: 21587 - DNA, 201 bp, Homo sapiens
taagcatggaaattttaaatttatgcctcatatatttaaaacactgtacatgtatttcactgttttagaggatcccaagccagtgtcttttttttttttttaacttttattttaggcttagtggtacaagtgcaagtttgttacataggtaaactcatgtcatgggagtttgttgtatacattatttcatcaccaagacag

SEQ ID NO: 21588 - DNA, 201 bp, Homo sapiens
cctgtcttccaatcttcctgctatggtgccaccaaagacagcaacagctacagggtccctgagctcccagcaactgttaactagcacagatatcctccctyctagtctctctctgctgatgctaccattggctggtgtttatagggcatgctagggagtaggtgcagagaggtttccaaacagaaattgcctctaatggag

SEQ ID NO: 21589 - DNA, 201 bp, Homo sapiens
ctgctctctctgggccctctcaggttcccgttctggcatttcccatcagtccatgttctccattgtccagttcaccatgagctcctttatgcttcccagcrgctggcgtatgtttctctagcacctgtgggttttccactattactttgtcaattttatgtacattgtgtgtactcaccatttccacctgagcacaagcat

SEQ ID NO: 21590 - DNA, 201 bp, Homo sapiens
cccgacgacacttgccatgcagaggtgaccctaactcagagatggtctcccagcacgaatgagctgagctctgcttgtgtgggtgggcttcagatcactgragttgtgactgtgcctgtgaggctgtgccaatggtttctgatgtcattttcacctatgacagcgagccacatcccatagcatcctctattctcaaactag

SEQ ID NO: 21591 - DNA, 201 bp, Homo sapiens
agatgctttgaataggaattacttcatcttctgctgaaatatcacttctccttggagctgcaagcatttgattgtcaccatccttgtcatgccagacatargagggctgaggctgcctcgtggtcagtcttgctgctccaaattagaggggtataaataatcaccaagtgaattagtttaattctgcagaagttcctgagc

SEQ ID NO: 21592 - DNA, 201 bp, Homo sapiens
tgggaggagagtccagctcaactcacccaccatggtccccgcggaaggctcctcgtttgtcactgtcccaccctgccagtttgactcagtatgagttgaaytgtgtccccttccaaaattcatatgccagagttctaactccagtacctgcgaatttggccttatctggaaatagggtttttacagagataatcaaattaa

SEQ ID NO: 21593 - DNA, 201 bp, Homo sapiens
ttttgtagttataaataaccacaagttatttgtagttataaataaccgcaagttatttgtagttataaataaccgcaagttatttgtagttataaataacsgcaagttatttgtagttaaaaataaccgcaagttatttgtagttaaaaataaccgcaagttatttgtagttataaataaccgcaagttatttgtagttat

SEQ ID NO: 21594 - DNA, 201 bp, Homo sapiens
gcttgtggttagtgttgttcgatgagtcggtcagatagagagtgggccaggctggccgggcaccgtggcttatgcctgtaatcccagcattttgggaggcygagacgggcggatcacgaggtcaggagatcgagaccatcctggctaacacggtgaaaccccgcctctactaaaaaaaaaaaactgcaaaaaactagccat

SEQ ID NO: 21595 - DNA, 201 bp, Homo sapiens
gggatgccctttatttctttctcttgctgattgctctggctaggatttccaatactgtgttgaataggagtcatgataatgggcatccttgtcttgttttkgttctcagcggaatgcttccagcttttgcctgttcagtatgatgttggccctgggtttgttatatatgacttttttttttgaggtatgttattttaatgc

SEQ ID NO: 21596 - DNA, 201 bp, Homo sapiens
taaaacaattttgtagttataaataaccacaagttatttgtagttataaataaccgcaagttatttgtagttataaataaccgcaagttatttgtagttawaaataaccgcaagttatttgtagttaaaaataaccgcaagttatttgtagttaaaaataaccgcaagttatttgtagttataaataaccgcaagttattt

SEQ ID NO: 21597 - DNA, 201 bp, Homo sapiens
aaggacaagtgcccaggaggaggtaaagacagaagggcgagtgggggtcggggaaggcagggctccctctgagagccaggggattacagtagctagcctggatctgtctgctgtagggactggacagacaggcccactgtcaagggggacagggttgggggctgcctgtggtccttgactaggaggaggcctgagcaggag

SEQ ID NO: 21598 - DNA, 201 bp, Homo sapiens
gcactggtattctctaagagcttcctgggtggtgccaaggggcggccagggccagccaatgaacggtggcccttcatgacgcagagatggaacgccaagggccaggcgtggccacgtgctttcccaccccagctcccagcaggtgattggctagtgggggtgctctcactgttgatttccttcatcacagctctggacatt

SEQ ID NO: 21599 - DNA, 201 bp, Homo sapiens
ttcttggaggtttcaggacttctacatggctgaggcccatccctaagcctggcttctgcctcccatggccacagatgcctggtctgccacagagaggggaraggaggaccaggctgctaggctagctggcttctccctggatgggaagcagggcttagacccccaaatttgcccaaggcctggtggtaggtctgatagccc

SEQ ID NO: 21600 - DNA, 201 bp, Homo sapiens
ggtgcctaacctagcctgggcttggggttaaccaggggaggcttcctggaagaagtgacttctgagctgagtcttaagtgtggaacagtggttggtcaggygaagaaagggaggcaggcactccaggcagtggcatagctggagctagggctcagaggtgagctgtccagggtccctgggcatagatggaggaggtgctga

SEQ ID NO: 21601 - DNA, 201 bp, Homo sapiens
ttaaagatgattgactataccaagcatcaggaagtttatgaggcaactggaattctcatttactgctgctgggaataatgtaaaatgcactaccagtttgrcaaactgtttggcggtttcttaaaaagctaaacatacacctatcatatcagtcattctactcccaggtatttacttgaaagaaatgaaggcacaagtcca

SEQ ID NO: 21602 - DNA, 201 bp, Homo sapiens
tttttctcatcctattatcttgaaccttcctgggtgtttgttttgtatcttttgtaaaaagttatgtcaaaaaaaaaagttatgtcatgatgaaaaaaatytcatttttttttgaagattttattagcataacttaatctatttacttttattgagatgattgatatgcctggacttttccttgccattttattttgtgtt

SEQ ID NO: 21603 - DNA, 201 bp, Homo sapiens
taatgtaaaatgcactaccagtttggcaaactgtttggcggtttcttaaaaagctaaacatacacctatcatatcagtcattctactcccaggtatttacytgaaagaaatgaaggcacaagtccacatgaagatttcagtagcagcttaattcataatagccccaaactgaaaacaaccaaaatgtccattggcaagtga

SEQ ID NO: 21604 - DNA, 201 bp, Homo sapiens
tatttaacatcattggccttttctgaaatcactatgaactatttgtaaacattacttctagtaactgcatacatttctcaatattcaaaactttttttttwataaaagggaactatttatgctgagatatgcagaatcaaatattcctgaacaaaacaagaaactcggcctggatatgttggtcctaagatttatacttac

SEQ ID NO: 21605 - DNA, 201 bp, Homo sapiens
tttcaaaataattaggctgggtgaaaaaagacaaaaagagtatatactatgtgattacatttatacaaaactagaacatagaaactaatctacagtgacasattgcagatcagtggttgcctggggactggggtgggggatagggaaagaaagaccgcaaagaagcacaagaaaatttggggagtatgttcagtatcctga

SEQ ID NO: 21606 - DNA, 201 bp, Homo sapiens
gtgtgcttattatataaaatgtggaaggtacaggaaagtgtcaagaggcagaacaaaatcactctgaattgcactagtgttatttccttccagtcttcccyccaccactgtattttatacattttgagagctcccattctgttcagttttatatcctgttattttttcctatttaacatcattggccttttctgaaatcac

SEQ ID NO: 21607 - DNA, 201 bp, Homo sapiens
tctcactgtggagcagtttgttcctttccacaaagaaattcattagtggcgatcaatggcatgcagtgtggaggctcccccactgatgcctggagtctccrtggcccggagtcgccccctgcttggggccgggagagaggtatccatgccagctctctggctgctcaccagggccactgggcagcccctcagggttaggct

SEQ ID NO: 21608 - DNA, 201 bp, Homo sapiens
ttgatattttcagctacattatttttttaagctagtgaattccttgagagaggacctaaactgaccttttcatttttagctcttacttttttccctgattrtaaaagaaatgcattgctgcaatgagcatgtattaatataaaaatataaaaaagaaaaagggcaatgtgtgcttattatataaaatgtggaaggtacagg

SEQ ID NO: 21609 - DNA, 201 bp, Homo sapiens
taacagatagtcacaataatttgtgaataatatctgctctgctccctctagaactagagatgaaggtcttatattgggaacatgggatggcacttcaagayggtaccacttcaacataacatcatgctgggggagggatggggcatgggcaagtaaaaatgccacaataccttcctaaagttgcctttttcttgactaagt

SEQ ID NO: 21610 - DNA, 201 bp, Homo sapiens
tggtgctgtcgctgttttggtctgagaggcagtgccatgcagtgataagagcttggtggagcttaaagagtttcagttcccatcttgcttgtcttcactcrtggtgtgaccctggagctctgctctgagcttctgtttccagatctgttcaaagggaataatcataggatttgcctcatgggattgtgaggattaaatgag

SEQ ID NO: 21611 - DNA, 201 bp, Homo sapiens
aaaactttggctagtgggaaggcttacatttgcctaagagtgctgccttaggcctgggtggctcagcaaatgaggccagggctgctcctgcaggtgggacrttcctgggcccagctgtggcacatggcagtggagtgtggggtgcagagagatcagcgtgtgtggtggtggtaagcagcagtggagaaaggtgtgggagac

SEQ ID NO: 21612 - DNA, 201 bp, Homo sapiens
atgatgcaggctccttcctgctgctgtatttacctgattgttacgtgatgctcttcccagctggcctcctatcaggcctgtctctgcaactaacacaattyccccggcagaatgcacagacaaatgtctcagacaacaaactggattattattattttcttcctcttggactgactgctccagtgcccatcaagggctctc

SEQ ID NO: 21613 - DNA, 201 bp, Homo sapiens
tcacttactcacccagcaagtaccaattgggagcctcctatggatgaggaaccctatcaaatgctgaggggcatggaattcagaggcagtgcctcctcctstccaagactggctatgatatggaaagtcgtggccacacaccatgccactggtgggcattccagtggctggcagagcagctgtgccccagggctgtcatcc

SEQ ID NO: 21614 - DNA, 201 bp, Homo sapiens
aagggctctcccagggcatctcatttggaaacattctgggcttgctatttgcaggtagttgcctttaagacaaaagcggtctgagacaacttcattacctktcaggtttttcttggttaaatttgggctgcttcaaatatgggagactgacttaccgtggaattcttagcgtacatttatgcatccacccaatccatccgt

SEQ ID NO: 21615 - DNA, 201 bp, Homo sapiens
aggctggtctcaaactcccaagctcaggcaatctgcccaccttggcctcccaaagtgctaggattacaggcatgagccacagattacatagtttcttgctstgctgtgctgtgctgggtgctgggggtcaggggggcgggtaagcagtgaaggtgcttctgcttatgggcagaatgagaccacacaaaatagtccaacatg

SEQ ID NO: 21616 - DNA, 201 bp, Homo sapiens
ggggcctgcaggttctgtgagcctggccttggcagtgagtgggtgagtggaagagttgtggcaggccaaggtgctggggcctgcctggggaccctgtgggyttgtgtgtcaggccccacctagagacccctcacatccctcgctcagtctttattccacattcatcctctgaggcctcctcagcaccatcttagtagccac

SEQ ID NO: 21617 - DNA, 201 bp, Homo sapiens
gagagagcttgtgcaggggaactgccatttataaaaccatcagatcttgtgagacttattcactaccatgagaacagtatggggaaaactgctcccagtastcaattatctccacctgtccctgcccttaaggcatggggattattacaattcaaggtgagatttgggtggggacacagccaaaccatgtcagtatccatt

SEQ ID NO: 21618 - DNA, 201 bp, Homo sapiens
ttcccttcccacctcctgtatcaatataactaggccaaggtttgggccaccctgtggggtttgccactgacatttgtgaggcttgtacatcgtacctgccragggacgcccttcagatcacggtcctcatggctgtgcattgttatcagggcacacctccagcagtcaaaggtctccagcagaatagctgtttgggccagg

SEQ ID NO: 21619 - DNA, 201 bp, Homo sapiens
agtgaacctattccagataaatcaggtgagctaatagtcacctcctacaaaagaggaagggacaattgtctgtaatgtctgatcatccctcccctgccagyatttattgtctttattgtctcacctctgaacttgacattgagcactgagctcaaaagataatagaaattctgtctgcaggaaaaacaaaaaacaaaaaag

SEQ ID NO: 21620 - DNA, 201 bp, Homo sapiens
tagcttattagggttcatgaaaattctgtcagaatcttgaatagaattgcattaaatatacagataagtatgggaagaatttatgtctacataagattatrtatccttatccacaagtatgttatatatcttcatttatttaagtgtttcagagaccagatagggcctgtgtttcaatagttctcttgcctgctgtcaggc

SEQ ID NO: 21621 - DNA, 201 bp, Homo sapiens
ctcctgcacctctccaccactccaccactgggctggcctccctttgtccagcctgctcctgctccgccctgcccactggctcccagactcttgacttggcytctgccataggttgatggagctctggtttctttgtggtgcctcaggcctctgcaagggattcagacccttctgcgtctttctggactcattctttggctc

SEQ ID NO: 21622 - DNA, 201 bp, Homo sapiens
cccttgcttttaggtgagagaacacacagtttgcagttagctgtccctagtgggcttgggaaaggaggagctgtgtggctgggctttgggtggctgggatkgggatgtatggctcttcttcctgttccctgcatggggtgagggtccctgggcctcagcagggacacggtaatgatggccccatgattttgcccttttcct

SEQ ID NO: 21623 - DNA, 201 bp, Homo sapiens
ccttgcttttaggtgagagaacacacagtttgcagttagctgtccctagtgggcttgggaaaggaggagctgtgtggctgggctttgggtggctgggatgrggatgtatggctcttcttcctgttccctgcatggggtgagggtccctgggcctcagcagggacacggtaatgatggccccatgattttgcccttttcctg

SEQ ID NO: 21624 - DNA, 201 bp, Homo sapiens
tagctgtccctagtgggcttgggaaaggaggagctgtgtggctgggctttgggtggctgggatggggatgtatggctcttcttcctgttccctgcatgggrtgagggtccctgggcctcagcagggacacggtaatgatggccccatgattttgcccttttcctgtctttgcttctgggtcagttccctccttgtgatggc

SEQ ID NO: 21625 - DNA, 201 bp, Homo sapiens
tgctgtctcttattcctaaaagcatggctcacaccttagttctttgggtcaccggggttggacggccagggtgtgggaatttcacatcatgtagcctgtcygttgttgctggtgctatcagctgagaggtgggaggcctgggacaatgcacagctttcctgagagccagctgggtaaacactttttcacaagaacaccctc

SEQ ID NO: 21626 - DNA, 201 bp, Homo sapiens
cctgaagggaaattagaaaagaggataagggaagattatgcaactgattaattactaactagttcttccaatggtcccaggtcatcagtttcccttccgtrgaaatgaaagtctttgacagtgagggtgaccagcttgttcaggcttctccaagctttgctagctgcaaagaagagagaaggttatcttattaaaccctaa

SEQ ID NO: 21627 - DNA, 201 bp, Homo sapiens
ttggttagctgtattccttggtattttattctttttgtggcaattgtgaatgggagtatgttcttgattgtgctctctgctttacagtggttgatgtatargaatgctagtgatttttgcacattgatttttgtaccctaagactttgctgaagttctttatcagtttaagaaacttttgatcagagtctatgtggttttc

SEQ ID NO: 21628 - DNA, 201 bp, Homo sapiens
tgcatggatggcagcacccactagagctataaaatcggattggagcaggataaggagtcattcccccaaacaagagcagggagctgtttccagaggaagayggatgtgctgggcaggcaacaagctgtgcatgcatctgctgcccctctcttctccccttgctcacaccttcgctagaggccaggcattcttttgggctct

SEQ ID NO: 21629 - DNA, 201 bp, Homo sapiens
cctccctgtggctttcttcttggacaggaagttaatctttccctctctccaaactctaacaaaatgggagcatctcctgaacaccctgggctagtgctcarttgactgagaaaaaaggccaggccctctatcaactgccagaatccagagttgagcagccctggaacctagacacctgcttcccactttaattgagtccac

SEQ ID NO: 21630 - DNA, 201 bp, Homo sapiens
tttccctattgcttgtttttgtcaggtttgttgaagatcaggtagttgtatgtgtgtggacttatttgtgggttttcttttctgttcttttggtatagatrtctgtttttgtaccagtaccatgctgatttggttactgtagctgtatagtatggtttgaagtagggtaccctgatacctccagctttgttctttttgctt

SEQ ID NO: 21631 - DNA, 201 bp, Homo sapiens
ccagcaccatttattgaagagggaattttccctattgcttgtttttgtcaggtttgttgaagatcaggtagttgtatgtgtgtggacttatttgtgggttytcttttctgttcttttggtatagatgtctgtttttgtaccagtaccatgctgatttggttactgtagctgtatagtatggtttgaagtagggtaccctga

SEQ ID NO: 21632 - DNA, 201 bp, Homo sapiens
agtgcctgaagctctctaggccccagttttttcctctgtaaagaaggaatgaaaatcctgctcccgtaggcttgctgtgaggaggaaatgaaggggagagwgtgggacagtgcaaagaagggacttcataagccataaatgggggctcacttccctactcccctcacccagcgttcctggcaggaaggacatctacccttg

SEQ ID NO: 21633 - DNA, 201 bp, Homo sapiens
catgcatgtgtttttacaataggacaatttatactcttggggtatatacccagtaatgggattactgggttgaatagtatgtctttctttaagtctttgargaattgctacactgtcttccacaatggttgaactaatttacacccctactaacagtatataagtgttcccttttctccataaccttgccatcatctgtta

SEQ ID NO: 21634 - DNA, 201 bp, Homo sapiens
aggtcccacagggaggcagaaaggaggaggggggaaactatggtcaagagtcggctgtgctttccatggggaggaacaggtgaggcagagtaggtgggctwaggattggctggtgggagtaagcccagtgggctctggggcatagaggtgtccttggttgtctggtacctggccctggggtgattaggacaagtatatagt

SEQ ID NO: 21635 - DNA, 201 bp, Homo sapiens
aaataaatatttataaactatgcatctgacaaggggttaatatgcagaatatacaagaagctcaacaactcaataacaaaaaaaaatctgatttaaaaatkaacaagagatcttaatatgaacttctcagaagatatgcaaagagacagtatgtatatgaaaaatgctcatcactaatcaccagggaaatgcaaatcaaaa

SEQ ID NO: 21636 - DNA, 201 bp, Homo sapiens
tcccaggggagagccaggtcctgggggccacagcttcaggggcagctggatgggagaccatgcagccctgcaccgccagcctgatctcctggatttgtaargtgatggttgcagtgggaggccttgggtgggtgcagctaaccaagttcacctgtggggataagagtgaaggtttgtaagcaaataccagggaacgtgccc

SEQ ID NO: 21637 - DNA, 201 bp, Homo sapiens
catatccctgatcactatgaaaactgagcagctcttcatatgttaatttaacatatgtttttttccagttaatattcatttccatttctcattttttctaygggaatatttatctctttctaactgattaatgagagttcttcatgtagtttctgaaacttctaactttttgattttaagtcacatgattatctttcatat

SEQ ID NO: 21638 - DNA, 201 bp, Homo sapiens
ttagctcgggatttcctgggaaggtgagaaaactttccaccaaagtctctggggtttgcatttcctgttctgtttggggattactatgcatctcttaactstgtgattttgctttccaagcttttgtggtttgcatcccttgtcaacaggatttttttctgcaaacagcaatgtaaaggctcaatgtgtctaatgtgcctg

SEQ ID NO: 21639 - DNA, 201 bp, Homo sapiens
caggaaggaatgggctactaggggacccagtgagctcccagggccttctgctgcttcctatacccctgtatttcactcggtcctctaacttgattcagctscaggtaaaggcggaaacttctcccacaaacagaccttcagcttctccagtgggggtgtgttcaggagaggagggtctccctttcccacttctggagttgg

SEQ ID NO: 21640 - DNA, 201 bp, Homo sapiens
ctgtcttgaaatggattcgatattaattgggcagtgaatatggactaggctctgttctagaccctgagaatataaagggactgagacaaacaaggtccttgtcttcaagagctgacatcttagtggaggtggtggtcagacactaaacaaataaatgagtaaaccaaaagtcatgtgggtagtgacaacccccatgaagaa

SEQ ID NO: 21641 - DNA, 201 bp, Homo sapiens
tgctcacaccttcgctagaggccaggcattcttttgggctctcctaccatttacatgtggatggagttccgaattttgcagcttgttgcagctgtctctayatctgactccttctccagcctgcttgctggacagtgctcagctaggaaggtcagattgcggactggaacttgccttggatgtctgggggctttgtcctcc

SEQ ID NO: 21642 - DNA, 201 bp, Homo sapiens
atggggacaggagagccctccctcccagacaagacgctctcagatgagaccttgggcaagtagacttagagcagtagccctttgctgctgaatctggcagracaccatcattctactcacctgaatgcagcccttgcctaggctctgggggaccttgtcaccctatgatgggggaggcctgcttccaattttaccaacagc

SEQ ID NO: 21643 - DNA, 201 bp, Homo sapiens
gcctgtccctgactctcaggtcaccaggcagctccacaggccacactggggagtgtgggtggggttctgggaggccccttatgtctaccttcctggatgcytgagaacactgggcttgttggcatcacagtgcaaaatgaaactgaagacaatttctcagagccgcccaagactgacctggggattcttccccccgcaatc

SEQ ID NO: 21644 - DNA, 201 bp, Homo sapiens
taatcacaagccacacatttcttgcttctgtgcttttgctcttgtggttctcttttggcaatgggtgacagaaactcaccttgagctaccttagttaaagygccagggccatctgagcctctggctttgtcaaaccagggacccaaatgtggccctttgttttcttcacctgtagatcggtcaattccctcaccccagctt

SEQ ID NO: 21645 - DNA, 201 bp, Homo sapiens
tgagatcacctggacatgacttgttctagacgtctcttctgacattcccttcctcatctgctgccacatagcaccattaatcacaagccacacatttcttrcttctgtgcttttgctcttgtggttctcttttggcaatgggtgacagaaactcaccttgagctaccttagttaaagtgccagggccatctgagcctctgg

SEQ ID NO: 21646 - DNA, 201 bp, Homo sapiens
aagtttaggaaacagaggcccagagactggggagatgcatagcaccagcaagcatgatgctgtgctgggcttggaaggcagatttcctgggagtgaggggkcttggcagaggacccagaacatcatttctgaacttgaggcgatgcagttctgtgactccctgtctcctcttcagctcactttctgctccaaccttcccca

SEQ ID NO: 21647 - DNA, 201 bp, Homo sapiens
atcttgcttcaattagatataaataatgaacaataattagaaagatttcttcatcgaatttgttattttatgtttcctttcatctgtaatgtattgaaacraatactgagctctgtttctgggccacatagcagggacctaaggagtgctgtggcatgtgtctccgaagcaaggggaggcatccacagctgggccttctgt

SEQ ID NO: 21648 - DNA, 201 bp, Homo sapiens
acatttatttaaaggctattttgcatctatcaagataattatataatttttattcttgctctttcctgttaatatgataaattatgttgatgtattccttyttgttggtgctcatttctctttattgcaccaataccataccatgctgttattattattttatagtatattccaatatttgctaagtttgataccatctaa

SEQ ID NO: 21649 - DNA, 201 bp, Homo sapiens
tagatgtaataacagtggacatctttattttgttcttgatatcagaagataatttataataatttattctttaatatgtttactacataattttggttgaygttcttttttcagattaagacaattcccttgaattcctagtctactaatagtgttatcaagaatgagtgttacatttatttaaaggctattttgcatcta

SEQ ID NO: 21650 - DNA, 201 bp, Homo sapiens
gccttgttttattctgaatatagttgtgactgaattcttagtggttttactaatataaactgaagtgtaacccttatacagaaaaatttctaaatcttacrtgaatcacagtgaattttcaaaagtgaacatgtacatacagacaacactcacatcaaagaacatcaccagcaccctcagagctctcccctgtgcacccct

SEQ ID NO: 21651 - DNA, 201 bp, Homo sapiens
tgcttcatcccagtaaaggaataaggaaaagatgcaatcaagtatttcattttaggtagtgtttttatcaatacatacccattaagggtagaatgttcagraaacacagataaatgaaaagaagaacgtaaaagtcagctacaatctttaaaccaagaattaaatactgttaatgtttctgttgtattttcttgttgtttc

SEQ ID NO: 21652 - DNA, 201 bp, Homo sapiens
cttccacctcttatgggtgatagagaacagttttcaggactgtggatagtggagagtggccttttatccagggtggggatccccaaagttaagtggactcrtgacacaaagagtctaacagggctaggacaaagaggccgacatggcaagtaagggcttagaacaattatccaagtgaaggaccttggatgtggtcactgt

SEQ ID NO: 21653 - DNA, 201 bp, Homo sapiens
gggatgcttaagggaggagaagggatctggggactggcatcagaagggttgctgtaagggctaagtggggagcataaagcaatcagctttcttgcctcccrtccttcagaattcatgggacatttcttacctttagattttacaatttggaagtctactagaagagctgggactttttttttaagtataaatattttgctc

SEQ ID NO: 21654 - DNA, 201 bp, Homo sapiens
agggaatagatgcaattgaacttagagaggtaggagaccaatgagatataaggcggagtctgggaggaggcctgggttctttcgtgtgtggctgtgtaaaycatacatgattcagggagcacaagaagtcaggaagaagaatgtgtttggtcagggggaggtggtgagtctggccttgggcatgctgggtgtgtagtgttg

SEQ ID NO: 21655 - DNA, 201 bp, Homo sapiens
tggtgcggtttatgtgtgcaggtattgtcagcaagcagtgggtaataaagaaatggtgttcaagagaggggtctggacagggacctggagaagcagtgggygtggagcaggttgctgagagaaggtttagagggaaaactggactgagggactgagccagtggagacgggatgggcaaagacagcaggagttcaagagcac

SEQ ID NO: 21656 - DNA, 201 bp, Homo sapiens
agttaagaaactactatgataattcctctgacagtttgctactacatctaagagttgtggcaggcagaacaatgccccctgcccacagctgtctctctctytctcttttttttttttttttttttttgagagggagtctcactgtgtcgcccaggctgcagtgcagtggtgcaatctctgctcactgcaacctccgcctcc

SEQ ID NO: 21657 - DNA, 201 bp, Homo sapiens
tgaattgtaatccgaattgtaatccccacgtgttgggggagggacctcgtgggaggtgattagatcatgggggcggttcctccatgctgttctcgtgatartgagtgagttctcaagagatctgttggttttataaggggcttttccctgcttcgctcagcacttctctctcctgccaccatgtgaagaaggatgtgtttg

SEQ ID NO: 21658 - DNA, 201 bp, Homo sapiens
tgatttttagggactggcagcttcaggttgtctccttaagtagagaagcaaggtggaaattgggaaagaaggctgtaggggaagatcacttccatccagtmaccagatgctaagcaactttgtaggggagagcaatgaacccggggatgctggaaaggaatgccgggaagggaaggagggaagggaagggtggcagacccc

SEQ ID NO: 21659 - DNA, 201 bp, Homo sapiens
ctcatgatttggctctctgtttgtctgttattgctgtagggatgcttgtgattttttaattcttttatggaagggcttatttatggaagtccttactctgycatgtataaatcctctttcagttagatatgaggaccttttaagtaatttctgcatgtgctgtgtcaggtgctgctgctagaatgagaaataagatatagg

SEQ ID NO: 21660 - DNA, 201 bp, Homo sapiens
gcgtgaggaatctctgctaagcctgcctgctcctggctggcctggcttgacctggggtcctaggtcccagcactgtgtcccctgtccctagtcatagggaygaggtgctgtgtcctcacctgggatgacttggacaactcctgtgttgagtcatctaagacactttgtggcaactcaggtcttacacctgaaagtgcctac

SEQ ID NO: 21661 - DNA, 201 bp, Homo sapiens
ccccccaccaaatggctgctcttgggaagatcattctggtttagaagtttctgggaggaccaagaagaacagggaatttttgcaagagtatccatcccttrgcttctctattgagctggcctcagaaactctgtcatcctctatgaggcttgtggtcagggctttctgtgctctaaagccaaccaagaactattatagcaa

SEQ ID NO: 21662 - DNA, 201 bp, Homo sapiens
ttgtcttgatgaaattagtgaagatccttttggaaatggagctctccagtccatctttcttcccccccaccaaatggctgctcttgggaagatcattctgktttagaagtttctgggaggaccaagaagaacagggaatttttgcaagagtatccatcccttagcttctctattgagctggcctcagaaactctgtcatcc

SEQ ID NO: 21663 - DNA, 201 bp, Homo sapiens
agcagtaagctgaggactgccgtctaaatgagatggctttgcctttcagagagcagacttggccatctctgccatcaccatcaccccagagagggagagcrttgtggacttcagcaagcggtacatggactattcagtggggattctaattaagaagcccgaggagaaaatcagcatcttctccctctttgctccatttga

SEQ ID NO: 21664 - DNA, 201 bp, Homo sapiens
aaggcccaactttcagtacacttcattataaagcccccttaaaagatactaatatgcagccaagttggaggcccagtgacctagaagagcaggggttctcracattggctgcagtatcaggagcactcaggaggcattaacacttcctatgctcaggccctgagatcctgatttagttgacttgagatggggctgggtatc

SEQ ID NO: 21665 - DNA, 201 bp, Homo sapiens
tatctcaatgcccccaaattaattagtggtggtggcggtgggtggttctttggggtacatggccatgttttttactaatttatttattcatcacaccaagrcaccctattattcaggatggagtgggtcttggtgggtatcatgtccaaggtgacaacaggaaattccaggtttctttaaaactgactctagaactccatc

SEQ ID NO: 21666 - DNA, 201 bp, Homo sapiens
ttcaccacattgcccaggctggttttgaactcctggactcaagcgatccacccaccttggcctcccgaaatgctgggattgcaggcataagccacagctcycagcctattttttaaggtccaatggagaaatagccatgatttttgctttttttttttttaactgtatcattacccaaagtgtggtattttggtatcttcg

SEQ ID NO: 21667 - DNA, 201 bp, Homo sapiens
acactaacaggggcctagtggtaaagacatatcaagcgagtttaaaaaaatatatatttattattcaaatactttaccatgactagaagtcttaaagtaartttccaacacaaaatcatgcaaaagacaaaatccaacccaggaactttcaaccactctaagtaaatcagcactgagtgagaaaaccttttgcagagcttc

SEQ ID NO: 21668 - DNA, 201 bp, Homo sapiens
aaggagaatttttaactatcgatagttattataatataaatatatgattttatttttctcatgtccacttgtgcatttcaaattttttatggtgtttagcrttctgttaccattattattactatagttacctcctacctgaagttaagcattttcttttaatctccagtggttttctttaggcttaaaaatacatgcaac

SEQ ID NO: 21669 - DNA, 201 bp, Homo sapiens
gccccgatggtgaggcctacacactggcttcgagaccacccgtccgcctcaatgatgtcatgctcaggctggtgacggagctgcgctggcagaagttcgtyatgttctacgacagcgagtatggtgagttgtccggcaggcgagctggggctgcttggggacagggatggccagatgctgggagacctgagagtgggtggg

SEQ ID NO: 21670 - DNA, 201 bp, Homo sapiens
aacagtgaaactatatattcatatctctccttatgtaaggtaatactaaaataccttttttcctcctctccttcttcctcctacttaatctttgtttacakaatcttcgacccagtttactatgtttccttttttcttcttaacatcctatatggcgtctctaagatatatatttgcctttcacattcttttattttttcc

SEQ ID NO: 21671 - DNA, 201 bp, Homo sapiens
aatgctggtaaatgagggtttctgcatactgtacccagcagagctgtgaggaacctaggcattttccgttgttactgctctgaattactttgtctctgtaratataagaagaaatccacggagatgatgcattttcaaagtgagaagaatttgaatctcccattgctgtatcccattaattttttccttctcccctagaaa

SEQ ID NO: 21672 - DNA, 201 bp, Homo sapiens
gagggtttctgcatactgtacccagcagagctgtgaggaacctaggcattttccgttgttactgctctgaattactttgtctctgtaaatataagaagaartccacggagatgatgcattttcaaagtgagaagaatttgaatctcccattgctgtatcccattaattttttccttctcccctagaaacctcccaaagagt

SEQ ID NO: 21673 - DNA, 201 bp, Homo sapiens
aggtgtggtggtgcatgcttgtgattccagctactgggaaagctgaggcaggagaattgcttgaacctgggaggcggaggttgcagtgagctgagatcacrgcactgcactccagcctgggccacagagtgagactctatctcaaaaaaacaaaacaaaaaacaaaacaaaacaaaaccccaaaacaaacaaacaaaaaaa

SEQ ID NO: 21674 - DNA, 201 bp, Homo sapiens
agaatcactgctgtcatgtaaaaaccattggttcatttttttgtgtgttagcacagtggcttgctggctgtgtgattttagatggtcactttatggatctsagtcttagctttctcacctccaaaatagaattaactagttcagtggtggattatgtcaattaattaaattagacatcatatgattcagcattgtgttggc

SEQ ID NO: 21675 - DNA, 201 bp, Homo sapiens
tagagatgcagaatgcctcataaatatgcctcaaagtctcctctttgtttcatttttgaagcaggtgttcacacacctagatagcttccttcctgctttgkggggtgtttaaatctatccatttctaggtcatgtgtgatggcccgtgcctgtaattcaagcactttgggaggctggggcatgtgggtcacttgaggccaa

SEQ ID NO: 21676 - DNA, 201 bp, Homo sapiens
ggagacaaagagtcagaggaagacatgactccccaagaaaggcccagaaagacgtgttgctgctgattgtgaagatggaggaaggggccaaggaatgagartggcttctagaagttggaaagggcaaagaagcacactctatcctagggcctctagacaggaacgcagccctgtcaacaccttgattttagcttagtgaga

SEQ ID NO: 21677 - DNA, 201 bp, Homo sapiens
ctatataagaagttttggagtttgggttctcagctagttttccaggcttggtgcagaaaatcgatattccttttattttgttttgctgccgattttccctsttctgtcagcccctgcacaagccatgctcatccctgctgtgccctggtccagccaccttgcatcagtcagtgttcttagtcatcaacaacagaagcctgc

SEQ ID NO: 21678 - DNA, 201 bp, Homo sapiens
tggccctatgttaaataccaagacttcaaaacaaacatagcaaaatgaacatcttcaggaataaccagtgaatttcaaaataaaatgaaatccatgcaatcatcttatatctattatatctattatagatgattaaaagtagtaatgctatcaaggttgtgataaaactggtgactttatacattgctggttgctgtgtca

SEQ ID NO: 21679 - DNA, 201 bp, Homo sapiens
aaaactggaaaggaaaagctactttatatagaaatagttagaaaatagcaaataatgaagggggccagtattaacagattttagaacatagaagcccatgktaattaaatctgagaaacactggtacaaacagagacttccagcaacgaaagacaaatctgaaagagttccttatacataaaataagagaagataaaggag

SEQ ID NO: 21680 - DNA, 201 bp, Homo sapiens
atgtgaagatacagagagaaatggctatctacaagccaggaaggggggcttggaagcgatccctccttcctggtcctcaggggaaccagccctgctgacaycttaatctcagatttccatcctccagaactgggagataatacatttgtgttgtttgatctagctacctggtctgtgatattttattatggcagccctagc

SEQ ID NO: 21681 - DNA, 201 bp, Homo sapiens
ttgtcttaagatttgggcaagatcacacagttttgtggaaatggggagattcactcagcctggggcacttggcttctgtctgatgtgagggaataataaastttcctacccaatatgaaggatcctgaatcctggaacatagttgaactttgatgtgtttgaaaggcagaattttgattttttgctttgaagtattttttt

SEQ ID NO: 21682 - DNA, 201 bp, Homo sapiens
aaggcttctgctatcccgtaacagaaaatgctttcaaaatctctgtctcttggttcctattgcctaatatcactcccaggttacatagactaatcactttstggtgtaggctttattattgttatgcttatatccattttctgggtaagaataactctttgactctggtgctgggggtgaatgagagtcattttccttctg

SEQ ID NO: 21683 - DNA, 201 bp, Homo sapiens
ttcattcttaaataattggtagaacactacagtgaagctatctgggccaaaagttttcaatgtagaaaggtttcaaaatatggatttagtttttcttaatrgttataggaatatttaagttttctattttattctcaggtcagattttaccagagttcttcaatgcagttcatggccagtgagcatgaaaagctaaagtta

SEQ ID NO: 21684 - DNA, 201 bp, Homo sapiens
atgtcccatgccaaatctaagagctctaaaacagtattgtgaagattcatttctattttctttttcagagcactattttaaaaatttccactcttaaggcmtagagatctcgtcaattgttttggcatattgtcactgagagagacatggagttctccctattcactttgacactcacacattcctcaaaccacctgtaag

SEQ ID NO: 21685 - DNA, 201 bp, Homo sapiens
tgcctcctcagcgcagagcagccatgtgtgcatgtgctgggggccatgtgcctgtgggtggtgtgcctgcatgcgtgccaggcagggcatttggaggggcygagcccccagccacagctccgcagcttcctgttccttctctggtgtgtgtcctggcagctgtgtccttctgcctgtcatctctttgtctctttccaggga

SEQ ID NO: 21686 - DNA, 201 bp, Homo sapiens
gatgccctgcccacggcctcaggactctttccgtgactgcctgcactcactggccaccacctctccctaggcccatcatggtcactgcctgcataattctrtcatgctgcatcttgcagggggtggggctgcctcagggcaggcgctggagtgtgttaatatccccccactgactgttacagatggtttgtcatgggtcct

SEQ ID NO: 21687 - DNA, 201 bp, Homo sapiens
gaatcatccctccaaatctcctgagaggttcagtggccttgggtgtgactgggaaagctccctgcaccatcatgggaatgcctcctcagcgcagagcagcyatgtgtgcatgtgctgggggccatgtgcctgtgggtggtgtgcctgcatgcgtgccaggcagggcatttggaggggccgagcccccagccacagctccgc

SEQ ID NO: 21688 - DNA, 201 bp, Homo sapiens
gaactgcctggaatcatccctccaaatctcctgagaggttcagtggccttgggtgtgactgggaaagctccctgcaccatcatgggaatgcctcctcagcrcagagcagccatgtgtgcatgtgctgggggccatgtgcctgtgggtggtgtgcctgcatgcgtgccaggcagggcatttggaggggccgagcccccagcc

SEQ ID NO: 21689 - DNA, 201 bp, Homo sapiens
ctgagccttcagtgagttgtaatctttttgctggtggagggtttgcctcaaagttgatgtctcctgactgatcagagtggtattgctaaaggtaggagtgrctgtggcagtttcttaaaatgagacaacagtgaaacttgccacatcaattgactcttcttttcatgaaagaattctctgtagcatgtgatgttgtttggt

SEQ ID NO: 21690 - DNA, 201 bp, Homo sapiens
atcaacctgctcttcaaagctttgaaggtgttttcttccaatagaaggccattgcatctacactgaaaattggttatttggtatagccacttatatcaatgatcttagctagatcttctggatgacttgctgctccatcagcacttgctgcttcaccttgcactgttatgttatggagacagcttcattccttaaacctca

SEQ ID NO: 21691 - DNA, 201 bp, Homo sapiens
ctgacagtttgtgagcttattgacaacttagttcaaactctcaccttaaacagtagcgtctaaagaacatctcagaagtggcttctcttggctccacacamtaagaaaagcaggacaaatttgatttggagtcaagaataggcacattttcctgcttccacttcagagctccacacagagaggacacacatcagcccacag

SEQ ID NO: 21692 - DNA, 201 bp, Homo sapiens
agatcagtgtaggggtgtggttttagtcaaacctggttttcaatactggctgagacattgactaaccatgctgggcctcagtgtccttgcctataaaatgrcaccactctatctctgtcagtatagtctggaaatttagtgcataataaatattcatttcatattagctccctccagaccatatcagaggacgtttacaaa

SEQ ID NO: 21693 - DNA, 201 bp, Homo sapiens
atcttatttggagacagggtctttgcagatgatcaaattaaaatgatgttataagggtggaccctaatccaatatgactatttccttatgaaaaggagacrtttgtattcaggacatacacagagggaagatgatgtgaagatacagagagaaatggctatctacaagccaggaaggggggcttggaagcgatccctcctt

SEQ ID NO: 21694 - DNA, 201 bp, Homo sapiens
agctaccaaggtgaatccccacatgcaaccttgtcctatggcttcattgggagctagtggcccctccacgctgaggctgtccaagctacggctcacctggraggaaggcaagagatagctgtcacttcctgggtgcccacagtgaccagcatcaatctagacatttatgtattcataatttcccaaatcctcactgtgaaa

SEQ ID NO: 21695 - DNA, 201 bp, Homo sapiens
tcactgttggaaattatctccttgtctatcctgctattgatttgttctggcttgttctcagcctctgaaatgttaagttctgcgataaagaaccccagggkttcattcagttttgttttcctgtacccggggagagacagacacagagtgctcagtgagtactaggggaagaaggaacgggtgggtgctggcaggactccg

SEQ ID NO: 21696 - DNA, 201 bp, Homo sapiens
tggggaaagacggagagcagtggtgaaggaaagggaagctttagacaaagttttcagatgtgtgcatctgagggtaaggacatcagcctgccagagagccyggggcaagaaggcagagcttggatgaacattgatgtacatttgaaggaggccgacattaagtcctttgccaaggttcctagtggctgctgggctcccatc

SEQ ID NO: 21697 - DNA, 201 bp, Homo sapiens
ctgacacatagtaggtgcctggagcatctagtgaatgaacgacccactgaactaacacaggaatcaaaggggcagtgggagtggggaaagacggagagcartggtgaaggaaagggaagctttagacaaagttttcagatgtgtgcatctgagggtaaggacatcagcctgccagagagcccggggcaagaaggcagagct

SEQ ID NO: 21698 - DNA, 201 bp, Homo sapiens
aatattgcagtaaaggccaggcatggtggctcatgcctgtaatcccagcactttgggaggccgaggcgggcggatctcctgagttcgagaccagcctggcsaacacggcgaaaccccatctctactaaaaatacaaaaaaaattagccaggcatggtggcgcatgcctatagtcccagctactcaaggaggctgaggcagg

SEQ ID NO: 21699 - DNA, 201 bp, Homo sapiens
ttccaaatttgtcaggatttgtaccaagagaccaggccttgcatctctaacttgactttggggaaacaacacagccaacagctgagttgttcttttgcctytccctgtgggccaggcagccagatccgggagatccaatggggccatggtctagacatgggacccccaccacccccaggtgttggttgaggtccagtagaa

SEQ ID NO: 21700 - DNA, 201 bp, Homo sapiens
ccgtttgatctctctgagtctctgtcttttttttttttttttttttgaaatgggcttaaaaatttgtggcattattgttgggattcaaagcacttacagakgtaaagagattgcacataagtgatcaaaagttgtgagttttgtagggataattgtccagagatgagcaactggtatttccttttttgatagtttcacttg

SEQ ID NO: 21701 - DNA, 201 bp, Homo sapiens
ggtccatgctggataccatcaaaaaggtacgtgtgagggggcacccccaacctggccaaagacaggccccttcttatacctccactgtgttcccctctagyagctggcctgaagctaggctctgtgtggctgccccagtaggcccctccccattcctctctccttgtcactcttcctgtcccagcatctgcaggccaggtg

SEQ ID NO: 21702 - DNA, 201 bp, Homo sapiens
cagagaaggacttagtaggggagtctacttaggatgataaggaatccctttagggaaaatgataactgactaatgcaagaagtctattaagagtagttctrgggtgaaaatgtttccagaaggagagcatgtacaaaggctctaaactgggaatagttttggactgtctgaggaacagaaagtgggccagtgtggctgttt

SEQ ID NO: 21703 - DNA, 201 bp, Homo sapiens
tgaggtgtgaggctttctgccctacacctatcaggacatagctgtaggctataaaagtgcttaagtgaagtctagaattggcttctcagcaatggagtatyccacaactgaagttatagtaatttagaccagataaagtctagaattggctccccagcaatgggatatctcacagctggagttacagtcaccaagaccctt

SEQ ID NO: 21704 - DNA, 201 bp, Homo sapiens
tctcccttctagaccagacatttctctaggacaggatctatacttcatttctgtgacctgtgcctgtcagtttctggcatgtggcagccttcaataaatgyttgtttaattactgaatatattgatgctttgatagaagaaacaactctgtgaactattgcccacatttgaaaaatgacatttctgatggaagtgagtccc

SEQ ID NO: 21705 - DNA, 201 bp, Homo sapiens
actagcatgtggcagaagtgacgttgcagaagttctggagcctcaagagaccacgcagcttctgttttgttcccttggacgccatcctgaactgggcaggygctgaagaaccaaggacggaaaccacgtggagagaaaggccaagtcatctcagccggctcagctgaacccaggacctattgatcttccagctgaatgaaa

SEQ ID NO: 21706 - DNA, 201 bp, Homo sapiens
aatttgatgctcttacctttcagaagagtcctttgctttactctgggaatcctggcactcctgcgacttgctttgaccactagcatgtggcagaagtgacrttgcagaagttctggagcctcaagagaccacgcagcttctgttttgttcccttggacgccatcctgaactgggcaggcgctgaagaaccaaggacggaaa

SEQ ID NO: 21707 - DNA, 201 bp, Homo sapiens
acctaaaattaatcattggcttttcctgctggaagtctctcttctcccacggaggaagacattggctttgctttgggtttgtggctaaattttgtgcattrcctttcatcccgaggcactgtggggacattattatgttgttaagagtcagaaaagcccatagtgacctgagctagtgcctttgaaggtggttgttttgct

SEQ ID NO: 21708 - DNA, 201 bp, Homo sapiens
gcaggcaaacaggaggctagccaaaccagccacttcttgactggccatgcaggttggcagtttacaagcactgacgtagcatcattctctcatttaatcaytggagaaactgaagctcataacgatagctaacacttaatggatgcttcccacagactggcattatgcttagtgctctgcttgaattcactcaatccatga

SEQ ID NO: 21709 - DNA, 201 bp, Homo sapiens
ttaccatgccttagatcctatgcttaactcaggtacattttagaaggtagatccttggaggggctatacaaaagcagctgacagactatgagaacattttsatccaaaaggcggtcattaatccttaagctataaaactacactttgcctcagtctccgcattgtacagggaatcagtaatggtgcctacctcattaggtt

SEQ ID NO: 21710 - DNA, 201 bp, Homo sapiens
tcaagtttgctgtgtccttacattgatatttatgcacctgagggaatagtagcctcttccaattttatagaataggtttcataggaaaagccttattcctrtagatgggtttttatatgtcgattggctgggatgtactgactttggttcttggtacataaagtagtgcagtttcttcagatgtaatccatgttagtgatg

SEQ ID NO: 21711 - DNA, 201 bp, Homo sapiens
gcaaatcagaaacacatataacatatgcctatgtttaggaattcacagtctgatttgggaccagggcaccaggcctgggttgaatccaggcagaaggtgcrgaagtgaggaaactccagcctgccttggtgtgggagcctcagtactgatgggccctgagtgcctgggatggcctcggaccactttgaattagtctcacat

SEQ ID NO: 21712 - DNA, 201 bp, Homo sapiens
gaaggggagttgaaggcattgaggctgtgcctgagctcagtagaggagcatctgctgagtgggtgaaccctgccgccccaagtttgccccctgttggcttsgtttgcttaccatgccttagatcctatgcttaactcaggtacattttagaaggtagatccttggaggggctatacaaaagcagctgacagactatgagaa

SEQ ID NO: 21713 - DNA, 201 bp, Homo sapiens
gaagatattggtttaaacgtaagattggaggagagggtaggctttgtcaggggaggattccaacacaaaatattatcaaaagttgaagtaagaagataggyagcaaacagaagtgaggctcaagtgatacacatgcttgcaccatgacatttcatgagccagtgcagactctggcaggcagcctggggctgatgcttttga

SEQ ID NO: 21714 - DNA, 201 bp, Homo sapiens
tcctcgtctttagtgtcccccagtaggctctgtcacattattcaggatgctgctgaactctgctcaaagtgagcttcttcccactttcccttagcaacaakgtcagtcacaatcctgtggatgctttgaatgtttgtaagaccacccagatttggtggtctcttattgcctccctgatcagagatcattatgtctgttttc

SEQ ID NO: 21715 - DNA, 201 bp, Homo sapiens
actagaccaaggattggcaaactctgactcctggtcaaatctgacctacagcttgtttttataaaggtttattggacaacagcccaactcatttatttacrtgctgtttatggctgctttcctgctatttcagcagagttgagtagttgtgataaagatatgtggcccacaaagcctaaaatatctattatctggcccttt

SEQ ID NO: 21716 - DNA, 201 bp, Homo sapiens
ctcctgttcctcgtctttagtgtcccccagtaggctctgtcacattattcaggatgctgctgaactctgctcaaagtgagcttcttcccactttcccttarcaacaaggtcagtcacaatcctgtggatgctttgaatgtttgtaagaccacccagatttggtggtctcttattgcctccctgatcagagatcattatgtc

SEQ ID NO: 21717 - DNA, 201 bp, Homo sapiens
tcagcttgccttttctcctggctccctaatacaacggctgcgttattcccctggggccctccctggcctcccagttttcttcctcgtgggattgggatgckctattctcattgcacttagggatgagagaggagaaaacagggaaagggaagctgggattcagggcttcctggcccacttctctacccttgtttctcctct

SEQ ID NO: 21718 - DNA, 201 bp, Homo sapiens
tttatttatttatttctgaaatggagttttgctcttgttgctcaggctggagtgcaatggtgatctcagctcaccgcaacctccgcctcccaggttcaagmgattctcctgcctcagcctcccaagtagcggggattacaggcatgtgccaccatgcccagctaattttgtatttttagtagagatggagtttctccatgt

SEQ ID NO: 21719 - DNA, 201 bp, Homo sapiens
agtgtatcagttcctgagggagcgggagcggcattccagagcatgcgggaacagtgctgctcagcttgccttttctcctggctccctaatacaacggctgygttattcccctggggccctccctggcctcccagttttcttcctcgtgggattgggatgctctattctcattgcacttagggatgagagaggagaaaacag

SEQ ID NO: 21720 - DNA, 201 bp, Homo sapiens
ttgacattgtttcatatgttaagtgggtggttggcatttgtaacaaaagaggctatgtgtgttttgctgcagctctattctccatgcctgcaacagcatcygacacatagtaggtgcctggagcatctagtgaatgaacgacccactgaactaacacaggaatcaaaggggcagtgggagtggggaaagacggagagcagt

SEQ ID NO: 21721 - DNA, 201 bp, Homo sapiens
agtaaattaacacattcatcatctcacatagtttacccaattttttttttttttttgtggcaagagcccttttcatcactttcaaggccctcactaaatgrccatttttccatctgtcctggtctccaacttcattccccagactcacctggagccttatttttggttatcaaacatgccaaacaagcgctcacctcaggg

SEQ ID NO: 21722 - DNA, 201 bp, Homo sapiens
ttgaacaaatggtgcttattgtcatgattgttgttttgttagtattttatttattcttgaattttagaaactgaggccaagggtgcccattgatgctgtcygtgaagcctctggaagagacttcagggtggaaaagggtggagggcagacctggaggggcaaacaggatgtgccccattcagcagctcagtcaagccaaga

SEQ ID NO: 21723 - DNA, 201 bp, Homo sapiens
tttcaatggcctatgtgacacactaggcactcatcatccttgttctttactacaacatggtaaagtgttatggcatgcttcaacttgcaggtgaagacatwgagaggttgaaatattgcctaagagaaaaaacgtgcaaatcacatattttataatgaatttctgtccagaacatataaatgagtcttccaattcaataag

SEQ ID NO: 21724 - DNA, 201 bp, Homo sapiens
gtccctttgccctactgacaaggttgtttatagtccctagttttgttgatagtgtacaattgcagattttgagaaaagaggcattgatttttccaacttargacttttctttttcctttataccaaaccagcttctttttttcttgaaaatataagaaaccttattttactaggacaattttttgctcaataaacaaaact

SEQ ID NO: 21725 - DNA, 201 bp, Homo sapiens
aaggtggatcagtacctcggacagcgccaggaagacacagttatcctaagctctggtaaggcagaactgtctggctctctggaacttttagctgttagggkaccttaggactctttaatgtcaacatggtcctcagggactttggatctctgtttctggaggacacctttgttttctagcctgggtgctggacctccttct

SEQ ID NO: 21726 - DNA, 201 bp, Homo sapiens
agtgatggtagtggtggctccgtttttcaatggcctatgtgacacactaggcactcatcatccttgttctttactacaacatggtaaagtgttatggcatrcttcaacttgcaggtgaagacatagagaggttgaaatattgcctaagagaaaaaacgtgcaaatcacatattttataatgaatttctgtccagaacatat

SEQ ID NO: 21727 - DNA, 201 bp, Homo sapiens
gtgggaggatggcttggggccaggagtttgagaacagcctgggcaacatagtgagaccctgtcactgcaaaaataaaaaattagccaggcatagtggtgcrtgcctgtggtcccagctacttgggaagcattaggtagcgttcaacatgtccatcatccatgaaaagtggtggagcactgactggttgcagaaagtcaaga

SEQ ID NO: 21728 - DNA, 201 bp, Homo sapiens
aacaattcttagcccctgagacagtagggtcactggagagctgggctgtgacaatgggcaccctgctttttctgctgcactgtgcagaaggaaggaggccragcctcgatatccgtaatcacaaaaggtgaggcttgctgagctgcaggaaacataggcaacacagagatgttcaaaaccaacaaaagccacccatgatgg

SEQ ID NO: 21729 - DNA, 201 bp, Homo sapiens
ggtgggacagggttctgggcggtggagggtggatggagggacctggaaaaggaggcaggggctttgaggaggcccgggttaatggtagggaatgccagcamggggagatggctcagtggtccccatgtggatgggcagattctcaggctcctcctcttccctgtgagctggcccaggtgcggccgggttgtggtggctgag

SEQ ID NO: 21730 - DNA, 201 bp, Homo sapiens
ttgagaacagcctgggcaacatagtgagaccctgtcactgcaaaaataaaaaattagccaggcatagtggtgcgtgcctgtggtcccagctacttgggaarcattaggtagcgttcaacatgtccatcatccatgaaaagtggtggagcactgactggttgcagaaagtcaagagggtcactatttcattagtgctgcaca

SEQ ID NO: 21731 - DNA, 201 bp, Homo sapiens
tctgaaatgactccagctcctgctttctggccacatctgtaataatatctgtaataatttcccctgcctcaccttctgtactgtcaggttcagattgcaaygatgaagtccgctcccactaacttaatcagctaaaatgacggattgttaagacactaggcaggtcacagagtcaatgggaagtccagagaacaagattaa

SEQ ID NO: 21732 - DNA, 201 bp, Homo sapiens
ctgggcaacatagtgagaccctgtcactgcaaaaataaaaaattagccaggcatagtggtgcgtgcctgtggtcccagctacttgggaagcattaggtagmgttcaacatgtccatcatccatgaaaagtggtggagcactgactggttgcagaaagtcaagagggtcactatttcattagtgctgcacaacctgccaggt

SEQ ID NO: 21733 - DNA, 201 bp, Homo sapiens
tgggcaacatagtgagaccctgtcactgcaaaaataaaaaattagccaggcatagtggtgcgtgcctgtggtcccagctacttgggaagcattaggtagcrttcaacatgtccatcatccatgaaaagtggtggagcactgactggttgcagaaagtcaagagggtcactatttcattagtgctgcacaacctgccaggta

SEQ ID NO: 21734 - DNA, 201 bp, Homo sapiens
gaactaggaaatcagaaataagaccatcttctgcaagtcatcactttagccaacacacaatagatcctcacagacatgcacaaagttacgttaaagagaartgacacaatgggatatttagaaggactgagaagtggaagtagaggtttgtctgcccagaagaaaagacaaaggaatttcagaggccaatgttggccatgt

SEQ ID NO: 21735 - DNA, 201 bp, Homo sapiens
gttccaggtagtccaataggtaccaaaagggaattttaagtggaactatttattcacagagtggtgaattgacatgagctgtgtcatgaactccagaactkccaaggttgagggtggaggaataggggaaaatgaccatagagaggttaggagtgaggaatgacaaggtcctatttgcattctgattctctttctagttga

SEQ ID NO: 21736 - DNA, 201 bp, Homo sapiens
atacaggattgggggtgctgtgtgtttcaaatatcatcatatcaagaagcacatccacaaacctttcactgcgattcatggttgagcatccttggccatgygaggttgtaggcagaggctctgtggatgtgagcatagaccttgtggggaggtggggagaggattcattggttgcatcaaattcccaaggaggtgttagaa

SEQ ID NO: 21737 - DNA, 201 bp, Homo sapiens
ggcctgtggcttggtcctcgtggtgagccggcctcattgtctcttttctgctcccatgggctggtgggtggggggcacctgaaagctaagcacttattccyttagccttccttggatggcaggggaccctccagggcctgtgcattttggcctaaacatatggactagcaatagagagggttcagcaacttctccaagacc

SEQ ID NO: 21738 - DNA, 201 bp, Homo sapiens
tattataaatcatgttgaacatctttttgaagcagtcatttctttctaacgaattattttctcagaagaagattattgggtcaaagagtgtgggcattttyatggtacttgcaatggtaacgccaaattgctttcgaaaagatcatttcctgtcagtgtgcaagaagattggttttaccacaactcaacaagcatttgatg

SEQ ID NO: 21739 - DNA, 201 bp, Homo sapiens
gccctggcttgagaatcagactggcctgggtttgagtccttctcaaagggccctggctgggtaacttgcccttgatttcctctgtcaggtgggcatgatamcccctcgatcagggccgcatgttgaattgctgccacctgcccccgccccagaccttgctgtgctgtgtccgtgtgtcatgggctcagggcatggtgctag

SEQ ID NO: 21740 - DNA, 201 bp, Homo sapiens
attctcatgagtgcacaacctagatctgtcgcatgcttaattcacaatagggtttgtagtcctgtgagaatcaaatgccgatgctgattgaacagggggcrgagctcaggtggtcctgctcactggcctgatgcttaccacctgctgtgtggcccggcttctaactggctatggactggtacctctattgggttcaacagg

SEQ ID NO: 21741 - DNA, 201 bp, Homo sapiens
gttagatgaaaatcatgctttcttttcccttcctgtagaacagcggtctccagcctttttggcaccagggacagatttcgtggaagacaatgtttccacgsaccagtgggggttgaaggctagtttcaggatgaaactgttccatttcagatcaccaggcactagttagattctcatgagtgcacaacctagatctgtcgc

SEQ ID NO: 21742 - DNA, 201 bp, Homo sapiens
tgcccagccctgatgtccaggcaccatccgtttctgtatgtcctgcagatgttggataatctgtccctgtaactagaacgtgctgcctgtaggccagggaytgtgtgatgttcaccattttatttcctgagagcagcatgggaccttgtctacagtagtgttgaaggactaaatgaatgggaatttaatatttcttacttc

SEQ ID NO: 21743 - DNA, 201 bp, Homo sapiens
gctggagctgaggctgggatgtcagcagggagggctccctagcctggggcaggaaatccagacttcaggactgatgtgttcttggggtccttttcagggtrttagaggttaacgccctacagtttacatgtcttattgttgttcttctccaggtcaggcttgatggggagaactccagtccacagtcatttggccctgggc

SEQ ID NO: 21744 - DNA, 201 bp, Homo sapiens
aggcattgaacaggattcaagtccggattttactccctccagagcccctctcttccatctgtgatgattccaggaatatcagtgtacagcactgcacttgytggagtggggaaatagggcatgctggcttcatcggggaagatatggttccactgtctctggccagggtttggcagaggttctcagggtgcttatacgcaa

SEQ ID NO: 21745 - DNA, 201 bp, Homo sapiens
gaggggaacgatggcatttggactttgggccaacagctcccaccgtagtcttcagtctccgccgatgataagagtcttgatccctgttctcatgcgcctgycattagtagggaggaagctgaggtttcttgggtgcccacgatggctctggccctttgtgcattctctaatcctcacactttgcagacagaggaaatggaa

SEQ ID NO: 21746 - DNA, 201 bp, Homo sapiens
accagaccctttttagttggcttatcattgaatcttatagcaggtaggaatgactgtccccaccttggagttgcaaaagcaggcttggagatttcagtaasatccttaggttcacacagtgtgtttggatggagctagaatttgacctggttcagctcaaccaccatacatagtacatggaccaacttcagctcctgttcc

SEQ ID NO: 21747 - DNA, 201 bp, Homo sapiens
tccattatcatatatatgatttacaaatatttttctattagcaggttgccttttcactctgctgatagtgtcttttgatgcagaaaagtttttaattttgwtgaagtccagattatccctttgtctcttgttgcctgtactttaggtataatattcattgccaaatctaacgtcataaagctttcctctatgttttcttct

SEQ ID NO: 21748 - DNA, 201 bp, Homo sapiens
gttttgcaattatttgataatgcagcaaaagataattaaaatggttatagatttcactttacagatgaaaaatctgaagttcaaagaggccataaaacttkcctcaaatgctatagctagatagtaacagatgcagaaatggaatcaaggagtgggagtgcagaggagcactctaaccaccatgctctactccctctgttg

SEQ ID NO: 21749 - DNA, 201 bp, Homo sapiens
ttctctcactttggcctcccaaagtgctgggattacaggcatagaacttaaaacagaattaccattcgacccggcaatcccattactggatatatacccaraggaatataaatcattctaccataaagatgcatgcatgtgtgtgtttgttgcagcaccattcaaaatagcaaagacatggaatcaacctaaatgcccatc

SEQ ID NO: 21750 - DNA, 201 bp, Homo sapiens
agctcctaaaccacagccccaccaacttgccagccatgtgagtgaagtcaacttggaaagaaattgcccacccctagtggttttccctggctgatggcacrtggagcagagatgagctgttgtcaaactctgtccaaactgcaaaagagtgagcaaataaataaaacaagtgaaagtgattgttgttgtaagctactaagt

SEQ ID NO: 21751 - DNA, 201 bp, Homo sapiens
aagagcagctgcattcagcacctgaccagactctagggttttaagggtgcagctgcccaaggactggtccagaatccaacagtaaatgtctatggtccatyatactgggatgcctggaaaggagcaccagggttgcagggagagggaaaggccctcagtgacctcaaggggcagccaggaacaaggtggaagacaacacct

SEQ ID NO: 21752 - DNA, 201 bp, Homo sapiens
ggacgtgcagtaaccgtccatttaccgtggggtgcaggtggttgtgctggtaattagaagggacatgactgccgcctcctgttttcagagcctgtgagagrctgccttgatccttgagaagtttggattctctggggtttgctgacttctctgtggctcttcatagtccagttttctttgttccaaagaaacgatgcattc

SEQ ID NO: 21753 - DNA, 201 bp, Homo sapiens
tttctagcttcatccatgtccctacaaaggatgtgaacacaacattttttatggctgcatggtattccatggtgtatatgtgccacattttcttaatccartctatcattgttggacatttgggttgtttccaagtctttgctattgtgaatagtgccgcaataaacatacgtgtgcatgtgtctttatagcagcatgatt

SEQ ID NO: 21754 - DNA, 201 bp, Homo sapiens
tggagtcccaggactccgtatctagtcctgaagggctctgtggggtcaaaagggcctggagtgttgggtgtctatgcccacctaggctctgcagacagctsaaggcttggagtaagcttggctgtatccacagccttgtctccagcctaagtttccaccagccttatgctaaggcattgatccatggtaagtcagcgattg

SEQ ID NO: 21755 - DNA, 201 bp, Homo sapiens
ttccgaactcattttaaaaatagtttcccttggaaattaaaaccattaaatgtacataattatgcagatcagtattcatgctttaaagaaacatgatttcrccttcacttaatttgtttctccaagacctaattatggattagatataaaaaaatattattttccaatcactgtgcaaatcgccttttaccacccaggagg

SEQ ID NO: 21756 - DNA, 201 bp, Homo sapiens
cctgtaatgccagcaccttgggaggccaaggcgggcagatcacttaaggccaggaattcgagactagcctggccaacatggtgaagcaccatctctactaraaatacaaaaattaactaggtgtggtggtgtgagtctgtaatcccagctacatgggaagctgaggcaagagaatcacttgaacccgggaggtggaggttg

SEQ ID NO: 21757 - DNA, 201 bp, Homo sapiens
tgtcactcagtacagctggactagacaagcccccataaatccctcgttccagtttcctgattctgtagcctggagtaatgataacactcatcccctaagcrcccctgcagaaaggtgtttgcaggcattcctagggaaggggggctgtgcctgtgcctgtgcctgtgaccctgtgctgcctgcaggaacccaagcgtctaa

SEQ ID NO: 21758 - DNA, 201 bp, Homo sapiens
ccagaccacagcacaaggttgaaaggaagctagattcctgctgatgctctgtcctttccagagcctgaaaaacatcctcaacagaaaagagttaatataamtaggaaatgacaaatgcttcctaatgtgaaagatctctgaaatggaaatgaagggatggagcaaggcaagaaaggggtagacatgctttcctgatagaac

SEQ ID NO: 21759 - DNA, 201 bp, Homo sapiens
tgagcaaatgtgtatcaggcacctgacaagtcacctggctcacaacaggcactcacttcttcccacgctccaaactgagttgatcacttgtgcattgttaygacttcaagacagggggactttcttctcttccccattgccctctctcttcctggtttctcatgtctgtgaaagcctctgtcgcttttttggtcagcaggt

SEQ ID NO: 21760 - DNA, 201 bp, Homo sapiens
tggaaaccatcagtctcttccaattcttccaatctgttggcttttcaattgaaggagagggaaagcactcataaacacatacaggaaacaaaataattaaytgagttctgtctgccttggccttccacttcatttgcataatcaacaatgtttgctgaatacctgctgtgtgctggttacagctattgggacacagctgtg

SEQ ID NO: 21761 - DNA, 201 bp, Homo sapiens
aatataaataggaaatgacaaatgcttcctaatgtgaaagatctctgaaatggaaatgaagggatggagcaaggcaagaaaggggtagacatgctttcctratagaactagaggctagataagaggttgcacccacagaggaggggtctgaacctaggagtgggattggaggaaatgctgagactcaaggaaggaggaggg

SEQ ID NO: 21762 - DNA, 201 bp, Homo sapiens
atgaagtctcagtttctggagaaggacgtcactcttgctctgaccacaggaggactttgcctgtttgctgtccacccctccattatccctggatgctgtgstctgctgcagtttcccagttgccagaaatagtgtggggtttgtagtcttatacacatagttgcaaatcctagctgtgactttggactaggttttaaccct

SEQ ID NO: 21763 - DNA, 201 bp, Homo sapiens
ctataaattttcctcttaccactgctttagctgtgtcccagagattctgtctgctatgttatatatttattttcattagtttcaaatcatttcttgatttrttgcttaatttcattgtttgcccaaatggcattcgggagcaggttgtttaaattccatgtaattgtatggtttttgaatgattttcttagtattgatttc

SEQ ID NO: 21764 - DNA, 201 bp, Homo sapiens
cctgaggcaccccatttcatcttgaatgacttggaaagtcagaaagttgtctcctatattgaattgatatctgcctccctgattatgggagccattggctstaggtcaacactcagaggatgcatagagcaattccaatctctcttgcacatgacaatttaaagacacctatattgtcccacctgtaagcatccctgatca

SEQ ID NO: 21765 - DNA, 201 bp, Homo sapiens
gaggcatgagctgctgcacccagcctgtatattaatatctagcaatgttgctaaacttacttattggttttagtgcctttttttaaagggtagattccatmaaattttctaagtaaatgataatgtcacctgtgaagaaagacagttttgctttttcccaatttggatgatttttatttcattttcttactttattgcaat

SEQ ID NO: 21766 - DNA, 201 bp, Homo sapiens
aagctttacctctcacaaatggtcaaccttcttagaaaacacggcactgtaaagagagcactgctcaccttctgctcaggcacttcctgggatgggacgtygctactcctgaggcaccccatttcatcttgaatgacttggaaagtcagaaagttgtctcctatattgaattgatatctgcctccctgattatgggagcca

SEQ ID NO: 21767 - DNA, 201 bp, Homo sapiens
gttgaattgctgccacctgcccccgccccagaccttgctgtgctgtgtccgtgtgtcatgggctcagggcatggtgctagcattgatggaatggtcacttygcatcagccttggagatgagctgatgtggtactcattcccacggagctctctgtttggtgggggaaccaacacagaaacagagacttagcgctgtgtgat

SEQ ID NO: 21768 - DNA, 201 bp, Homo sapiens
gtgtcatgggctcagggcatggtgctagcattgatggaatggtcacttcgcatcagccttggagatgagctgatgtggtactcattcccacggagctctcygtttggtgggggaaccaacacagaaacagagacttagcgctgtgtgatcttgcaccagctgagatgaacagagagagtggtgttggggacagcagcccag

SEQ ID NO: 21769 - DNA, 201 bp, Homo sapiens
cagccttggagatgagctgatgtggtactcattcccacggagctctctgtttggtgggggaaccaacacagaaacagagacttagcgctgtgtgatcttgyaccagctgagatgaacagagagagtggtgttggggacagcagcccagggcagcccaacattcaggagaaggtgtctggagggcttcctggaggtggatgg

SEQ ID NO: 21770 - DNA, 201 bp, Homo sapiens
aacttgtttaagtaaaaaagggaattcgttttagcttatatgacaaagtggtccaaggatgggctagcttcaggcatggctggatctagcggttacgcctyctgctcttgctttctctttcttgctccctcgcggtgtcttgtttctcttcttctctcattggcttgactcttaggaatgtccttcccacccaatgacaaa

SEQ ID NO: 21771 - DNA, 201 bp, Homo sapiens
atctacttccgtgcctccagagctgtcctgtgcatccttctggacctcaccttctcagcctttagggtcctgctctgctgtgctcctcaagtccctacggmactgcctggagtcacgtgtctgcctccctgaccagcctataagagcatggctcataggagcaacaccaggtggccatgtctgtggcccaggatcttgcag

SEQ ID NO: 21772 - DNA, 201 bp, Homo sapiens
tggcagggcaggactatgatgaaatcctgcctctatctgacctgattccaggatcttgacaatttgctgagccactgagaagtgtttcctatctgcctcgygatgccacggagaagccatttgtggagcgcatcctgtactgcaaattcctgcctggcttctcgtggcctcactcgtgggaggacgcagggaattcgtgga

SEQ ID NO: 21773 - DNA, 201 bp, Homo sapiens
cccagcctaggctggggttgcacctctgcttttctccatgtctgccaatcttgtgctctgtaaactagtgcctggacaagcccagctctcaggaccattgrgctagtcatgaggtaaagattgggttctctgcccagccaccgacaggaccagcacccatgacctccccctgtccccgtagctggactttggcaagtctgc

SEQ ID NO: 21774 - DNA, 201 bp, Homo sapiens
cttttgtggtagcaaataccctttggagacacacttggacaggttattcttcccatttatcaaatgggaaagctgaggcctacagagataacatgaccccractgtgctcttcatccaaagcttttgctgtctcattgcttgaatacttgtggagagagagaatggttgacagtagggccatgggcctgcctggttcagca

SEQ ID NO: 21775 - DNA, 201 bp, Homo sapiens
tgcaaaagtctgctcaggggatggctcttcttgcagtatttccccagctggattctgtactggtgatggtatcgactaatctcatcgctggccccctcccktcttgcttcttgccaattccttgcccgttccccttgcttcctttccttcttgctctgctgtgaagcttgggggtggaaagactattggctttggagttga

SEQ ID NO: 21776 - DNA, 201 bp, Homo sapiens
aaggaccccgacaaaagctgaacttacctgtgtcttagccgccacttctcttgacctcactgctctggccacattggccttttccccatctctccaacaasccaagcatgcatctaccctggggcctttgcacatgctgttcctactatctggaaggctctttgcatgctgggccccttcttggcctttggctatgcctct

SEQ ID NO: 21777 - DNA, 201 bp, Homo sapiens
tctttctcagaatatacccagctgtgtgtttgcaaaagtctgctcaggggatggctcttcttgcagtatttccccagctggattctgtactggtgatggtrtcgactaatctcatcgctggccccctcccttcttgcttcttgccaattccttgcccgttccccttgcttcctttccttcttgctctgctgtgaagcttgg

SEQ ID NO: 21778 - DNA, 201 bp, Homo sapiens
cacttgggctaataatcagtgtgaatttcttttaaaaacatctctgttcgaggttggagccttctaatgaagacagggcccatcagtttaagaatccattrgttagtaaagaatccattcatttgtaaagaatccattaatttgagaagaaactagaaataacctatgagttggctgattggcgctggcccaggtagtcta

SEQ ID NO: 21779 - DNA, 201 bp, Homo sapiens
tcggcccacagcactcagcctgtaaggggggattctctgagcactacttggctcctgatagttccctgacaggtgagtcaaggcctgcccagcctctgaaragctgtggggaggctggtggaagcctgtttacaagtcactgacagagatttctgaggcaagactcagcccttttttttttctttttaattttcctctctt

SEQ ID NO: 21780 - DNA, 201 bp, Homo sapiens
gaattgccgtgattgggcccatatagggaaagaaagagagcttgtcatgaatcaagggcactttctggccatagaacctgttggatggcatccaacctgtrgggggagacagtcagccagggctggacactggtgaacgctgctgggtctacgccggcgtcctccaacctctgtttacgggaatcactgaggctgacttgg

SEQ ID NO: 21781 - DNA, 201 bp, Homo sapiens
ttcgggagaaacaggcttcagcctcacatgcacccaggggctgaaaatgacattgtcaggaccgtgtctcactctcagacccgcctgcctctgttcctggkcatgtctctttttgggaaagccaaatggcttctacaaggctgctgctaagagatgattttggcactggatgaaaaaactttagcaccctcaggcctcaca

SEQ ID NO: 21782 - DNA, 201 bp, Homo sapiens
cccgtactcccaggtgcaggctcctgagacacaagcaggtggcctgcacaggaagtgtggttcttcagagtcccaggaaaatggtagttggtgattttcaycccattttacagacagcccctcaggctcaaaagggatagtgatttgcctgagggcttcagagactgtactgagtcctaagtgtcggagttcgtggcaggt

SEQ ID NO: 21783 - DNA, 201 bp, Homo sapiens
ataaatcaaaaactagagtcttaactggatatgtatttcatggtctgattttaatgaaaacacttgtctgatatctatttgtagctatttacttgcggagrtaactgtaaaatcttctagaaggtgacacctcaaacaacatttagagggtaaatttggagggataaagggggaattttcactatgtcagcatattttttt

SEQ ID NO: 21784 - DNA, 201 bp, Homo sapiens
tacagttccggagcggttttattgaattcaattgagctgtgaatttgccagagatcagattgaagctctggctggatgcagagccaaggtaggtcacctayagcctgcagcctgcccacctgtgccctttcctgctcctccaggccccagcctgccagtaatgagggcaaggatcaccaggctgccagcaacaggcccgca

SEQ ID NO: 21785 - DNA, 201 bp, Homo sapiens
tattagatatgcatattaaaatatctagcataaccaataaaagataacatagaaaacataactgccaagggtaggtaaataagtaaagataggaaacaaawcattttaaagggaaacaaacaaggaataaagagaaaactccaaaatgtataatataaataatgttatagaaatcaatccaaatatataaataatcataat

SEQ ID NO: 21786 - DNA, 201 bp, Homo sapiens
tgcgaccactgcctcccatgacccttctgacctcagacttggaactcaagaacctgaggattccagcggtcagtgtcagtggggggtgggaggagagagcrgcagagaagctctgagagccccttcccacaacaaatctagttctagttgttatatttaggcaaaactttgtagtcttctttcccttttatgatggatttt

SEQ ID NO: 21787 - DNA, 201 bp, Homo sapiens
atatagtgcagccaggatttgaacctatatcttcctgattatgaagaccaaccctcctaaggtgggaagaataaatgaatacacatcacacatcacagatkgatgaaaagcacctgatatatgtgggtccttaatacatacaattcttctccagtctccccatcctgtgatctggccttccccaagcagaatggttcttat

SEQ ID NO: 21788 - DNA, 201 bp, Homo sapiens
aaaaaaacaaaactgaggcacttcacttagaaactggggtcctgcttataatcatgcatataacctttactttgatggatctggccagaggggtgttggascccagccctcccacataccagacaagctcttaggggagcagaagaaaagcaggaagaatttaaatatttaatttttttaattgacttttctagttattaa

SEQ ID NO: 21789 - DNA, 201 bp, Homo sapiens
gatatcaagattttgctattgtgaactgtgttattatgaacatttttgtgctgcttcctgctgtacatgtgcaagagtttctcttggagtggcgctggatygctggggacatgaatatttaaattaaaccaaaaaactcccaaattgattgtatcaatttattcttctaccagcaaaatatgggagatgttcttgatttac

SEQ ID NO: 21790 - DNA, 201 bp, Homo sapiens
gaaattaataaagttggggataggattgggggtgatggtgtgggaggaggataggctcatagaagtgtaacttatatgagtttatacaattgctacatttygccaacttggctctacatttcctagcggtcaaagtaaaaagggaaatattagctacaactttcataagacaaatagctgtgcctgagtggcccagcttct

SEQ ID NO: 21791 - DNA, 201 bp, Homo sapiens
aaagatccctatcccaaactcctttaaaggtttctatagaatttagggcaaagactggaatcttgatagccttcatgattcatctgccgcctaattttgcrcatatttcttctgccttatttttttctacacaaacacatacacacacgccttcacaccttcaactcattacttttttttttttttttggagacatagtct

SEQ ID NO: 21792 - DNA, 201 bp, Homo sapiens
ttttctgctgcccgtggagaggagctgagccttgctgggttcctctgaggttagggcatcaggttgtttctccccaggtggaggctctctcttgcctcatscatttggaaatgtcctgctgttctttaaggtggcacccaggggccagctaacacaggagctgccggttgagggggcttgggacctcagagttgcaggggc

SEQ ID NO: 21793 - DNA, 201 bp, Homo sapiens
cataggtaaaatgagggaattgaaccttggagagatttgagttattgtctcaaacaaatgttttatcacacatagcaagtaagtggttggggtcaaattgsaaaccaggaatacttagcagcaggtccaatactttgtgtctgtaacctttgatctctgtagttacatgtgtgtaacttcttcctgggatttcagactatt

SEQ ID NO: 21794 - DNA, 201 bp, Homo sapiens
acctgtggcctgctggatcaggggccattagagccagagcctctgtccggagtgcagaatgacttggccctgcttcccaggcagatggctgtgccctgagygtgcagagatggtgggggtcaagagggcatttctgacctcccaggaaccagcccgggccccctgcctccctcctgggagacactatcttcagatttccag

SEQ ID NO: 21795 - DNA, 201 bp, Homo sapiens
tctgtgatagaaactcccccaggcaactgtgtgaccagagaagtggagacctgtggtggcctctctcctccgtagttcttgatatgattgcccagtctggrttggggtagggtgggtggtggttctgggatggggcgggactgtagggtgaggtcaggcagggcctgaagccaggtttaggaggcaggggcaagttgggct

SEQ ID NO: 21796 - DNA, 201 bp, Homo sapiens
atattttgcttcccctggagttgctgactgactttttggtggttcggggctttgcttgctatgcatctctcctcatttcatccccgcactctcagctgggygtctgagtgtccccttgctctgatccttgctcagcaactcctgggctttccattccgctgcttggctgcttgaccttctcccctggagcctcccaactgc

SEQ ID NO: 21797 - DNA, 201 bp, Homo sapiens
gtgcagagaggtttccaaacagaaattgcctctaatggagtctctttgagtagagcaggggtacctggtaacaactgggtcctactgcttggatcaggggrctgcatggaggctataaaggacaatgtgttttctcagagcagtgaaatcagcccgaccacagggacaagtgtgaattgtggttgaggcaggaggcagagg

SEQ ID NO: 21798 - DNA, 201 bp, Homo sapiens
ttaaaaatggcttctgccaaattgtcttccagaaagtggaatcaatttgcacacccagcgacagggtaagaagagcacccactttttcacattcttgccarcacttgatattatcagtcttaatttttgtcagtccaatggctgataggcggtacctcattgttattttcttttccatttccctaattactgtgagccttc

SEQ ID NO: 21799 - DNA, 201 bp, Homo sapiens
gagggaatttgatagagtagaaggaggagaggaggaggggcagcccctgggcaccctggacagcagatcctcctgaaagccatcagcagtgctttcaccaygctccctgtcctcgtcagcaacttctgcagacaccaggattgcccacctcccagattatctcatggaagcctctgaggcagctgctactatttattggaa

SEQ ID NO: 21800 - DNA, 201 bp, Homo sapiens
cagttttggaaaggaaagtgaggaggcagtttaactgccagtgattggaactaggatgcagtttccagcagccctagaggccagcttgtcagctactgagrcaatgaggggctgaaccttctgggtactttcacgcctgatactcctcttactcaagaattgctgaaaagcccactgtgtgaggcccatggggatctgaac

SEQ ID NO: 21801 - DNA, 201 bp, Homo sapiens
gcacttgctgtgtgcctggtcacactgcccagagaagcagagaaagaagatggagaataaggacaggttatacatgtctcttgatacttacccatgtgccyggaattctattttcagttgttattcccataggtaaaatgagggaattgaaccttggagagatttgagttattgtctcaaacaaatgttttatcacacata

SEQ ID NO: 21802 - DNA, 201 bp, Homo sapiens
tgcaattattattattttaataacagttattgttgttataaaaatgtaaaaaccaatacaacaccctggtacaaaaggctatctgctgcccttcccctccygcaccccacacctgtcagagtaccctcctgggagaagcacgtcttctgttcccatagaaagtgcttcctttgtcctctccacccaaatttaagcatcatg

SEQ ID NO: 21803 - DNA, 201 bp, Homo sapiens
tcacagcattgttgagcacattatagtattataataaaaggctcagctggagggaggagacacctgttcgccaaggagtctctcctgagattcttaccagraaacccagagaagcccagatagggagttaatgccttttaaaaatttgcttggcttccatttgggagattaaggccttaaatcacacctgcaattgcaagt

SEQ ID NO: 21804 - DNA, 201 bp, Homo sapiens
aaccagaaaccacttgtacctgaaaagctattgcaattttcaaaaatgtgaaaaaatgaattaaaaaacaaccaaaaagggctgggcatggtggcacatgyctgtaatgccagcaccttgggaggccaaggcgggcagatcacttaaggccaggaattcgagactagcctggccaacatggtgaagcaccatctctactag

SEQ ID NO: 21805 - DNA, 201 bp, Homo sapiens
atatgtatacatgtgccatgttggtgtgctgcacccattaacttgtcatttacattaggtatatctcctaatgctatccctaccccctccccgcaactcaygacaggccctggtgtgtgatgttccccttcctgtgtccaggtgttctcattattcagttcccacctatgagtgagaacatatggtgtttggttttttgtc

SEQ ID NO: 21806 - DNA, 201 bp, Homo sapiens
ggtatatctcctaatgctatccctaccccctccccgcaactcatgacaggccctggtgtgtgatgttccccttcctgtgtccaggtgttctcattattcarttcccacctatgagtgagaacatatggtgtttggttttttgtccttgcaatagtttgctgagaatgatggtttctagcttcatccatgtccctacaaagg

SEQ ID NO: 21807 - DNA, 201 bp, Homo sapiens
ggtggtgcaacactgcggctgtccagttcaccatgtggtgtgccatgagagaggtctgtagtgttctggggcaatctaagcatgaccccaaaccatataartgcacatgtatcttaacaactaagtcactgaatgcacagccacattctgtgtcttacatgctgatcagtgccctaagcacttaaaggacattatatcaat

SEQ ID NO: 21808 - DNA, 201 bp, Homo sapiens
ggttttggattggaagagggtttggtgataggcgggcaagttcccggacgtcattatatcttgtgccaaggacctactgaactgagcctaaagagggagayttccctgccacggagactcccctggtggctcttcctgcccctgtgccacacttcaagttctggggagtggggatctgaggaggggagctcagaggcctgg

SEQ ID NO: 21809 - DNA, 201 bp, Homo sapiens
aggaggagggacttcagtacaacctttgtgtgctaattggacaaatatacttcagaaggaaggacattgaaggctattgatcccattctacttattggacsttccttagatggttctttgacggcagtgaccatggaggtcagaggccacactgctagcaattcaagtcccctataaagatcactgggagaacaaaagctg

SEQ ID NO: 21810 - DNA, 201 bp, Homo sapiens
actcctggggaaaggttgtcactggggaaccatctaagtgcatctgttttcacttagatttgttatttttattcctaaatttgatttccttttcatactaytgtaaatggaattgtttcattaattttatttttattttcatgatagtatatagaaatagagttgatttttacatattgatcttgtatcctgcaaccttgc

SEQ ID NO: 21811 - DNA, 201 bp, Homo sapiens
aagagaaatgtacctgtaatgtggcagtagtcaatgtggagactttaaaaaagtagagtcagagaagcagaatgtctccatatttatttgcacgtggctgkatggggcctctgattgtagggcagaactttcctggtccaaggagatgctgtctgctggggcagggaagggatgtggccttagccaggaagggtggaagtg

SEQ ID NO: 21812 - DNA, 201 bp, Homo sapiens
gggccaggctagctgctcagaaaggatgagtagcccaggtctgtccctgcccagtgtgtggccaggggagcctctccgtgcccatgccacttgtcttgcttaagtgtggctaggaaggaaaaggctgggcaagtgcagctcctgcttggctgatccaggccttgatggcagatagctatgttcagagagtttcctgggggc

SEQ ID NO: 21813 - DNA, 201 bp, Homo sapiens
aaaggcacagctcccagatatgtggccggacatcatcaaatgaggtaaatgcagtgtcagatccaggaaccctgggacactatgcctccctctgttcctgstgagacccaggcattgcataaagagcaaagctgaagtgcaacactacaggaatcttgtagtaatagcagcaacagtaaaagaggaatcaagtcacctggg

SEQ ID NO: 21814 - DNA, 201 bp, Homo sapiens
actttaaaaaaaataaatgagctgtgtcatctgcaaatatagatagttttacttcttcctccctatttccttctagatgttttaaaatttccttttcttgmctgatttgcatgactagaatctccagtacaatattgagtagaagttgcaaaagtggatatccttgtcttgttccttgtcttaggggaaaaacattgagtc

SEQ ID NO: 21815 - DNA, 201 bp, Homo sapiens
tttacttattgactttctgcctggatgatctttccattgttgaaagtggggcattgatgtccccaagtattcttgtatcgctatttctcccttcagttttktcaaaatttacataacatatttatgtgttgtaatgttgagtgcatatgtgtatatgtacacatgtgtctattttgttggatataagtatagtcaacctat

SEQ ID NO: 21816 - DNA, 201 bp, Homo sapiens
tgaataatatcacattgaatgtatatatcatattttatttatccattcatctatcagtggaatcttggattgctttcacattttagctgttgtaaatactrccgttataaacatgggtgtacaaatacctgttcaatgcctgcttttaattcttcggtgtatatacccagaagtaaaattgctggatcatatggtaatcct

SEQ ID NO: 21817 - DNA, 201 bp, Homo sapiens
gcttaagcttatatgtgcaccatctcacaaaaagaaataagcttttaaaaagttggatcatactatatataatgttatgtaatctatttttccccccacayaccatggagctatttgcagttaaaactgtacttatattcttcctaaacccttacaatgatgcatctagttctttgagatcgataattttttggccacttg

SEQ ID NO: 21818 - DNA, 201 bp, Homo sapiens
gcagtgtagaaatcttgccaccatttagttccctctacgttcatcaaaaccttatccaactatgttataattttttttttttttgagatggagtctcgctytgttgcccaggctgtagtacagtggcgcgatcttggctcactgcaacctccacctcccaggttcaagcagttctctgcctcagcctcccgagtagttggg

SEQ ID NO: 21819 - DNA, 201 bp, Homo sapiens
cgaggatcttggcatagatactgggcaccacagcttaatgttggcatcctgcattcctcctcctttctgtgggtttctccaaagctctctagaaatgcacytgtggaaagggtttcactgcctctgtctttgcagatctccaacctctatctgtatgacagtgttctgatgctggccaacgcctttcacaggaagctggag

SEQ ID NO: 21820 - DNA, 201 bp, Homo sapiens
tggaggctgagaagtccaagatcaaggtgctggatctgacgtcttgtgagggcacttttcctggtttgcagttggccatcttctctcagtgtgcgcacctsgtggagagaaaaagatctcgagtctcttattttcttataaggccactaattccaaccaggaggtctctgcccttataaccctaattacctcccaaaaccc

SEQ ID NO: 21821 - DNA, 201 bp, Homo sapiens
ttgggttccatgaggcctttgatcctgacatcctcttggtctggaatactccctctcttgtccatgcagaaaatgcctcttcatcctgcaagttccaactscccactctctgaaggctttcttgagaccttccctctgtctggagaaacaaaccccttctcgtgcactccctgctgttcctagtacatcctcaaacactgt

SEQ ID NO: 21822 - DNA, 201 bp, Homo sapiens
attgtgagtagtgttgtaataagcatagataaacataggagtgcagatattccttcaacataatcatttttcatatatagaagaaaacagttctaaacttkgtatggagctacaaaagatcccagatagcaaaagcaatcttaaacaaaaagaacaaagctggaggcattacactttctgacttcaaagtataccccaaag

SEQ ID NO: 21823 - DNA, 201 bp, Homo sapiens
atcaaatcagcataattagcatattaattacctcaaacatttgtcatttctttgtgatgagaacattcaaacttccctcttctagctattttgaaatatayaacacactatctttaactgtagtcaccctactatgcaactgagcaccagaagtcattactcctctttaactaattttatacccaataaacaacctctgcc

SEQ ID NO: 21824 - DNA, 201 bp, Homo sapiens
tcataatattgtttgtttgttgtcactctttatttctctctctctccaaatcaataatcccagaggtttgcctattttattattctttttaaataattgasttttatgtatattggagtctttctattttaacgaaacagctcaaactctgtagccagattctggctccagcaattactagctgtgtggttctgtgttaat

SEQ ID NO: 21825 - DNA, 201 bp, Homo sapiens
taaaatggctctgggtctctgggaactccaggggactactgttcacctacctgcctaattcaggatcccagtgtaggagccgaggtcctatggtgtgcacrggtgccagttccatccctcacaatctttatttttccttcacagttggcgacatgggactcagagaagggcttgaatggcagcttgcaagagaggcccatg

SEQ ID NO: 21826 - DNA, 201 bp, Homo sapiens
ctccaacttcctgggaaagaggatggcactaaccctgtccagatcttcagagccaccgtaaatcacttccttaaaaatcccaaacttgtgtgtaattatgkgactatgtaatgaagtcagaagtgggtaggattgatttgtcaggtgaattaatctccacagcaagtggaggcacatgggggcacgaggcctgtcacagcc

SEQ ID NO: 21827 - DNA, 201 bp, Homo sapiens
tgtgtaactttttgtaaccttttttttttcttggcgtccatattctctgctatttactgacaaattactattgttcagagaaaaatgctggtaaatgaggrtttctgcatactgtacccagcagagctgtgaggaacctaggcattttccgttgttactgctctgaattactttgtctctgtaaatataagaagaaatcca

SEQ ID NO: 21828 - DNA, 201 bp, Homo sapiens
agatgggaaaacagagtctccagaggttaaatcacttgttcaaggtcatgcagctattaatggtgtatctgggatcctatttgaggactgtctggctccamatttttccatcaaacagtagtttcatgcacatggccttggcaaagatctataactcacagtcagtatctgattcagtgaagtcagtcagtgggggtcagg

SEQ ID NO: 21829 - DNA, 201 bp, Homo sapiens
atccagcttgactcaagatcctcttgacttggccacttggaagctccatcaccacctcgaactcagcgtacttctttccaaactcaccatcctccccaaamctggttctctcttggtgctcctgatctcagagaccactgtccccatccttctggttggctcctcagacacagaaaaaacaaaggcatgataaaagaaaaa

SEQ ID NO: 21830 - DNA, 201 bp, Homo sapiens
aagactgtgatatgaatgctgaatcacatagctttaagaaatctgcccacttcatccagcctgctgcagccctctgcaggatgaccctgaccccacatttrtacccttatttacttcttactattgcgttcatatctcatgggtcatccctgcaaatggatgagtgacttctttcttgcatttatttttccctcctagctt

SEQ ID NO: 21831 - DNA, 201 bp, Homo sapiens
agagaaagagagggaaggaaaagatttttttcttccttttattttgaagattccaattctgttggactgttcagtccctataccatttaccatcttcaaakttaatttagtaacactcgaaaacaattacgtttgtcataatctttttacttgtttctctcccagcctcattgaggaatctttgaggacagggagcatatc

SEQ ID NO: 21832 - DNA, 201 bp, Homo sapiens
acaggtggagagggaaggggctggcccttctagctggctaacacggacattggcctatttcccactgaggctgaaggtggctccagctcccaagttccctygtgtgtctgtcctgatcccctttcctgatgccctcggggcctggccttcttgtcctcccatgctgcagtatagtccaagaaggcgggtggagcttcaggg

SEQ ID NO: 21833 - DNA, 201 bp, Homo sapiens
aaggatttcataaatacctgtgtatggcagaatgcctggcacatagtaggtgcgaactgaagacagttcttttctcttcctgagccccactgtatctttamcatctttgcatttaaggagtgacctgcaggttacttttgtctaccctctctcactcatgatgtaatcaggcccctgacaagcaagacctcttgatatcca

SEQ ID NO: 21834 - DNA, 201 bp, Homo sapiens
aggtggcagccttcatgtatatatatgtacattacagatggtaaaatattctctataagtactctcagtgcctgggcctttctcagaaattgaaaatagtrggggaagcaatttgaaatgtcttctttcgcttcaattacttttcagaaagaaagtattaaaaatacccagtgactatctgatttttttcagagggagtgg

SEQ ID NO: 21835 - DNA, 201 bp, Homo sapiens
aaatgtagtgctaggttgagaaaccctggtgtaaatgagtaagcatcacctagcgcttggcacccaagagagtgttaatcagggctaattgaattaagagtcagagtgttaagagccagaggactctcaacactggggctcctaccaggtgctccagtgccccatggtttgctcctgggactcaaggtgggggctgtgaat

SEQ ID NO: 21836 - DNA, 201 bp, Homo sapiens
ataataatgcttttattttttcatatagttttcattacctttaccatggtagtaatagctatcatttgtggagtattttgtatgtgccgtaccttgtaaaygttactatcagtgagcgtagcagagatgccaaatggtgaagccctgcagagaccatcagaccctgaagaggctggaaaactcacatgatagctgttggtc

SEQ ID NO: 21837 - DNA, 201 bp, Homo sapiens
catacgcagaaagaattagtgaactggaaaatatgaagaaattgtttagaatgaggcctagagaaacaaagagatggaaaatatgaagaagttaacatacrtggaaggtagaatgaaaacgtcctacatatttttattggacttctaaaacgaaatatgacataatggagaagaaaaaataataaacaatgttaaggcttc

SEQ ID NO: 21838 - DNA, 201 bp, Homo sapiens
ctattcctacatctaatctgtacctattcctagacctacagccatgccaacaccagcacctacagctgcgccctcatctccggtacatatctcagagcagkgtctggcatcctggaagccctgtgtgggcgtgctgacatatggttattattactgcaggccaggtggtgggcacagtgctggtctcttggaggtggcaca

SEQ ID NO: 21839 - DNA, 201 bp, Homo sapiens
catctccctctgctgcgaccctatgccccgtcctcagactctgacctgggattttggctcctgacagtggatggcattgtggccttccccacagcatccaygtttactgagggcgctctcttagcttttctgcctgccttgactgccatactgagagcctgtggcctggcgggcccacattcgctgctttggggtctgctc

SEQ ID NO: 21840 - DNA, 201 bp, Homo sapiens
atggcattgtggccttccccacagcatccacgtttactgagggcgctctcttagcttttctgcctgccttgactgccatactgagagcctgtggcctggcrggcccacattcgctgctttggggtctgctctgagaggcctggctgtgtgatggagcacagcagctttgttggcccccacctgggagctggcagaagagct

SEQ ID NO: 21841 - DNA, 201 bp, Homo sapiens
tgggctggtgcaggagtgcgtggagggagagcaggaaatcagatgtctgtgttcagatgaagcttcttgcagctaaggcagccagagcaggccccaggggratggcatgttttgtgaggaaaatattctccaagaacaatgtttataaaactctgtctcggcaatcatcctgtgtctgccagcttctgtcttgcttctgtt

SEQ ID NO: 21842 - DNA, 201 bp, Homo sapiens
gttgtaagaggtgaagccaggttgaaaaggctaactcgtaatgaagtagaagctacctttacctggtggctccagcagttggtgctaggagcctgggaagkgggcacagcagtgaggagggggatatgggtggaggtggggctgggaggatctagtctgaggactgtgcagtgtctctattaagctgctcccatagagact

SEQ ID NO: 21843 - DNA, 201 bp, Homo sapiens
aagctttactctggccctacaaagtctggtcaagcaggatcttgctgggacccaaatgtattaaacagtcatagaagcacatgtgctggttgcaataggtrgggaattggggtctgcacagctaagtttaggaaacagaggcccagagactggggagatgcatagcaccagcaagcatgatgctgtgctgggcttggaagg

SEQ ID NO: 21844 - DNA, 201 bp, Homo sapiens
ccctcataactgacaatacttcctagcatttttcttgtgcttatttgccatttagatctaggtatcttcttggcaaagtatctgtttaaacaacttacccrtttatattggattttttgttttcttattattgagttctgaaaattctttttacattgggataaaagattttttaaaaatcagatatatactttgtaaata

SEQ ID NO: 21845 - DNA, 201 bp, Homo sapiens
gtttaacttatcaatttattcttttaagaattatgtttttcgtgtagtatctgaaaactgcctggactcttgattctattccattgatctatttttttctrtctttatgccaatccgacattcttttgattactatagctttagctttacgatacgatttgaaattacattttgttaggctcctgccttgttcttcatttt

SEQ ID NO: 21846 - DNA, 201 bp, Homo sapiens
gtgtacagatttttcacatatttttgtgagatttatcccttagaattttatattgtcagtgctactgaaaattatagtttaaaacaaattttaatttccarttgttcattggtagaacatacaaatgcaattgatttttgcatattgatcttgtatcctagaactttgctaaacccacttaccaaaactagtggagttttt

SEQ ID NO: 21847 - DNA, 201 bp, Homo sapiens
atgaagttcataatatcccactagcatcctttcaatatttgttgaatctgtagacatgtgatttttctcatatataatattcattacttgtctcttttctytttttattgatcagtctgattggaggtttattgacgttattcatttcaaagaaccagttttcaatttcattgattttctctattgtttttcaatttccat

SEQ ID NO: 21848 - DNA, 201 bp, Homo sapiens
attgtttttcaatttccatttatattaatttattgttttgtcttccttattttcttttttctgtttactttggctttaatttgctcttttttcccctagtktctagggagtaagctgagatcattgatttaagacctgtctttttctttgctatgtttccccttaagtgatttagtgacatcccacaaatcttgatatgtt

SEQ ID NO: 21849 - DNA, 201 bp, Homo sapiens
gacctgtctttttctttgctatgtttccccttaagtgatttagtgacatcccacaaatcttgatatgttgtgctttcattatttagttcaaaatacttctmtattacttttggattccttctttgacccatgggttttagaagtatgtttttagtttccaaatatttggggattttaaagaaatctttctgctattgattt

SEQ ID NO: 21850 - DNA, 201 bp, Homo sapiens
gttaattttgagatacctattagaccattacacagagatggtatgtagacactagacatgtggctctatgagtctggagttcagagggagggtaaagctgktgatatgaatctgggaaccatctgcatataggggatattgaacctcatgtgactggatgagaccacagaggggttgcattactaaaaatgcgaagaggcc

SEQ ID NO: 21851 - DNA, 201 bp, Homo sapiens
acagtttgatgtcacataattagtaagtggcagaatcaggacttgagatctgagtgacttcgaatttaagaactccatacccgatgccacacggctccccscttatcttccctctcactcccagcactggttgaatgctgaataagttatggaatcccagcaatatctgaatttttcataacttagaaacagtaatatagt

SEQ ID NO: 21852 - DNA, 201 bp, Homo sapiens
gtttgtatttcaccagttcctttgggcatagacttccttgcctctccaatctgtcaggatgtacagaagcaatgacctgtttcaaccaaatatccacagaytctggaagtggctctggggctgggaccaggggctagggcctcatcccaatgtctggtgggccctagttcaggtctggaggtagacggacccagctggcca

SEQ ID NO: 21853 - DNA, 201 bp, Homo sapiens
gttctctaggttcacccatgttattgcaaatggcaggatttaattcttttttaaggctgaattccattgtgtatgtataccacattttctttatccattcrctcattgatggccacttaggctgtttgcataccttggctattgtggattatgctgcaatggacatgggagtgcaatatttctttgagatacagatttcaa

SEQ ID NO: 21854 - DNA, 201 bp, Homo sapiens
agtaacattccttttaggataaatggtattggatttgggtagctagagaaactttattgttaacctttggggaatctttcctgcaattattaatcccttcrtgacttccacagaccatctaagacatgcttaaaccttctgtcttgtcctaaatatccttgttttaaaccaaccgttctctttaggaaaagcatttaccat

SEQ ID NO: 21855 - DNA, 201 bp, Homo sapiens
ccgcctgcatgggcccttggtgtgggaagccacgctggctcctgctttgtgcctcacagagcaagttcgcaggggtgagctcagcctcatggcagccaccrtggcagcttcctgtgaggagcaagcaatcagcctaaagagctttgcacattattaatgtgtgtgcacatgggcctgccttgctgctccaaggactctcct

SEQ ID NO: 21856 - DNA, 201 bp, Homo sapiens
tagaccccttccctacagggggtcttagtgcccgtagtacagtgaaatgggaccttgtattacaggcatctttcagggtttccatggagtacacctaggcratggtcaataaatgtgggtcccatatcttagagggcttagagggacagcaaaaagcaaaaaagcaaacaggatgtgcccctacctccaagaagttgctgc

SEQ ID NO: 21857 - DNA, 201 bp, Homo sapiens
gggcagtgtcctttcaaatctggctacttttagcttccaaaggaagataggtaaagggaagttgtataagttatccaggcacccagtggagctccagtgcyagggagaggctgagcaggaattccagctccagggctgctcattcctcttccagctgttgggtatttcttcctacgcataaggggccatgcccaggatggc

SEQ ID NO: 21858 - DNA, 201 bp, Homo sapiens
catgtagttataatgactgttttaatatctttgtcttctaattccaacatctgtttcagttgtggtttgattttgatcgattgatttttttcttcacatgsgtaaatttttttcctgcttctctacatacctaatcagttttgattggattccagacattgtgatggatatttttgcattcgtagaaatatccttgggctt

SEQ ID NO: 21859 - DNA, 201 bp, Homo sapiens
ttccctaggtttggattgtagctttgcctttaggacaaggtggtcttgagtaggtcccccttctcctcctgtgacccagtagactccaatcctccccaccrttcattccagatcccccggggcactggcagtgttggggcggagtagtcaggcctggcattgcacggaaccaaaatcatgacatgacttgattcaaaactc

SEQ ID NO: 21860 - DNA, 201 bp, Homo sapiens
tgtctctacttaacgtttgaacatacggcatgtagttataatgactgttttaatatctttgtcttctaattccaacatctgtttcagttgtggtttgattytgatcgattgatttttttcttcacatgggtaaatttttttcctgcttctctacatacctaatcagttttgattggattccagacattgtgatggatattt

SEQ ID NO: 21861 - DNA, 201 bp, Homo sapiens
atttttagagacagggtctagctctgttgcccaggctggagcacaatcatagctcactgtagccttgacctcctgggctcaagcaatcttcccatctcagyctcctgggtagctgcgagtaaagatgtgcaccactatgcctggctaatttttaaatttgtggaagagatgagatcttgttatgttgcccaggctggtctc

SEQ ID NO: 21862 - DNA, 201 bp, Homo sapiens
gagcagtgctctacccccatcctagaacaactgtgggctggaggaaggagtccttcccaggccagggtctcaacctggctgcccagcagaatcatctgggrgagcttttaaagtgtgctcaagctctgatcaattgaaattgcatttctggagatgggacatgggcatctacattttaaaaaacctccccagctgatcctg

SEQ ID NO: 21863 - DNA, 201 bp, Homo sapiens
tgtgccacactgtttggaagacatccattcatccttcattctgccaccaaagtcaccttccttaactcactgccctgcttagacccctgaatgtctccccytctccttaaggatcaagttcagatcccttctcgcagtgcacagggcctccaaggtctgtctctccctggcctttctctcatcactccctcaagacctccg

SEQ ID NO: 21864 - DNA, 201 bp, Homo sapiens
catctctgagtgcttctgctgcaccatggagggcactgaggtggctcctccgagattaacccaaaaatcatctccagcatcattgctgggttccaattaayccagagcttctttgatctcctcagtccttaatgtttacttcataacaatttgaaggcaaggagagggcagggttaggaactctgtttaggctgggcaatg

SEQ ID NO: 21865 - DNA, 201 bp, Homo sapiens
gtgtaattgaattagtgtacattattacaagccatctgcttcacgtctctgttgcttcttccatgtgagccattgaggccaggattcccctgagggtgggktgaagctcgatccttgcatccagggacccagcataggcattggcacacaggaggtgcttcctgagggtctgttgagctcagcaaaatacccggggctctg

SEQ ID NO: 21866 - DNA, 201 bp, Homo sapiens
tggtgggtaggaagaccattgaggatgggtccctcaaatcccaccatcaagatggctcaccaatcaaagctgacacagctggccaggactgcctgacttcrtggtaattttgatctttcaggcaaagaaggggaactacgccttcctgtgggatgtggccgtggtggaatacgcagccctgacggatgacgactgctcggt

SEQ ID NO: 21867 - DNA, 201 bp, Homo sapiens
ttatttttccttcacagttggcgacatgggactcagagaagggcttgaatggcagcttgcaagagaggcccatgggcagccgcctccaaggattgactctyaaagtggtgactgtcttggtaggatcatggggacattctgggagcgagctacaccatccaggctgttgaatcagaggctgctttctgtttaatgctgggt

SEQ ID NO: 21868 - DNA, 201 bp, Homo sapiens
cttgaaagagaaagtgaaaggtggccagtgtcggtggggtgtagtgagcgaggtagaaagtgtgatggttggggttaaaggcagacatggatcaggtcttrgtgagtcttacaggccatgaaaaggaggacccaactgtagttgaaaaccacttgagaattttgagaagaatgaaataaagcaattttcttaaagaaaaag

SEQ ID NO: 21869 - DNA, 201 bp, Homo sapiens
gtgggccatgccgggcttggagttcagaagggccttgcagcccatttgtatccttgcagtgtgcaatgcacagcatgtactcatgcctcgctgcctttctscatttcaggactttccaggacctgtccaaacaagtggaaatgtcttatggcactgtccgggattctgctgtatatgagtacttccgagccaagggcacca

SEQ ID NO: 21870 - DNA, 201 bp, Homo sapiens
actttttatggtttcagtcacccactgtcaactgaggttcaaaagtattaagtggaaaattccataaataaataatttatacgtttttcaatcgcatgctsttctgcatagtgtgatgaaagctctcgctgtactgctttgtcccacccaggatatgaatcatccctttatccagggtctccacactgtatgcaccaccca

SEQ ID NO: 21871 - DNA, 201 bp, Homo sapiens
acattttaattcccttgtttctttttctgtatatattttttagttatttttgtggtggttgccctgggaattacaattaacatgttaccttaaaacaaacyggaacagattaatggtagataattttaaatgttatgcaaaaactttgctttagtgtagctgtttcctcccccttctttatattattgttgctgtcgaaat

SEQ ID NO: 21872 - DNA, 201 bp, Homo sapiens
tgagacacaacatgagatccacaggagatgtctggcttctgtcatgcaacataatgtctttgacattttcccatgttgttgtgtctgttaggggttgattstcatttgttaccacgtagacatgtagaattcctttgtaagaatatacggtcatttatttattcttttgttaatggaaatttgggttatttctaatttttg

SEQ ID NO: 21873 - DNA, 201 bp, Homo sapiens
gatccccatggttggtagaatcagggagcgcttcttagaaaagcaggtattttcagcctgtctgtaagggttgagaaggatttggatgtgagcagaaggargagtaatcgaggctggagaatgagctataaaaggaaagaaggaggaagggaaaatgggggagagaaaatacatggatatgttatgcactgacaggggaaa

SEQ ID NO: 21874 - DNA, 201 bp, Homo sapiens
ctttttaatgattaaaagtgaccttaaagttatgggtatcattctgggaccagggataatgactgaaggaaaaaaaaagcctttatatttttattctattkgtttccgattgtctaacaaactaattataataaatgtgagcacatcacttcctgtttcagacttctcaaaggtgttccattcaacttaaaataaaaccca

SEQ ID NO: 21875 - DNA, 201 bp, Homo sapiens
ggcaggtcatgacggtgctctgcagtctggtcagatccgtggtgcacgttttctgcattaggcctgtgtcaacacacagcacagcccagttagggaagcgytgccttagcctttcctgtccgatattttgcttcccctggagttgctgactgactttttggtggttcggggctttgcttgctatgcatctctcctcatttc

SEQ ID NO: 21876 - DNA, 201 bp, Homo sapiens
cctgcagagcgagaagatcacctactccatcaaggtcatcgaggccaacaacccattccaggctgtgcaggaaggtgagtgaccgctgtgcccagggcccwctgggacacggcctgcgaggcgtcgcagcagtgggcaccggaggggttgggacgagctgggctgcgcagggcaccctctgttcctcggcagccgcggtgc

SEQ ID NO: 21877 - DNA, 201 bp, Homo sapiens
ctcttgctattgggatgccctttatttctttctcttgctgattgctctggctaggatttccaatactgtgttgaataggagtcatgataatgggcatcctygtcttgttttggttctcagcggaatgcttccagcttttgcctgttcagtatgatgttggccctgggtttgttatatatgacttttttttttgaggtatgt

SEQ ID NO: 21878 - DNA, 201 bp, Homo sapiens
ataggagtcatgataatgggcatccttgtcttgttttggttctcagcggaatgcttccagcttttgcctgttcagtatgatgttggccctgggtttgttayatatgacttttttttttgaggtatgttattttaatgcctagtttgttgagggtttttaacattaaggaatgttccattttatcaaaaccttttctacatt

SEQ ID NO: 21879 - DNA, 201 bp, Homo sapiens
cctgcgtaatccgcctctcctgtttcttccctcacaaaccgcacaaaaagctcttgtccacattttcctcctgctccctgtgacctgactcaccctggggyttccccatgtggccccaaaaggtgtgccctgcctcctctttctagggatctgtgactctgtgaccacaacagacttcttccttcatgggagtcatttctg

SEQ ID NO: 21880 - DNA, 201 bp, Homo sapiens
atgttgttattattgagatagagtcttgctctgtcatccaggctggagtgcagtggcacaaatatggcccactgcagccttgacctcttgggctcaggctmtcctcctacctcagcctcttgagtagctgggaccatagggacatgccaccatgctgggctaattttgtattttttgtagagatgggtctcactgtgtttc

SEQ ID NO: 21881 - DNA, 201 bp, Homo sapiens
attacaggcgtgagccaccgcgcccggctctctccgacattttactataataataataataacaagccacaatgaacatcttgtgcttgaaattttgtccrtatttggaacattttcctaaggtagagtcctaaggatgtgtgtgtgtttgttaaaatgtacataacatttaccattttagccatttttaagtgtacattt

SEQ ID NO: 21882 - DNA, 201 bp, Homo sapiens
ccatatttggaacattttcctaaggtagagtcctaaggatgtgtgtgtgtttgttaaaatgtacataacatttaccattttagccatttttaagtgtacakttcaatagcattaattcacattctgtgcagccatcaccaccatccatctccagaactttttcattttcccaaacagaaatactatagcacttaaacagtg

SEQ ID NO: 21883 - DNA, 201 bp, Homo sapiens
ttaagtgtacatttcaatagcattaattcacattctgtgcagccatcaccaccatccatctccagaactttttcattttcccaaacagaaatactatagcmcttaaacagtgactccccattccttcttcctccagccccgcaaaaccaccattctcctttctctccttctgactttgactactccagatatttcatacaa

SEQ ID NO: 21884 - DNA, 201 bp, Homo sapiens
gtatatgtatttacttgtttagtttttagtgctttctctcctgctagaatggagctccatgagaacaggttctaagtctggttctcaggtgaatcttaagsgcttggtgaccagtaggtgcttagttgaatgaatggatgaatgaatgaatgaatgagggagtgaatgagtgaatgagtatctagcagattgccctgccta

SEQ ID NO: 21885 - DNA, 201 bp, Homo sapiens
ataccaatgttcagcaaagttgacaggcattatggggactcctagaagatatgaatggatttgttgagtggacagtaggctggaggtaggcaaagctcttytggaaatattacaggctgggagaaaggagggcccaggggagagagtggaccccaggtttttgtagcattggcctttgcccactgctaattctgggaacat

SEQ ID NO: 21886 - DNA, 201 bp, Homo sapiens
tgcccgaggcctgcccacctcttcttcttcctgccatcccagcagaagtggggtgcaaggatgccagatgtgtgttcccaagaaatgtggcagtatggagratccacactttcagcaggtgagatgtaattgtgggtaattgaaaaacaccatcaaagctatttgtcataatttttacaaatgctttcttcctgggtcatt

SEQ ID NO: 21887 - DNA, 201 bp, Homo sapiens
cagctgcccaaaattcctcctggaagaagatttagacgtgcacgtacactaatttgtacttgaatcttttctagaatagtctctgaggcccatgtgacccrgtcccctgtgacatccctggctccacagcagctgccctggcagtattgcactcattttatgcccaccaggcatgcatctacgtcagggcctttgcactcg

SEQ ID NO: 21888 - DNA, 201 bp, Homo sapiens
tggggctttaaattcacagtgctggcttattctaggctaggtaccccttgctgtctcaggagctggctccatctccaccctgtgtcccatcttccactggrgctctgccctcccgagcctggaggctttgcctgggctgttccacctaggctggggcagctttgaggggcctctgggtccagcactggagaaaggctcttt

SEQ ID NO: 21889 - DNA, 201 bp, Homo sapiens
tcacagtgctggcttattctaggctaggtaccccttgctgtctcaggagctggctccatctccaccctgtgtcccatcttccactggggctctgccctccygagcctggaggctttgcctgggctgttccacctaggctggggcagctttgaggggcctctgggtccagcactggagaaaggctctttgtctggtttcagg

SEQ ID NO: 21890 - DNA, 201 bp, Homo sapiens
taacagggctgtggtccagagcacgtaataagagaacgcttgggggtggagccacgttcccttcctccagaaggcgccctccactcttggccctctgccakcatccatgcccaagatggtgtggtggggtgtggggacccaggaggctgctgtccggctgggcctagaccctgtggcatggaccagggggccgaactgaag

SEQ ID NO: 21891 - DNA, 201 bp, Homo sapiens
ggatgatgtgtagatggatggattattggggattggagctggataggtggctggatgaattggaggttggggatggttggatagatggttgggttgatagwgtgtgagtgggagtagatagatggatgggtggatggttggaggcagatgtatatgggtggctgaaggaaaatatgggggcatatgaatggatgggtggga

SEQ ID NO: 21892 - DNA, 201 bp, Homo sapiens
agcaaataatgaagggggccagtattaacagattttagaacatagaagcccatgttaattaaatctgagaaacactggtacaaacagagacttccagcaaygaaagacaaatctgaaagagttccttatacataaaataagagaagataaaggaggaatcaaataccatggagaaaagaaggatttgtaatgaaggatgtt

SEQ ID NO: 21893 - DNA, 201 bp, Homo sapiens
gatagatggttgggttgatagagtgtgagtgggagtagatagatggatgggtggatggttggaggcagatgtatatgggtggctgaaggaaaatatggggrcatatgaatggatgggtgggaggatggatggatgaaggggagggtgagtgcatggatgggtcacaggtggatgggttaatgtggctggaaggaggcattg

SEQ ID NO: 21894 - DNA, 201 bp, Homo sapiens
aacagaatcttgtctttacatttttgggttaaactgttagggctgacagcttgcaaagaggctaggctaggccacttgccctagggcagggggctgggtcrtcaaaggaaacagcttcatgttcttatagctcctcctgcagctttaagggcacagctgggcagcacatgttggcctgtgtccagccatcagcgcccacct

SEQ ID NO: 21895 - DNA, 201 bp, Homo sapiens
ggctatgcctggccagggtgacaaattgcaagaaccttgcagtggctattgggggcgggggctggaggacaaaggctgaggaaaatgggcctttgctttayggggtctccacaaggcaatgtgctaagtgctttcatcatgttgctgtttcatgtttgtgacagctggggaggtatgggccccacagatgaggagtctgaa

SEQ ID NO: 21896 - DNA, 201 bp, Homo sapiens
ctgttctttatcttcctggagataatccttttaggtgtctggagttggcgctcatgtcatcttcacacttagtctgccttctcccaggccctctctgtgtycctcagccatgccccatgatgagttctgtgtcccatacacctgcctggctattcccttctaattcttccccatagtatcactgtccctactgaatgtaga

SEQ ID NO: 21897 - DNA, 201 bp, Homo sapiens
gtcccgatggcagtgggagagcctgggttctgctcttggggctcggtgagtatcagaactcttcctaattccccagcctgttcctggtttgatgccacggrctgtgggatcagcagggaccttcggactgatgtcccctgcctgcaagtcctgaagacccctgggatccccagggatatggagaccattggatggaggtga

SEQ ID NO: 21898 - DNA, 201 bp, Homo sapiens
taatacattcaacatgcacaaatatgtgttaatagactgtttatggtatcagtaaggcttccggtcaacagtgggttattagtagttaagtttttagggartcaaaagttgtactcaaatttttgactgcatgaggggtcagcgccccaacctctcattgttcaagtgtcaactgtactttcaacaaacatttgttcacag

SEQ ID NO: 21899 - DNA, 201 bp, Homo sapiens
aattatcctagaagcagcatagactggcaggaaagttttgctctctagtgaagttagggaaggcttcctgaaagacactttagttggggttttgaaatgtrgataggagttgaccaggttgcctaagatgagggataagagatggtggtgggagatggcattctaagcagagatgagaaacctccatctgtggggtgtgca

SEQ ID NO: 21900 - DNA, 201 bp, Homo sapiens
ttgatttgcatttctctgatggccagtgatgatgagcatttttccatggttttttggctgcataaatgtcttcttttgagaagtgtctgttcatatccttwgcccactttttgatggggttgtttgtttttttcttgtaaatttgttggagttcttgtagattctggatagtagccctttgtcagatgagtagattgcaaa

SEQ ID NO: 21901 - DNA, 201 bp, Homo sapiens
gaactggtggggttggccttgcacttggggattttcttcctttccaactttcaggcttgcataccaaatccctgggctggaggcagaaacgcttctattgycccaggtcccttccctagtggttctcttgagcttgagaaggatgagaaccatccctttaatttaagctcttgctgccctggcaggtccaaagcatgcttt

SEQ ID NO: 21902 - DNA, 201 bp, Homo sapiens
ggttttttggctgcataaatgtcttcttttgagaagtgtctgttcatatcctttgcccactttttgatggggttgtttgtttttttcttgtaaatttgttkgagttcttgtagattctggatagtagccctttgtcagatgagtagattgcaaaaattttctcccattctgtaggttgcctgttcactctgatggtagttt

SEQ ID NO: 21903 - DNA, 201 bp, Homo sapiens
gtagtttgttttgctgtgcagaagctctttagtttaattagatcccatttgtcaattttggcttttgttgccattgcttttggtgttttagacatgaagcmcttgcccatgcctatgtcctgaatggtattgcctaggttttcttctagggtttttatggttttaggtctaacatttaagtctttaatccatcttgaatta

SEQ ID NO: 21904 - DNA, 201 bp, Homo sapiens
ttgtacacttcattgggtacaatattggcttcaatattgcctctaacttgatcgctgattatggttttttgactcactgcctttagtaacatccctttaaytcatcacactcactgtcatcatattggttcttttgatccatagctcttaatcaagtcgtccatactcaaccagcctctatgggtctcaactagctattga

SEQ ID NO: 21905 - DNA, 201 bp, Homo sapiens
gtgtataagaatgcttgtgatttttgtacattgattttgtatcctgagactttgctgaagttgcttatcagcttaaggagattttgggcttagacagtggkgttttctagatatacaatcatgttatctgcaaacagggacaatttgacttactcttttcctaattgaataccctttatttccttctcctgcctaattgcc

SEQ ID NO: 21906 - DNA, 201 bp, Homo sapiens
taatttgtatttctgtgggatcggtggtgatataccctttatcattttttattgcgtctatttgattcttctctcttttcttctttattagtcttgctagyggtctatcaattttgttgatcctttcaaaaaaccagctcctggattcattaattttttgaagggttttttgtgtctctatttccttcagttctgctctga

SEQ ID NO: 21907 - DNA, 201 bp, Homo sapiens
gtcaattttggatctttcctgctttctcttgtgggcatttagtgctataaatttccctctacacactgctttgaatgtgtcccagagattctcgtatgttktgtctttgttctcgttggtttcaaagaacatctttatttctgccttcctttcattatgtccccagtagtcattcaggagcaggttgttcagtttccatgt

SEQ ID NO: 21908 - DNA, 201 bp, Homo sapiens
attctagttatccatttgtctaattttttttgaagtttctaacttctttgccattggtttgaatttcctcctatagctcggagtattttcatcgtctgaarccttcttctctcaactcgtcaaggtcattctccgttcagctttgttccgttgctggtgaggagctgcgttcctttggaggaggagaggtgctctgctttt

SEQ ID NO: 21909 - DNA, 201 bp, Homo sapiens
gtcattctccgttcagctttgttccgttgctggtgaggagctgcgttcctttggaggaggagaggtgctctgctttttagagtttccagtttttctgctcygttttttccccatctttgtggttttatctacttttggtctttgatgatggtgacgtacagatgggtttttggtgtggatgtccttttctttttgttagtt

SEQ ID NO: 21910 - DNA, 201 bp, Homo sapiens
ccgttcagctttgttccgttgctggtgaggagctgcgttcctttggaggaggagaggtgctctgctttttagagtttccagtttttctgctctgttttttycccatctttgtggttttatctacttttggtctttgatgatggtgacgtacagatgggtttttggtgtggatgtccttttctttttgttagttttccttct

SEQ ID NO: 21911 - DNA, 201 bp, Homo sapiens
tggagataggtttgccttgttttcacccacatttaacttcacagtagctgaggcagcctgaactttacagaagtgccctgtcagcagaaagagcctgtgcrgtggcagtcagccacaaggcactttgcacaaattacaagtgctgggaaacaaaggccagcccccaatgcagaagtgggctccccagttctgtttacattg

SEQ ID NO: 21912 - DNA, 201 bp, Homo sapiens
ggctgctcgggggtcagggacccacttgaggaggcagtctgcccgttctcagatctccagctgtgtgctgggagaaccactgctctcttcaaagctgtcaracagggacatttaagtctgcagaggttactgctgtgtttttgtttgtctgtgccctgcccccagaggtggagcctacagaggcaggcaggcctccctgag

SEQ ID NO: 21913 - DNA, 201 bp, Homo sapiens
cttcataatcactattttaatgactgcataatatttctgctggtgggtacatctgaattgactttgctgtttcctttttcttcccaacatttttttttttkctttttttcttttttttttttgagatggagtctcactctgtcgcccaggctggagtgcagtggcgcgatcttggctcactgcaagctccgcctcccaggt

SEQ ID NO: 21914 - DNA, 201 bp, Homo sapiens
tgattgctagcagagctgaggcatgcccaccatccaggtccttgccatatactttgggagaaaagatatagaatttgagcctgaaaatatttcattgcttkcctgatgtgacgttggtaagttattcagctcctctaagcctcagtcttactccttataaaatggaatcaatgatagcttcctcagagtgtgatgttacag

SEQ ID NO: 21915 - DNA, 201 bp, Homo sapiens
caatcaagctaattgtcaggcatctcccacaaatgctagggaaactttctggatcattggatgctaaactttgtagcagaatcacagatgcctctgaagcygaatctgcatttgtaacagatgccctttctctgcaaggccaaattccttcaggaaatctttcccaaactctgacaaacaagaaagattgaagaacagcac

SEQ ID NO: 21916 - DNA, 201 bp, Homo sapiens
tgttttctttgacatacaagcataatatagacataatatttatttttaaatgctggtctgttcactcaatatctttaccttttaaggtcttaattctattkactattttatctcttgattatcagtcattttctgttttttaatatgtgtaatagtacatttttacgtttcctggacattgtgggagatacgttgtaccat

SEQ ID NO: 21917 - DNA, 201 bp, Homo sapiens
gctgaggaaaatgggcctttgctttatggggtctccacaaggcaatgtgctaagtgctttcatcatgttgctgtttcatgtttgtgacagctggggaggtrtgggccccacagatgaggagtctgaaggtgacttgctcaaggtcatgctgtttgacagaggcagagcctggaagcttgatggaagcagggcggctctgaa

SEQ ID NO: 21918 - DNA, 201 bp, Homo sapiens
tgttctttatcttcctggagataatccttttaggtgtctggagttggcgctcatgtcatcttcacacttagtctgccttctcccaggccctctctgtgtcyctcagccatgccccatgatgagttctgtgtcccatacacctgcctggctattcccttctaattcttccccatagtatcactgtccctactgaatgtagag

SEQ ID NO: 21919 - DNA, 201 bp, Homo sapiens
gctgggtaatgatcgctgttagtattttcatggttattttaatggcagaggaattaaacagagcttgccaagttccagcttctgatccccctttccccacygcatagtctcaaccccagttccctccacaggactttcctcttgcccaggctcctcccccagccctgactggcggctctgtccaacccacctggcctctct

SEQ ID NO: 21920 - DNA, 201 bp, Homo sapiens
agcaatacatgagtttccatgctaactttaggtaccaatgctgccattaccaccatgctgatacacagcaagagccctcttaagttgaaagagagcagggkaatatatatatacacacatatgtgtgtgtatatatatataatatacacacagatatacacatattaatacacatacatacacatatatatgtatatatag

SEQ ID NO: 21921 - DNA, 201 bp, Homo sapiens
ctctctaggcatttatcatacaagtgtggtctaggcatttgccctgcctggctagagaggcccaaatgggaaccagtaactccctcaggctttggtggagrcaagttttgttgtggagccacaccccatgatacagcaaagcattatgggagcaagtatatgggtgacacccatctgctgtcctgattaggtctcccagct

SEQ ID NO: 21922 - DNA, 201 bp, Homo sapiens
atgtaattgagttggaagggaagctgattttcaagtcggctttattttaaaatgtatctttttgtcattttaaaatctgcccttaataactgcatatcctrgttgttatctgtctgcctagcagcttatcgctgctaaggggaagttatctggaaagcagggagtgggatttactgtagcaaatgtttgtgattcaggcct

SEQ ID NO: 21923 - DNA, 201 bp, Homo sapiens
tctgggctgaggtgacagaggggcagcaggcatgtctgtctaggtttgagggccatcagctgccttttctggagtctccatcctctttgcagaaaccatgygtggcgcagtgggaagcctggagaccaggtagatatatgcctttctccccaacactcaggtacctgctcctcagcaagggcactggctggctgatgcacc

SEQ ID NO: 21924 - DNA, 201 bp, Homo sapiens
tcagaggctgaaatcattgaggcactggcatcctctcttaggatgtctctcccagcagtgaggctttgtaggaggagggacttcagtacaacctttgtgtrctaattggacaaatatacttcagaaggaaggacattgaaggctattgatcccattctacttattggaccttccttagatggttctttgacggcagtgacc

SEQ ID NO: 21925 - DNA, 201 bp, Homo sapiens
tcctagttgagtcttttccacctgttcttatgtctgtgactctcaatccatctctgttgagctccgttttgctcattatggcccattggtccagatggccmgatctttttgtatcccacacactgtattaagtctctctcaagtggaatcagtagcaatcaatatcctctgcagtcattgataaaactgttgagcagacag

SEQ ID NO: 21926 - DNA, 201 bp, Homo sapiens
gctattgatcccattctacttattggaccttccttagatggttctttgacggcagtgaccatggaggtcagaggccacactgctagcaattcaagtccccyataaagatcactgggagaacaaaagctgccatctctagttcagagttcctcccacgcggtgctgccaggacaggatgctgccaggtagaacagagaaggc

SEQ ID NO: 21927 - DNA, 201 bp, Homo sapiens
ctctcaagtggaatcagtagcaatcaatatcctctgcagtcattgataaaactgttgagcagacaggtctgaggatagagccctaaggcctatcactagakactctgccagttgttatctctgaatgcacctaattgcactagcacccagcccacctcagagaggactgtgtgaatacctcattgaaatccaactctgcgt

SEQ ID NO: 21928 - DNA, 201 bp, Homo sapiens
gtataccttgaagtagaattgatgggtcatgtcataagtagataatttattttcataagaaactgccaaactttttatcaaagtggctgtataattttgcwtttccaccaacaatgaattcatgttctttttgctccacatttttgccagcatttggtgctgccaatttattatcataatatatatttttttaaatttagc

SEQ ID NO: 21929 - DNA, 201 bp, Homo sapiens
tggccactcagaggtgggctcagtttgcacatccatgaggataaagaggaactgcttctggaggtggggcaggctggaaagtgagtgtctagggtggcacrgtcaagatgggcaggatggcagggagtgagagcagaattctggactgcagaattcacactgaggtggaagccaggagtggggatgaagaatggtggtcct

SEQ ID NO: 21930 - DNA, 201 bp, Homo sapiens
tacctcattgaaatccaactctgcgtcaaagcctaaggttgttgactcttgaggtgctttagtcagtgtttgggaagaaacagatcacgtattccaaaggrgcactgaacagatttgaatacagaggaacccagcagggacagggaagcactcagagggtatcagtgctagggagatgcactatccctgggcctgaaggga

SEQ ID NO: 21931 - DNA, 201 bp, Homo sapiens
ctcataaaaagagttggtaaatattctctcctcttctgttttctagaagaaattgtgcagaattggtattatttcttcctgatccatcagtgaaactatargggccttttgaaaggtttttaactacaaatttaataactttaatagatatgagggttatctcattatctatttcttcttaagtagtttatagtagtttgt

SEQ ID NO: 21932 - DNA, 201 bp, Homo sapiens
ctacatttcacaacattacataagttgcataattatccatccatttattttcaatctgcctggcatttatatttaaattgttgcttgtatatgcagcccayggcagggtattgctttttgtccactctatcaatatctgcctttaaattggagtgtttggcacattgtataattttgtgtaattattgatagagttgggtt

SEQ ID NO: 21933 - DNA, 201 bp, Homo sapiens
acatcatcaaatgaggtaaatgcagtgtcagatccaggaaccctgggacactatgcctccctctgttcctgctgagacccaggcattgcataaagagcaamgctgaagtgcaacactacaggaatcttgtagtaatagcagcaacagtaaaagaggaatcaagtcacctgggttcaaatcctgataactctagttactagc

SEQ ID NO: 21934 - DNA, 201 bp, Homo sapiens
gattaagatgtatgtagacatggttttctttgtgcttatactttttggagttcactgactgtcttgaatccgtaatttatatatatatatattttatcaamtttggaatgttttctataattactgctttaaatatttttgcatgaaaatgtttttctcttcttctggggctccaatggcacatcaattaaaccatttaat

SEQ ID NO: 21935 - DNA, 201 bp, Homo sapiens
agaaataaatagggtatctatatgatggtaacatttaattcagcaagggctgtctttctatactgtgtgtaacgaataaaaaaaccccctggccaggcacsatagctgacacctgtaatcccagcactttgggaggccgaggcgagtggatcacctgaggtcgagttcaagaccagcctgaccaacatggtgaaaccccgt

SEQ ID NO: 21936 - DNA, 201 bp, Homo sapiens
gagcctcttgcccgactcccggctgagcgcgctgcccatggagcgggggatgggcgcccgccgaggtccgcgcggccagccagggttcgagcccacggccygggctctactctgagatgcttgcggcggccggccccctctggctccccagctgtcctggggcctggcccggcgccccgccccggtctctcttcttgctcc

SEQ ID NO: 21937 - DNA, 201 bp, Homo sapiens
gtggaggttgcagtgagccgagattgtgccactgcactccagcccaggagacagaacgagactctgtctcaaaataaataaataaatacataaaataaaataacataaccccaaaatatattaaaaatagccaatattcaaagagaaatacacagatttttaatggacctaaaaatgaccattgacaccaacaaatgaaca

SEQ ID NO: 21938 - DNA, 201 bp, Homo sapiens
acttctctaatcagctatccctgctatctcaagtgtccgtgatggtcaaggggtcctctcctgcctggaatccagaggcctgtggtgagagtgggttgctycttgccagttcaattcatccattcccctagagctgttgtaggtcaaaaatgaatcccagggctcagtagcccttgtggggttaacagttttctccctctt

SEQ ID NO: 21939 - DNA, 201 bp, Homo sapiens
gaggttgcagtgagccgagattgtgccactgcactccagcccaggagacagaacgagactctgtctcaaaataaataaataaatacataaaataaaataacataaccccaaaatatattaaaaatagccaatattcaaagagaaatacacagatttttaatggacctaaaaatgaccattgacaccaacaaatgaacagtg

SEQ ID NO: 21940 - DNA, 201 bp, Homo sapiens
ataaataaatacataaaataaaataacataaccccaaaatatattaaaaatagccaatattcaaagagaaatacacagatttttaatggacctaaaaatgrccattgacaccaacaaatgaacagtgaatgcacatgaaacgttcatgtagtacaaactgaccacacggtaagctacaaagccagcctttccacaaagaac

SEQ ID NO: 21941 - DNA, 201 bp, Homo sapiens
aagatggaaacgatggcatggagctcccaggtggccacacactcagggacaagttctccccgccagtcctcaaccgctacgagagccctggtacccttctmagaaagggcatctcccaataagtgatgctttagatacaactgcatgagaatataatgttcaaggggagaagaaaatgctgctttgaattccaagttcaga

SEQ ID NO: 21942 - DNA, 201 bp, Homo sapiens
ttgatatgtgtatcagtagttcattttttaaaaaattgcagagtagtatttcattggtgtatcatagttggtttctccattcacccgctgaagaacaagtggttgtttctagtttttggtaattatgaagagtgccactaaaagctttttctggtatgaattttttattcttgttgagtaacacccaggagtgggtttgct

SEQ ID NO: 21943 - DNA, 201 bp, Homo sapiens
acactaaaaaaagtgcccattggggtatttcagattttgcatttttggattaaggatgctcaactggaattggaatataatgcaaatatttcaaaatctgaaaaaaaaaaatcccaaataaaaacacttcttgtcctaagcatttcagatatgggatacttaacctattatcatcattactgtggaggtggacaggtacat

SEQ ID NO: 21944 - DNA, 201 bp, Homo sapiens
ttcttcaactgatttttcaacagtgtttagctgttctaattcctttgcctttccatatgtatgttggaaatggcttgtccatattatgaaaaatcctcttkggattttgttacctatagaccaatttggagaggattggcatccttgctaaactgagttttccagtctgtgaacacaatttgtctttccatttacttatgt

SEQ ID NO: 21945 - DNA, 201 bp, Homo sapiens
ccttgataaggaattaaaggatgaatctattaagaatgcaggtctcagtacaagttaaactgaccctagatgcctctctctctctctctctctctctctctctctctccatatatatgtgtatatatatatatatatatatatatatatatatgtatatatgtaaaacactttattaaaggaatctctgtctccatttgtt

SEQ ID NO: 21946 - DNA, 201 bp, Homo sapiens
gttttatcttacttttctaaaattggttatttgtgtcttttctttctcttttctttgttaggtttgctagagctttatcaaatttgctgatgttttcaaakaatcagttttggttctgttgattttatctgttgtttttaggtttttaatttctttgatttctgatctttattattttattccatctgcctgttatggagt

SEQ ID NO: 21947 - DNA, 201 bp, Homo sapiens
ttgataaggaattaaaggatgaatctattaagaatgcaggtctcagtacaagttaaactgaccctagatgcctctctctctctctctctctctctctctcwctctccatatatatgtgtatatatatatatatatatatatatatatatatgtatatatgtaaaacactttattaaaggaatctctgtctccatttgttgc

SEQ ID NO: 21948 - DNA, 201 bp, Homo sapiens
aggaatgtgagggctccgcaatagtgaatcagtcgtggtgcaagggggaaagggagcttcctgtcgtgccacttttggcccagctcccagccttcacaggwcaccagttctgcagctggagtgacttggtgtctgcaggccaagcctgccagtgccgattcccacactggaggacggggactgtgcaggctgccttgctgc

SEQ ID NO: 21949 - DNA, 201 bp, Homo sapiens
actgagaatcaataatttgccactttaagtgcagtgtagaaatcttgccaccatttagttccctctacgttcatcaaaaccttatccaactatgttataattttttttttttttgagatggagtctcgctctgttgcccaggctgtagtacagtggcgcgatcttggctcactgcaacctccacctcccaggttcaagcag

SEQ ID NO: 21950 - DNA, 201 bp, Homo sapiens
tgataaggaattaaaggatgaatctattaagaatgcaggtctcagtacaagttaaactgaccctagatgcctctctctctctctctctctctctctctctctctccatatatatgtgtatatatatatatatatatatatatatatatatgtatatatgtaaaacactttattaaaggaatctctgtctccatttgttgca

SEQ ID NO: 21951 - DNA, 201 bp, Homo sapiens
gggactctttgatggttctccaatcagctgtggctttggagttcttgctctgctgcacacttttgtggctgcatctgcctctagggcaaggggtcaagagkgttagaggataaaagcttggtaaacttacagccagtttggtgttctttgaattcttgttttcttctcctatctgcctgctcatgtttactcatcagactc

SEQ ID NO: 21952 - DNA, 201 bp, Homo sapiens
ataaggaattaaaggatgaatctattaagaatgcaggtctcagtacaagttaaactgaccctagatgcctctctctctctctctctctctctctctctctmtccatatatatgtgtatatatatatatatatatatatatatatatatgtatatatgtaaaacactttattaaaggaatctctgtctccatttgttgcatc

SEQ ID NO: 21953 - DNA, 201 bp, Homo sapiens
gttataagagaagcttctattttctatggctgtagcattattttctataggtgcagggttccacttctgaaaaataacttttaacataaaaatccgcaagyctaacatgaaaataaatggaaagaacataaaactcaactatgtgcctttaaaaacatttatagtaagcatgtgaaggcaaacagtgtctatgaaggttaa

SEQ ID NO: 21954 - DNA, 201 bp, Homo sapiens
aaggaattaaaggatgaatctattaagaatgcaggtctcagtacaagttaaactgaccctagatgcctctctctctctctctctctctctctctctctctccatatatatgtgtatatatatatatatatatatatatatatatatgtatatatgtaaaacactttattaaaggaatctctgtctccatttgttgcatctg

SEQ ID NO: 21955 - DNA, 201 bp, Homo sapiens
tctccttcttcttctcttattactagtcatgggccctggctggggtacctagtttctctaaaccttttccttgtgtatagagtaggagcagtagtagctcmtttgcagacttgtaggaggattaaatgggacagtaggaggattaaatggtcctaggaccagtgggtttccaacactaattgcttccctgaccccatttga

SEQ ID NO: 21956 - DNA, 201 bp, Homo sapiens
atggggtaaaatgaacatgaactttttaatgattaaaagtgaccttaaagttatgggtatcattctgggaccagggataatgactgaaggaaaaaaaaagyctttatatttttattctattggtttccgattgtctaacaaactaattataataaatgtgagcacatcacttcctgtttcagacttctcaaaggtgttcca

SEQ ID NO: 21957 - DNA, 201 bp, Homo sapiens
gcagagctcaggtggtcctgctcactggcctgatgcttaccacctgctgtgtggcccggcttctaactggctatggactggtacctctattgggttcaacrggaaaatgcaggtaccagtccgtggccagtgggtggacccctgctgtggacccctctgtattaatcatgtttttgattccccagattttaggatgctttg

SEQ ID NO: 21958 - DNA, 201 bp, Homo sapiens
ggcttgcttctttgcacgcccttcttaaatacttgtgattccccagggagtgggggacaagggtgtggggtgacatccaggtgggtggggagcccatggarcaggagacacagtgggaaaggatcagggagagtggctatgaccaagggcaggcctggtcttgggggtgtggaggccaggctcaggctggagttgtttgcc

SEQ ID NO: 21959 - DNA, 201 bp, Homo sapiens
ctgaaggtggctccagctcccaagttccctcgtgtgtctgtcctgatcccctttcctgatgccctcggggcctggccttcttgtcctcccatgctgcagtrtagtccaagaaggcgggtggagcttcagggcctggctgggtgggtgtgtctctgggcctgggagggaggagtgttcggatgggctggggagcggcaatgt

SEQ ID NO: 21960 - DNA, 201 bp, Homo sapiens
gagcgcgctgcccatggagcgggggatgggcgcccgccgaggtccgcgcggccagccagggttcgagcccacggcccgggctctactctgagatgcttgckgcggccggccccctctggctccccagctgtcctggggcctggcccggcgccccgccccggtctctcttcttgctccccaggtcccactccacgaggaacg

SEQ ID NO: 21961 - DNA, 201 bp, Homo sapiens
aggtgcttggggtgggctccagccaggggagggcagggccttcttagcggaaggaaccctaaatggggtggggacctggggtgacaagctacaactttcayagtgccacctgttcccttgacactggttccacaaaccccatctctgttgacattcattctttgtgcttgggagctgaagccacagtttggaagcacatat

SEQ ID NO: 21962 - DNA, 201 bp, Homo sapiens
agaagctatctgtgccatgtagtccacatctggtgccattctctgcacatggcatccctaaacagagccctctcctggtgccggtgagataagagagttcyctgaccccactcgcaggacgtgtgatagggacgtggctcctttgtttggctgcttgctccttacgggatggggggcacgcagacgggcaggtgcaggaac

SEQ ID NO: 21963 - DNA, 201 bp, Homo sapiens
ctgttaggcatggtgaaaccccttctctacaaaaaatacaaaaatgagccgggcgtggtggcgggtgtctgtaatcccagctactccggaggctgaggcargagaatcacttgaacctgggaggtggaggtttcagtgagctgagatcatgccactgcattccagcctgggcaacaagagcgagactctgtctcaaaaaaa

SEQ ID NO: 21964 - DNA, 201 bp, Homo sapiens
atttctaacccattccatccctggatgtgattctttttacacttggttacccatggctgtgcctgtgggtctccaccctttggttttgttctgtgtttccygttgtatgagtcaggggagactaagttatgctgcagtaacaaacaatccaaaactcccagcagctttcatgacacagtatttcctcctcctgctgtgtgt

SEQ ID NO: 21965 - DNA, 201 bp, Homo sapiens
gagggcttatgtcctcccgtttgcatgttcttgtgtactcatgggtgccaagacagttgctacttgcccatggcatctcctattccctgaagaaataaaamcgtcctgtgggttgagatggttttaggtagagggagctcagggaagggactgaaggagacttttcccccagactgagaggactggccatgctggcatgag

SEQ ID NO: 21966 - DNA, 201 bp, Homo sapiens
atggtcacttcacttggttgttgccagttgctgtgccagagggaaagagagctctggggggctcagcctggatgtgctcacatcacttctgcttatgactygttggccacaaccagccatgtggccacagccagtcacaagggatccaggaagcacagccctactatgtgcctggaagcagagagaactggaaacaactgg

SEQ ID NO: 21967 - DNA, 201 bp, Homo sapiens
gtccccgtagctggactttggcaagtctgcactttccacggcttcagccctgtggccctgtccctcatatagactcccacgtcttgcccctgctgccccaygaagtggcagccctctcctgctaatggcagtgggctggggcagagaccacgcatctctctgccattgctggcctgtgacagcccctttctctggggtgct

SEQ ID NO: 21968 - DNA, 201 bp, Homo sapiens
acgacatggctcatatggaggctgctcggagccatctgtataggctggggctctgggaacctgtggcctgtcacggcacggtatttccatcttactgtggycttgtctgctctgagtgcatagagtggccagaatcccactggcctgcccctccctccccgggacctggccatagggcaggcctaccttgctctatttggt

SEQ ID NO: 21969 - DNA, 201 bp, Homo sapiens
ctgggaacctgtggcctgtcacggcacggtatttccatcttactgtggtcttgtctgctctgagtgcatagagtggccagaatcccactggcctgcccctscctccccgggacctggccatagggcaggcctaccttgctctatttggtggaaaggggtcaggtggaaaggtgtgggttcagttcccaaatctgattgatt

SEQ ID NO: 21970 - DNA, 201 bp, Homo sapiens
ctgggccgagcccccctcccaacagtgccccatctccagtggccagtgtcagatgctgaggtggccttgatttggctgggctctagggctcctaactcctwccctgccatggctgtaacatccaatgctggtcctcctgtgtcccaggaggctcccagggtacctgccctcactcacctctcccacagggctctcgtaact

SEQ ID NO: 21971 - DNA, 201 bp, Homo sapiens
ggtgccctggacagtccagcagtgtgatggctcagccctccaaagggcttctgggggctctggtgtggtgggcagtgctgagcagatgtgtatgtacacamatgcatacatacacaaggagactgttgcagacacccatgctgcctgggcatgtttagcagaaagagccaagacttccagctgctgctcagagctccgctg

SEQ ID NO: 21972 - DNA, 201 bp, Homo sapiens
ggcctgaagccaggtttaggaggcaggggcaagttgggctcgtggtgggctgcttgaggctggctggtcaccataggcaggagggctaaggccgggaggargagctgctgctaccaggagcaggatgcaggggctggggatacctggaggctgttactccttcacttaccaatggtcccatgttgagtcaacaagcaccct

SEQ ID NO: 21973 - DNA, 201 bp, Homo sapiens
gtgtctgggcaggacttagtgaagtgggggaggttgtggaggaggctacagcagatgccaggtatgggtaggtggacttggctggcccgcacgcccggctrtctgccctggccacgccatcagaagggttgaagccagatgagttgaactccaggcagtgctgggctatgacaaacctgcttaagaatgaagcttctgggg

SEQ ID NO: 21974 - DNA, 201 bp, Homo sapiens
aacgccaaattgctttcgaaaagatcatttcctgtcagtgtgcaagaagattggttttaccacaactcaacaagcatttgatgtggcaattaagcctttgyttttcattttctgctatttaatagatgtgaagtgacctcccattggattcccagagaggtggattttcctgtgtttgctaacagcaccttcccatgggtg

SEQ ID NO: 21975 - DNA, 201 bp, Homo sapiens
tcattgggtactggggggtccaggagagtgatttttctgctggccttggtggagtaggcccatctcctgccatccctcatacggggccaacacctggcagytctgggatgcctggccagggtgtcaggtggaattaactggcagcagggccaggtgggtgttgattgaggctgattgctggaaggcagcggctgcaggctg

SEQ ID NO: 21976 - DNA, 201 bp, Homo sapiens
gcaccccaacgctctcagccagaatgaggcactgcctcttcagtgctcacaagagcaatttgcagttcctcttagttttattaggctccatgttttaggawaattattcatttatctataattgagtccacttatttttgcaggcatgaggagatgtattaatcaggactgtttgttgaaagtgataaaaataccagttaa

SEQ ID NO: 21977 - DNA, 201 bp, Homo sapiens
aggaattaaaggatgaatctattaagaatgcaggtctcagtacaagttaaactgaccctagatgcctctctctctctctctctctctctctctctctctccatatatatgtgtatatatatatatatatatatatatatatatatgtatatatgtaaaacactttattaaaggaatctctgtctccatttgttgcatctgc

SEQ ID NO: 21978 - DNA, 201 bp, Homo sapiens
ttaaaggatgaatctattaagaatgcaggtctcagtacaagttaaactgaccctagatgcctctctctctctctctctctctctctctctctctccatatrtatgtgtatatatatatatatatatatatatatatatatgtatatatgtaaaacactttattaaaggaatctctgtctccatttgttgcatctgcttcct

SEQ ID NO: 21979 - DNA, 201 bp, Homo sapiens
caccctcattcttgagtatttaggggagcacccaaacagatgctgagagatcaaggcaggattttggcctctaataataaggatgctttgtttccagcacrctgagcgtgtgctcagacagtgggctataccgttttaagagaacagcttttgggctggagtctcctagactccattccctgctttaccgcttataccctg

SEQ ID NO: 21980 - DNA, 201 bp, Homo sapiens
aggatgaatctattaagaatgcaggtctcagtacaagttaaactgaccctagatgcctctctctctctctctctctctctctctctctctccatatatatrtgtatatatatatatatatatatatatatatatatgtatatatgtaaaacactttattaaaggaatctctgtctccatttgttgcatctgcttccttgca

SEQ ID NO: 21981 - DNA, 201 bp, Homo sapiens
gatgaatctattaagaatgcaggtctcagtacaagttaaactgaccctagatgcctctctctctctctctctctctctctctctctctccatatatatgtrtatatatatatatatatatatatatatatatatgtatatatgtaaaacactttattaaaggaatctctgtctccatttgttgcatctgcttccttgcaag

SEQ ID NO: 21982 - DNA, 201 bp, Homo sapiens
ggtggaagaggctgaggtagcagagcttggcttggcctgtgctgaatcaccaagggcagccgaggggtctgaaggggtgatgactgcttcagctggccgaygttctgtttctcagggattcacaattaggataatgacatgagggatgaccttgccagcagtggtctccaggcccttcccctcttcctcactcagtttcat

SEQ ID NO: 21983 - DNA, 201 bp, Homo sapiens
actatgtgtctggctttgtgctgggtgtagtgacaaagatgagcaatgtgacatctttcatcctccagaaactcttggtctagtggagtgaaaaggcagayaattccttgcaggaatagaaacagaaacccagagctgagatcatcagctgcttccacccgctctgtccttgcctgctgggaacacactacaaaggaggaa

SEQ ID NO: 21984 - DNA, 201 bp, Homo sapiens
ctcagggattcacaattaggataatgacatgagggatgaccttgccagcagtggtctccaggcccttcccctcttcctcactcagtttcatgcttcttggrgccctctgtttttcatggctggggctgatgttcctgggcattaattggtcttcattagacagtttgagagttgaggatgctttgggcctcactgtgtctc

SEQ ID NO: 21985 - DNA, 201 bp, Homo sapiens
ccagaggggatctcagtggggacatacaggggagacagctgcccaaccaggaggtgactgtgagtgcaggtagcatttcagatgctccttaggcactgagmggccatcctgggaacccagatgtaggttcttgctgcatctggggttccaggatggctagtggctcctacaaggagagcctgccccatgagcttcatgtac

SEQ ID NO: 21986 - DNA, 201 bp, Homo sapiens
ccatcacaaaataataataataataatgagatagttacctttacttgctgtttccactgcagctcttcccattctctcaggaacccctctgcagcagatgytggcagtgatcaccgcccatcctcctcctctcccttgtcagtgggctctgcagcatctgcctctctgtgtctggggctttttctggaaccttaaaggcca

SEQ ID NO: 21987 - DNA, 201 bp, Homo sapiens
caaaatgtagtgctaggttgagaaaccctggtgtaaatgagtaagcatcacctagcgcttggcacccaagagagtgttaatcagggctaattgaattaagagtcagagtgttaagagccagaggactctcaacactggggctcctaccaggtgctccagtgccccatggtttgctcctgggactcaaggtgggggctgtga

SEQ ID NO: 21988 - DNA, 201 bp, Homo sapiens
ttatgaataaagccactatgagcatttgtgtacaggttttctgggataaatgcccaagagtgcaattgctgtgtcatatggtaattacatgtgtagtgttaaaaaaaaattacagccaaactgttttccagagtagctgtaccattttatacttcagccatgaaatgcataagaaaatgcctctacatcctcacctgcatt

SEQ ID NO: 21989 - DNA, 201 bp, Homo sapiens
aaaatgtagtgctaggttgagaaaccctggtgtaaatgagtaagcatcacctagcgcttggcacccaagagagtgttaatcagggctaattgaattaagagtcagagtgttaagagccagaggactctcaacactggggctcctaccaggtgctccagtgccccatggtttgctcctgggactcaaggtgggggctgtgaa

SEQ ID NO: 21990 - DNA, 201 bp, Homo sapiens
ctaatttaattacactgtggtatgagagactgttataattttggttcttttgcattggctgatgagtgttttactttggattatgtgatcaattgtaaaakatgtgccatgtggcaatgagaagatgtttattctgttgtttttgggtagagaggtctgtagatatccataagttctatttgatccagtgctgagttcagg

SEQ ID NO: 21991 - DNA, 201 bp, Homo sapiens
aatgtagtgctaggttgagaaaccctggtgtaaatgagtaagcatcacctagcgcttggcacccaagagagtgttaatcagggctaattgaattaagagtcagagtgttaagagccagaggactctcaacactggggctcctaccaggtgctccagtgccccatggtttgctcctgggactcaaggtgggggctgtgaatg

SEQ ID NO: 21992 - DNA, 201 bp, Homo sapiens
acactgtggtatgagagactgttataattttggttcttttgcattggctgatgagtgttttactttggattatgtgatcaattgtaaaatatgtgccatgyggcaatgagaagatgtttattctgttgtttttgggtagagaggtctgtagatatccataagttctatttgatccagtgctgagttcaggtcttgaatatc

SEQ ID NO: 21993 - DNA, 201 bp, Homo sapiens
atcagttgcttgtgaaggacactcccttccccttcctgagcctctctgcctgcatccttctggtgtctgaaagagcttctgagggccgttttgctctgatrtttctttccaggtgctgggatatgctgggatttggccaggaccaaggctccttgcacttctattcactagcgtgagtttcctgcccacctctcccagctc

SEQ ID NO: 21994 - DNA, 201 bp, Homo sapiens
agtgttttactttggattatgtgatcaattgtaaaatatgtgccatgtggcaatgagaagatgtttattctgttgtttttgggtagagaggtctgtagatrtccataagttctatttgatccagtgctgagttcaggtcttgaatatcttaatttcctctctcagtgctctgtctaatattgtcagtggggtgttaaagtc

SEQ ID NO: 21995 - DNA, 201 bp, Homo sapiens
agtttgaaatcaggtaatgtgatgcctccagatttgttccttttgcttagtcttgctttggctatgtggactcttttttggttccacatgaattttagaattttttttttttttctaattctgtgaagaacgatggcggtattctgatggggattgcgttgaatttgtagatagcttttggcagtatggtcattttcacaa

SEQ ID NO: 21996 - DNA, 201 bp, Homo sapiens
tttttatgcaggtttttacagtcttgatttaagaggttcttgagttttcctgtttttgcctgtgggttgcccttgctgagaaacttgggctgagggagttyctttttcagtgacaatagccacttagggaaaaagttcttcccaaaacatagagatgatagcggatggggaaagaaagtcacttttgctgaggtcctgata

SEQ ID NO: 21997 - DNA, 201 bp, Homo sapiens
tttcacaatattgattctacccatccatgagcatgggatgtttttccatttgtttgtgtcgtctgtgatttctttcggcagtgttttccttgtagaggtctttgactcctttgttaggtatattcctcagtattttatttattttttgcagctattggaaaaggggttgagttcttgatttgattcactgattggttgctg

SEQ ID NO: 21998 - DNA, 201 bp, Homo sapiens
aggtgtacaacatgatgttttgctatacatacaaatagtgaaatggctactgtatagccaagtaaattaacacattcatcatctcacatagtttacccaattttttttttttttttgtggcaagagcccttttcatcactttcaaggccctcactaaatgaccatttttccatctgtcctggtctccaacttcattcccca

SEQ ID NO: 21999 - DNA, 201 bp, Homo sapiens
aaatccaaaatgagtgttcctgattgctagggtgcacaagtgtgtgcatgtgcatgcgcctctcagtcaggccaggccccagatcaaatgactggttcagragccatgctgggtgacattatgctatctacatacaagggagagcatcggggatctcctctgcaattgtgtagccagacttagaagtgtcacctgtcacat

SEQ ID NO: 22000 - DNA, 201 bp, Homo sapiens
tcaaatcccacccagcctctagatccattcaaaagcccagaacttctggactccatcagcttaagatgggctccttgctgtactgtgactcaggagcttaracaagcaaactgatgctcacggttgtctgcagtccatgctcccaaagcacaccagacacggtcctagaattgggacaggataaatgcagtaagcatccca

SEQ ID NO: 22001 - DNA, 201 bp, Homo sapiens
agttgggaggtggcatcctcagggtgcatcccagcacccacaggagactggcctggtcatgtgctccccttgccttgtgtttcctttgacttgtcggtgaygtcttctggaggttgtgggctgtggggagggagggacttggtcgcttttgttccctgtggtatcctcagctctaagggcagtttgtagtgcacactcaat

SEQ ID NO: 22002 - DNA, 201 bp, Homo sapiens
atggcattgcaggcagggccttgggaggtaattaggtttagatggggtcataagggtggggccctcatgatgggattagtggccttataagaagagacacyggagagcttgctgtgtctctctgctgtgtgaggatgcagcaagaaggcagccatctgcaagccaggaagacagccctcatcaggaaccaaccatgctggc

SEQ ID NO: 22003 - DNA, 201 bp, Homo sapiens
ctgccttcttagggctacagtgcccaaatttctcaaatccagccttggaccacatgagctgaagatccatgtacctctgaggatgggtgactctcatctcraaccagtctttatgctgagctgtatttttagtagagacggggtttcaccatgttggtcaggctggtctctaactcctgaccttgtgatccgctcgcctcg

SEQ ID NO: 22004 - DNA, 201 bp, Homo sapiens
cttctctcattggcttgactcttaggaatgtccttcccacccaatgacaaagaggaaccaccacaactccagcttgtctggtctttggtgtccacagtctyagcacaagtaagagtccctgtttggaaagctcaggcaaaggctttaaggatatagtattggcccagctggggtggctgcccatccctgaaccaactgggg

SEQ ID NO: 22005 - DNA, 201 bp, Homo sapiens
aacaagggacgtaattcacagagcctcagtgttccttcctgtacacttgggatactggtgcccccacttaatgggctgacttcgggaacaaatgaagtaaygattacagaggacttagcatgtgcctggcaccaaggaggtgctcagtaaagaacagctacagttattgttctcatgatgtcacctggccagtgcagaggg

SEQ ID NO: 22006 - DNA, 201 bp, Homo sapiens
agggtgtcaggtggaattaactggcagcagggccaggtgggtgttgattgaggctgattgctggaaggcagcggctgcaggctgcgcaaagctatttccasctgctccaattgtatcaaggaggcttaatccttctaagtgcctttgtggttgggtggtgtggagtgaggatgggggaccaaggccagagcaaggtcagac

SEQ ID NO: 22007 - DNA, 201 bp, Homo sapiens
catacaccgtcttgtgcatgtttcacggagccacaggatgccggagtcggctggggtcctggagccatttcagctgatcctcctttcattgtagaagcctsatggacagtcacctgagtggcgcttgcagctggcccaggaatctcactgggtaaaggaatgcagtgagcttggcagcatctgctgtactgcaggctcctg

SEQ ID NO: 22008 - DNA, 201 bp, Homo sapiens
acccggtcccccatccatccacgcattcaaccatctttccttccatccatccaactatccttccatccacccatctgttgatctatccattcacccatcartctgcccacccatctacctacccatctgtctgttcttttgtggccatcattcagcattttcctcagtgtttactatgtatctaccatgtgtcaggcacca

SEQ ID NO: 22009 - DNA, 201 bp, Homo sapiens
gcccaggaatctcactgggtaaaggaatgcagtgagcttggcagcatctgctgtactgcaggctcctggtgattgcctgttcaaaagcagaggcatctgcrtgttctcactcatgtgggagctaaacacattgaactcatagaagtagagagtggaatacaggttactagagactggggagggcagggggagggaagatag

SEQ ID NO: 22010 - DNA, 201 bp, Homo sapiens
gaagattgctcctgtgagcagttagcccaagaggcaaggctggaggcaggaaaatgaaaagaccaggagctcctgccttggtgctggggctgcagcccccsactactatgagcaagttcttagggagtactatgagctctccaccacccctgccttaatgctggtctcatgggccacctcagtgcctatgacccaccatac

SEQ ID NO: 22011 - DNA, 201 bp, Homo sapiens
tctgctgtactgcaggctcctggtgattgcctgttcaaaagcagaggcatctgcatgttctcactcatgtgggagctaaacacattgaactcatagaagtrgagagtggaatacaggttactagagactggggagggcagggggagggaagatagggagaagatggttaagggacacaaagttacagctggttagaaggca

SEQ ID NO: 22012 - DNA, 201 bp, Homo sapiens
ggctccctttcttgactctgtggctttggaggcttcccctttccaccagctgcaggcgcacagctcagggtggctcctctggtagatgcttgataatgtastgaaggataaactgcagggcaggaggcctgtgccagcagggcatgcagcaccaaatcaggaaaagcagcaaggctgaggcctggtaattccctgcagttg

SEQ ID NO: 22013 - DNA, 201 bp, Homo sapiens
caatcctgggcagtacagggaatgacacagaaagcaaagtgaagcagggattgcttagggaatgtgaaggactggcagccaagccggtgctctccttgtaygtgctgggcctcccactacgcacctggcttttgtgtggttctctccacctccagtgccatctccccagccccagcctggacacttgaggtcacttccccg

SEQ ID NO: 22014 - DNA, 201 bp, Homo sapiens
agatgaagatgtctcatgtcagacatctgagatgaaggctcatgcaccagcagtggactttggaacatgtgccaagggaagaggaagtgtgaatcagggcrggagggaaggccagtctgattggtcactgccgtgggccactggagctcattcctgctggggccctccagggaaccacaaaaaaatgcatctggattgtcc

SEQ ID NO: 22015 - DNA, 201 bp, Homo sapiens
tgagatgtacacagtcacggtgggcaggtgcacctcactcctatgactcatttccctgaacacagccttcaagcttatcagaaacagagtcccctctaatyttacaaagtaatgtactgatcattttctcttttaactgttgtagaaagaaaggtgatttatttggttatcttcatatctgagttacatgtataaactaaa

SEQ ID NO: 22016 - DNA, 201 bp, Homo sapiens
ctgctctgtgccaggcattttaataagtgctgaaggacctgctgaaaataggtcaaacaatactctgtcctcatgcagcttatattccagtgaggggagakagacaagaaatctataaaagtttagaaactaaataataaaataagttggatcattttatatagttatgaatactattgaaaactacaataggaatacagg

SEQ ID NO: 22017 - DNA, 201 bp, Homo sapiens
tgacgttgcagaagttctggagcctcaagagaccacgcagcttctgttttgttcccttggacgccatcctgaactgggcaggcgctgaagaaccaaggacrgaaaccacgtggagagaaaggccaagtcatctcagccggctcagctgaacccaggacctattgatcttccagctgaatgaaatcccaggagcaggctcca

SEQ ID NO: 22018 - DNA, 201 bp, Homo sapiens
ctctgatgggaagggacagtgagtgcaaaggactagaggctccaaagagtttggtgagcttgaggaacagaaaggcccagctgggctggggtgtggagacytgagaaaagaatgggctgaagcaagctcgggatgctgggcaatgcccaggccatgggtcccgatggcagtgggagagcctgggttctgctcttggggctc

SEQ ID NO: 22019 - DNA, 201 bp, Homo sapiens
tctagtaaaatcattatagtctggggatttcttttacaggagctcttaaattacaaattaaatttctctaacggttattgggatattcagattatctattkcatcatggttgacttctggtagtttgtaggaaataattggtcatttcttctaacttgtcaaatttatgagtgtaatgttgtttgtattttcttttattgt

SEQ ID NO: 22020 - DNA, 201 bp, Homo sapiens
ttcttatagctcctcctgcagctttaagggcacagctgggcagcacatgttggcctgtgtccagccatcagcgcccacctttttgaggccacagctgctcygttttcctcatcagaggttctctctttttctttgaaatttaagcattgttcagttatgaaacttagcattaatttctgtgcataaactaagactggtttt

SEQ ID NO: 22021 - DNA, 201 bp, Homo sapiens
atggtgtgctgcacccactgtcctgcacccactgtctggcactccctagtgagatgaacccggtaccccagatggaaatgcagaaatcacccgtcttctgygtcgctcacgctgggagctgtagaccggagctgttcctattcagccatcttggctccagctcctgccatctttatattcatgtgtaccccacatttatct

SEQ ID NO: 22022 - DNA, 201 bp, Homo sapiens
tttgtttagctccaaattaaagctaaagcagaaaatacaaaacatttcctccatcacaggtgaaggaaccggctgtcttatcagctctggagccgagtggyttggcatgtgtgtgctggtaattgtggagtctgaatgaaggggtgtctctggggaccatgctttccatcactgtccgtgtctgttatcatggttatctca

SEQ ID NO: 22023 - DNA, 201 bp, Homo sapiens
tgctgtctcattgcttgaatacttgtggagagagagaatggttgacagtagggccatgggcctgcctggttcagcatgccctggctcagggcacaagggtycacttagggggtctggaatagggttacctgtggcctgctggatcaggggccattagagccagagcctctgtccggagtgcagaatgacttggccctgctt

SEQ ID NO: 22024 - DNA, 201 bp, Homo sapiens
acttctttgtctttttttatctttattgatttaaagtctgttttgtcagagacaaggattacaacctctgcttttttctgtttcccatttgcttggtagatttttttcctttctttattttgagcctatgtgtgtcactgcatgtgagatgggtctcttgaagacagcataacaatggatcttggttctttatccagcttg

SEQ ID NO: 22025 - DNA, 201 bp, Homo sapiens
cacagctctttgggccccaatgtcctgtaacaaatgcttatggagcacatacttgtgccaggctctgagatacaatggtaagcaatgaagccttgtgtgayctccaggggttgactggggagcaggatgacctggatgctggtggctgcccggatgtgtatgtgtgtgtgtgccacctcaatgcccctgctcaggtgagag

SEQ ID NO: 22026 - DNA, 201 bp, Homo sapiens
attttagtagagatggagtttcatcattgcccaggcctgtctccaactcctgagctcaggcaatccattctcctcggcctcccaaagtgctaggattatasgaatgaaccaccatacccggcctcattacttccttttcatattcagaaatcaatttaaactttactttctggaatcccagtcccactcctgccaacatgg

SEQ ID NO: 22027 - DNA, 201 bp, Homo sapiens
gacactctggctttgagttttcagcattcttgtgctgattctttctcatctttgtgggcttatctaacttcaatctttgaggttgctgacctctggatggttttttttttttctccttttgtcctattcgatgactctgaggacttgattgtagtataaggtggattcactaacttgctttatttctgggagattttcagg

SEQ ID NO: 22028 - DNA, 201 bp, Homo sapiens
tgtgagactggcatgaagagtgaagctcctgggctgatgtctggcacacagctctttgggccccaatgtcctgtaacaaatgcttatggagcacatacttrtgccaggctctgagatacaatggtaagcaatgaagccttgtgtgacctccaggggttgactggggagcaggatgacctggatgctggtggctgcccggat

SEQ ID NO: 22029 - DNA, 201 bp, Homo sapiens
ttatcaaggcacttcatacctgctaacttatgccctctatgtctgtcttatcagcatgatgtcatcaatgttttagactagcatgatgttcttctcttaamtggtcagacggtcaaattcttatggactgtgtagctcagagacagaaagttgctatggacctcaggaaggatagtgaaggtttattgctatagctatctg

SEQ ID NO: 22030 - DNA, 201 bp, Homo sapiens
tctctgctgttgcctctttggtgttgaagagaccaatgcaagatgcccttaggggtccctcctggggtcccagctctttagagcaatgaactggttgccargtgagtataaaagagtggccgggccaggagggaacccacacatccacttcctgaggggtgacccagctccctgaatgtgtgtgtgtgggtgtctcttggt

SEQ ID NO: 22031 - DNA, 201 bp, Homo sapiens
atatacatttagattttatattatttcttgagtcagtttgttaagatgtgattttcaataagtatttccacttcatctaaattgtcaaatatcatggcacaaaaaaaattgttttcttaccctgatttttgttgttttcatccctttattcttttcaaaaaacaaattttggccttattactttgttttgtttaaaatttt

SEQ ID NO: 22032 - DNA, 201 bp, Homo sapiens
ctgttagaaagtcaggaacggcccaatatgaaaaatgagaatagcttcttgccaagtagggcataacttggctcccaagccctataaatgtctggcatgtwtaacttgtgtgagttccatacagcatcctcactcagtggagtcatgttaaatcctgacttgtgggagctgagtgtcagagcctctgtcctgtagcctgga

SEQ ID NO: 22033 - DNA, 201 bp, Homo sapiens
agtataaaagagtggccgggccaggagggaacccacacatccacttcctgaggggtgacccagctccctgaatgtgtgtgtgtgggtgtctcttggtgtcyccaagctctgctgtgggctggagctcctgggacactgttgttctcattgggtactggggggtccaggagagtgatttttctgctggccttggtggagtag

SEQ ID NO: 22034 - DNA, 201 bp, Homo sapiens
agattttatattatttcttgagtcagtttgttaagatgtgattttcaataagtatttccacttcatctaaattgtcaaatatcatggcacaaaaaaaattkttttcttaccctgatttttgttgttttcatccctttattcttttcaaaaaacaaattttggccttattactttgttttgtttaaaatttttattaatctt

SEQ ID NO: 22035 - DNA, 201 bp, Homo sapiens
ggctcagcctatgcattaatatggtttccatttagtatggtttccattattaggcatttcttctttcctaagtctgttagaaagtcaggaacggcccaatwtgaaaaatgagaatagcttcttgccaagtagggcataacttggctcccaagccctataaatgtctggcatgtttaacttgtgtgagttccatacagcatc

SEQ ID NO: 22036 - DNA, 201 bp, Homo sapiens
tggcttactatatgaccaccatagaggtaaatatttcatgtgcccttgaaaagacggtatctcattttattgtttcatattgtggttgtggatttacctatttttttcttatttttattttatatcttataaaacttattttagcttcaggggtatatatgcaggtttgttatataggtaagttgcatgtcatgggggttt

SEQ ID NO: 22037 - DNA, 201 bp, Homo sapiens
tctggtagaattctgctgtgaatccgtctggtcctggacttttttttgttggtaatttttaccatttcaatcccactgcttgttgttgatctgttcagggtatctaattcttcctggtttaagctaagatggttgtatttttccaggaatttatccatctcttttaggttttctagtttatgtgcataaaggtgttcatag

SEQ ID NO: 22038 - DNA, 201 bp, Homo sapiens
aagtgagaacacatagtattttgttttctgttcttgtgttagtttgcttaggaaaatggcctccatctccatctaattttctgcaaaggacatgatctcattttttttttatagctacatagtattccatggtgtatatgtaccacatttactttatccagtttaccattgatgggcattaatgttgacttcatgtctgcc

SEQ ID NO: 22039 - DNA, 201 bp, Homo sapiens
tcagcttttggcatatggctagcccgttttctcaacaccatttattaaatagtgaatcctttccccattgcttgtttttgtcaggtttgtcaaagattagrtggttgtagatgtgtaacattatttctgaggcctctattctgttccattggtccatatatctgttttggtaccagtaccatgctgttttggttactgtag

SEQ ID NO: 22040 - DNA, 201 bp, Homo sapiens
tctgggatcctttcctacccaaggaactttctttagtgtttctttcaatgcaggtttattggtgcccagtggattctctcagtattcttttgaaaatatattttttccagcactcattgatgatggttatttttactgggtgtggaattttaagctagtagttatttttcttttataactttaaaaggtattattctactt

SEQ ID NO: 22041 - DNA, 201 bp, Homo sapiens
agaaggaggatgggaaggaaggaagaaaggaagaagggagggaaagaagcagggaaggaaaaaaggaaggagagaaggaagctgagaaggaaggagggaaagagagaaaaacagatgaaaggcagaaaaggaaggaatgaaagaaggagggagagaaggtaaaaaggaaggaaggaaagaaggaaggaggaaagggaagaa

SEQ ID NO: 22042 - DNA, 201 bp, Homo sapiens
gcctcagagatgagcaaagaccccactattgaaagtaaaagttctttaatttacatctggcatgcttttaacatcttgagctagatgattcctgtttagamcctcaaaataattcttgcaagagaaggttcatgtttcagttttcttaatatttacattatttcctttgcaagatgttccccagctcctttttaatctgta

SEQ ID NO: 22043 - DNA, 201 bp, Homo sapiens
caaattatctttatttttctcttttttgtaatttaaaaaagtttcttgaacatatcatggatttttcaataacttgattgagtcatattttacaaatcacwatgcacccatttcaagtgtatatttcagtgacttttagcaactttactgagagatgattgaagtaaaataattgagattttgacaatgtacttttttttt

SEQ ID NO: 22044 - DNA, 201 bp, Homo sapiens
ccatctgcctgttatggagttaataaaatgcttttatttttatagtctcttaagataaaagctaaaagcttaagttaattttttttaaatctttctttttwttagtataagtattttattgctatgcatttccctctaagcactggtttacctgtgtctcacaaattgtgcagtgttgtgttttccatctttatgtaattc

SEQ ID NO: 22045 - DNA, 201 bp, Homo sapiens
gaaggaggatgggaaggaaggaagaaaggaagaagggagggaaagaagcagggaaggaaaaaaggaaggagagaaggaagctgagaaggaaggagggaaagagagaaaaacagatgaaaggcagaaaaggaaggaatgaaagaaggagggagagaaggtaaaaaggaaggaaggaaagaaggaaggaggaaagggaagaag

SEQ ID NO: 22046 - DNA, 201 bp, Homo sapiens
gcaagggtgctgctagcgatgctgttgtccactttgcttcacagagtctggatatatgatcccccgggagacagtcttttctaattacaatgccaaaaacwgttttaatccctcagattgagttgttggcacttattctctggggatggtgcatttggtgatgaatagcatttccctgtttgtgccaactgtgactcctag

SEQ ID NO: 22047 - DNA, 201 bp, Homo sapiens
atttataatcttttgggtatatacccagtaatgggatggctgggtcaaatggtatttctagttccagatccctgaggaatcgccacaccgacttccacaayggttgaactagtttacagtcccaccaatggtgtaaaagtgttcctatttctccacatcctctccagcacttgttgtttcctgactttttaatgattgcca

SEQ ID NO: 22048 - DNA, 201 bp, Homo sapiens
ggaaagagagaaaaacagatgaaaggcagaaaaggaaggaatgaaagaaggagggagagaaggtaaaaaggaaggaaggaaagaaggaaggaggaaagggmagaaggaagggaggaaggaagaaaggcagaagggagggaggacagacggtggttggtgggtcctgaggtctttggacacaagccagttgatttcgtttgc

SEQ ID NO: 22049 - DNA, 201 bp, Homo sapiens
ttgagttgttggcacttattctctggggatggtgcatttggtgatgaatagcatttccctgtttgtgccaactgtgactcctaggaggctgagaagaaaartgaggcccagctgttggagacgtggagagatcatctttttaggcatttctagtgccgttctggctgtagtttatttccatccttattcattttctttctt

SEQ ID NO: 22050 - DNA, 201 bp, Homo sapiens
agaagctctttagtttaattagatcccatttgtcaattttggcttttgttgccattgcttttggtgttttagacatgaagtccttgcccatgcctatgtcytgaatggtaatgcctaggttttcttctagggtttttatggttttaggtctaacgtttaagtctttgatccatcttgaattaatttttgtataaggtgtaa

SEQ ID NO: 22051 - DNA, 201 bp, Homo sapiens
tttggtggaatttttcagtaaaatcatctagtactgaatatttcttttatggaaaacttttaactatgtgttacatttatttaatacttataggagtactsaggttattgagttaatcttgggtaaattttgttgtttgtgtttttctttctttctttcttttttttttttttttgaaatagagtcttgctctgttggcca

SEQ ID NO: 22052 - DNA, 201 bp, Homo sapiens
cagaaaaggaaggaatgaaagaaggagggagagaaggtaaaaaggaaggaaggaaagaaggaaggaggaaagggaagaaggaagggaggaaggaagaaaggcagaagggagggaggacagacggtggttggtgggtcctgaggtctttggacacaagccagttgatttcgtttgcctcaggacccaagtggcgggaggcct

SEQ ID NO: 22053 - DNA, 201 bp, Homo sapiens
tctcaaccaccacgtttgcaactggccagccactgctatactgcagctcatgtaatcaataatgttgtattttacaaaagtagattattcatttgtcagaracatactacaaaaaagtaactatatggatttcagggaacaaaggattaatttctgatggagctaatcatgcttatgtggcatagtgggagcacgcagaga

SEQ ID NO: 22054 - DNA, 201 bp, Homo sapiens
agaaaaggaaggaatgaaagaaggagggagagaaggtaaaaaggaaggaaggaaagaaggaaggaggaaagggaagaaggaagggaggaaggaagaaaggcagaagggagggaggacagacggtggttggtgggtcctgaggtctttggacacaagccagttgatttcgtttgcctcaggacccaagtggcgggaggcctc

SEQ ID NO: 22055 - DNA, 201 bp, Homo sapiens
actttccttttccctttccgtcttcatctccacagggctgcattgccagtgcctgttgtgtgagattaggaggtattagtgactgctcattcaggggcaarctcatagaacatgcctggaaggggcagttaggacctctttagatgatgtaattaacctcgtcacatttctgcttgtagagtggataatgctgtcaaatgc

SEQ ID NO: 22056 - DNA, 201 bp, Homo sapiens
tgctttgactgtgtcccataaactttgctatttgagtgtgcattattttttagctcaaaatataacaaaaagtataaatgtgtgaggtgatggataccccrttgactctgatgtgattattatgtattgatgcttgtatcaaaacatctgatgtaacccacaaatatatacacttaccatgtacccacaaaaattaaaatc

SEQ ID NO: 22057 - DNA, 201 bp, Homo sapiens
gaaaaggaaggaatgaaagaaggagggagagaaggtaaaaaggaaggaaggaaagaaggaaggaggaaagggaagaaggaagggaggaaggaagaaaggcagaagggagggaggacagacggtggttggtgggtcctgaggtctttggacacaagccagttgatttcgtttgcctcaggacccaagtggcgggaggcctcc

SEQ ID NO: 22058 - DNA, 201 bp, Homo sapiens
aaaaggaaggaatgaaagaaggagggagagaaggtaaaaaggaaggaaggaaagaaggaaggaggaaagggaagaaggaagggaggaaggaagaaaggcagaagggagggaggacagacggtggttggtgggtcctgaggtctttggacacaagccagttgatttcgtttgcctcaggacccaagtggcgggaggcctcct

SEQ ID NO: 22059 - DNA, 201 bp, Homo sapiens
tgggcagttcccgcctggtgccagcagagagccccctgctgagcagagatgagggctgcccagggatgcccgtatgcagccagtcaccacagcaacaggargagaggtggctgagaggatgtgacatgggccacaagagttgtctagagacccaaattctgctagacttcttagaatgacctaatggtaaaattcaggtgt

SEQ ID NO: 22060 - DNA, 201 bp, Homo sapiens
gaggggcagagctgtgcgtctaccccactgcccgaggcaccaactccgcagatgtaaatgccaggctcatagcaagagactacgtgttgtgaaatgtgtcygtggttttgtgacatgttctctcggtgtgtctgttatttacagctggtgaggagggcctagctctgggagccgcaggagagggagtgctcaggctgaggg

SEQ ID NO: 22061 - DNA, 201 bp, Homo sapiens
agtgaaggcctttctcttcctcccttgacaccctccaggtgtttgtccagggccaccgcctccaggcagcttcccgctccagtcctcatccagttgctctsctccctctttgtaggccctggctgccatggggacttcagcaggcagggccatcttgcctttttccttcttccctcctccccttctagtttttggttgtat

SEQ ID NO: 22062 - DNA, 201 bp, Homo sapiens
ttcgagtccgggtagttcggtgccagaacctatcctcttaccgctgggccagtccttctctctgagagttctggagagcctcctttctcttgtgtcaatcrgcgtcctctgcactaatgtggcttttagtttcaaaggggccaagaaggagtgtgtttagcacttgattggtaaatgaatgaatgaatgaatgaatgaaca

SEQ ID NO: 22063 - DNA, 201 bp, Homo sapiens
ccaccccactgccgcccctcccgtcctcctggtgctgcctgtctttctccgtagttctcatctccttttaataggccacttggctggacgatgggttaacyttgttgttgctcgttcacctctatcccaagtggaagcgttaggagggcagggattgctgtcttttgggtcctcatctctagcgccgtgccttgcatacag

SEQ ID NO: 22064 - DNA, 201 bp, Homo sapiens
ttattcaagatctattttgtgccagtggctatattttcacatctgtgtgtggtgcaggtgccatgacttgttcttctctgcccttcccccattttacaaartaaggcatgaggcatgaccaacccaggctctgggctgctgtgtggtagaggtgggctggggcctgggcttcgtgattgccaagtccattctctttgcaca

SEQ ID NO: 22065 - DNA, 201 bp, Homo sapiens
cgggcacagcctgggtcatgtgcccatccaagagccaatcagtgttatcagggaggagtattttcattggccagcccaagccacgtgtctcacttctttcyaaaaccaggtggaattagaaagaagttccaggccaggtacggtggctcacgcctgtaatcccagcacttcgggaggccgaggcagatggatcacctgagg

SEQ ID NO: 22066 - DNA, 201 bp, Homo sapiens
tttgtaagttttagactgcagtgctgttttaagtaacgtgatgaagtctcactccatctggctccatcctacctaggacatgaatcatccctttgtccagygtattcacactgtagataatgcctaccagtcggtcactttgtacctgtcttggttatcagattgtctgtcttaggatttcaatgcttgtgttcaagtaac

SEQ ID NO: 22067 - DNA, 201 bp, Homo sapiens
tcgggaggccgaggcagatggatcacctgaggtcaggggtttgagaccagcctggccaacatggcgaaaccctgtctctactaataatacaaaaattagcygggtgtggtggcgggcgcctgtaatcccagctactcgggaggctgaggcaggagaatcgcttgaacctgggagaccgaggtttcagtaagccgagatcat

SEQ ID NO: 22068 - DNA, 201 bp, Homo sapiens
atattaaatggtaaattccagaaataaacaatttgtaagttttagactgcagtgctgttttaagtaacgtgatgaagtctcactccatctggctccatccyacctaggacatgaatcatccctttgtccagcgtattcacactgtagataatgcctaccagtcggtcactttgtacctgtcttggttatcagattgtctgt

SEQ ID NO: 22069 - DNA, 201 bp, Homo sapiens
gtggttttcaggctgtctaggccacccctactgatgggagttccccgatttcaggacgtgggagggtcagtgcctccccgagtgctggctttctgtggtgktgtagctggggcccagtgtggttggaagctgtctgccccttacaggatggtgtccctgtgggaaggcccgggctacagactcctgagcgcacaaagtcaa

SEQ ID NO: 22070 - DNA, 201 bp, Homo sapiens
ggaagctctgaggattagtccttttggaacaatggagtgtcagtgatcatttggaaaagtaattatgtcaaatttaattatcatgcatatgcatttcatcracatcactgtgcacacccaggagacagtggggaaaggactgctccagcatgagcccttgatagaggaatgcggtgcaaaattgtacatgttgtaattgag

SEQ ID NO: 22071 - DNA, 201 bp, Homo sapiens
ttctgtttcctggatgtcacggttcttccattccatcatgaaatcctgtccaattcctaagtgtgtgcttggccaggggctggggattacagtgatcagcstttagcctctgcctctgccattgtgcatcctattagtgtttctatgtgttattgtgtacattttattgcaaacactgtgaaacaatctccttcttagaca

SEQ ID NO: 22072 - DNA, 201 bp, Homo sapiens
tctgcctccccacacagagatgaaattatttcccaagtgccttagatcatgaattggtaccttttggaaaggaaaagataatactgtttatgtgcgagtasaagagaattacttcacttgtctgtagtaacactgattaaactgaaatgtcagagctaatgttacagttaataaatgttatacatactcaaatctgtctac

SEQ ID NO: 22073 - DNA, 201 bp, Homo sapiens
gcttggccaggggctggggattacagtgatcagcctttagcctctgcctctgccattgtgcatcctattagtgtttctatgtgttattgtgtacattttaytgcaaacactgtgaaacaatctccttcttagacacaacactggacaagtaagtccagtgatcagactcctaggagagcaacctggagttgtctgtgatag

SEQ ID NO: 22074 - DNA, 201 bp, Homo sapiens
ttgattttgagacacacgcatgttgttgtgtatattggcggttaatttttgcatatgatatgaggtaagggttaagattaatccttattttatttttttayatagttatttaatttttccagcaccagccattgaaaatatcctttctactttggatcttttgtcaaaaatcaattgcccttcagtatgtgtatctattct

SEQ ID NO: 22075 - DNA, 201 bp, Homo sapiens
ggtctgtgtaagtaccctctatgatgttctcacaatgacacaatcatctaacaacacatttctcagaacatatccctgtcattaagcaatgtgtgactgcrtgtggaatccaaaaaagttgaacttatagaagcagagagaagaagggtgagatgccgtgggccagagtgacagtggggggttggggagatggtggtccaa

SEQ ID NO: 22076 - DNA, 201 bp, Homo sapiens
ttatttcactcagcatattgattttgagacacacgcatgttgttgtgtatattggcggttaatttttgcatatgatatgaggtaagggttaagattaatcyttattttatttttttatatagttatttaatttttccagcaccagccattgaaaatatcctttctactttggatcttttgtcaaaaatcaattgcccttca

SEQ ID NO: 22077 - DNA, 201 bp, Homo sapiens
tgctcagaactactaatcattcacaatcatcagggagagctactttgattcacacaaataactcaagggtggaaggacacttgtgttgtcagctggatacygtggccctctggattgaatgtctgccagccatacctgccccttgtcctggagacaccagggccaatacagccaaatgggctatgacattgaaccatgacc

SEQ ID NO: 22078 - DNA, 201 bp, Homo sapiens
aaacaagcaccttcaagtagcaagtgttgaaaggagatgaaggttataggttctgtgcagggtgagttatattttacaatatatatatatatatatatatwttttttttttttttgagagtcccagtttgttgaaggctgtggtgcagtgacacaatcttggttcactgcaacctccagctctcaggttcaagcgattctc

SEQ ID NO: 22079 - DNA, 201 bp, Homo sapiens
gatgccagggtttggttgtggctcatggcatgaaggagctcatcagaagtctgtgtgctcatgaaggagctcatcagaaggctgcggtgcatggcccaggsccggatcacccctccactggaacagaggcgagcagactgccctgttggatgtgaactgttgctccatatcgttctctttttcctagagctgtgggacaag

SEQ ID NO: 22080 - DNA, 201 bp, Homo sapiens
tcttgtgacatgaatataataaattgttatttgtttttaccaatattttagataaaaaggtgcactgcattgtttaatttgtatttctttgcttattagcyaagtcaaacacttttaatatttcttgattgatcatcacgtctacttctattttgtgacatggttgcctatgtcctttgcacagatgtgttagttttatat

SEQ ID NO: 22081 - DNA, 201 bp, Homo sapiens
ctgatgccagggtttggttgtggctcatggcatgaaggagctcatcagaagtctgtgtgctcatgaaggagctcatcagaaggctgcggtgcatggcccakggccggatcacccctccactggaacagaggcgagcagactgccctgttggatgtgaactgttgctccatatcgttctctttttcctagagctgtgggaca

SEQ ID NO: 22082 - DNA, 201 bp, Homo sapiens
ttaggtctaacgtttaagtctttgatccatcttgaattaatttttgtataaggtgtaaggaagggatccagtttcagctttctacttatggctagccagtkttcccagcaccatttattaaatagggaatcctttccccatttcttgtttttgtcaggtttgtcaaagatcagatggttgtagatgtgtggtattatttct

SEQ ID NO: 22083 - DNA, 201 bp, Homo sapiens
tttgtataaggtgtaaggaagggatccagtttcagctttctacttatggctagccagtgttcccagcaccatttattaaatagggaatcctttccccattkcttgtttttgtcaggtttgtcaaagatcagatggttgtagatgtgtggtattatttctgagggctctgttctgttccattggtctacatgtctgttttgg

SEQ ID NO: 22084 - DNA, 201 bp, Homo sapiens
cacatagcagttagtcatcgtggctctttcctcctccaatctataacaaattgttagtttctttctttttttaaagaccttgtcaattttgaagagtattyatcaggtattttgtagaaagctcctcattttgagtgtatcagaagttttcttttcttttctctttctttctttctttctttctttctttctgtttctttc

SEQ ID NO: 22085 - DNA, 201 bp, Homo sapiens
ctgcttcttggaccttttaatggacaaagtgaggaagtatatgcatgtgtattaactcatgtatgcacacacatctctatttctgtctgtctgtctatctrtccattcatccatccatgtgtgtgtgtagatgtatatttgtagatacaaatagatggaaacataggtagatataaacacacatacatgtatgtataaata

SEQ ID NO: 22086 - DNA, 201 bp, Homo sapiens
tggaagagggggattatttaacaagagtctcacaggagtcccaggacttcagctcactgggctggtatggggctgaatcacttcctccccgaatcaatccyggtgcccaaggagtagaacaccctgattgtcagactggtgggggctgcccagtccctggactgagagtgaaagaggcacggtagatgggggtggggtcac

SEQ ID NO: 22087 - DNA, 201 bp, Homo sapiens
cctcagggtgaaggccagggttaatagcagggtctgcagaagcccctcctccctcctgaagccaccagcaacaagcaggaaagttctcaagagatcaaaakaaatgttttccctgagtgaggtcagtgctcacaatggtgcatccatgggtggaatgcagtgctccaattccagcaaggctggtgtggccgtgatagaagt

SEQ ID NO: 22088 - DNA, 201 bp, Homo sapiens
tattacctggatgatgaaattatttgaacaccaaatccctttgacacacagtttacctatataacaaacctgcacatgtacacccgaacctcaaataaacrttaaaataataatgataacaaaaagcatgaaaaaattatacaataaagtttacttttgtggtgtgcggttttatagattttgacaaatgcacagtgtcat

SEQ ID NO: 22089 - DNA, 201 bp, Homo sapiens; identical to SEQ ID NO: 3467

SEQ ID NO: 22090 - DNA, 201 bp, Homo sapiens
ctaggactgtgggcataggtcagctgcactgtccactgtgactgtggcagacaggggcaaagcgtgggcttgtagggagctcaggaaaggtgctgactgactgtctgatgactaaatgaatcatggagaaaggacagcctggagtctccacttgctctgtcgaaagagacctttctgacccattgaaccctgtcagttgct

SEQ ID NO: 22091 - DNA, 201 bp, Homo sapiens
gtaaaacttctatttgtttttcttcttgtgagaagattgtaagtttcatttgttcttgaaggatatttttataggatataaaattctggtttgacagttcttttttttttttcagcgtttcacattttaaagatgttgttccactttattctgacttccatatcctctgatgagaaatcaatggtgattccaatcctgctt

SEQ ID NO: 22092 - DNA, 201 bp, Homo sapiens
taggactgtgggcataggtcagctgcactgtccactgtgactgtggcagacaggggcaaagcgtgggcttgtagggagctcaggaaaggtgctgactgactgtctgatgactaaatgaatcatggagaaaggacagcctggagtctccacttgctctgtcgaaagagacctttctgacccattgaaccctgtcagttgcta

SEQ ID NO: 22093 - DNA, 201 bp, Homo sapiens
cgtgaacctgtagtcccagcaactcaagatgctgaagaaggactattgcttgagcccaggagttcaagttcagcctgggcaacatagcaagactgtctatwttttttttaaaaaaaagaaaaaataaatataatgatgaacttagtccctgtttacaaataggcaaatggggagatggagtgttcagtaggtccagaaggc

SEQ ID NO: 22094 - DNA, 201 bp, Homo sapiens
atatatatattttatcaaatttggaatgttttctataattactgctttaaatatttttgcatgaaaatgtttttctcttcttctggggctccaatggcacrtcaattaaaccatttaatgtagagtcctagaggctctgatctttctttttcaatcttttcccccttcttttctcttcagattgaattgtttctattgttc

SEQ ID NO: 22095 - DNA, 201 bp, Homo sapiens
aggactgtgggcataggtcagctgcactgtccactgtgactgtggcagacaggggcaaagcgtgggcttgtagggagctcaggaaaggtgctgactgactgtctgatgactaaatgaatcatggagaaaggacagcctggagtctccacttgctctgtcgaaagagacctttctgacccattgaaccctgtcagttgctag

SEQ ID NO: 22096 - DNA, 201 bp, Homo sapiens
cagcatattttgttttcattcttggagcatcacttgaaatgtagaaacaaacctttatcttaatttttccctcaacgtgacatacccttttgaaatcatasaaataacaatgtctgattgtcatgttgaattgcaagcatggatgtgaaatgctccaaagtctgactaaagccaaatattaggtcataagtcaacattttg

SEQ ID NO: 22097 - DNA, 201 bp, Homo sapiens
tacacacagatatacacatattaatacacatacatacacatatatatgtatatatagacacacacaaatatgtagtgaaagagagagattggggggagggrgagagagagagagagagagaacttctgtttgcttgtttagttttgactttcattcacaatctgcctgcattacctcacactttagagtcctcaggtaatt

SEQ ID NO: 22098 - DNA, 201 bp, Homo sapiens
ggactgtgggcataggtcagctgcactgtccactgtgactgtggcagacaggggcaaagcgtgggcttgtagggagctcaggaaaggtgctgactgactgtctgatgactaaatgaatcatggagaaaggacagcctggagtctccacttgctctgtcgaaagagacctttctgacccattgaaccctgtcagttgctagt

SEQ ID NO: 22099 - DNA, 201 bp, Homo sapiens
cataagtcaacattttgctgagaaacttggttactaagaggttgaaaatgtctatctttttgtgagaaaacttgtttgccagcaggaaaaatttataggaytgttatcttcctacaaggaaggagagagatgtgtgtaattttgcaacctgggtcaaagtcctttaggacttctgaaattggattggctgaggactgaagc

SEQ ID NO: 22100 - DNA, 201 bp, Homo sapiens
taatacacatacatacacatatatatgtatatatagacacacacaaatatgtagtgaaagagagagattggggggagggagagagagagagagagagagarcttctgtttgcttgtttagttttgactttcattcacaatctgcctgcattacctcacactttagagtcctcaggtaattattttctgcatttttttccag

SEQ ID NO: 22101 - DNA, 201 bp, Homo sapiens
aactttttgacaaattctgtttgctaagattgaggaagcaataccccaaagaacttcttcagtttggacatatggaaatctgacagataccactttcagctacagtacagtacccattaaaatcaagtattgaaataaatggaaactggaagcaggctttgaattactgtattacaaagggttaaaccaagatttaaaaaa

SEQ ID NO: 22102 - DNA, 201 bp, Homo sapiens
tttggaaagtctcagtggacatgaagactcaactgaacaaaggcaggagccagggacaatgtcctcaacaatgccaagaagcctgtagcttgctagcatgrcctattattgtctgtgatgtttcagtgctgtcactaagcccataatgaggcccccatcatctggtgcaagccatggtaaaaaggaaagaagcggcaaagg

SEQ ID NO: 22103 - DNA, 201 bp, Homo sapiens
tattctagtatatttttcttatcttctttgcattttttagatatatgaccaaaagggcagtcaacttcttccttccttttctcccttctctctcctcccaycctcttttttccttcattttcttttcttttcattctgtggttttttcttttgtacctttactataatgttggaaagatgtggtaagagctgacatccttg

SEQ ID NO: 22104 - DNA, 201 bp, Homo sapiens
actttttgacaaattctgtttgctaagattgaggaagcaataccccaaagaacttcttcagtttggacatatggaaatctgacagataccactttcagctacagtacagtacccattaaaatcaagtattgaaataaatggaaactggaagcaggctttgaattactgtattacaaagggttaaaccaagatttaaaaaaa

SEQ ID NO: 22105 - DNA, 201 bp, Homo sapiens
taaagcagcttgcattccctccgagtgcccaaactccaggcaaagttagaattgttgttcaggatagaagagaacctctgctgtggatgagtgcgacagartagggctttagctgtcgctgcaggcaagttcctgatggaagaatctgccaccactgcactgatgtggagatagtgacaccagaaacctgcacctgtgtgt

SEQ ID NO: 22106 - DNA, 201 bp, Homo sapiens
ctttttgacaaattctgtttgctaagattgaggaagcaataccccaaagaacttcttcagtttggacatatggaaatctgacagataccactttcagctacagtacagtacccattaaaatcaagtattgaaataaatggaaactggaagcaggctttgaattactgtattacaaagggttaaaccaagatttaaaaaaaa

SEQ ID NO: 22107 - DNA, 201 bp, Homo sapiens
tttttgacaaattctgtttgctaagattgaggaagcaataccccaaagaacttcttcagtttggacatatggaaatctgacagataccactttcagctacagtacagtacccattaaaatcaagtattgaaataaatggaaactggaagcaggctttgaattactgtattacaaagggttaaaccaagatttaaaaaaaat

SEQ ID NO: 22108 - DNA, 201 bp, Homo sapiens
ttttgacaaattctgtttgctaagattgaggaagcaataccccaaagaacttcttcagtttggacatatggaaatctgacagataccactttcagctacagtacagtacccattaaaatcaagtattgaaataaatggaaactggaagcaggctttgaattactgtattacaaagggttaaaccaagatttaaaaaaaatt

SEQ ID NO: 22109 - DNA, 201 bp, Homo sapiens
acgctactgggatgggggaggggaaggactttgtggggaggcaatgaggggaggaaagtcctgctggctagctcagcatgcagggagggagcccatcctcragatcagagtgtgggaagtggcacaggagctgaggagagggccgtggtggtcagtatctggggtgggtcatgcttggcctcacaggctggcctggaaggg

SEQ ID NO: 22110 - DNA, 201 bp, Homo sapiens
atgaggggaggaaagtcctgctggctagctcagcatgcagggagggagcccatcctcgagatcagagtgtgggaagtggcacaggagctgaggagagggcygtggtggtcagtatctggggtgggtcatgcttggcctcacaggctggcctggaagggcaccagtgatgccaaactgtgatgtggcctggtttgcttcaag

SEQ ID NO: 22111 - DNA, 201 bp, Homo sapiens
agatccaggctctgggtccttggggttggattctgagttgtccagagcatgagcaggggtagactggcaggccaatttgagcagagacccccagcagggcscttctgctgagactttgtgtctgggacctctgggttctgccagttggctggttgggggtcaggggtcagtcagtgagtgtggaccaggggatggtcacag

SEQ ID NO: 22112 - DNA, 201 bp, Homo sapiens
ggtggaccctgcagcaggcagcatgcatgtctgtggtcagcggggctggccagggcaagggaaccaggcagccgctttatcactttacattagagggctcrggagggatgccctgaagctgtccctgcatgtgggaggcaatgctggcggatatttgtctcacacccctgcttctttctctgagccagggctttgctttcc

SEQ ID NO: 22113 - DNA, 201 bp, Homo sapiens
cccagctttccttgtcagaatcaggtaggtgactcccaaaaggaaagttagcctttctgtcttgctaatgtctaccatgaccttttatggcattagttcckaaaagcttcacacctgtggaaaccagtgcaccagtggtttagtctcaaacgtctttttctagccttcagggaaaatgttgactaatcttgtttgcctcta

SEQ ID NO: 22114 - DNA, 201 bp, Homo sapiens
cgaggatcacggaaaaatgaggacatgcggaaaagcccatgaaagtgcttcggtacctggcaagataaatgctgccaggaacccagccatgcagagcaccrctgctcatggcttccagcctctcctcttgcagacttcttcacatggctgagcgcataccattcactcaattttgtcttcagccttcaactttaacacttt

SEQ ID NO: 22115 - DNA, 201 bp, Homo sapiens
caatatagacagcacataggtttccttagccctggaacttggcataatccatcctaggatgcccatgagatttatgggacaggatagggcctgattttttyctggctgtatccacagtgcttagtacagaacaaacttcagagatataggtagattttgtggaatgaatagtgaataaatgaatggatatattctcaaaat

SEQ ID NO: 22116 - DNA, 201 bp, Homo sapiens
ggcaagataaatgctgccaggaacccagccatgcagagcaccgctgctcatggcttccagcctctcctcttgcagacttcttcacatggctgagcgcatascattcactcaattttgtcttcagccttcaactttaacacttttatttctttaaatgtcacaaataatacacaaacacatctcattatgaaagactgaaga

SEQ ID NO: 22117 - DNA, 201 bp, Homo sapiens
agcgcatgcacaggctgctccttgcttatgcctccattttttcaggcctcagtgcctttgcacatgctgatcttcctgcctggaaatgcctttctttcacytcgtgccatgatgaatataataaggccaagttccccattcttttaggtaacattagatacactctccttgtgctatttctgttctttttttgatgacaac

SEQ ID NO: 22118 - DNA, 201 bp, Homo sapiens
tgcaggaaaggcaatacaaatgattcataagtgtataaaagatattcaaccttattaagaattagggaagtgaaaataaaatttaacaatgctccaatgcrtacttaccagactgtcaaatattaggaagtcatacaatatcaggtgtaggcaaggaggtagagcaacagaaactcccttaccacatatgattataacttt

SEQ ID NO: 22119 - DNA, 201 bp, Homo sapiens
gagtggcctgaaatcacacactctagctttcccaaagaatcccctctgcccacatatcctttgaggagcactaccggggtggcctgtgtgacctcagtgcrctatattcactaaaagctgactcagaatgtgttcctggtgcaagctttcatcatggctatggccttcagctgctcctaaattactgatcaatttctaatg

SEQ ID NO: 22120 - DNA, 201 bp, Homo sapiens
gctttttgatcatgagtagggaagtgtgttttggttgtatgtgaaagaaaccccaattaaacgtctcccacctatactccaggcccagctaaagctagtayaagcagaaatacagaaatataacatgtgagcacacttaatggggaggtctgagggtgcatgcttagaactccctctgcacactggtgctgcttgtccttt

SEQ ID NO: 22121 - DNA, 201 bp, Homo sapiens
ctttatttgatgctctttggtctctctatggctttaaattttaattttggtcttatggacgatttgagctgccttctactttttcattaaagtttccctcygatttttcagaatttgttcatgtggttcagaccgttttacccttcttcaaactttcatacatttgattaggtaaataagtgctcagtaaacacatgcaat

SEQ ID NO: 22122 - DNA, 201 bp, Homo sapiens
tagtttgtgttatatgtgacctgctttaaatttctgtgtcaatttacagccccatactgtaagatacaaagtcagtgtctattgcaaatacctctaaaagwtaggttcataatgttttaatcttaatactaggcttactatacaaaaattatctacacatccttattatttcaatttttaaaaaaccaagtgagatgtgtg

SEQ ID NO: 22123 - DNA, 201 bp, Homo sapiens
catattgattttatatccttgagttttgctgaactcttgtatgagttccaatagtttattagttaattctcttggagttcataggtagatacctatatttrctacaaattatgtcaattttgtctgtcctttttcaacacttgtccatatttctttttcaggtgctgtcacgttgtctgggacaatgctaaatatttttag

SEQ ID NO: 22124 - DNA, 201 bp, Homo sapiens
gattcacagcaatttagaggggtgcaggcatctggccaccgcagcaattcctttgggcttattgggccctagttcccagctcccacggggtttgtgtcccycagccacagtgtctagcttcaggagagaagtctaactgcagacagcagggaaccagccaccccacctgctgggagcccaccctgagcagaaggccggccc

SEQ ID NO: 22125 - DNA, 201 bp, Homo sapiens
aatttacagccccatactgtaagatacaaagtcagtgtctattgcaaatacctctaaaagttaggttcataatgttttaatcttaatactaggcttactayacaaaaattatctacacatccttattatttcaatttttaaaaaaccaagtgagatgtgtgtagggcagttaattccttcagagaagagaacatcttctaa

SEQ ID NO: 22126 - DNA, 201 bp, Homo sapiens
gaggcgggcggatcactcaagctcaggagtttgagaccagcctggtcaacatggcgaacccctgtctttgctaaaaaatacaaaaaaattatccaggtgtsgtggcatgtgcctatagtcccagctactcaggaggctgaggcacgagactcgcttgaacaggggaggcagaggttgcagtgagccaagattgtgccactg

SEQ ID NO: 22127 - DNA, 201 bp, Homo sapiens
gaatctaaaataagtttttttttttttttttttttttttttaaagaacagagatttatttcttatacttctggaggctgggaagtccaaagttgaggagtstgcatcattggcaagggcctttgtgctgtgccatcccatgtcagaaagcaggagggcaagagagggtaagagagagtgagcaggagagcaagagggagtc

SEQ ID NO: 22128 - DNA, 201 bp, Homo sapiens
tatgtcatgatgaaaaaaatctcatttttttttgaagattttattagcataacttaatctatttacttttattgagatgattgatatgcctggacttttcyttgccattttattttgtgtttcttgtttgctatgctttcttgtgctacttttgccctttcctgccttttattgaatcaactgtgttttctttgtccaggt

SEQ ID NO: 22129 - DNA, 201 bp, Homo sapiens
ggagcatatatgtttttaattataccaaaaagattttgtactattaatcacagtaaatcataacttattaaaatcatttatttcttcttttggatcttttmgtattatatattctaatatgttttataatctatagtaattcatgtgcataatttttaaatacctaagtatacacataacggagcacctgcttcaaaggtt

SEQ ID NO: 22130 - DNA, 201 bp, Homo sapiens
tgcttggagttctggtgagattgcaggactctcttcatctgtctctcttctctcaacggtcacagttctgccctgcctcttgtccagtgtttgaaaacagtttttttttgtatatttatttctgcttttaagttatttattggtggaagtgctagtaccagttcctctgttatgaccaggattaggagttcttcctattaa

SEQ ID NO: 22131 - DNA, 201 bp, Homo sapiens
cttctagctattttgaaatatacaacacactatctttaactgtagtcaccctactatgcaactgagcaccagaagtcattactcctctttaactaattttrtacccaataaacaacctctgcccttctccacctccccactactctcccaactttggtaaccactattctactctctactcctatgagattggctttttta

SEQ ID NO: 22132 - DNA, 201 bp, Homo sapiens
actccttccctgccatggctgtaacatccaatgctggtcctcctgtgtcccaggaggctcccagggtacctgccctcactcacctctcccacagggctctygtaactaaaacaaccccgtgggccgtccccaagtcctgcagtttgccagcctgggcctggagagctgagggtgggtctctccttatcacagaaccccaac

SEQ ID NO: 22133 - DNA, 201 bp, Homo sapiens
gcacacatgatgaaatcgaaactgcctctcatgccccctcagagcctgtgttctgggctctgccttcttccctgtcctcacctaatgcctgctcccatatyacccaatagtctcactggccatttttctgcttcttaaatgtgctaagtgctaccccagacatgactttcacatggggttttagtcttaggaagtttcttc

SEQ ID NO: 22134 - DNA, 201 bp, Homo sapiens
acctgggcttgatctaatgcaatagtttcattcactccttcagtaaacattcctccggcacctgtgccttggggaccctgaagtggcctcaacacggttcstaaattccaacagctcacagcctggtggtggaggcagagggtgatgattcagagtgataatgccccggctgagctgagctctggatgttgcgagggtggg

SEQ ID NO: 22135 - DNA, 201 bp, Homo sapiens
tatagtaatgaaagctcaaaagaaagcattttcatgatcaggaatatcctaaatccacaacctaaatgtttgcctctttcatgtctatttcctagttttaycttgagctcttgccacagaatccatgtaatgggccttatgtgatttgctgttagactttatccttgggcagtggaatagggtgggagagggcagaggggc

SEQ ID NO: 22136 - DNA, 201 bp, Homo sapiens
tcagtattataatattctgcaaaaacgcatataactatatcatcgtttttattttagaaaaaatggaattgtactatatccgttacgttgtaacttacttaaaaaaaaaactctacagtaaatcacattcatctttccaaattagtaaatgtaagtctaatttactcctttagtatttatctagtgacccataatatgcac

SEQ ID NO: 22137 - DNA, 201 bp, Homo sapiens
caggcgcaagcttgtcaaaaggccagggcactgtcctttcctctgggtatgtgcatgagcccattgggttccgaggtagcattttccagaggacttgggartgaaggttgtgactcagtgctctacccagggccaggctcctggatcctggcttctggctacacatttacattatctgaacctcagtctctcccttctgct

SEQ ID NO: 22138 - DNA, 201 bp, Homo sapiens
agaggtccttcacgttccttgtaagttggattcctaggtattttattctctttgaagcaattgtaaatgagagttcactcatgatttggctctctgtttgyctgttattggtatttaagaatgcttgtgatttttgtacattgattttgtatcctgagactttgctgaagttgcttatcagcttaaggagattttgggctg

SEQ ID NO: 22139 - DNA, 201 bp, Homo sapiens
cctttgccccattctcctttattttcttattaatactaaaggagctctttatttactgatattaaccacttgcttggcatgtatagttgacccttgaacarcatgagtttgaactacataggttgacttttcatagaggtgggctctgcagggccagctgtgattttaagtgtgcctggattttggtataggtgggggtag

SEQ ID NO: 22140 - DNA, 201 bp, Homo sapiens
tggaattgcctgagcttcagcaagctgccttacccctagcctcagtcattcctcggtgcacctgctgctaccacccacgatgtgaagtcattgtcggttcrctctcattgccctccctaaaacatctgcgattgaactgatcagaactctttctcctgatgctttgaaaaactgcccaccatctcctgagaccatttcact

SEQ ID NO: 22141 - DNA, 201 bp, Homo sapiens
ggccttttctgcatctattgagataatcatgtggtttttgtctttggttctgtttatatgctggattacatttattgatttgtgtatattgaaccagcctkgcatcccagggatgaagcccacttgatcatggtggataaggtttttgatgtgctgctggattcggtttgccagtattttattgaggatttttgcatcaat

SEQ ID NO: 22142 - DNA, 201 bp, Homo sapiens
aaactactatgataattcctctgacagtttgctactacatctaagagttgtggcaggcagaacaatgccccctgcccacagctgtctctctctctctcttytttttttttttttttttttgagagggagtctcactgtgtcgcccaggctgcagtgcagtggtgcaatctctgctcactgcaacctccgcctcccaggttc

SEQ ID NO: 22143 - DNA, 201 bp, Homo sapiens
acagtgagggtgaccagcttgttcaggcttctccaagctttgctagctgcaaagaagagagaaggttatcttattaaaccctaaaagtacctgaatttctytctcaactacttcagcttccagactccctggtacttgttttgtgcccttcatacattttgaaatgaacatgccttatagatacaaatattcgccaaaacg

SEQ ID NO: 22144 - DNA, 201 bp, Homo sapiens
tggtatcaggatgatgctggcctcataaaatgagttagggaggattccctctttttctattgattggaatagtttcagaaggaatggtaccagttcctccytgtacctgtggtagaattcggctgtgaatccttctggtcctggactctttttggttgataagctattgattattgccccaatttcagagcctgctattgg

SEQ ID NO: 22145 - DNA, 201 bp, Homo sapiens
cggcagtgttggaattctgggctgggcacttctttgtggtgggggcagaactgtgcattgtacgatgtttagcagccttcctgacctctacccatttgatrcccttgaccccctcacctcaagttttgacaaccccaaatgtccccagacattgccaaatgttccagtgggaggagggcagtggaggtaaaattgcccctg

SEQ ID NO: 22146 - DNA, 201 bp, Homo sapiens
ctcaaggactatttcctttattcctgtgggacttcttctcctgtctctgcctgctcttgaaagcatcttgtcctaagggttggttctgggtatggcagtgactctaaactgagtacagaggcaaggcaggatgcagccaaggcctgttgatggcatcttctttgctacatagggatcatgtctcccccctggcttctccag

SEQ ID NO: 22147 - DNA, 201 bp, Homo sapiens
gctcttcttgttgaattgatccctttaccattatgtaatggccgcctttgtctcttttgatatttgctggtttaaagtctgtttatcagagactaggattrcaacccctgcctttttttgttttccatttgcttggtagatcttcctctatccttttattttgagcctatttgtgtctctgcacatgagatgggtttcctg

SEQ ID NO: 22148 - DNA, 201 bp, Homo sapiens
gaggcaggagaatcacttgaacctgggaggtggaggttgcagtgagccgagatcacgccattgcactccagcctgggtgacaagaatgagactccgtctcaaaaaaaaaaaaaatttttttttgtttggtccttctttatatattgtatttccttgctgagattttcttttttcatttggttcaaatacatttgcaattgc

SEQ ID NO: 22149 - DNA, 201 bp, Homo sapiens
cagaccctgtttgcctgggtaccagcagcggtggctgcagaacagcagattttcgtgaaccgcgaatgctgctgtccgatcgttcctctggaagttttgtytcagaggagtacccggccgtgtgaggtgtcagtctgcccctactggggggtgcctctcagttaggctgctcaggggtcaggggttagggtcccacttgag

SEQ ID NO: 22150 - DNA, 201 bp, Homo sapiens
cccacttaaagatgatttttcttttcctcctcttctctcactgctcagatatccgtgggcttcaaagctttctggaccaggcctcgcggctgggccttgaygtctctttacaaaaggtggacaagaacattagccacgtattcaccagcctcttcaccacgatgaagacagaggagctgaatcgctaccgggacacgcttc

SEQ ID NO: 22151 - DNA, 201 bp, Homo sapiens; identical to SEQ ID NO: 3466

SEQ ID NO: 22152 - DNA, 201 bp, Homo sapiens
tccagaactaaaaagcagatatttttctttctattccattctccaaaaagtcaggctcgtaaaaaagaatacaaattatactcagcagctcttatcagctyggtaaagaattgctactttcaactttattgccttaagaagaattcacatgtttccatcttttaaaaatgatttgggttgagggaaggaatttgattcatg

SEQ ID NO: 22153 - DNA, 201 bp, Homo sapiens
acataattatgcagatcagtattcatgctttaaagaaacatgatttcgccttcacttaatttgtttctccaagacctaattatggattagatataaaaaartattattttccaatcactgtgcaaatcgccttttaccacccaggaggacagttctctctgattagtgagagttgtttccatgcactgatcagtcaaggaa

SEQ ID NO: 22154 - DNA, 201 bp, Homo sapiens
gtgtgctcagagctctgcgaatctcatgcctactttctagagggctggctgtctttcccagccccagccaccttgtaggggggcctgtgctgccctcaccracctcagaaatgtccagcaggctggacccattgatccctcagcccacctccccagcctgccctgtggcttgaccctgggtcacagaccagctcctacgtg

SEQ ID NO: 22155 - DNA, 201 bp, Homo sapiens; identical to SEQ ID NO: 3472

SEQ ID NO: 22156 - DNA, 201 bp, Homo sapiens
aaacagtctcaggaacaacctatcacaacaggtctgtacacacacatacacagacaccccggacacacacacacagactccattatgcagacactcacaamacacacacacacacacacacacacaaacacactcaaacccacatgtacattcatgccatatactggcatactaacatattacacacagacacatagatgc

SEQ ID NO: 22157 - DNA, 201 bp, Homo sapiens; identical to SEQ ID NO: 3473

SEQ ID NO: 22158 - DNA, 201 bp, Homo sapiens
catacacagacaccccggacacacacacacagactccattatgcagacactcacaacacacacacacacacacacacacacaaacacactcaaacccacakgtacattcatgccatatactggcatactaacatattacacacagacacatagatgctcagacacaagagctcccccgacagacacacagacacacacaca

SEQ ID NO: 22159 - DNA, 201 bp, Homo sapiens; identical to SEQ ID NO: 3475

SEQ ID NO: 22160 - DNA, 201 bp, Homo sapiens
tgggagaatggcgtgaacccatgaggcagagcttggcagtaagccaagatcatgccactgcactccagcctgggcgacagagcgagactctgtctcaaaawaaataaataaataaataaataaataaataaaataaaataaaataaatgaataaataaataaaagatagctcttctttgtaacaagtgactcacatcctgt

SEQ ID NO: 22161 - DNA, 201 bp, Homo sapiens
gttttaaaaatagctttaattaccatatgcagcaaatgtatttgaaaactaaaggttggtgtctacctttccgcattcctatccatctgtcttccagcaartggattctggtggattcagatgaacttgctgcttgtgccagaaaggccctattatctgtgccttctaccctgttattacacctccttcgccagtctggat

SEQ ID NO: 22162 - DNA, 201 bp, Homo sapiens
caatcatatacttcaggagaaggaagatgaccccagatataaggtctgaggtctctaaaagaagccttaccaataaactaatgaatattggttacatagawaaatattggctgtatcaaacaatagaaataatgtgtaatgggaaaatacaaagaaagattgaattaaaatactggaggtttttagcgtgttagttgggat

SEQ ID NO: 22163 - DNA, 201 bp, Homo sapiens
ctgggccctgcctgccattgtggagaagcacacagggccagggtgtggccccagctgcatgaatcatccaggagtgtgtgaacactgactccaggctcccrcactatggggctgcaacgtgagtatcaagggttttgaaagctacccaggtgattctaaggagcagctacggtagttctcaaattttatgtgcatccgtca

SEQ ID NO: 22164 - DNA, 201 bp, Homo sapiens
aaaatagtagtcgacttagaattatatctttcaagagtgagataaaaataaaggcatttcccagcaaacaaaaactgagtttatcaccaacaaacccaaaktaaaggaaattctcaatcatatacttcaggagaaggaagatgaccccagatataaggtctgaggtctctaaaagaagccttaccaataaactaatgaata

SEQ ID NO: 22165 - DNA, 201 bp, Homo sapiens
cagctaatttttgtaattttagtagagatggggtttcaccatgttggctgggctggtctcaaactcctgacctcaagtgactcgcccaccttggcctcccraagtgctgggattacaggtgtgagccaccatgctgggcctcaataaagttttaatgataagttttagttttttctcactactgcttttgcattccacatt

SEQ ID NO: 22166 - DNA, 201 bp, Homo sapiens
gcaagcctgggcaatggcaggcgcccctcccccagccttactgccgccttgcagtttgatctcagactgctgtgctagcaatcagcgagactccgtgggcrtaggaccctccgagccaggtgcaggatataatctcctggtgtgcaattttttaagcccattggaaaagcgcagtattggggtgggtgtgacccgattttc

SEQ ID NO: 22167 - DNA, 201 bp, Homo sapiens
cctaagtcagtgctctcgtagctctgctgggtagagattcttattcctatttaatagaaaatggaggctgagaaagggacatgcccatggctgtgtggctrctgaccggaggagccaaaactggaacttgggtgaatgaatgcttgagatccgaatgctcttcccaccacccctggtgaggtggtagctggtgagggttca

SEQ ID NO: 22168 - DNA, 201 bp, Homo sapiens
tatttacatgtaatggaaaactctagttccttatgtactgagtggaagtagttccaaaacatggtgctgttagctgacaatagagaagtgagaatggtgaygtgggtgttgctttgtgtacaagtgagcttctatgtgtgtgtatctgagtggacacacatggtcactccaaggaaatgctgtttaaggaaaggaaacaca

SEQ ID NO: 22169 - DNA, 201 bp, Homo sapiens
ctctctcctccatgctggccacagccccgagcagcagagttttgttccctatatagttcactgaggagagagaaggtggcagtggatggcgatgctccatycccacacctgcctgcctacccacccgtgtcctggacaacgctcgggctcactgctgacctgcccatgtcctgtctgagacgccctttccttgggcactac

SEQ ID NO: 22170 - DNA, 201 bp, Homo sapiens
tcttgaactcgtgatctcaagtgatctgcctgcctcaggctcccaaagtgctaggattaaaggtgtgtccagcctatttttttaaaatcatacttttaatytattgtataaccaagatggcaacagcattgcagaatttaaaaagaaaacaaaggaggaaccaccatctcaccaccttaacaagcaaatggttttaatttt

SEQ ID NO: 22171 - DNA, 201 bp, Homo sapiens
gaaggaggaaagggaagaaggaagggaggaaggaagaaaggcagaagggagggaggacagacggtggttggtgggtcctgaggtctttggacacaagccasttgatttcgtttgcctcaggacccaagtggcgggaggcctcctcactggtctgggcttcactgtgcttatgataccagggtccctggtgggctctacagg

SEQ ID NO: 22172 - DNA, 201 bp, Homo sapiens
cctctaggtgactaatttgatcttcatctgttccatgctgctattcagcccctttttaaactttaatgatgaaatgtttggttcccagatctagttcattygttttaaatggatgtgatagcctctcccctctctctgttttctcgttcaaagtgtcattctgcttgtcctagtacccaagtcctcaggggtgcgttcgtt

SEQ ID NO: 22173 - DNA, 201 bp, Homo sapiens
ttttctctagttccttgaaaatatttttaatagctgacttaaagtctttgggtactaatttcaacaactgtcccccatgggacaatttatattgaatgcaytttttcctatttttctgaatgtctcatatattttgttgaaaactgaacactttagataatatgatgtggcaactctggaaataagtcccctttatcctgg

SEQ ID NO: 22174 - DNA, 201 bp, Homo sapiens
ttttttgtgttttttagtagagacggggtttcaccgtgttagccaggatggtcttgatctcctgacctcgtgatccacccacctcagcctcccaaagtgcwgggattacaggcgtgagccaccgcgcccggctctctccgacattttactataataataataataacaagccacaatgaacatcttgtgcttgaaattttg

SEQ ID NO: 22175 - DNA, 201 bp, Homo sapiens
tagccaggatggtcttgatctcctgacctcgtgatccacccacctcagcctcccaaagtgctgggattacaggcgtgagccaccgcgcccggctctctccracattttactataataataataataacaagccacaatgaacatcttgtgcttgaaattttgtccatatttggaacattttcctaaggtagagtcctaagg

SEQ ID NO: 22176 - DNA, 201 bp, Homo sapiens
cataccttcctaatagatggacactttatcattataaaatgttccttttgtgttcaatagcacttttgtcttaaagtctattttgtctgctattagtacarccacttcagctgtcttgtggttactgtttgtatggtacatattttcccattgttttactttcaacctattatatctttgaaactaaagtgtgttttttgt

SEQ ID NO: 22177 - DNA, 201 bp, Homo sapiens
ttctagtatagattttctactttaattctatttaggtcaaataacatactttgtgtgattttaatccttttacttttatcgaggcatgttttagggcatarcacatagtctgtcctatcctggggaaatgttccatgtgtgcatgagaagaattctcctcttgttgaatggagtgttccatagatatctgttaaatctagt

SEQ ID NO: 22178 - DNA, 201 bp, Homo sapiens
atatgcccttgtttttcatatttttttcttctccagagttcaagctcactgcccatgggctgaattcagatcagaggtgtatttgtgtggctggcatggtrttttctacaacatcagagtccctttaggtggggtctgcacccttgagtcaggcaagtctcatctctcctcatgggctcattcctacctgttcccctcact

SEQ ID NO: 22179 - DNA, 201 bp, Homo sapiens
tcactgggtcgggggggaggtcttcaactggctagtgactgccacgtaaggactggctgggtatttctggatgtgaaatagggacttgtgatctaatccasggcagtaaggaagaccagcccactgcgttgtgtctggagagggacagccttgagtgtgagtgcaagggagcactcccaggctctgcaggtgtgcatggag

SEQ ID NO: 22180 - DNA, 201 bp, Homo sapiens
cgtattcacactgtagataatgcctaccagtcggtcactttgtacctgtcttggttatcagattgtctgtcttaggatttcaatgcttgtgttcaagtaacccttatttgacttaataatggtcccaaagtacaagattagtgctgctggcaattcagatatgccacagagaggccataaagtgcttcctttaagtgaaaa

SEQ ID NO: 22181 - DNA, 201 bp, Homo sapiens
gcctgggttctgctcttggggctcggtgagtatcagaactcttcctaattccccagcctgttcctggtttgatgccacgggctgtgggatcagcagggacyttcggactgatgtcccctgcctgcaagtcctgaagacccctgggatccccagggatatggagaccattggatggaggtgacagctctgagctgccacctg

SEQ ID NO: 22182 - DNA, 201 bp, Homo sapiens
tgaacagattcaaagagccagtggaagacaatgtaaagtagcttttatgatttactgcaaagaatcctgcttgtttaaagtcctggctgtcttatgttgarctttcaatggccccaccaagaagacttgcagtgaggggcaggcactctcctcacccttgtgggagtgacaacatgtccatgttcgtttttcccccagaga

SEQ ID NO: 22183 - DNA, 201 bp, Homo sapiens
gagtctggattctgtcaccacaaagacccatctaggcttctgatctagaagtcctctctcgtagaacttcacctctctcctcacctcctccttgttgtcarttcattttcctcttcacccctgggctccttcacctccccagctccattctctatcccatcttagccgccacctccaacggcctcatcctggagcctgccc

SEQ ID NO: 22184 - DNA, 201 bp, Homo sapiens
tctttgggattcttctaatgttaactaaagtcactcaatgacactcagctagtttatgcacctgtcttaagggtctaagatggattcactcacatgtctaktgctttggcagaggtgattggaaggctggacacatatgggatccatgtgggacccacaggtggtctctccagcatggtggtctcagggttactgtacttt

SEQ ID NO: 22185 - DNA, 201 bp, Homo sapiens
agcatttctgttcctaatgtaacatttttgtatctaaaatattcttttatgccattagttgtttttaataaaactgtttattcttattatcctcacccttygtaccaagaaactgcacataaataaccctcttctatgccaataactttaatcattgtcttttttttttttttttttgtctctcagtggtggtatttagtc

SEQ ID NO: 22186 - DNA, 201 bp, Homo sapiens
tgggtctgaaaaggttcctctgaatacccttcatggaaagattttaagaacacattctatttttttagcagatctaggactatttagattatctttttttyctgaagatttttttttttaccttttatttttctaaaaacgtctttgctttagttttgcatgtataaaaatctaggaaaaacatagttttctttttttttc

SEQ ID NO: 22187 - DNA, 201 bp, Homo sapiens
tgggacccacaggtggtctctccagcatggtggtctcagggttactgtactttttgcgggcagctggattctcctagataattggttctcaatgggtggtgggggggggggctgcataattctatcctccaagggtttttggcaatgtctggagatatttttggttatcacactggtggggggccggggagtcgggggaga

SEQ ID NO: 22188 - DNA, 201 bp, Homo sapiens
tccccttctctctcttctccctcatggacttgaatgacttgtatattaggctgcttgaaattattctattctcactaatgctctgttgatctttttcctgtttttttttttgttttttttttatctccatgattcattttgagtagtttctgttgccatactttcaagttcatcgacttttcttctacagtgtctaatgtg

SEQ ID NO: 22189 - DNA, 201 bp, Homo sapiens
tgaggcaggagaattgcttgaactggggaggcaaagtttgcagtgagctaagatcgtgccactgcactccagcctgggtgacagagcgagactccattgcaaaaaaaaaaaaagtacagtgtatttgtgaacagatagatgtaaaattttaatatattatgaaaggcatttccacaggggtatggtcaggatatcatgggc

SEQ ID NO: 22190 - DNA, 201 bp, Homo sapiens
cttcctgaaatgctcttccctggaaactcctcttctttctttatttgtttaaatatacattgcatgcgtattggtaaaatacataacataagatttaccaygttaaccatttttagggcattaggtacattttcagtgttgtgcaaccatcaccaccatccgtttccagaacttttttattagcccaaactgcaactttgt

SEQ ID NO: 22191 - DNA, 201 bp, Homo sapiens
tgcaattgcaagtttcttataggctaactttatatatatgtatatatgtatggttatacatatatatatggttgtatatatatgaatataatacatggttwtatatatataaacatgtatgttatatatatatatatataaccatatatgtttatatatatatatatatatatatatatatctggctttactgttgttgtt

SEQ ID NO: 22192 - DNA, 201 bp, Homo sapiens
aatcaaaggcttcataaggcagttttaaggaaaatgagattacgtacatgacggaaaaaaacaaggaagaaagagaagatgggagagagggagggaagaggagagagagagagagagacagagagagagagagagagacacagagagagagagagagacagagagagaaggacaaaggaaaacgaaggaaagaaaaaagtc

SEQ ID NO: 22193 - DNA, 201 bp, Homo sapiens
tgtatatatgtatggttatacatatatatatggttgtatatatatgaatataatacatggttatatatatataaacatgtatgttatatatatatatatawaaccatatatgtttatatatatatatatatatatatatatatctggctttactgttgttgttgttcaaaaatcctctcgctcctttctatatcttaagca

SEQ ID NO: 22194 - DNA, 201 bp, Homo sapiens
atcaaaggcttcataaggcagttttaaggaaaatgagattacgtacatgacggaaaaaaacaaggaagaaagagaagatgggagagagggagggaagaggagagagagagagagagacagagagagagagagagagacacagagagagagagagagacagagagagaaggacaaaggaaaacgaaggaaagaaaaaagtca

SEQ ID NO: 22195 - DNA, 201 bp, Homo sapiens
taggctgaagtgggaggattgcttgagtccaggagatcaaggctgtagtgagacgtgattgggccactgcactccagcctgggtgacagatattctgtctrttaaaaacaaaataaaacaaaaacaggaaaaatccttgtcttttggagacacaattgaaatgtatacatgtgaaagatgtgatgctggagattttcttca

SEQ ID NO: 22196 - DNA, 201 bp, Homo sapiens
tcaaaggcttcataaggcagttttaaggaaaatgagattacgtacatgacggaaaaaaacaaggaagaaagagaagatgggagagagggagggaagaggagagagagagagagagacagagagagagagagagagacacagagagagagagagagacagagagagaaggacaaaggaaaacgaaggaaagaaaaaagtcac

SEQ ID NO: 22197 - DNA, 201 bp, Homo sapiens
tgacagatattctgtctgttaaaaacaaaataaaacaaaaacaggaaaaatccttgtcttttggagacacaattgaaatgtatacatgtgaaagatgtgatgctggagattttcttcaacttaatttgagggtgggtgaggtgtaggtggtaacaactgaagttgggtaagacatacacaaggcccactacccttttttcc

SEQ ID NO: 22198 - DNA, 201 bp, Homo sapiens
caaaggcttcataaggcagttttaaggaaaatgagattacgtacatgacggaaaaaaacaaggaagaaagagaagatgggagagagggagggaagaggagagagagagagagagacagagagagagagagagagacacagagagagagagagagacagagagagaaggacaaaggaaaacgaaggaaagaaaaaagtcacc

SEQ ID NO: 22199 - DNA, 201 bp, Homo sapiens
agtctgaatataataagccattcaattgtacacttaagacaggtgaattttttggcatgtaaattatatctcaataaagctgcttgaaaaaaatataccamccacatcacagagttaaggattaaatgaaaaactgtgtgtaacgtatttcctggcatgccgcgtagggtttctaactccaggtgcttcgctgaaatcttt

SEQ ID NO: 22200 - DNA, 201 bp, Homo sapiens
attacgtacatgacggaaaaaaacaaggaagaaagagaagatgggagagagggagggaagaggagagagagagagagagacagagagagagagagagagasacagagagagagagagagacagagagagaaggacaaaggaaaacgaaggaaagaaaaaagtcaccatgagtgagaaccaagaaacaataaagtgcagttt

SEQ ID NO: 22201 - DNA, 201 bp, Homo sapiens
taaaatgttatgggagagacacagagctagctgacccacagaactggtggggttggccttgcacttggggattttcttcctttccaactttcaggcttgcrtaccaaatccctgggctggaggcagaaacgcttctattgccccaggtcccttccctagtggttctcttgagcttgagaaggatgagaaccatccctttaa

SEQ ID NO: 22202 - DNA, 201 bp, Homo sapiens
tcctccaacctctgtttacgggaatcactgaggctgacttggaccctcatttttcgtggtggcctgcatgggtggaacgtgttgcagttagacaccctccygggtgcattcccacttaaagatgatttttcttttcctcctcttctctcactgctcagatatccgtgggcttcaaagctttctggaccaggcctcgcggct

SEQ ID NO: 22203 - DNA, 201 bp, Homo sapiens
ctctgccaggctcctaagcatgttccatcagggcatgattagtgttgggcttggcattgtgcttaaacagcagcttaggatttcattttcactgggtcggsggggaggtcttcaactggctagtgactgccacgtaaggactggctgggtatttctggatgtgaaatagggacttgtgatctaatccagggcagtaaggaa

SEQ ID NO: 22204 - DNA, 201 bp, Homo sapiens
ttgggggctcaggggcacaggacacctattaggagccttgtgagaaagtaagggagatgagcaggcagggatgaagccagggagatgggttggagcctctstctgtggtgcagggagaggtgaggaggctgctgggaggtcatggaggagagatggagaggagggctggattcagattacattcctgaagtccagtcgcca

SEQ ID NO: 22205 - DNA, 201 bp, Homo sapiens
ttttcccaattctttgaagaaagtcaatggtagcttgagggggatagcattgagtccataaattactttgggcagtatggccattttcatgatattgattsttcttatccatgagcatggaatgtttttccatttgtttgtgtcctctcttatttccttgagcagtggtctatagtcctccttgaagagatccttcatatc

SEQ ID NO: 22206 - DNA, 201 bp, Homo sapiens
ctgtgctgggatctgcctcagttctgtgttcccagcacggcgtgcttgaggagttttgtggggggtttccgggaggcaatttgataacctgctgggagaaygtggctcccaatctgtctattatggctagaaatgtgctggtgggaagatggagcctcaccaaccaggattctctaaagttcctctctggtttgtgagttt

SEQ ID NO: 22207 - DNA, 201 bp, Homo sapiens
ccaggtctttactgaggcccccagattgggggctcaggggcacaggacacctattaggagccttgtgagaaagtaagggagatgagcaggcagggatgaarccagggagatgggttggagcctctctctgtggtgcagggagaggtgaggaggctgctgggaggtcatggaggagagatggagaggagggctggattcaga

SEQ ID NO: 22208 - DNA, 201 bp, Homo sapiens
atgttttcttccctccctctccatttaggaagctgacatggctccaggcaatgtaacttctctgggcatcattttcaagtggagcttttggacagttctawcgtttgtcaggtgcttgggaggtctatgcagctgagctggggcttttttctgatttttagggactggcagcttcaggttgtctccttaagtagagaagca

SEQ ID NO: 22209 - DNA, 201 bp, Homo sapiens
gttgccacatgcagctgagcaggttgcatcctgcacctggatggctgggaggtgagtctggacttcatcagcacactgcttgctgctcagcaggccttccycactggggcattttcttctaatttgaataagagctcatgcaggcagggaggaccctgtatggcaaatgtctcacagtgtttctagcatgtagtagacatt

SEQ ID NO: 22210 - DNA, 201 bp, Homo sapiens
gttatacatatatatatggttgtatatatatgaatataatacatggttatatatatataaacatgtatgttatatatatatatatataaccatatatgtttatatatatatatatatatatatatatatctggctttactgttgttgttgttcaaaaatcctctcgctcctttctatatcttaagcagaagtggaactgcc

SEQ ID NO: 22211 - DNA, 201 bp, Homo sapiens
ttatacatatatatatggttgtatatatatgaatataatacatggttatatatatataaacatgtatgttatatatatatatatataaccatatatgtttatatatatatatatatatatatatatatctggctttactgttgttgttgttcaaaaatcctctcgctcctttctatatcttaagcagaagtggaactgcct

SEQ ID NO: 22212 - DNA, 201 bp, Homo sapiens
tatacatatatatatggttgtatatatatgaatataatacatggttatatatatataaacatgtatgttatatatatatatatataaccatatatgtttatatatatatatatatatatatatatatctggctttactgttgttgttgttcaaaaatcctctcgctcctttctatatcttaagcagaagtggaactgcctg

SEQ ID NO: 22213 - DNA, 201 bp, Homo sapiens
atacatatatatatggttgtatatatatgaatataatacatggttatatatatataaacatgtatgttatatatatatatatataaccatatatgtttatatatatatatatatatatatatatatctggctttactgttgttgttgttcaaaaatcctctcgctcctttctatatcttaagcagaagtggaactgcctgc

SEQ ID NO: 22214 - DNA, 201 bp, Homo sapiens
tacatatatatatggttgtatatatatgaatataatacatggttatatatatataaacatgtatgttatatatatatatatataaccatatatgtttatawatatatatatatatatatatatatctggctttactgttgttgttgttcaaaaatcctctcgctcctttctatatcttaagcagaagtggaactgcctgcc

SEQ ID NO: 22215 - DNA, 201 bp, Homo sapiens
atgatagctctcctttccatttcactcttcttttagtttcttacagctctgtcctctggacacttaacacacatccttctaggacttgtttttaagaaagkatgtctttcaccaaaggctcaattccttgtgcaaaggtcctaactgagatggatactctcaattctctccatctcagacagcgataatcactccttccta

SEQ ID NO: 22216 - DNA, 201 bp, Homo sapiens
gttccctttcaccttacccctatttaaggctgtgatcctttgaaacatactctgagcccatttgctttccaatagaagtaaacaaagaaaaaaaaccctartagatgacttattgttttagaaaagcccatgcactgacataatgacagacccactatggccatcatcattgaggctggggccatctgcactcagatcatg

SEQ ID NO: 22217 - DNA, 201 bp, Homo sapiens
ctctgacaagcattttaatccagctgtaggaaccaattctgtatcttaatgcaatttcttcctttcctttcctttttcctttttcctttcccttcccttcycttctctctctctctttctttctttctctttctttctccctccctccctacctccctttctttatcccttcctccctccctttcttcctccctccctccc

SEQ ID NO: 22218 - DNA, 201 bp, Homo sapiens
tcctttcctttttcctttttcctttcccttcccttcccttctctctctctctttctttctttctctttctttctccctccctccctacctccctttctttmtcccttcctccctccctttcttcctccctccctccctcccttccttccttccttcttcttcttttttttttttttgtcagggtctcactctgttgcccag

SEQ ID NO: 22219 - DNA, 201 bp, Homo sapiens
ctttcccttcccttcccttctctctctctctttctttctttctctttctttctccctccctccctacctccctttctttatcccttcctccctccctttcttcctccctccctccctcccttccttccttccttcttcttcttttttttttttttgtcagggtctcactctgttgcccaggctggagtgcagtggcacaat

SEQ ID NO: 22220 - DNA, 201 bp, Homo sapiens
gaagaatccagcagctcagggagagggcaccaagcacctgagggctggaggcgagcctctcactgggcgacttcagctggggtcttgctcctgccccgagrggcctgttgatgcaggaaagaagcttgtggggaaatgccatgccaattcctcatcctgaaaaaatggcatcaaagcagcaggactctgaaaaccatccct

SEQ ID NO: 22221 - DNA, 201 bp, Homo sapiens
agcccagccccggctagagattcatgactttcctccctcctgccctccctattcccctacacccactagagagtcctgaggactattaacctgtcccctcrtttagggctgatgtatatattcagtgaaaaaggcaggggagtggagacgagaatgggggacttcctccagagcttctgacacctctgattgccccaggaa

SEQ ID NO: 22222 - DNA, 201 bp, Homo sapiens
aaattcttgcatggtgttcttgcacgagtctttactgctattgtgaactgggcttagcctgtgtctgggaaaggatggtgaacacagcaggcatgaccctkgtcctcctggagcctggggtcaagttggagagccagccagtaacacaggcaacatgtggctcatgacagggaagtgcagtgaagggggataatgccacaa

SEQ ID NO: 22223 - DNA, 201 bp, Homo sapiens
tggccagaatcagactggaaggtgggaaccccatgctgttaatgggtggcgctggcattttgggcaagcaactttcatttccaggccttgatttcctcgtytgtatactggcagcagcaatccctcactcagactatttttgaaaattaagggagatgatacaattgacactctttctccagggcctggcgtagaggaact

SEQ ID NO: 22224 - DNA, 201 bp, Homo sapiens
caggttttcttatgactgctctgtaaaaacagactagtcttaatcctgagatagaatggtttccatgtttagtgtttaaacaatttttttgaaaattatgygataatttagatttacatgcaattataaggagcaacctagggagatccagcgtgcccttcacccaggttcccccacagtaacatcctgcatagctgtagt

SEQ ID NO: 22225 - DNA, 201 bp, Homo sapiens
attgaggaagagagataaggagaggagctgtgtttgcatgcctatgtatatgtgtatacaggtgtgcacacatacatgtatacatgtatgtatatatgtgyacacacagtgcacacaagcacacgtgtgtgcatgtatgtgcaggtatgtatgcatgtgcttgtgtgcacatgtgtggcacgtgtgtgcagagatggtggc

SEQ ID NO: 22226 - DNA, 201 bp, Homo sapiens
gcagaggagacatcagtcattcttatggggccatatttagtgatccaaggatgccacagagcttggtgagctgtccaagggctctgaacaaatcagtacastcatcacagtgattgttactgaaattgagtggggaggggcatgtaggagccagcactggctgggggaggccctgtgtagggggttggctttggagaggtg

SEQ ID NO: 22227 - DNA, 201 bp, Homo sapiens
cttctccttaaggatcaagttcagatcccttctcgcagtgcacagggcctccaaggtctgtctctccctggcctttctctcatcactccctcaagacctcygtgtcccagcgacgcaggatggatcagcaggggtgccatcaggaacacatggcccactccaggtcattcagaggaggggatttaacatgaggaactactg

SEQ ID NO: 22228 - DNA, 201 bp, Homo sapiens
agtcattgagccaacatgtatttactgacacctgtggtgttccaggcacggtgtcaggcagcatggacccaaaaagagatgaggctcatttctaattggakaagcaatgtgcagaggagacatcagtcattcttatggggccatatttagtgatccaaggatgccacagagcttggtgagctgtccaagggctctgaacaa

SEQ ID NO: 22229 - DNA, 201 bp, Homo sapiens
tccgtctcttttacacacatactggagcctttgtttctgtctctttcatgcacacacacacacatacactgaagtctctgtctgtctcgtgcacacacgcrtgcatacgctaaagtctctatttctgtttctctgtaatgcatgcacacacaggcacacacacgcacgcacacactgtctcgctcatgcacatatacacac

SEQ ID NO: 22230 - DNA, 201 bp, Homo sapiens
gtacttaccaggcctggtgctcagagctaggaagatagcacaacaggagacatttacctcaccgtggaagagctggttctggttctaactccagcatagayagagcaatggattatcacttacaatttccttttggttttggaggcacagtgagaatttacagtagtcctgaactaaatgaaaattgtgggtatatacagt

SEQ ID NO: 22231 - DNA, 201 bp, Homo sapiens
catacagaatttgcacaccaaagtagagatggtgtcaaaccacgtatttatttattcatctgtttattcatgcactttgtggatccattcacacagacccktaagtaatccttacagtgcagtgtgatgagtattctaatggagggatgtactaggcttgctgcagtggaggaagcacagagcaggaggcacatgaactgc

SEQ ID NO: 22232 - DNA, 201 bp, Homo sapiens
atcttagttttatttctccctgcatatcggatcttcttcttctagctgcttttaggattttttctttgcctctctttggttatgtgcttaattatgtgtgytcttcatcaaacttggaaactttttggcaattattttctcaagtacttttttctgtatccccttctctctcttctccctcatggacttgaatgacttgta

SEQ ID NO: 22233 - DNA, 201 bp, Homo sapiens
atctaggactatttagattatctttttttcctgaagatttttttttttaccttttatttttctaaaaacgtctttgctttagttttgcatgtataaaaatstaggaaaaacatagttttctttttttttcttttcatacttaaaagatgtatcacggacttcaggcttgccttgatgaggactcagctcttaatcttagtt

SEQ ID NO: 22234 - DNA, 201 bp, Homo sapiens
ttcccttcccttcccttctctctctctctttctttctttctctttctttctccctccctccctacctccctttctttatcccttcctccctccctttcttcctccctccctccctcccttccttccttccttcttcttcttttttttttttttgtcagggtctcactctgttgcccaggctggagtgcagtggcacaattg

SEQ ID NO: 22235 - DNA, 201 bp, Homo sapiens
tcccttcccttcccttctctctctctctttctttctttctctttctttctccctccctccctacctccctttctttatcccttcctccctccctttcttcctccctccctccctcccttccttccttccttcttcttcttttttttttttttgtcagggtctcactctgttgcccaggctggagtgcagtggcacaattgt

SEQ ID NO: 22236 - DNA, 201 bp, Homo sapiens
ccttcccttcccttctctctctctctttctttctttctctttctttctccctccctccctacctccctttctttatcccttcctccctccctttcttcctccctccctccctcccttccttccttccttcttcttcttttttttttttttgtcagggtctcactctgttgcccaggctggagtgcagtggcacaattgtgg

SEQ ID NO: 22237 - DNA, 201 bp, Homo sapiens
tttctttctttctctttctttctccctccctccctacctccctttctttatcccttcctccctccctttcttcctccctccctccctcccttccttccttccttcttcttcttttttttttttttgtcagggtctcactctgttgcccaggctggagtgcagtggcacaattgtggctccctgcagtcttgacctcctggt

SEQ ID NO: 22238 - DNA, 201 bp, Homo sapiens
tccctccctacctccctttctttatcccttcctccctccctttcttcctccctccctccctcccttccttccttccttcttcttcttttttttttttttgkcagggtctcactctgttgcccaggctggagtgcagtggcacaattgtggctccctgcagtcttgacctcctggtctcaattgatcctcctacctcagcct

SEQ ID NO: 22239 - DNA, 201 bp, Homo sapiens
ggctggagtgcagtggcacaattgtggctccctgcagtcttgacctcctggtctcaattgatcctcctacctcagcctcccaaatagctgggactacaggwgtatgccaccacactggctaatttatttttattttttatagaggcagtatttcaccacattgcccaggctggttttgaactcctggactcaagcgatcca

SEQ ID NO: 22240 - DNA, 201 bp, Homo sapiens
ctgagtggtttcataaatttttaaatttctccccaaacccagtacctcccaaacctgagcagagtgttcagttgtcatagccctgctcagtgctttagacwctcagtctccctggggcaagggtggcaccttgatcaagatggtttctcttgagccaccatcttgcattctaggatccccactgggagctgttagtgtgcc

SEQ ID NO: 22241 - DNA, 201 bp, Homo sapiens
ccacccaccttggcctcccgaaatgctgggattgcaggcataagccacagctctcagcctattttttaaggtccaatggagaaatagccatgatttttgctttttttttttttaactgtatcattacccaaagtgtggtattttggtatcttcgaggtctttaagcagaattttgggtagatcttcacttgttctttatct

SEQ ID NO: 22242 - DNA, 201 bp, Homo sapiens
ctatgatatgatcacaaccttttcctgactctgcatcctgcaggcagcacctgaacacttcgccacctgtctgtgtgggcagagtgatgttaaaactttgycagctttgctagtgaaaatggaagattgtgcaactatttcagaggacagtttgtctgtttcttagaaagctaagcataaaattaccttaggactttgcta

SEQ ID NO: 22243 - DNA, 201 bp, Homo sapiens
agcagctgagattacaggcacatgccaccatgcccagctaatttttgtatttttagtagagacggggtttcactatgttggccaggctggtcttgaactcstgatctcaagtgatctgcctgcctcaggctcccaaagtgctaggattaaaggtgtgtccagcctatttttttaaaatcatacttttaatttattgtataa

SEQ ID NO: 22244 - DNA, 201 bp, Homo sapiens
tttcttagaaagctaagcataaaattaccttaggactttgctattctgctcctaaatattgacccagaagaggctgagcgtggtggctcacacctgtaatyccagcacttctggaggttgaggcaggcggatcacttgaggtcaggagtttgagaccagcctggccaaccctgtctctaccaaaaaatggtgaaaccctgt

SEQ ID NO: 22245 - DNA, 201 bp, Homo sapiens
cgtccgatttctattaatctttttcagaaacacctttactgtgataaattcacatactataaaatttatccattttagatatacaattcaatgatttttartaaagataccgggttgtgcaaccttcattataatctggttttagaatacttccgtcacgccattgatatctttcatacctacttatagttaatgccattc

SEQ ID NO: 22246 - DNA, 201 bp, Homo sapiens
gggtgcacagcagttcagctgacccaggatggcttacctgcagtgtggtaagggagcaagggccattcctgggcccaggctctgagcagctggggtcatgrtgttacagccacccatgtgggtggagagatggtggaatcccatggttggaggcccaaagttgctactggcccccagggcagagcacactccagtagtggc

SEQ ID NO: 22247 - DNA, 201 bp, Homo sapiens
cataaaattgtacctctaattcctatgaaatttacatctgcaggcacctgccatctcccacagaagggagtgtcccctgtcccctgtcagtctgtcccacygtcacaggacaacccctccacctgtgtcatgagttgattcctttgtgcctcctttgaaccttgcttcataaattagtttcccttcattttgtcttgtaag

SEQ ID NO: 22248 - DNA, 201 bp, Homo sapiens
ggtcatggtgttacagccacccatgtgggtggagagatggtggaatcccatggttggaggcccaaagttgctactggcccccagggcagagcacactccartagtggctctggttttaagatggcaccacaccccagcagctggggtcatggtgttacagccacccatgtgggtggaaagatggtggaatcccatggttgg

SEQ ID NO: 22249 - DNA, 201 bp, Homo sapiens
gagtagtgagctcaatacccatgtaacaaacctgcacacataccccatatatctaaaaataaaagttgaaattaaaaaaaaaggaaatttgaaattttgayttaaattatccagtgttttgaggttttttaaaaaactctttttcaataataagaaatttaacagcttcataccatatcatcctgctattctctttcattc

SEQ ID NO: 22250 - DNA, 201 bp, Homo sapiens
tggttctgaacctctctttccttctggttcctgggctgctgttccaggtcgctgggctggagcctcccccagattttgtcctttaaaactcattgattttwgtgctgacttttacagtacaaatgtcatcgttagataaaataattgaagcgggtaatctattcactgagctcacacagcccctcccactctgcccagcct

SEQ ID NO: 22251 - DNA, 201 bp, Homo sapiens
tcatacaagtatgggacccatggttggtttgcgactcatatatgtggaataacacttctgcatgcttctgagattgttttttaattttcactcagcattargtttttgagattgatccgtttgatgcaggtggatgtattaatcatttttattgctgcactgtgtgccctgatttatttatctactttattgtctgtgggc

SEQ ID NO: 22252 - DNA, 201 bp, Homo sapiens
aaacattgtctgacccaggcctcccacacagagtccctgcttgtggctctgggccagaagagcagccagaggccaactgcaggggcaaggctcaaagtctyagcctctgaccgcttctctgcctgcctggtcggtggctgacgctatcagtccaaagtatcatgctcacagtcttcatcactggcttaacagctgacgtgt

SEQ ID NO: 22253 - DNA, 201 bp, Homo sapiens
ttttccaaagcattcctacctattcacactaccatgtgcaatatatgagatttccccaagtcccctaacctcaccaacacttgtcttcttgttacttttargtttctagtgtaaaatgtaattttattttgattttaatgtacattttcttgatgatagatgaggttgggtatcttttcacatctttatgggctattttta

SEQ ID NO: 22254 - DNA, 201 bp, Homo sapiens
ggatttttccttttaaaattttgtaatgtccctctttatctctgttgattttatttacctgatattaatatagtcactcctactttttaaaaattaatgtytgcatggtatatttttgaattttttgacattaacccaccatgttattgcctttgaagtaactttttttttgcaaacagcatttagttggatttttaaaaa

SEQ ID NO: 22255 - DNA, 201 bp, Homo sapiens
aagaactatccatcaactagttctttaatttatttcctgattcaacaaataatttgttaagtgcatgccacgtgccagaaagtgtgtcagatgtttagtgkatgctggtgagcaaaatagacatcctccctatcgtggaaggtgcttttcacagtttcaatatttgagaagtatgaagaaaatagcaaggtcttgtgttta

SEQ ID NO: 22256 - DNA, 201 bp, Homo sapiens
ctactttttaaaaattaatgtctgcatggtatatttttgaattttttgacattaacccaccatgttattgcctttgaagtaactttttttttgcaaacagmatttagttggatttttaaaaaatctattcttcccatttttgccttttaattggcatatttacatccttaagataagtattgttgttttagcatttaagta

SEQ ID NO: 22257 - DNA, 201 bp, Homo sapiens
gtgcacatggaccctagaacttaaagtataatgaaaaaaaaaaaaaaaagaaatgcgtcaaaacatgctgctctggggctcatgctcataggacagctacrccccacagcccctagctctgtctctgctatgggcctcaaggacaggatgggccatggagcgcctcacctgggcttgatggagacagctggcagtgccatg

SEQ ID NO: 22258 - DNA, 201 bp, Homo sapiens
cacttgtgacaagactatcctgcctctagggaaaggagggcacttccctggctggggactgcttgtggcaggatcccccttgccaatgccacctgctgacwctgggtggaggagaaaagattccagcctatagggatgaagagtttttatgggctaggtggaatcacccttgctggtcctgcccagctgcctgagtatctc

SEQ ID NO: 22259 - DNA, 201 bp, Homo sapiens
aaaaatggaagtcattgactgtagcttgttagggggaagatgagtttcttctccattcctggagacatacagaatttgcacaccaaagtagagatggtgtyaaaccacgtatttatttattcatctgtttattcatgcactttgtggatccattcacacagacccttaagtaatccttacagtgcagtgtgatgagtattc

SEQ ID NO: 22260 - DNA, 201 bp, Homo sapiens
tgtctccaactcctgagctcaggcaatccattctcctcggcctcccaaagtgctaggattataggaatgaaccaccatacccggcctcattacttcctttycatattcagaaatcaatttaaactttactttctggaatcccagtcccactcctgccaacatggtctggtccctgggcaccctgcctgcccttcatagccc

SEQ ID NO: 22261 - DNA, 201 bp, Homo sapiens
agggatgaagagtttttatgggctaggtggaatcacccttgctggtcctgcccagctgcctgagtatctctcagtgggggtgtggagtcttggaccctcartgacagagaggattcctgggctgtgtccaataatgatgagatctccttgccagtgctgctcatggtgcctggtttctcatggtggttcaggggagtccca

SEQ ID NO: 22262 - DNA, 201 bp, Homo sapiens
ggcttctgatccacagggggagagtgacaagttgacagataattaccactccatgtgctagtcttttcctgtcacacaagttctggcttccaagggctaaktatttatacctgactcttctgtgagttctgcactaattcagaagcatacatacaagtgagatagagagaaacgtctctattttattggtggattaaagac

SEQ ID NO: 22263 - DNA, 201 bp, Homo sapiens
agtatctctcagtgggggtgtggagtcttggaccctcaatgacagagaggattcctgggctgtgtccaataatgatgagatctccttgccagtgctgctcwtggtgcctggtttctcatggtggttcaggggagtcccaggttggtgtggagggtagttagtgtggaagggtagtgcttctagggctgggccatttctttt

SEQ ID NO: 22264 - DNA, 201 bp, Homo sapiens
gtttcaccatgttgaccaggctagtctcaaactcctgaccttaagtgatcagcccgccttggcatcccagagtgctgggattataggtgtgagccactgcrcccggctccaaaccccaatctttctaacatgcttcacgtgcctcttactttttcagatttcatcatgtggttatcatagggacatatctggcactaagcc

SEQ ID NO: 22265 - DNA, 201 bp, Homo sapiens
aacccaagtctgctttccaaaccccaatctttcttttcatttttttttgagacagagtctcactctgtcacccgggctggagtgcagtggcgtgatctcagctcactgcaacctccgcctcacaggtcaagcaagcctcctgcctcagcctcccaagtagctgggactacaggcatgtgccaccacacccagctcattttt

SEQ ID NO: 22266 - DNA, 201 bp, Homo sapiens
gatgacaaaaagaagaagaagaagaggtgagttgcaggcagagcccaaatatgtctccaagaggaggttatgtatttctcaaaggcttggacaagtaagartcatggatgaatctggtcccagaggtagtcaaagccaagcaatgcagccataaccactgacaggcctagtgccctggaaaatgcatgtcatctagagtca

SEQ ID NO: 22267 - DNA, 201 bp, Homo sapiens
tctcatgtcgttaactcctcaattaaaacttgttactgcttctttgtttcttcactctactctttgagctcttgattcttcccaaatcatccttacttttygagagaaaaaaatgtagattctttttgcagctgatttccttcccatacttcagggatctaaatgtctctcttattctgcattgtctctaacccattttgt

SEQ ID NO: 22268 - DNA, 201 bp, Homo sapiens
gggagaagaatgagcctacccggaccatcttctgttgcttggttggaatttagaaaattctaggtctgtgtttgttgcattttttatgttgttgggggccrtaagacaccctgtcactatgtttttcctctagcgctgagttccattactattttgtcttcctcttcccatctttcagaattctcctttcattgccttttg

SEQ ID NO: 22269 - DNA, 201 bp, Homo sapiens
tccattactattttgtcttcctcttcccatctttcagaattctcctttcattgccttttgcattatttccagtgtttgtagttgtacatagcagagaagarcagggagaaatgagtctacatcatcttcttcagaaactctcacactgatgggtttttggaagttgagccatttttcattgctcaaattatgcttagtaat

SEQ ID NO: 22270 - DNA, 201 bp, Homo sapiens
aaattcatgtattcgtccaatgagtatttattgtgtaccttttgcatgctaggttctggggattcatggagaatgagggggtcaacgttcctgccctcatkgagctatagcctggcataggagacagagaataaataactaagaaagccaacaagataagtaccactgagtaattaagaaaacttgttattatgtaatgtc

SEQ ID NO: 22271 - DNA, 201 bp, Homo sapiens
cacaaagtgttggtgacactcaaatgagatattatgtgtgacaatactttgttgaatgtaaacaagttcacctactgtatgggaggcagcattttagatgmtgtgggaatacagagaggaataaaccagcccaggcttttaagatgagcataaaggcaaatgcatgagaaactgttattattgatgcattaacaaatgacc

SEQ ID NO: 22272 - DNA, 201 bp, Homo sapiens
cttcttcagaaactctcacactgatgggtttttggaagttgagccatttttcattgctcaaattatgcttagtaataatttattatccttgttgtgtatcrcatttgattttctaacattttgttaataatttctttatgttcatggagaatttgtctgaaattttcttatgtggcaatgtccttttcagttttagtattc

SEQ ID NO: 22273 - DNA, 201 bp, Homo sapiens
cgtgatccatctgcctcggcctcccaaagtgctgggattacaggcgtgagccactgcacctggccttctgaaatttattttttatagccaactttccatcytggaatcttttgacattctggctataattttttttaatgttgttattattgagatagagtcttgctctgtcatccaggctggagtgcagtggcacaaata

SEQ ID NO: 22274 - DNA, 201 bp, Homo sapiens
taaaatatctgtttttatcttttctaaatggattgcttattacttttgagttttgaaagttcttcatatattttagacactagttctttgtcagatatgcrgtcagcaaatatttgctgccactctatagcttgtcttttcaaactcttgtcttttcaccatgaaaaggttttaattttgatgaggttcaatttagagaat

SEQ ID NO: 22275 - DNA, 201 bp, Homo sapiens
tcttcatatattttagacactagttctttgtcagatatgcagtcagcaaatatttgctgccactctatagcttgtcttttcaaactcttgtcttttcaccrtgaaaaggttttaattttgatgaggttcaatttagagaattatttatttcacgaatcacgcttttgatgtcaagtcttttcctagcctgagaccccgaag

SEQ ID NO: 22276 - DNA, 201 bp, Homo sapiens
tgccgtagctttctttggcttgtagatgcatcccccattttctgccaccatcctcaaatgggcttcttctctctgcaatgtctctgtgtgttctctcctcktcatatgaggacaccaggtgttggatgtaaggccctccctaatctaatatgacctcatctcaactaatgacatctgcaaacacactatttctatataagg

SEQ ID NO: 22277 - DNA, 201 bp, Homo sapiens
ttttattttttactgaaaacgtttgcattttacaattcagtccacaatcaattttgagataattttataaagtttgaggtttaggttgagagttttggggkttttttttctcttcttttcttttctttctttctttcttttttttttttgtctgtttgttttggtctatggatgcccaatagctttaatactatttgttga

SEQ ID NO: 22278 - DNA, 201 bp, Homo sapiens
cagtccacaatcaattttgagataattttataaagtttgaggtttaggttgagagttttggggtttttttttctcttcttttcttttctttctttctttcttttttttttttgtctgtttgttttggtctatggatgcccaatagctttaatactatttgttgaaaaggctatccgtcctccatggaattgcttttgtatt

SEQ ID NO: 22279 - DNA, 201 bp, Homo sapiens
ggaggctgtaccctgcaaagccacaggggcggagttgcccaagaccatggaaaccaaccttttgcatcagtgtgtcttggatgtgagacctggagtcaaaratcattttggagctttaaaatctgactgcccactggatttcggacttgcatgggccctgtaacccctttgttgtggccaatttctcccatttagaatggc

SEQ ID NO: 22280 - DNA, 201 bp, Homo sapiens
ccaaatataagtgagagcattcagtatgtgtctttctgtgcctagcttatttgagttaacataatataatatttgagttaacgtaacataatatcctctaggttcacccatgttgtcacaatggaaatatattttatttatatattgtatatattaattatatataatgtatcacatttatatattatatatgtatatata

SEQ ID NO: 22281 - DNA, 201 bp, Homo sapiens
ttcactgtgttagccaggttggtctcgatctcctgacctcgtgatccgcccacctcggcctcccaaagtgctgggattataggctaatcttgtgttttttktttttttttttattatactttaagttttagggtacacgtgcacaacgtgcaggtttgttatatatatacacatgtgccatgttggtgtgctgcactcatt

SEQ ID NO: 22282 - DNA, 201 bp, Homo sapiens
tagttttttccaattctgtgaagaaagtcattggtagcttgatggggatggcattgaatctataaattaccttgggcagtatggccattttcacgatattsattcttcctacccatgagcatggcatgttcttccatttgtttgtatcctcttttattcactgagcagtggtttgtagttcttcctgaagaggtccttcac

SEQ ID NO: 22283 - DNA, 201 bp, Homo sapiens
taatttattgagagtttttagcatgaaatgctgttgaagtttattgaaggccttttctgcatctattgggataatcatgtggtttttgtctttggttctgyttatatgctggattacatttatttatttgcatatgtttaaccagccttgcatcccagggatgaagcccaagtggtggctcatggtgggtaagctttttga

SEQ ID NO: 22284 - DNA, 201 bp, Homo sapiens
ttccctccttttctattggttggaatagtttcagaaggaatggtaccagctcctccttgtacctgtggtagaattcggctgtgaatccatctggtcctggrctttttttggttggtaagctattaattattgcctcaatttcagaggctgttattggtctattcagagattcaacttcttcctggtttagtcttgggagag

SEQ ID NO: 22285 - DNA, 201 bp, Homo sapiens
gctttggagcagtcagccctaccagggaggcaggacataggctgcggtggggggagtaatttccacccatacacctgcatatacctttgctggtgcgtgcrtgaactcacacacacacgcgcacaagcacacacacacaggaccaagactcagaaagtcagaagtaatgataaggagaatgagagagccagagaaagctaa

SEQ ID NO: 22286 - DNA, 201 bp, Homo sapiens
tctgggcctctatgccatttgtcggtaaaatgaggggctcctgcctgtggcatggaggagaggagttgctgagccaatcactgcgggccccaggcatggtrcccacccctggtgttctctagtgtccttctggtgcaccagccggagccttctgctcacaagctagctggcggccacctctcctgcacctctccaccactc

SEQ ID NO: 22287 - DNA, 201 bp, Homo sapiens
cctattgaaatgttttgaattatgaaatctgcatatgtgtgcacatacatattagttttatgtaatgtatatgaatagttcaaacatgttgtggtgtatawttgtatgccttattccttcacaatcccaattatctgcctctagcactttgctttagttccacagagtttgactccctttcccattcttcttctctatgtt

SEQ ID NO: 22288 - DNA, 201 bp, Homo sapiens
agttggaatgcagcctgagtcccagggacagcagccctttatggatgtgctgaaggaacttcatcttcgctaagagttctaccacagtctaaagccaggcraggggcagttcgccagctctgcaggaagcacaaggcatcttctgatgcttcgtggcatctcaaatgaggctctgtctttgcactgcagatgggcccgagg

SEQ ID NO: 22289 - DNA, 201 bp, Homo sapiens
aagctacccaggtgattctaaggagcagctacggtagttctcaaattttatgtgcatccgtcacctggatcttgtcaaaagacacaattacagagccccayctcaaaagtttctgatttgctatgtttgtctgagaatttgtaagaaattgaaatctaacaagttcccaggagatgctggtgctgctggtctggggacccc

SEQ ID NO: 22290 - DNA, 201 bp, Homo sapiens
actggagggttctcgagggccaggaccatgtcttgttagttggaatgcagcctgagtcccagggacagcagccctttatggatgtgctgaaggaacttcaycttcgctaagagttctaccacagtctaaagccaggcaaggggcagttcgccagctctgcaggaagcacaaggcatcttctgatgcttcgtggcatctcaa

SEQ ID NO: 22291 - DNA, 201 bp, Homo sapiens
cattctgctcacataaaacctcctgatttgagaaagcagagatggagtatttggtcccacctaaattttaagtgtcagccaggccaatttatgctgtggcrccaggaactgggctgttgtggcagcaggtcctactttgccacttcccagctgtgccaagttactcatcctctcagaacctcattgtgcttatttgcataa

SEQ ID NO: 22292 - DNA, 201 bp, Homo sapiens
ccaagggattctggggaaggggcactaactgtgtggcccagtgggggaagtcccagctctgttcattgtctacctgcttggggagttctctctgtgtgagmagcagcagcagacagtcaggttttttggggggatggggtagggtgggattacaaatttggtttcttgaagggagaaaaggactttgcgggagaagtgggg

SEQ ID NO: 22293 - DNA, 201 bp, Homo sapiens
aattgtgttgtccattaaaatcgttccagggctttgctaagcacatccctggagttgtcgctgtctcctggcctctgggaaagataagctgtatgatcacwgccctcttctagctgtggagatgaaaatcaatccgtatgcatttccttggagatggcccatggatgggcaggatcaggcctgccaagggaggcatgagtg

SEQ ID NO: 22294 - DNA, 201 bp, Homo sapiens
ggcctcccactacgcacctggcttttgtgtggttctctccacctccagtgccatctccccagccccagcctggacacttgaggtcacttccccgtgtcccyctgcctctgcccttccctccaggccattgtccatgtagcagccagagttatctgaaaaatcaacctaaccacctccctctcctgctgaaacccttcaatg

SEQ ID NO: 22295 - DNA, 201 bp, Homo sapiens
ctattaattattgcctcaatttcagaggctgttattggtctattcagagattcaacttcttcctggtttagtcttgggagagtgtatgtttcgaggaattyatccatttcttccagattttctagtttatttgtgtagaggtgtttatagtattctctgatggtagtttgtatttctgtgatatcccctttatcatttttc

SEQ ID NO: 22296 - DNA, 201 bp, Homo sapiens
ctactaggagaaaacacagtggaaaatcattgtgaccctaggttaggcaaagatttcttagatgtaacagtaaaagcacaatccataaaataaaaaaattkatcagccagattttattaaaattaagaacttgcactctttgaaagattctgtgaagaggataaaaagccaaaactgaggagaaatatttatgaatcacat

SEQ ID NO: 22297 - DNA, 201 bp, Homo sapiens
ggtctctaaggacttgctttatgaatctgggtactcctgtattgggtgcatatatatttaggatagttagctcttcttgttgaattgatccctttaccatyatgtaatggccttctttgtctcttttgatctttgttggtttaaagtctgttttatcagagactaggattgcaacccctgcccttttttgttttccacttg

SEQ ID NO: 22298 - DNA, 201 bp, Homo sapiens
ttcagtgaagaaagaataaatagtcttttaaacaaatggtgctggaacaattaactttctgtatgcaaaaaaaaaaaaaaaaagaaaaaagaaatatactrcaatcaccttgcctgtatgtaaaaataagtcaaaatactttacagacacaagaataaaccttaaaaatataaaactactaggagaaaacacagtggaaaa

SEQ ID NO: 22299 - DNA, 201 bp, Homo sapiens
gctaggtggtcagggagggcttcttgggggtggtgatttgagctgaagcctgaaggaagagcataggtcagccctggggacatggggaacagcactctgaygggaagggacagtgagtgcaaaggactagaggctccaaagagtttggtgagcttgaggaacagaaaggcccagctgggctggggtgtggagacctgagaa

SEQ ID NO: 22300 - DNA, 201 bp, Homo sapiens
agggctctgctctcatgaatggattaatgtcattgagggagtgggttcattattgagagtgagttgttaccgaagtgaggtaggccctctcgtgctctctygtgctctcctgcccttgtgccttccgccttctgctatgagatgatgtggcaagaaagccctcagcagatgtgggcccctcaaccttggacttcccagcct

SEQ ID NO: 22301 - DNA, 201 bp, Homo sapiens
ctttattttgatggattttttatcagctggagtagctttttgagcaatataataagtagtatgatttctgagacagcatatctgagaacattttctgttgmctttatacattaattaaaacatatctgtatataatattcttgtgtcacagctttcctctctaatattgtttagaatttgctcgattgccttcttcctgtg

SEQ ID NO: 22302 - DNA, 201 bp, Homo sapiens
gactcctaagtgtctagtgccaaatctgggtgccaggccaaaaataacagacaagagcagaccccagccctcatggaaccacaaagtagaaggaggagagmcagtaaatgaataaacagagatggtataagtggagcagacaattgtggagggtggtgagttctgtggcaggaaggagccaagggatgtgatggagaatag

SEQ ID NO: 22303 - DNA, 201 bp, Homo sapiens
ttgagttttttgccccagtgacaaagtttcattttctagcattcggattgatacagcctcaacaacagtaagagaaaccactgtgtaactttttgtaaccttttttttttcttggcgtccatattctctgctatttactgacaaattactattgttcagagaaaaatgctggtaaatgagggtttctgcatactgtaccca

SEQ ID NO: 22304 - DNA, 201 bp, Homo sapiens
ttctctattcctcagggagtgggtcttggcaaaggaacctgtttctaggcttagacagcgggctggcagggggatggggtagcttggcagaatggaaggtrtggacaggacaggcctagcaagggctgctctcctggtgggctgcagctcccattttccctctggcctggtttgttggggaatgagctggtccctgaaggg

SEQ ID NO: 22305 - DNA, 201 bp, Homo sapiens
cactccagcctgggccacagagtgagactctatctcaaaaaaacaaaacaaaaaacaaaacaaaacaaaaccccaaaacaaacaaacaaaaaaattcaacwatgaaaaaaataccaaccacctgtttaaaaattgggcaaaaattctgaacagacaccttatcaaagatttacagatggcaaacaaacatgagaagatgct

SEQ ID NO: 22306 - DNA, 201 bp, Homo sapiens
taaagttgtgtttttagtgcagtttgtggaatagagtggaaatgtgtgcatgtgatgtgtgtgtgtgtgcatgtgtgtgtgtgtgtagagggtagggatgstggggaaaaggagaccacaggcaggggagtaatgaggaggctgtgtcaggacttctgggatggtgatgagggcttactgggggtggtagcagtgagacca

SEQ ID NO: 22307 - DNA, 201 bp, Homo sapiens
aggataatggcctccagctgcacccatgttgctgcaaaggacatgattttattccctttttatggctgcataatattccatggcctcttcaccatttttcytgcagttattttcatattagttcagaaagaacttcttgattcttttttttacaggtacattactatagtctttttgtttgtttacaagtacaatactttc

SEQ ID NO: 22308 - DNA, 201 bp, Homo sapiens
gcctcccaaagtgctgtgatgacaggcatgatccaccgtgcctggtcctggttacattatttttttgcaaatatttttattcttaccatacaaattcaaaytttaaaaaataacaattactaacatgtttccctctctccaagtaattaatattttcagtttggagaaaaccatttcaggtgtctggctctgcctattttt

SEQ ID NO: 22309 - DNA, 201 bp, Homo sapiens
agctattgcaggttcatggtcagggatctataaagttgtgtttttagtgcagtttgtggaatagagtggaaatgtgtgcatgtgatgtgtgtgtgtgtgcrtgtgtgtgtgtgtgtagagggtagggatgctggggaaaaggagaccacaggcaggggagtaatgaggaggctgtgtcaggacttctgggatggtgatgag

SEQ ID NO: 22310 - DNA, 201 bp, Homo sapiens
accccagatggaaatgcagaaatcacccgtcttctgtgtcgctcacgctgggagctgtagaccggagctgttcctattcagccatcttggctccagctccygccatctttatattcatgtgtaccccacatttatctcccacttatgagtgagaacatgcagtatttggtcttctgttctggtattaatttgcttaggata

SEQ ID NO: 22311 - DNA, 201 bp, Homo sapiens
atgattgagcttctcattagcatacactgggcatgtcagtgtcaggtaatccatttgactctgctatggatggatttatgctgcacaccaaaaaaaaaaamaacctgcaattttcactcttaacttctcttgtactaagttgtgtgacagaaagaacaggtgatatggcaccacaaaatattaactatgtgatcttgaata

SEQ ID NO: 22312 - DNA, 201 bp, Homo sapiens
acatcgcacagcacccgcttaagacagcccctgacagtaaagaactttctggcctcaagtgtcaatagtaggtaacagggcataggtaatagggagctatkgcaggttcatggtcagggatctataaagttgtgtttttagtgcagtttgtggaatagagtggaaatgtgtgcatgtgatgtgtgtgtgtgtgcatgtgtg

SEQ ID NO: 22313 - DNA, 201 bp, Homo sapiens
gaatattgcaataaactggtcccatctaaacctgctatgtcaggtagagaaaggtggaaaaagtgaaagatgagcaaactcattttaacctaaggttaaamaaatggatctattaatcgagaagagtgatctgagaggaatttgttcaagtccagatcatctcaataaagtgaatattgcaataaataaagtcgcaggaat

SEQ ID NO: 22314 - DNA, 201 bp, Homo sapiens
gaactggttgccaagtgagtataaaagagtggccgggccaggagggaacccacacatccacttcctgaggggtgacccagctccctgaatgtgtgtgtgtgggtgtctcttggtgtctccaagctctgctgtgggctggagctcctgggacactgttgttctcattgggtactggggggtccaggagagtgatttttctgc

SEQ ID NO: 22315 - DNA, 201 bp, Homo sapiens
ctgagaaagttcttcccatagcttcaagtcaagaatgactacaaaacacatatgaatcacagtgagatggcaatggtgctgctgaggtctggtgggtgagyctggcttgtgttggaagacttagttctcttcctggctttatctttttctaacgtgcttctgggcacactggcaactctttctgatcctttgttttcccac

SEQ ID NO: 22316 - DNA, 201 bp, Homo sapiens
tgaactggttgccaagtgagtataaaagagtggccgggccaggagggaacccacacatccacttcctgaggggtgacccagctccctgaatgtgtgtgtgtgggtgtctcttggtgtctccaagctctgctgtgggctggagctcctgggacactgttgttctcattgggtactggggggtccaggagagtgatttttctg

SEQ ID NO: 22317 - DNA, 201 bp, Homo sapiens
atttactcatcttttgatgtctgtctttccccaactagttccatgcagacaggcagttttgtttgcttggttgagtgatactggacccacagcatttagarcagcacctaaagcttagtaggtgctcattaaatatttgatgagtgaatgagtgaattgatattttgggggtgtttcattgcccatttattggcccagaag

SEQ ID NO: 22318 - DNA, 201 bp, Homo sapiens
gagtgatttaagatcatccttttaatagtaagcatgtactcctttcatatcagaaccataatatggtaactacattgacttgaggatataaaaggaggccrgatgccactggaacagaggtgccatggttagcaaaactgagtcaaagaactacttatcttgtgtggtatttttatctaaaatccactttgtggaaaacaa

SEQ ID NO: 22319 - DNA, 201 bp, Homo sapiens
gcttccaactttttttcctacagtttcctcacctctctcagccttcgttaaaattgaagagagttggggcattgatctggattaggctttagcttaagggaatgtcctgttgatcttctattcagaccactaaaactttctccatatcagtaataaggctcttttgctttcttataattcatatgttcactggagtttcac

SEQ ID NO: 22320 - DNA, 201 bp, Homo sapiens
attagtgagagaaacttgccgaaaatctctggagtggctaaatgaaaccatccagtccctcttccagctctctcctcacttacaatagagcccatgagctsccaggaaggcctcaagcccttttcctggcttctgtctggccttgacttcactccctctagcatctctgacctggctccaggtattttgctttgcagccag

SEQ ID NO: 22321 - DNA, 201 bp, Homo sapiens
tagcagcactggatgatgatttagcactcagactctggtgcagactgtctgagttcaaatcctgcctccagcctttctaggtagcatgaacttgggtgagrtactcaatgtctccatgtctcaggttgcctgtaggcgtctacatcatagccttcttgtaaggtatagagagctggcaccagaataacactcagtgcctgt

SEQ ID NO: 22322 - DNA, 201 bp, Homo sapiens
atgcttatagcggctttgttgtaataaccgcaaactggaaaccatcccaatgtccttcagctggtgaatggataacaaactgtggtacagccatacaatgraatattattcagcattaaaaagggagtttgagaccagcctgagccccataatgagactctgtctctacaaaaaaataaataaataaaataaaattagcca

SEQ ID NO: 22323 - DNA, 201 bp, Homo sapiens
gagtaagaactcactaataatcttctattgtttgtgtttattctttttttttaaaacagcctactaggggagtaggctaacaaataaaagacattgttcgyctctctctctctctctctctctctctctctgtgtgtgtgtgattttagaaagagttgctacatatcagaatgcctgcctctacctgaaagtcccagagga

SEQ ID NO: 22324 - DNA, 201 bp, Homo sapiens
atgtccaccaaggcactgagtgtcatagaaaacctggtttccccagcttaaacctctaaagctagtccagaggaacagttgcttctgcctgggagttagtstctctacctcagtttgcttctctctaaatgaatagatcagatctgctggactctcttgtggctgcattgatctctgtgttttgtggctatggtgtgcttc

SEQ ID NO: 22325 - DNA, 201 bp, Homo sapiens
ctaagaaggcattacataagcagcatcgggagtcctcttcctccggggcctgtctgcagtttcactgcttgtccacatgggctccagctcccatggctgaygcttgcttgggggagcctaggcctgtggcctgggggtgcagttgagcctccttacatggcataatgtgaatctagccctgggcactaagctgaggctgag

SEQ ID NO: 22326 - DNA, 201 bp, Homo sapiens
agagcgctacaccctctgggcctcagtttcctggtctctgtggtgggcacactccaggccttaatggacaggcataaccttgcccaccctcactgtcttcytgggcagactgaagctatcccagtgcctatttcatgcagctctttcctcaggtatttggggtaacagttcttgagaaaacatggctcgttaaattgaaaa

SEQ ID NO: 22327 - DNA, 201 bp, Homo sapiens
gatgatcaggaatcagagaagtgaatgacttggcccaagtgtgcagcccaggaagaaatgtttgacttgaactcaaggctccctcctcccatccccgcacmtgaagcaggctcctccctctatccccacacctgaagcaggcccattctcccatccccacacctgaagcaggcccattctcccatccccacacctgaagca

SEQ ID NO: 22328 - DNA, 201 bp, Homo sapiens
ggcagcttgcaagagaggcccatgggcagccgcctccaaggattgactcttaaagtggtgactgtcttggtaggatcatggggacattctgggagcgagcyacaccatccaggctgttgaatcagaggctgctttctgtttaatgctgggtttggggagaagagaatcttgaggagtattgtgagctttcataaggccttt

SEQ ID NO: 22329 - DNA, 201 bp, Homo sapiens
gtgacaaagtgctcacgatctccagccagcccagctggggttgagaaccagcttgtggtccagcactcagctggagaggatgttagagtccaagagagagsgggagaagaggagggctaagtgctgcctgggctccagatgctggctaggcactttcggatctttttcaggagcagggtgagagttcacagggcacctccc

SEQ ID NO: 22330 - DNA, 201 bp, Homo sapiens
ccatgtaatagaaaaggccagaggctgcatcgcttcaggcatggctggatccaaggcccaaatggtatccacaggactctgcctccgtctccacacccctygtccctgctctctcctgtgtggtttccttcctgggcagcctcctgcctgttgcaggctgatgtctaatgagcccagccccctggccacttgcccctggaa

SEQ ID NO: 22331 - DNA, 201 bp, Homo sapiens
ggaagtcttgcaggcattcactgcttatcccttttacttttgtttttatatttatttacatttattaattgttactttttacaagtatgtaaatatatacmaatgctttgagtttttagcagtttattttgggtgtcttttaatttcaatagcaattgaagaagtgggatttggagagaaaacgccatggagggaaggaag

SEQ ID NO: 22332 - DNA, 201 bp, Homo sapiens
aagtatgtaaatatatacaaatgctttgagtttttagcagtttattttgggtgtcttttaatttcaatagcaattgaagaagtgggatttggagagaaaaygccatggagggaaggaaggtgaggagggaggacacctcagctggccctccgaggctggctttcaggcataggtttgaagaagggctctgtgacctatgga

SEQ ID NO: 22333 - DNA, 201 bp, Homo sapiens
attgctttgatgattgcagcatcatctcttgtagagccaaacatgagatagaaaatcaagactgctggaatgatagtaaaggcatctgtaggctgtagctwtgaaagtttcaagtcaccaggatggatatccccaccctcccgtgtcttttgagccactccaccacattctcttctccttaaggaagaataataggacttc

SEQ ID NO: 22334 - DNA, 201 bp, Homo sapiens
aagtcccagctctgttcattgtctacctgcttggggagttctctctgtgtgagcagcagcagcagacagtcaggttttttggggggatggggtagggtggsattacaaatttggtttcttgaagggagaaaaggactttgcgggagaagtggggttccgtggccccattcctggagagtggcaggagggctgcagcatggg

SEQ ID NO: 22335 - DNA, 201 bp, Homo sapiens
taggacttccagatccacatgtatcaggcccatgcttatgacatccccaccgttgttgaaatccgttttacgtatactgaatattgattctgctcttgttrcaagtgtttatctccattgccaatgtaaatatttttgtaacatgcaaagatgtatttataaattctgtattattgatttttctcatactgcaaacacatt

SEQ ID NO: 22336 - DNA, 201 bp, Homo sapiens
atctcagactgctttgttagcaatcagcgagactccgtgggtgtaggaccctccgagccaggtgcaggatataatctcctggtgtgccattttttaagccygttggaaaagcacagtattggggtgggtgtgacccgatttcccaggtgccgtctgttacccctttctttgactcggaaagggaactccctgaccccttgc

SEQ ID NO: 22337 - DNA, 201 bp, Homo sapiens
aagcacttctctgtattggttattctagttatacattcgtctaagtttttttcaaagttttcaacttctttgcctttggtttgaatttcctcctgtagctmggagtagtttgatcgtctgaagccttcttctctcaacttgtcaaaggcattctccgtccagctttgttccgttgctcatgaggagctgcattcctttgga

SEQ ID NO: 22338 - DNA, 201 bp, Homo sapiens
gaagttccctcacccctccatcagattccagagtgcgtctggagacatgaggagatgcctgatgcaggcctgcataaaggactggaaagtgaggctatgcygactcccacacatgccccggtgtgctgctgggtcctgctggagttgagggagcaagaacttgtccagatcgtcccccgtttcctcttctcaccacacacc

SEQ ID NO: 22339 - DNA, 201 bp, Homo sapiens
gtttgtgtttattctttttttttaaaacagcctactaggggagtaggctaacaaataaaagacattgttcgtctctctctctctctctctctctctctctstgtgtgtgtgtgattttagaaagagttgctacatatcagaatgcctgcctctacctgaaagtcccagaggatgcgggggaaatttttcccaggaagaaga

SEQ ID NO: 22340 - DNA, 201 bp, Homo sapiens
gcaagttactcaacctctctgtgcaacagttttttcatttgtaaaattgcgatacaatactactttctgcctgatggggttaacgtgtggattaaatgagycaatagatgtcaggggcttagctcagtacctggcgcgtggtaactgctcagtaacacttactactctggagctgtgcccagcagtggtcccattgctgtc

SEQ ID NO: 22341 - DNA, 201 bp, Homo sapiens
ttcgtttctttttattcttttttctctaaacttcccttctcacttcatttcattcatttcatcttccatcactgataccctttcttctagttgatcgcatyggctcccgaggcttctgcattcttcacgtagttctcgagccttggctttcagctccatcagttcctttaagcacttctctgtattggttattctagttat

SEQ ID NO: 22342 - DNA, 201 bp, Homo sapiens
tttgtgtttattctttttttttaaaacagcctactaggggagtaggctaacaaataaaagacattgttcgtctctctctctctctctctctctctctctckgtgtgtgtgtgattttagaaagagttgctacatatcagaatgcctgcctctacctgaaagtcccagaggatgcgggggaaatttttcccaggaagaagag

SEQ ID NO: 22343 - DNA, 201 bp, Homo sapiens
atccaaaccatattattctgtccttggcccctcccaagtctcattttttatcacattgcaaaatacaatcaacccttctcaacagtcccccaagtcttaaytaatttcaggattaactcaaaagtccacagtccaaagtctcatctgagacaaggcaagtaccttctgcctatgagcctgcaagctcaaaaccagttagtg

SEQ ID NO: 22344 - DNA, 201 bp, Homo sapiens
agcaaagggcactgggggctggaggtgacatttaaacaggtgcttaaataggagtagtttttattttttgttaggcaagcaaagggcactgagggctgtasgaagagtgttctaagcagagggaagaacttgcttccctctttccagaggaaaggtctgggggcaatggagaggaggaaaaatcatatggctggaatatgg

SEQ ID NO: 22345 - DNA, 201 bp, Homo sapiens
cagtagcaaacgatgcaaacaaaggatttcttatcaatgcctatcacttcatggtatagaatttaatctttgttagtacataagatggattagttttatgrtaccttcattttatgaaccccaagctggctttgggatcacaaatctctctcttgcatttggatctctaagaaaaaaaaaactgactgccagcactagaca

SEQ ID NO: 22346 - DNA, 201 bp, Homo sapiens
ctgtctttccatctacccacccatctattcatctacccacccatccactcatatatccatccatccatccgtctatccatctatccatccatccatccatctatccatccatctgtccatccctctgtccttccatctacttacccatctattcatctacccacccatccactcatatatccatccatccatccatccatc

SEQ ID NO: 22347 - DNA, 201 bp, Homo sapiens
ttagtgaacagaaattctttattgtattgttgtcaaatgtagtcatctttttttatggctagctcttttgcttgtcttgtttaagaagtcctttcctaccygaatgtcagaaagaaattttcctgctgaaacctccctctctatatggagggcagatattgtccacctggctaggtgtccacagctatggcctggccaggc

SEQ ID NO: 22348 - DNA, 201 bp, Homo sapiens
cctggataataccctgcagagtgttttccatcttggttccattctccccgtcactttcaggtacaccaatcagacgtagatttggtcttttcacatagtcycatatttcttggaggctttgttcgtttctttttattcttttttctctaaacttcccttctcacttcatttcattcatttcatcttccatcactgataccc

SEQ ID NO: 22349 - DNA, 201 bp, Homo sapiens
tttttctgttcaaaaataccaacttttgtcttcactgattttcactgttgtttttatattttattgatttcaacttttttgtgcataaaatattttcttctattttactttggttataattttatcttacctcttctagcttcttaatgttaaaacttatatcattaattttacacttgttttctttcctaatataagtat

SEQ ID NO: 22350 - DNA, 201 bp, Homo sapiens
tctgtctttccatctacccacccatctattcatctacccacccatccactcatatatccatccatccatccgtctatccatctatccatccatccatccatctatccatccatctgtccatccctctgtccttccatctacttacccatctattcatctacccacccatccactcatatatccatccatccatccatccat

SEQ ID NO: 22351 - DNA, 201 bp, Homo sapiens
agagcaaagacagtaggtgaattttccccagtccatacttcataagtctaaccagggcagaggagacagcacagacttctttggagccagatgtaactcargttgacatggctccactgttcataattcaggcttgtttgggacacgtcatttaattttttggagcctcagtctttttgtctgtaaatggggtggaatctt

SEQ ID NO: 22352 - DNA, 201 bp, Homo sapiens
ctctgtctttccatctacccacccatctattcatctacccacccatccactcatatatccatccatccatccgtctatccatctatccatccatccatccatctatccatccatctgtccatccctctgtccttccatctacttacccatctattcatctacccacccatccactcatatatccatccatccatccatcca

SEQ ID NO: 22353 - DNA, 201 bp, Homo sapiens
caatcagtttgaaaaatatcaaggagcccttgtgtgcttcacctgaccatgtctcccctacagagggacttaaacactctcccgattgtgtgctaacaagwccctcgctttccttgatagtttttttttctttttatgtgtctgaagttttgccaagttgtatctaagcatggaaattttaaatttatgcctcatatattt

SEQ ID NO: 22354 - DNA, 201 bp, Homo sapiens
attatttggggccacgtggaaaactgattctgaccctacaaggaggaagcaaagcttagagtttttgtggggcaggatggagctcattctgcaaggaaacaagaagagggtctgtataaagacaacagggccatgatgggtgggatattttaacttcttagagctggtgtctgcaatgttcctgacagtatggtcagacct

SEQ ID NO: 22355 - DNA, 201 bp, Homo sapiens
cctctgtctttccatctacccacccatctattcatctacccacccatccactcatatatccatccatccatccgtctatccatctatccatccatccatccatctatccatccatctgtccatccctctgtccttccatctacttacccatctattcatctacccacccatccactcatatatccatccatccatccatcc

SEQ ID NO: 22356 - DNA, 201 bp, Homo sapiens
ccaggcaggtggggcaacaagagccaaaagtgactgatggctgcaaggaggactctccgtgggagtcctgggatgggacaattccacaattgagcattggmgttcctggacaatttacgtcccagggatatacagtttattttatacaattgctgtttaagattataaatgtattgtattggcattaaagagagcatgcat

SEQ ID NO: 22357 - DNA, 201 bp, Homo sapiens
ttatttggggccacgtggaaaactgattctgaccctacaaggaggaagcaaagcttagagtttttgtggggcaggatggagctcattctgcaaggaaacaagaagagggtctgtataaagacaacagggccatgatgggtgggatattttaacttcttagagctggtgtctgcaatgttcctgacagtatggtcagaccta

SEQ ID NO: 22358 - DNA, 201 bp, Homo sapiens
ggattggaaggttctattgtggggagatagacatagaagaacacatatattagaggacctggaggcccagtgatggaggtggtgattggaggctttctcarggaaggccatctgagcattagcaaagtgatggttgagggagaggagtttcaggaagaagggactgcctgggcaaaggcatagaggcctgaaacagctatc

SEQ ID NO: 22359 - DNA, 201 bp, Homo sapiens
tccaggacagctctctgtcctgggtttcaggggtgcattgtggcctgaggaggtgttctctcttgctggtctattaaacaaagcctaggttcattaacagygggaaaagaccctcacctcatgatccaagctgactcattcttggctttccacaactgcctcttgccttattgttcatactacttcctatttctcccaaac

SEQ ID NO: 22360 - DNA, 201 bp, Homo sapiens
ctgagagtccgctgtctggaaaagcctggatgggtgggatgtgaacatcttctccagggaagcaggtgggaatgtgactgtggattgtgcagttgtattgsgaatgctgtctgggcaccccccacacccccaatgccgagctctgagtagccctttcttttgtggggaccctccactttcccaggacacagggtgcaggtg

SEQ ID NO: 22361 - DNA, 201 bp, Homo sapiens
aagcctggaggttgccctgggaagtctgctggctatgctgcaggattagtgcaaggccttggagctggggcttggggctggttaggctggcagggtgggcyactccaacctttcctagaagggctgctggccaaggagtgagttttgctcctgctgcatgaatcacctggggtgggagagactagacagctgagggcctag

SEQ ID NO: 22362 - DNA, 201 bp, Homo sapiens
tatttggggccacgtggaaaactgattctgaccctacaaggaggaagcaaagcttagagtttttgtggggcaggatggagctcattctgcaaggaaacaagaagagggtctgtataaagacaacagggccatgatgggtgggatattttaacttcttagagctggtgtctgcaatgttcctgacagtatggtcagacctaa

SEQ ID NO: 22363 - DNA, 201 bp, Homo sapiens
ctgccattgtggagaagcacacagggccagggtgtggccccagctgcatgaatcatccaggagtgtgtgaacactgactccaggctcccacactatggggctgcaacgtgagtatcaagggttttgaaagctacccaggtgattctaaggagcagctacggtagttctcaaattttatgtgcatccgtcacctggatcttg

SEQ ID NO: 22364 - DNA, 201 bp, Homo sapiens
ctgcccaggcagttgtagagggagtgaggtgggtgtgggcatccctgtgacttttaccccagagacagacccacagggtgatgactggctgccattgcctrtggtttgcctggtgagcacagctgtctcgggctgtgctgtcgatagtgggtggaccagggccaggccaggatgatgtacatcccgcattgtcctgttgct

SEQ ID NO: 22365 - DNA, 201 bp, Homo sapiens
cctgatggaagaatctgccaccactgcactgatgtggagatagtgacaccagaaacctgcacctgtgtgtgcatatatatgtttatgtgtgtgtacaaacwtatatgcatgtgagtgtgtgcatgcatatgtgcacacatatttatgggtgcatatatgtgtgcttattacacatgtatgtgcgtgtgcacaggtgtgttt

SEQ ID NO: 22366 - DNA, 201 bp, Homo sapiens
ctgaagggggaggtgaatggtgggcatgggtggcaaggggctgagccagggcagtggatgagtcaggagtatgggaggctgggctgctgatcagcgactttgcagatcctcagggtcattacttgctgttgttgctggggaaagttgcaaaatgaaaattaactgtcagagaagattgattcgtttgatgcctaaccagga

SEQ ID NO: 22367 - DNA, 201 bp, Homo sapiens
tcggctcactgcaacctctgcctcctgggttcaagtagttctcctacgtcagcctcctgagtagctgggattacaggcacgcaccaccacacctggctaakttttgtgtttttgctagagacagggctgcaccatgttggccagggtggtttcgaactgctgacctcaagtgatccacccgccttggtctcccaaaatgct

SEQ ID NO: 22368 - DNA, 201 bp, Homo sapiens
ttgaaccagcccagctctaacttaatggaagatacatgttgatttttgtccttaaagggtcaaaatttccgcatcaagccaagtaaaagttctgattattrtattgggtagatcattttaatagctgaatcaaaacttggctttgcaacttaaagtgacagaacttcctgttaactagaaatagacagaaaagccacgaaa

SEQ ID NO: 22369 - DNA, 201 bp, Homo sapiens
cagacccagcccctttcttgccccgctttctcaccatgtggctttctgagctctggttcctcatctgctcaatggagtcaatacttgattcacaacgttcytctaagtacagggtattttggggtgtaggctttcctttttcctttctcacagtgcttgacatgggtatgggtacccagaacatgcccagtgactgatgtg

SEQ ID NO: 22370 - DNA, 201 bp, Homo sapiens
attagccgaagccttccattgttagtgccccaggcagggggtgtgggtacggctcattcaaggtccctgtgtctgaaacagcacatgtgtgaacacaccaygtgaacgtgcccatacggagtcatccagaccacccattccctttcctgaatctgctcttatgtggttctgtggctggttctgaaacctgtctgagcagaa

SEQ ID NO: 22371 - DNA, 201 bp, Homo sapiens
cagaccacccattccctttcctgaatctgctcttatgtggttctgtggctggttctgaaacctgtctgagcagaaggctcctgggtactatcagcccttaktagaggcagaaacttgtttcccctctcaaagagttttcaatgacagaccttccccttcaagccactttacaactttggaatttccattatcacagaaggg

SEQ ID NO: 22372 - DNA, 201 bp, Homo sapiens
gatcttcctaagttgttagttactaaggagccgatgagtgagaggtgcagacccttccgtgtgtctggatgcacacagggattctggaaaaaccaatgccrttgtttggctttcattcttttggctccactggggagcagggctcatttgatagcgtgggagctgctgcctgtatagggattagctgggggcagacgtgcc

SEQ ID NO: 22373 - DNA, 201 bp, Homo sapiens
gaatggcagcttgcaagagaggcccatgggcagccgcctccaaggattgactcttaaagtggtgactgtcttggtaggatcatggggacattctgggagckagctacaccatccaggctgttgaatcagaggctgctttctgtttaatgctgggtttggggagaagagaatcttgaggagtattgtgagctttcataaggc

SEQ ID NO: 22374 - DNA, 201 bp, Homo sapiens
gtgattttccccatgaactgcatctcggctcattaaggaagccggtggctccctgtgtcgccagtatgcctgctgtattttgctgatgggcccagagctgsatggaccatggaggctgctttctcaccctcccattctcatcattagcattccaaagtagaaaacaagcctgatgcttgctgcctaaatatttatggaatg

SEQ ID NO: 22375 - DNA, 201 bp, Homo sapiens
ggcaggggcaggctcagaggagaacccagtgccgcatgataattgaggcttgtgtttggggagcaatttagtgttttcaaagcactttcatgtacattatytcattctatcctcagagcgatactgtgaatgtgttattatcactctgttctgttcagagtagaaatctgggcttaggatgtactgccattcaacaaggca

SEQ ID NO: 22376 - DNA, 201 bp, Homo sapiens
atgctaccattggctggtgtttatagggcatgctagggagtaggtgcagagaggtttccaaacagaaattgcctctaatggagtctctttgagtagagcasgggtacctggtaacaactgggtcctactgcttggatcagggggctgcatggaggctataaaggacaatgtgttttctcagagcagtgaaatcagcccgac

SEQ ID NO: 22377 - DNA, 201 bp, Homo sapiens
aggccaaagctgggagatgggcaatgtgcccaaggtggcacaggtggcaaagccaggatccaagctagggatcttgctgtgccctccaatgcacatgtttkctgccctgcaacttaccatcatgtgtctgatatgtctcctgttgacctttgaattttctcttgggttaggctaaggtgagcccctggaactgattgcaag

SEQ ID NO: 22378 - DNA, 201 bp, Homo sapiens
gaacgcaaccgagaggcaagcacggctgttcagcaggactcctgggttctcacagagttccaccttgtttctggtttctgagtcaactgaagaccaagttrctgaagtggatgttgaccacattctagaatagcagtgtggttgcttcataaaagccttacttgtaggcatattaagctgaatgaacattgccagagagaa

SEQ ID NO: 22379 - DNA, 201 bp, Homo sapiens
cttgtgatgtatctcatgtgctgaggagggatactgaattagaaagctggatttgaagtgaattgagtaatctatggatgatttgttagagtgaattcacytttagaggcttcaaaagagcatttagggaaatccatagcgttaggaatttagtcacaatgaattgcatgtggtttcagtagcagggaacatgctttagtg

SEQ ID NO: 22380 - DNA, 201 bp, Homo sapiens
ttagtggggagaataaggaaaaagtatgtctactccatttccctgggagcagaagtccccactctggcctgccctcaaccatgaacccccaaagttttcakctgaagttcctcccagcaatctctaatttgccctggagaagtggagtcactgtttcagagctgggatccccatgctctctgggacgtgacagctgttctt

SEQ ID NO: 22381 - DNA, 201 bp, Homo sapiens
ctcacagagttccaccttgtttctggtttctgagtcaactgaagaccaagttactgaagtggatgttgaccacattctagaatagcagtgtggttgcttcmtaaaagccttacttgtaggcatattaagctgaatgaacattgccagagagaaccccctccctcaaaactgtaactgatcacacactgtccaaacagcagg

SEQ ID NO: 22382 - DNA, 201 bp, Homo sapiens
gcttctctcttgatcctgctccctctgtattgtacccattgacacagtcgtcttgaactgctttcagttcctttaacccaaggatccgccagcggtggccratagagcaaatccagtatattgcctcttttggaaaataatgttttattgcacatggcagcacccatatgtttatatattgtctatggctgctttcaagtt

SEQ ID NO: 22383 - DNA, 201 bp, Homo sapiens
agggagctcagccactgcatcccaagggtggtgagcacagggagggcctcctgaggggctagtatatgagtgtcaggggacattgaccttggccttagtgygcttctctaaaagtgctacccagcctccaagttgtgctgcactcagttacttgttaatgtcccaaagagtcttgtgaattatataggcattgatcccttg

SEQ ID NO: 22384 - DNA, 201 bp, Homo sapiens
gggctcaatccctgcttctctcttgatcctgctccctctgtattgtacccattgacacagtcgtcttgaactgctttcagttcctttaacccaaggatccrccagcggtggccaatagagcaaatccagtatattgcctcttttggaaaataatgttttattgcacatggcagcacccatatgtttatatattgtctatgg

SEQ ID NO: 22385 - DNA, 201 bp, Homo sapiens
gcttgcatggggatgagtgtttaaatagtgacagcatctgcttgcttgccttacctttgctaatggactctgtactgtgcataacctacaatatgagggarggaggcaaggacttctccaagccgggcctcattctctgcacctgtggcctgtgactccagcctgggctgttggcccctggtggtcaatgacgagtgagca

SEQ ID NO: 22386 - DNA, 201 bp, Homo sapiens
tatggttaggacgtggtcagtatggggcactctgaggacaacctctgaggtcctagagtcacttttcttacagagtatcatataggactgtcacacctgcycaagcatggccctgggcagctgttcgatcactctgggcctctatgccatttgtcggtaaaatgaggggctcctgcctgtggcatggaggagaggagttgc

SEQ ID NO: 22387 - DNA, 201 bp, Homo sapiens
gctggctttgggggccagtcagcacctgtatccacttttccatcttgagagacccttgcccccagggtggtcccctcagatgctggtgctgggtgcatggygcacccccgacacctggctgactcattctctaaaacaggcctcatgtcaacaacttcagaggctgtgtgctgtcatgctggctgttaggacggcgatgag

SEQ ID NO: 22388 - DNA, 201 bp, Homo sapiens
gttatcaagataagtctcagagtgttcaacagcttgttcaacatcactcagcaaatggatgctagtggagatctacttcactcgttccatcaacatttatygagtgcttgctgtatccacgcactactgtggagacctggggtccagcagtgagcaaagctggtccaggctggaatgaatccaaagctgttgctgttccta

SEQ ID NO: 22389 - DNA, 201 bp, Homo sapiens
ctccatagttagccaagccgtaatgaatgtgaaatgttcccgtgtctttagcattttggcatctccctttgcgctaatgtccaatcagcatgaccggagcstcctccgattgtggtgggaaccgttgctctgcacaggatttctgggggtgtgaatgaggagtgagtcttacctcctgaatcccaggccctgctgaatgtc

SEQ ID NO: 22390 - DNA, 201 bp, Homo sapiens
catgaataaattctgattggcaaactagattcctcttactttagctgggttagaagcagaagtacaaattgtttttattattattattattttttgagacrgagtctcgctctattgcccaggctggagtgcagtggcacaatctcggctcactgcaacctctgcctcctgggttcaagtagttctcctacgtcagcctcc

SEQ ID NO: 22391 - DNA, 201 bp, Homo sapiens
ctgtgtactgtcttggggggatttctcccttctgggtggggattgggtctggagcctggaaacacctttggtctgatgacctaagccccaggcattccatyccatccttggctcaggctaggctgggacctgggatggctccagtcccagctctcctattagccccaggagtgtgcagctggggcaaggcctgagggtaaa

SEQ ID NO: 22392 - DNA, 201 bp, Homo sapiens
cctcaccagacacagaatctgtaggcaccttgatcttgtacttgccaggcttcagaacggtgagaagttaaatttttgttgcttataagccacccagtctrtgtttttttgttacagtgacctgagtggactaaggcagccttcgcgtctcctcaggagcctcagagcccagagccggtgttgtacgcgatggggagttgg

SEQ ID NO: 22393 - DNA, 201 bp, Homo sapiens
ctttgaaccagcccagctctaacttaatggaagatacatgttgatttttgtccttaaagggtcaaaatttccgcatcaagccaagtaaaagttctgattaytatattgggtagatcattttaatagctgaatcaaaacttggctttgcaacttaaagtgacagaacttcctgttaactagaaatagacagaaaagccacga

SEQ ID NO: 22394 - DNA, 201 bp, Homo sapiens
tagaattaccatttgacccagccatcccattactgggtatatacccaaaggactataaatcatgctgctataaagacacatgcacacgtatgtttattgcrgcactattcacaatagcaaagacttggaaccaacccaaatgtccaacaatgatagactggattaagaaaatgtggcacatatacaccatggaatactatg

SEQ ID NO: 22395 - DNA, 201 bp, Homo sapiens
atcgccaagcttcaggtgccccctctgcaaatgggtggccccccctctaggcctgggaggatgccatgagatggcatgcaggaccctcggggaccaccgcrtggtaggtgcccttccctagtcctgccagcttcagggttcttggggtttggtgtctgtccttggcctgtccccttcttccccccatgctttagctggctc

SEQ ID NO: 22396 - DNA, 201 bp, Homo sapiens
gggagccctcataaatgggattcgtgcccatataaggagctgaagagaccagacttctcctcttccactctgccagggcaagatgagaaagcaccacttaygagccaaaaagcacgtcctcaccagacacagaatctgtaggcaccttgatcttgtacttgccaggcttcagaacggtgagaagttaaatttttgttgctt

SEQ ID NO: 22397 - DNA, 201 bp, Homo sapiens
agttggtctgattccaaaccctgtgttaccttcatgcagtactgcctttgaaccagcccagctctaacttaatggaagatacatgttgatttttgtccttwaagggtcaaaatttccgcatcaagccaagtaaaagttctgattattatattgggtagatcattttaatagctgaatcaaaacttggctttgcaacttaaa

SEQ ID NO: 22398 - DNA, 201 bp, Homo sapiens
caatcattaaaaagtcaggaaacaacaggtgctggagaggatgtggagaaataggaacacttttacactgttggtgggactgtaaagtagttcaaccattrtggaagtcagtgtggagattcctcagggatctagaactagaattaccatttgacccagccatcccattactgggtatatacccaaaggactataaatcat

SEQ ID NO: 22399 - DNA, 201 bp, Homo sapiens
tccccatacctccagaactgcctggaatcatccctccaaatctcctgagaggttcagtggccttgggtgtgactgggaaagctccctgcaccatcatgggratgcctcctcagcgcagagcagccatgtgtgcatgtgctgggggccatgtgcctgtgggtggtgtgcctgcatgcgtgccaggcagggcatttggagggg

SEQ ID NO: 22400 - DNA, 201 bp, Homo sapiens
gtgtcaacttgtcctccccgctgatccctctgtcagctgcttgtctaactttgccggccaaccacaacctgtctgaggatttggtcagaggtcagttcctrctgtttgcctctgtgatgtctcactgaactgtccactttgcttgattaatgacagagggaagagaaagctgggttcttcagaagcctggaggaaatgcag

SEQ ID NO: 22401 - DNA, 201 bp, Homo sapiens
aattatcctttcaaacagccttatatacgtcatttattttgcctcattgagattttactgttatgttcagttttgtgtctcactgttttcaattaataatrtatcattaacaatttatcatgtcagtaaatagcatttgaaataatatttaatgaccttctagtattctgtcattggaggaatcataatttatgcaaatct

SEQ ID NO: 22402 - DNA, 201 bp, Homo sapiens
accagttagaatggcaatcattaaaaagtcaggaaacaacaggtgctggagaggatgtggagaaataggaacacttttacactgttggtgggactgtaaastagttcaaccattatggaagtcagtgtggagattcctcagggatctagaactagaattaccatttgacccagccatcccattactgggtatatacccaaa

SEQ ID NO: 22403 - DNA, 201 bp, Homo sapiens
ggtgaggaggaagggacagagagccatgggcttggtggttggtgtgacaatggctgagcttattttagtggccagtgctctggatggctgcgtagagggargtgaaacctgggtgcactaaggatagcagctggctgtctcctcagcttacaccttcctttagcttcctagagcccctacgggttgatggaggtgcaggac

SEQ ID NO: 22404 - DNA, 201 bp, Homo sapiens
atcataaatatataacattttatttgtcaccatcatcatcatcataaaaagaaagacttctgtaggcactcaataacattaactccaagccactttgggcmtcaggcatgatgatatgttttccgagcatgagagaccccatgcctatggccaagccttcctgaggggccagtgtattggggatgggttaatccaaggctt

SEQ ID NO: 22405 - DNA, 201 bp, Homo sapiens
ccatcactggccatcagagaaatgcaaatcaaaaccacaatgagatactacctcacaccagttagaatggcaatcattaaaaagtcaggaaacaacaggtkctggagaggatgtggagaaataggaacacttttacactgttggtgggactgtaaagtagttcaaccattatggaagtcagtgtggagattcctcagggat

SEQ ID NO: 22406 - DNA, 201 bp, Homo sapiens
ctgccctcctgaaggatatgcaaaggttcctggattttacactaacaagatcaatcatagaaagatgtctgtagactcagcagtcccactactgggtatayatccaatggaaatgaaatcagtgtatcaaagggatatctgcactctcatgtggattgcagcgctattcacaatagcaagatatggaatcaacctaagtgt

SEQ ID NO: 22407 - DNA, 201 bp, Homo sapiens
gttttaccacaactcaacaagcatttgatgtggcaattaagcctttgtttttcattttctgctatttaatagatgtgaagtgacctcccattggattcccrgagaggtggattttcctgtgtttgctaacagcaccttcccatgggtggactttctgtccagcccattcatctgctggcctctgggagttttgttttttat

SEQ ID NO: 22408 - DNA, 201 bp, Homo sapiens
cctccttgtgatggctgcaccctcttccctttttcctccctgggccttgctgcctgggacaccacccacccaaagccccaaaaggtgtggaggtccatctrgataaattactaaccccaggacacatttatacatattcatttgtttaatatttaattttaattagaagtgaaatggcattgcaaaaacaccctgccactg

SEQ ID NO: 22409 - DNA, 201 bp, Homo sapiens
cctacaggagccattagagcttggtaagcaggagctggggagatcagagccatattttagaaagattaagccaactgcagttaggagagtggcacggggcrgttgggggcatgggggctgggccaccgagaggcagcatcctgggttccctggaagcagaggtggaagaggctgaggtagcagagcttggcttggcctgtg

SEQ ID NO: 22410 - DNA, 201 bp, Homo sapiens
tgtggcccttttggtctgctgtgaccaaatccctaggtctgacacaaggccttcttgttgcagtccggtctagctcttgccatgatcctggattggcctgraccagtgcactgaagcatcttttacgtcagacacactgtccttcagcctttctgcaccggcattgtgcacccatgcaggtgtgtgagagtggggagcaat

SEQ ID NO: 22411 - DNA, 201 bp, Homo sapiens
tacttcctatttctcccaaacatatcatggtctttcatgctttatctttgtggctctcttacctggaacatattttattttattttattttattttatttttgagacagagtcttgctctgttgcccaggctggagtgcagtgtcatgatcttggctcactgaaacctctgcctcctgggtttaagcaattttcctgcctc

SEQ ID NO: 22412 - DNA, 201 bp, Homo sapiens
ctacttcctatttctcccaaacatatcatggtctttcatgctttatctttgtggctctcttacctggaacatattttattttattttattttattttatttttgagacagagtcttgctctgttgcccaggctggagtgcagtgtcatgatcttggctcactgaaacctctgcctcctgggtttaagcaattttcctgcct

SEQ ID NO: 22413 - DNA, 201 bp, Homo sapiens
ttctatttcctttaattttactttatagctggtcacggtggctcatgcctgtaatcccagcactttgggaggccaaggtgggtggatcacttgaggccagragtttgagaccagcctggccaacatggtgaaaccccatgtctacaaaaaatacaaaaattagctgggcgtgtggtacatgcctgtaatcccagctactta

SEQ ID NO: 22414 - DNA, 201 bp, Homo sapiens
gtgtgatctcggctcaccacaacctctgcctcccggtttcaagcgattctcctgcctcagcctccgagtagctgggattataggcatgtgccaccatgccyggctaatttttgtatttttagtagcgatggggtttcactatgttggtcaggctggtcttgaactcctgacctcaggtgatccacccaccttggcctccca

SEQ ID NO: 22415 - DNA, 201 bp, Homo sapiens
cctcaaagtgctgggataacaggtgtgagctaccacgcccggccatttttgtatttttttagtagagacgagatttcatcatgttgaccagggtggtatcraactcttgatctcagatgatccctccaccttggcctcccaaagtgttgggattacaggcatgagccaccactcctggcctacaataaagtattttttaag

SEQ ID NO: 22416 - DNA, 201 bp, Homo sapiens
tcttaggggttcatgccatggttctggttcccctgttttaaaaaactaaatgctggtgaaacaactgtctttccctcaaagaaagatgtgggaaaaagggyaaaaaaggactgaccagtgctcagcattttgcctttcccagcacagggcccacctgcctggggggagatggccctgaggctcagctgtgcccatggccct

SEQ ID NO: 22417 - DNA, 201 bp, Homo sapiens
gtggagggagtcacgattctccaaagggtagtttagcttcaaaggctgtatgtgtcctgcaagtcctgtcagtgtacactgagctcccatgatgtgcaagrtgctggcagaaggggtgggtgcacgtcagccaccaaacctgcccatccccaccatcgccatcccagtatctgggacacagctactgttattgtcatgcca

SEQ ID NO: 22418 - DNA, 201 bp, Homo sapiens
tcttttcctaggaacgagggcagtgtggttcatgtcaggaaccttagccagagctctgtacctcctttggcctaggccccactccttggaactttggtcarcacacaaatgacagcactgatggctttggtcatgcacaggcttgcactttatgtgtgtgtcctgtctaccactgcagctctgagaggcagggatgaggct

SEQ ID NO: 22419 - DNA, 201 bp, Homo sapiens
agccctgggggccagccctaggggaggtgccagtgtgtgcaagctccatcccttctcaagtggagaccggcacctgctcaccacaggtgtgtcttggccargtgaggcctgagcctcaagctcctcagtgcctggtgctgtgtgaacctggtacccaagctccctggaaagcatggaggcatccaggcagcactgaccgca

SEQ ID NO: 22420 - DNA, 201 bp, Homo sapiens
cacaggcacatagatgttcctaagaccaggagcagacagttgggctggaactggggttgggagagccacctggagagttgaggctttattctgtgggcagygaaggatggccctgggcaggtggccagggacttgaacctcactcaggtgatagacaagtttggggcagtaagagaaggctatgcccacgcctttggtacc

SEQ ID NO: 22421 - DNA, 201 bp, Homo sapiens
gcagggctggggagatgggaggtggtgggagacggggtgatacaggaagacaggggcttctcatcagggggtgctgagaagacagctttgcagcatgacargccctgggccatttttccacggttgtggtcctgcatttcatgactgggctgtgcctttgtccccacatgtcccctgctcgagccactcgcgtcaggttct

SEQ ID NO: 22422 - DNA, 201 bp, Homo sapiens
ggtgctgccatagacccttttcctctggaagggcccaatgccagctggtaaaggaggggctgggcaagaggcccctgcctgaggtgctaggtgctctgggytgtgccctctgcctcgggtatagcaggccccaggagacctgaggaccagagcgtctggtgcccacaggctgtccatggtggaactagaggttcctgggct

SEQ ID NO: 22423 - DNA, 201 bp, Homo sapiens
actattttatgttcttttttcttactggtttcagagatccactggtgtgtcaggtgacagcaggtctcagtttggcctggccactgctccatcattcagtractgcatgtagctttgctgagtggggctttggggtacgggtataagagtgtgggggggttgggggtcagccttggttcccacttggtgctgccatagacc

SEQ ID NO: 22424 - DNA, 201 bp, Homo sapiens
  misc_feature (1)...(201): n = A,T,C or G, or insertion/deletion polymorphism (see Tables 1-2)
catgggaataaataccctgcggcaggggagccggtggctagaaacaccctgctgtgggggctgtggtcctgctcagaaacagcttaggccaaggggcgagntggccgtgtgtttggggagagcatttccgcagatgttggctgattatgcagcattaactgtttggcaagaaaaaatatctcatctgaaatggtgtgaggt

SEQ ID NO: 22425 - DNA, 201 bp, Homo sapiens
actaaggtctgctgtgtgccctgctctgtgctaggcactggggagccacactggggctatgcttgagagtctgtggcttaggaggagaagtagatgtgtakgcagatcagtaattaaagttcaggtacatacgtgctgtacgatcacagagctaggagaaaggtgtatcttcagaggagctttgagttggctttttaaatg

SEQ ID NO: 22426 - DNA, 201 bp, Homo sapiens
ctgtgtcccagaaggaaaaggcctatcagtgcccatacttgaaacttggcacacaaggggaaggtggtttgagggcacactgtaacggtggctgtgccgtrccgtgctccgccaggcctgttctgtgcacacttgctgggcccactcagcctccatgaggtcccctcttgcctcatgacccctggccccacttatcagctg

SEQ ID NO: 22427 - DNA, 201 bp, Homo sapiens
tcttatttcactgcagacctcagctagggctcgggtgctcgcagagtgcagacactgagtgtcttgtgaaacctcagagggccgaggggttccctcggcctggtggggcctccacaccgtgattggctcattcttcccactgtgggtgcaggaggttcaaagtgttggaaaggccgtgtgtataggaatggtaaataccag

SEQ ID NO: 22428 - DNA, 201 bp, Homo sapiens
gtgatcttggttcacttcaacctctgcctttggggttcaaagaattctcctgcctcagcctcctgagtagctgagattataggtgtgtgtcaccatgcccygctaatttttgtatttttagtagagacagcgtttcaccatgttgtccaggctggtcttaaactcctgacctcaggtgatccacccatcttggcctcccaa

SEQ ID NO: 22429 - DNA, 201 bp, Homo sapiens
tttgtgatgatttgctaggatagtttccaggagtggaatagacaggctggagggcagggacatttttaaggctcttgattcattttgctgacatgccttcmagagaagattgccttgatcttctgtttctgtgcaagtgtgaattactgttttttataggcggtaaaaaagatgaccattgattacttgatgcttcagatg

SEQ ID NO: 22430 - DNA, 201 bp, Homo sapiens
caaagagactctccagggagccagaggctctaaagtccatttaaaaacagatgagacgattgtgggggagctcatgtcattgccctgcttgtgtccccccsacccccatgttcttttcgtaagatcagtttagcaaaaccgccttcagaaagacacctcggctctcttgattttcccattgatgggttggtgagcttctcc

SEQ ID NO: 22431 - DNA, 201 bp, Homo sapiens
ttctgttccctgagcgaatggggaaaacacagggctaaacatagccttgattgtttttacttttctcgtattgtacttctcaaagcgataaagatagaaasaattacaatattatctgcctgcagactgagcaagtggtcacctggctggtgttgatacacaatagcagtgctttgcttttccaaagtattttagacgtga

SEQ ID NO: 22432 - DNA, 201 bp, Homo sapiens
ggcagatgggagggatggtgtgttcctatttagctggctcccgattccccttttggaagtgatttccctagagatggggaagattccaggccagtggtgcaaaaatggaacagaaaatggtatcctctgagagtgggatcaactccttttcatgtcacgggtttccccgaggcctggcggagacgcagtctgtagtatgtc

SEQ ID NO: 22433 - DNA, 201 bp, Homo sapiens
ttgtagtccttgctgcctcgagcactcatgggttaaatctcagttttctgcacctgagcccatcttgcctgacccataaactccttagggccagggccagagtcaggctcacccacagtccacctcagcgctgcagtgtagtgaaaagggcctgcgctctggggcctgactaagctgggtttacatcctgtctggtgttag

SEQ ID NO: 22434 - DNA, 201 bp, Homo sapiens
tgtagtccttgctgcctcgagcactcatgggttaaatctcagttttctgcacctgagcccatcttgcctgacccataaactccttagggccagggccagagtcaggctcacccacagtccacctcagcgctgcagtgtagtgaaaagggcctgcgctctggggcctgactaagctgggtttacatcctgtctggtgttagc

SEQ ID NO: 22435 - DNA, 201 bp, Homo sapiens
gtagtccttgctgcctcgagcactcatgggttaaatctcagttttctgcacctgagcccatcttgcctgacccataaactccttagggccagggccagagtcaggctcacccacagtccacctcagcgctgcagtgtagtgaaaagggcctgcgctctggggcctgactaagctgggtttacatcctgtctggtgttagct

SEQ ID NO: 22436 - DNA, 201 bp, Homo sapiens
tagtccttgctgcctcgagcactcatgggttaaatctcagttttctgcacctgagcccatcttgcctgacccataaactccttagggccagggccagagtcaggctcacccacagtccacctcagcgctgcagtgtagtgaaaagggcctgcgctctggggcctgactaagctgggtttacatcctgtctggtgttagctg

SEQ ID NO: 22437 - DNA, 201 bp, Homo sapiens
cctgccagctgtggcgcatgctggcatcaggcttccaggagactagtttcagctctagtcctcatcttccctgcttcccttccttcctttccctccctttstttcctttcttttgacggagtgttgctctgtcacccaggctggagtgcagtggtgagatctcgactcactgcagcctccgcctggatccctcctttctgt

SEQ ID NO: 22438 - DNA, 201 bp, Homo sapiens
ccaccaagcccagctaattttttgtatttttagtagagatggggtttcaccatgttgaccgggctggtctcgaactcctgacctcaggtgatccacctgcmtaagcttcctgaagtgctgggattacaggcatgagccaccgtgcctggccaaatgtatgcctttttaaatggaccctactgattgttccattagcttctg

SEQ ID NO: 22439 - DNA, 201 bp, Homo sapiens
ggtaaggaggaagttgtgtttaagaggtcgtacgtggaaaattttttccccacatgctttaaaagggaaaagaatagccttgaaaggccagccttgattaygtgtccccctcccatcccactgccacctttgacactgtgcttgcctctagccagccactcctggaatggtgtcctgtgtcttccttcttcagccagtgga

SEQ ID NO: 22440 - DNA, 201 bp, Homo sapiens
catgtccagtgccccatgtgtgtttgcatgctgggtcctgcagaaatcccatttttatgtattcatacctgttctgttctgggccatttgggcctgatggrttataccattgttcctaccatgctggaatgggaaatacatggtctgatgaaatgaccatgttttccatgggcatcagataaagaactacttcattcattc

SEQ ID NO: 22441 - DNA, 201 bp, Homo sapiens
  misc_feature (1)...(201): n = A,T,C or G, or insertion/deletion polymorphism (see Tables 1-2)
gtcacctctcacgttggacagcacagacccagaacgttgctgtcattgcagagtgttccatcaggtaggagcacacgagactgtgtcccagtgtggggagnatccaaatctgggagaaccaaaagtgcagaggaggtattctgctgaaagaaaagacactggaccttcctgctcccaaaacacagaattgaaaattagttt

SEQ ID NO: 22442 - DNA, 201 bp, Homo sapiens
gaggacggtttcgtcccgtcggcgctggggacccgcgagcagtgagtgtgacgctgggcaggggaggatgagccgtgccgccctgcctgggccccgagaaygggacggcggggtggagacccggggctcagggacagggagaccctcgggggcgtgacgggagcagggccacctggcggggggcttacggggatttcaaag

SEQ ID NO: 22443 - DNA, 201 bp, Homo sapiens
tcctcacgtggggctgctcccagcctttggcccaggacctggtgctcaggtggtgctcagaatgtgtggctgttacttaccacatcctccgggcccatcamctgatggatcagtgaatccccggtggccctgacttctcctcccagcccttgagcagactctgcatttcttgagctatgagcaggctggtaaagccgggca

SEQ ID NO: 22444 - DNA, 201 bp, Homo sapiens
ctggggtgagctccccaccacttgtgaagcacagggccccgggaagtctgggatttgccctaggctttgggttccctgacggtcaggtagggatggtgacrtcctcacgtggggctgctcccagcctttggcccaggacctggtgctcaggtggtgctcagaatgtgtggctgttacttaccacatcctccgggcccatca

SEQ ID NO: 22445 - DNA, 201 bp, Homo sapiens
atcctcacccaccctgtaatcctcacccaccctatggtccttacccaccctgtaatcctcacccaccctgtggtcctcacccaccctgtgaggggctcctyctgttctactttccagggaagaaaagggagtgccgaggccatgtacttgctggctgcgtggcagagcggtgagtgggatccactcactctttggccccga

SEQ ID NO: 22446 - DNA, 201 bp, Homo sapiens
gcccatcaactgatggatcagtgaatccccggtggccctgacttctcctcccagcccttgagcagactctgcatttcttgagctatgagcaggctggtaargccgggcacggggctcatagagaggctctgtggccagcaccatggcctctctggaagagcgctttagttctgcctggcactgcggttcagctgtcctgtt

SEQ ID NO: 22447 - DNA, 201 bp, Homo sapiens
  misc_feature (1)...(201): n = A,T,C or G, or insertion/deletion polymorphism (see Tables 1-2)
tctttgcctcgttctggcttcctgcttcatgcagagctgtgtctggatgggctaatgtgttcccatggcgacagacttccacagtttcattctactggccncctcctacttcaccagagggatgggccatcatatagccaggcccttgttaatggaatttagcttgtttccctttaaacacatttgagaggatggccgctt

SEQ ID NO: 22448 - DNA, 201 bp, Homo sapiens
  misc_feature (1)...(201): n = A,T,C or G, or insertion/deletion polymorphism (see Tables 1-2)
ccagaggtgggagtgggtgtggtgagtgcagggcatggcgaggctgcggtgactggggtcggagtgggcgtggtgagcgcagggcacagtgaagctggggngacaggttcctgagtcgggggtgcaagggatgcttgagatgtcggcagggccatcacggttggccttgcaggctggggtgaggagcgggctttttgcctg

SEQ ID NO: 22449 - DNA, 201 bp, Homo sapiens
tggcagcatgagcctctgtcgccccaggcactgcatcagtagagaatttctcctgctgacaggagcccatttatgtaccatttttgtggtatcagccatcyggaattaccactctttcttgcaacttcaagccacagtcaagaaatcagaaagcaaatgccacacgaagaacaaaccctttgctgcaatccccatgctggc

SEQ ID NO: 22450 - DNA, 201 bp, Homo sapiens
tcccagcccagagtagttccggaaggggcagccatgaactgtcagagccaacactcacagcagtggagagtgggcactgctgtgggtttgggactccaggrgggacaccagcagcctggctttcctcttaggatccttgcagtggccctgtgaagcagcctggccagagacagcagttctgcttcccaggggaggaaacgg

SEQ ID NO: 22451 - DNA, 201 bp, Homo sapiens
gaagccaacacactgcaggttcctagacgttgtccaagagagtctgaattagcaggtctggggcagagccccagtacctcggggtcccagaagctccctakgtgagtctggggcttgtgggggcagcagagatgggcacattcctagcccagtgactccacagatgcccagggactagttttgtgtcatatggagatggca

SEQ ID NO: 22452 - DNA, 201 bp, Homo sapiens
agtagacatagcgtttcaccatgttggctaggctggtctcgaactcctgacctcaggtgatctacccaccttggcctcctgaagtgcttggattacaagcrtgagccaccacgcctggcctgtttatcttctttagtaaaatgtctcttcagatcttttgcccatttttaaattggattgtttacttattaagttttgaca

SEQ ID NO: 22453 - DNA, 201 bp, Homo sapiens
aaatcactgtcagtggctgagttctcatgtttaggttttgatctgagtcctgtttttaaggcggtaaaattaactgtgaaactaatgtgtgcaagtagtakgtacaggctaaataaagacactaaaagaaggaaaagcttgtcttgctgatttccagtttcttttaagggatagcccttcaaaatgcattacagagcattt

SEQ ID NO: 22454 - DNA, 201 bp, Homo sapiens
aggcctcacctgagggcgcagctgagttgttgagcggtgctgctggggtatgagtcccgggctctgtaactctgagggcagggttttgccttattgccacstggtagaggcctctcatatcctaagggaaagagaggtgcactgtcgttggaacacagctgctgttggagtcagaagagctgggtttgagaggcactctgc

SEQ ID NO: 22455 - DNA, 201 bp, Homo sapiens
gtgattctcctgcctcagcctcctgagtagatgggattacaggtgcgcgccagcacgcctggctaatttttttgtatttttagtagacatagcgtttcacyatgttggctaggctggtctcgaactcctgacctcaggtgatctacccaccttggcctcctgaagtgcttggattacaagcgtgagccaccacgcctggcc

SEQ ID NO: 22456 - DNA, 201 bp, Homo sapiens
tcaggcaggacagctctgggagggcagacctctgagaggtggagagaagcagagtgatgggaggcagagagcagggtggcggcttgtggctgtccggtgcrcagagctccccctgcctgggccttgtgagggcgctggcgctggcactggccgatgttgtggcagctgacctgtctgggcatcctgaggctccttccacca

SEQ ID NO: 22457 - DNA, 201 bp, Homo sapiens
gatttctagcctggggaggtggaccttgcttttctgtggggccctgagaacgaggcctagggtatccctgtgtatttatcaagagccctggcgagtgcacrgccttgtgcgtgggaacctgatgagctgggcatgttgctggtgtacaaggactaacgtgttgccagatggccagtgaggtgagaccactggccacagacc

SEQ ID NO: 22458 - DNA, 201 bp, Homo sapiens
aggggcctctggaaagtgtgtgtgcccaaggcctatggccagagccctgaggctgggcccgtggacgctgagccatgcccccaccaagagtctagaccctsgtcagccctctctccatggggctctgcctgctttggctctgccatcagatgatttctagcctggggaggtggaccttgcttttctgtggggccctgagaa

SEQ ID NO: 22459 - DNA, 201 bp, Homo sapiens
aggtgatctgcctgcctcggcctcccaaagtgttgagattacaggtgtgagtcactgcgcccggcctaatttttgtatttttagtggagaccgggtttcamcatgttggtcaggctggtctcaaactcctgacctcaagagatccacctaccttggcctcccagagtgctgggattatgggcatgagccactgtgttcagc

SEQ ID NO: 22460 - DNA, 201 bp, Homo sapiens
cctgcttggcagtgggtctcgggcacagggaaagtagagaggggcctctggaaagtgtgtgtgcccaaggcctatggccagagccctgaggctgggcccgyggacgctgagccatgcccccaccaagagtctagaccctggtcagccctctctccatggggctctgcctgctttggctctgccatcagatgatttctagcc

SEQ ID NO: 22461 - DNA, 201 bp, Homo sapiens
ttcactcttgttgcccaggctggagtgcaatggcgtgatctcggctcaccgcaacctccgtttcctgggttcaaacgattctcctgcctcagcctcccgaktagctgggattactggcatgcgccaccacgcccagctaatttttgtatttttagtagaggcggggtttgtccatgttggtcaggctggtctcgaactcct

SEQ ID NO: 22462 - DNA, 201 bp, Homo sapiens
cagcctcctgagtagctaggattacaggcgtacaccatgcctggttaatttttgtatttgtagtagagatggggttctgctatgttggccagctgttctcraactcctgacctcaggtaatccatctgcctgcctcagcctcccggagtgctggtattataggtgtgagccactctgcctggcctgaacttcttttttttt

SEQ ID NO: 22463 - DNA, 201 bp, Homo sapiens
tcaagtctatcccgggcaacatagcaagactcctgtcttcaagaaatcttatttccagtgaacttagttccaaataaattgtcatttttaagaatatgtcraattttctactttttgacagaaacaggtttttcataaactaggcttgtgagctccataatgtgctggtattattagggaatatggctagctttgatttgt

SEQ ID NO: 22464 - DNA, 201 bp, Homo sapiens; identical to SEQ ID NO: 3493

SEQ ID NO: 22465 - DNA, 201 bp, Homo sapiens
  misc_feature (1)...(201): n = A,T,C or G, or insertion/deletion polymorphism (see Tables 1-2)
agaggatcgcataagcccaggaggcagaggttgcagtgagtcgagattgtgccactgcactccagcctgggtgacagagtgagacacatctaaacaaaaanagagaaaaacttaagttctctatttgagtcgtacaatcttttatttaaggtatataatctattatttatagaatcaaacaaaaagcacatatattgtgct

SEQ ID NO: 22466 - DNA, 201 bp, Homo sapiens
tatatacacatatatatgtatatacacacatatatacacatatatatgtatatacacacatatatatacacacacacatatatacacatatatatacacayatatatacacacacatatatatacatatatacatatatatatatatttatactttaagttctagggtacatgtgcacaacgtgcaggtttgttacgtatg

SEQ ID NO: 22467 - DNA, 201 bp, Homo sapiens
tatacacatatatatgtatatacacacatatatacacatatatatgtatatacacacatatatatacacacacacatatatacacatatatatacacatayatatacacacacatatatatacatatatacatatatatatatatttatactttaagttctagggtacatgtgcacaacgtgcaggtttgttacgtatgta

SEQ ID NO: 22468 - DNA, 201 bp, Homo sapiens
catatatatgtatatacacacatatatacacatatatatgtatatacacacatatatatacacacacacatatatacacatatatatacacatatatatayacacacatatatatacatatatacatatatatatatatttatactttaagttctagggtacatgtgcacaacgtgcaggtttgttacgtatgtatacatg

SEQ ID NO: 22469 - DNA, 201 bp, Homo sapiens
tatatatgtatatacacacatatatacacatatatatgtatatacacacatatatatacacacacacatatatacacatatatatacacatatatatacayacacatatatatacatatatacatatatatatatatttatactttaagttctagggtacatgtgcacaacgtgcaggtttgttacgtatgtatacatgtg

SEQ ID NO: 22470 - DNA, 201 bp, Homo sapiens
tatgtatatacacacatatatacacatatatatgtatatacacacatatatatacacacacacatatatacacatatatatacacatatatatacacacayatatatatacatatatacatatatatatatatttatactttaagttctagggtacatgtgcacaacgtgcaggtttgttacgtatgtatacatgtgccat

SEQ ID NO: 22471 - DNA, 201 bp, Homo sapiens; identical to SEQ ID NO: 3505

SEQ ID NO: 22472 - DNA, 201 bp, Homo sapiens
gtctgccttttgcagactctaggagtaggtcttgatccatgtccctggccactagcctgaggccatagggacagttcccactgagctttttacctgggcaggcctgttccagagtaggtggcccagcccagggctggggctggatgtcaagagagcagaagtcgacgggctgggggacagttggtcctggagcagcacttt

SEQ ID NO: 22473 - DNA, 201 bp, Homo sapiens; identical to SEQ ID NO: 3495

SEQ ID NO: 22474 - DNA, 201 bp, Homo sapiens; identical to SEQ ID NO: 3497

SEQ ID NO: 22475 - DNA, 201 bp, Homo sapiens
tctccttccttttgagtgtgtcaagcagcttccagtctatagcaagctcttctttcatagtgtttgtgggttaaaaggacatgagcggtcgtgagaattaygggagtgcctataggaagctcgtccatcagttatttttcattgataaatggactcttgacaagtcatgcatgcagttggcttcagtttcaagaaacaaca

SEQ ID NO: 22476 - DNA, 201 bp, Homo sapiens
ttatagaccacagggtctacaaagcctaaaatatttattgcctggccctttacagaaaaaaaaatgtgctgacctcttctccacatgaatactctgcactycggacctgggctgttcagtatgttagctgtagcctcatgtggcaatttaaattaaatctaaatgaaacgaagacttcagttctttggttgcactagccac

SEQ ID NO: 22477 - DNA, 201 bp, Homo sapiens
actagccacagttggaataacaccactggcatcattggagacatttcttgacctcgtttggttagaaactatttaaaaatacattgctcagtggggctgcrcccagttgtatagatggcttcatcagccccaggcaggcctcccagatctgggaaggtgtgcggagcctgaggaggctgctctggttcagcctgtctgtcc

SEQ ID NO: 22478 - DNA, 201 bp, Homo sapiens
gcgagtccaagcacccagttctttcccgttttcattcacccaacaagtactttttgaatgccactgtgcgttaggcttcgccgttaattcatataaccacsctgagaagtgagtgctgttattattccctttttatagatgaagaatatagggttctgtgaggtaaagtgcccaaggtcatttagctcatgggcagtagtt

SEQ ID NO: 22479 - DNA, 201 bp, Homo sapiens
  misc_feature (1)...(201): n = A,T,C or G, or insertion/deletion polymorphism (see Tables 1-2)
cccagcagcctggagtcaccttggtgctcactggagcctctgctggttctgggccgtcctagacaagcatagattgccagtttcagaaatacccaggagtnggttaatttccttgtttttttaaatcctattcaaagaaagattatttccagttggtttttaaaaagcgtttatttctatttacaagcaaatattcccttt

SEQ ID NO: 22480 - DNA, 201 bp, Homo sapiens
ggttcagccacttcacttctctgagctgtgattttctcatctgtggactgggaataatagtgcctacttaacagagcaggaggaataaacaggatagtgcragtccaagcacccagttctttcccgttttcattcacccaacaagtactttttgaatgccactgtgcgttaggcttcgccgttaattcatataaccaccct

SEQ ID NO: 22481 - DNA, 201 bp, Homo sapiens
ttaaatacctaccaaatatcatttcaggtttcacttctattcttctcttgactgactcaagccattcacatgtgcatgatttataaatatatataggctcragaaaatagtactaacaggttgttccctgatatcatggcatattttgtaactttgcttttatactgtaaacttgaatacaagaactatgtcaaatttatc

SEQ ID NO: 22482 - DNA, 201 bp, Homo sapiens
  misc_feature (1)...(201): n = A,T,C or G, or insertion/deletion polymorphism (see Tables 1-2)
ttaatggctgcatacctacctagactgagagtgaggggcccacttaccaccttctggattctctttaggtgctttgcagtgggcatctttgttttttgttnttcctctcacgttgggggagctgccttggacacctggagtcagcgtcttccgggtgcgggttatgtggttgcagctggagcgcctgcccccagctcggcc

SEQ ID NO: 22483 - DNA, 201 bp, Homo sapiens
ccctcccctcacccctgcctccgtatctgacagatgactggtgggccaggggctggcggggggcttctacccagcgcagtgcccccacccttgtgccccayctgagggtagggcacagagtggccctggaattacctctggcccttaccagccccttgctgcccccaatccctagatgaggtccctggctggatggatagc

SEQ ID NO: 22484 - DNA, 201 bp, Homo sapiens
ctgaagggaggctggaaggacatgagtcaggcaggttgccctgaggaggtcagtcagtgatgacaagatacaggacagagcagaggggacttcaactggarttgggcttggctggacgggtcaggctggggcggatagagccttttctcctccagcatcttcctctctcagatagcgtagggtttttttcgggaggaaaag

SEQ ID NO: 22485 - DNA, 201 bp, Homo sapiens
gggagaaggtttggctcaggattggtagcccttgactctgtgtctgcacttggctgtcacccatcatgcgacctgggagtctgccgatccagcttccaggygctttttcaggttaaaaagctaaggagaggcgtggggaaggcctgtatttttttcttccaaacgttccttcagagaacgaggcgatttaaattcaaataa

SEQ ID NO: 22486 - DNA, 201 bp, Homo sapiens
tgccagtctgaaatgcttgtcttctttcccggaaacagtggctgacagctgaagcgaatgggccacaataggtgggggcttcagaaagttctctagaggcrgtgaggaggtaggcctggagtagggaggccctgaggggtcccttcaagaagcaccaagatcgcaggctggccatgggaaaggaaggcagatgggagggat

SEQ ID NO: 22487 - DNA, 201 bp, Homo sapiens
aagtaaagagcactaaccccatcctgagggcctcactctcatggcctcatctaaccctaattatttcacaaaggccctatctccaaatatcatcacattgsgggtagggggtcagggcttcaatatgtggattgtaggggaaaccagcatttagtccataatactcctgaaatcaattaaggcttagaaaaagccctacaa

SEQ ID NO: 22488 - DNA, 201 bp, Homo sapiens; identical to SEQ ID NO: 3499
  misc_feature (1)...(201): n = A,T,C or G, or insertion/deletion polymorphism (see Tables 1-2)

SEQ ID NO: 22489 - DNA, 201 bp, Homo sapiens
ttcccttccttcctttccctccctttctttcctttcttttgacggagtgttgctctgtcacccaggctggagtgcagtggtgagatctcgactcactgcarcctccgcctggatccctcctttctgtctctagtcacagccctcaggttgcacaagcaatctgcttaaggtcactgggatcggggccgagtgttgccacaa

SEQ ID NO: 22490 - DNA, 201 bp, Homo sapiens; identical to SEQ ID NO: 3500

SEQ ID NO: 22491 - DNA, 201 bp, Homo sapiens
  misc_feature (1)...(201): n = A,T,C or G, or insertion/deletion polymorphism (see Tables 1-2)
aagttagtcctggaaaatttatacagacagaaaatttttattattaaatatccagagcatttgtaaaatttttgaaaacaaatatgggtgtataactatgnatgtatccaggacaatgcctgcattttccagcattaagaaacatcatattattttattaaaaggaatgtcataatttggaaaagttttcttacgataagc

SEQ ID NO: 22492 - DNA, 201 bp, Homo sapiens
gacacagctgatgggcccttgcgtgttctcagggagaaagtgggaggcttcacactcatcttgttcataggagtgagttagcttctaaggcctttgctagwggctgtccatcaagagcatgttgtgtagcttgagaaggaagccctgagggtccccatcctgtcctgtgaaacctctgatgggtgaagtgatccttctcca

SEQ ID NO: 22493 - DNA, 201 bp, Homo sapiens; identical to SEQ ID NO: 3501

SEQ ID NO: 22494 - DNA, 201 bp, Homo sapiens
atataaataattatatacaattgaaaacattttttaggcatgagtcccttagaaaatggtatttggagttagatatgggacagtaacagaatacactgccytgcgtcactgccaaaggtcttgttcctgactactcatactggctgccacattctctttgcataaaataaagcttgtttcaccaatcttttaaggttcttt

SEQ ID NO: 22495 - DNA, 201 bp, Homo sapiens
acttgacaactccccaggccaacggagtgactttctagggctccgttatgagtaaccctctgttgctgatagcccacgggatgagtggagtccacagggcmcctgctggagcccacgcttgccttccttgggtctggcaggggagatagtaggctgggcctgctggccctaggtccgtcttcagaggcctgggattttagg

SEQ ID NO: 22496 - DNA, 201 bp, Homo sapiens; identical to SEQ ID NO: 3502

SEQ ID NO: 22497 - DNA, 201 bp, Homo sapiens; identical to SEQ ID NO: 3503

SEQ ID NO: 22498 - DNA, 201 bp, Homo sapiens
cccccgctacctgcgccttatgccagaggaggtcagtgggaagctccgagcaggaccgagagggtgagcacagacaagcgctgtgcggcgtctgtccgatygcgcaggctgcgctcctgctgcgttcacgtgcgaggccacagaaaacactcgcagcaggccacgccccaggcccctcacatgacagctcgcagaaaacgc

SEQ ID NO: 22499 - DNA, 201 bp, Homo sapiens
  misc_feature (1)...(201): n = A,T,C or G, or insertion/deletion polymorphism (see Tables 1-2)
taaagagaaaaggaaagaaaagaactttggtagagaaacatcgagagattttaatatggagatggggtgggaattcgaccttggaaaacacaagcgatcangtgaataggattttggccttttctaacttagtgtgtgctctgctcttaagataaatacacacacacagagatagacatggcatttcattttcggacagta

SEQ ID NO: 22500 - DNA, 201 bp, Homo sapiens
attgcgcgtgtctttatgagcacagagcgctcattggccggaggtgcatcttcatgagtacgttgctcatgggcccgtccttgcctggataggaggaaccygggacttgattggtcttgccacagcctggtggtctagttgctttgtggggtgtgcagtcctggggctgcgggaggggagtaacccttagtaacctgtgtg

SEQ ID NO: 22501 - DNA, 201 bp, Homo sapiens
  misc_feature (1)...(201): n = A,T,C or G, or insertion/deletion polymorphism (see Tables 1-2)
cctttgttcccaggacaagacaagattctaggggatgacggactggtgggattcatggcatctccacctttgggttggttttctgcacaggaagaaacacntggatttaagaatgatttagggtggctccaagccctgcacattcttcaggggccatcttggtgtgccccctactccccttgttatcccagccactgcctg

SEQ ID NO: 22502 - DNA, 201 bp, Homo sapiens
  misc_feature (1)...(201): n = A,T,C or G, or insertion/deletion polymorphism (see Tables 1-2)
cccctctgctattcgacctcgttgctgcagtccggttggggatatccaggactgcgccgggagtgcccctcactgtctcagcctctgtcctgtctgtggcntgtgcatcattctgaggagaaggctggattttgtgctctgccctgggagcaggtgttgaactgcacccacttgtgcacagtgtcagccctacccccatcg

SEQ ID NO: 22503 - DNA, 201 bp, Homo sapiens
ctgcacttgtggtgactgtcagttagggctccgatggcttattcttcctcgaggaacactcacgttctcagggtgggcatgtatgcacacgtgtatgcacrcacgccatttgttcagttgtgtacctgctttaggcttccggctctccagctgggtgaccttagcaggttcctcagcctctctaggcctctgtttcctcaa

SEQ ID NO: 22504 - DNA, 201 bp, Homo sapiens
ggcctgggtttgaatcctggtcttgcccctgctagatgtatgatattgggcaaatgacttgatttcttttcttggagcctcagtcttcccatctggaaaargtgcatactaccaaccataatgcctgttcataggaacgtgagaggattagctgagaaggacccagcctctggtggatgcccagggagatgggaatggagg

SEQ ID NO: 22505 - DNA, 201 bp, Homo sapiens
gcagatgggagtcatcaggcttgagaaggtgacatctgggctatgccgggctgcccttctgttttggtagagtcactgccttcactgccccacccttgaarctggcttgcttttgtcacaaccaccggagaggcgttggtgtgagagtgagacccgtcactgtggacgtgttcacacgcatggcgctctggctgtcctctc

SEQ ID NO: 22506 - DNA, 201 bp, Homo sapiens
ggccacagtgatatcagatagctgtgttcagcggttgcaaacaaatgaagacacattgaagactgtagaacaaaagcaagaaaatttcatgttagcaaggkcttgtgtgagagcaaagctgtcccccctgtttctgtggtgtcagagacagagtggcctggggaggaaggcctgggtttgaatcctggtcttgcccctgct

SEQ ID NO: 22507 - DNA, 201 bp, Homo sapiens
tcggggatcctgactcacggggatttcaggttccgtgttcactcagggacattgctgccgaaggatggcaaccattctggctgctgtggcagagcgggacrcctgcaagccagcctgagcacccatctgcctgttgggccaccgggcagcttctgcagatgggagtcatcaggcttgagaaggtgacatctgggctatgcc

SEQ ID NO: 22508 - DNA, 201 bp, Homo sapiens
gtggggccggagccttacttggcagccgctccagtgctggcctttctctagcctctgatgttggtctcctgctcgcattgtctcttttcctaggaacgagygcagtgtggttcatgtcaggaaccttagccagagctctgtacctcctttggcctaggccccactccttggaactttggtcaacacacaaatgacagcact

SEQ ID NO: 22509 - DNA, 201 bp, Homo sapiens
ttttcgtgctctttcttttctttctttaagatcatctcaagctaacagtgagaaaaaaggcatatgtgagcgattctgcctcgacaggtcccacgataccrtcaggaatgtccgtttttcttgctttcatgaaaacactgtggggtcttacttagaggagacagtggtagagatgaaagaaggaaggagaggagtgcatgt

SEQ ID NO: 22510 - DNA, 201 bp, Homo sapiens
tggatgccctgtgtctctctgaggatggggcggtggtcagaaagggccctgtcttcctagcctgccggccgctccaggagccgcccagcgtgcaccgctgygcctcatcttctgagccttccatcctcactgctcctgggggcagccctgtgggggaaatcacgtttttaattagcctggttcgggatggcggctctaaag

SEQ ID NO: 22511 - DNA, 201 bp, Homo sapiens
gcagatgccatgtacagatgggcatctccaacctctggatgccctgtgtctctctgaggatggggcggtggtcagaaagggccctgtcttcctagcctgcyggccgctccaggagccgcccagcgtgcaccgctgcgcctcatcttctgagccttccatcctcactgctcctgggggcagccctgtgggggaaatcacgtt

SEQ ID NO: 22512 - DNA, 201 bp, Homo sapiens
gccccggctggtcttgaatacctagccttaagtgatagaaagtgcatagaaatcaggatcatggtagaggtaacttgacagcctgtctcatttagtaagtrctgaagctgagacttcacctaggattttagattccaagttaattttttgaacctaggatttgaacctaggattttagacgccaagttaattttttttaaa

SEQ ID NO: 22513 - DNA, 201 bp, Homo sapiens
gcctgtctcatttagtaagtgctgaagctgagacttcacctaggattttagattccaagttaattttttgaacctaggatttgaacctaggattttagackccaagttaattttttttaaaccatactgtgatgctttgaaagttactagttccttgtcttccaggccctttattagttcgtttagtttgagtcttcatct

SEQ ID NO: 22514 - DNA, 201 bp, Homo sapiens
acaaaccaggtgatagaggctaacagagatacagctttgcagagatgacaaacaggaagtggaggaaatgggaggtggatggaaagcctgttttttccaawttgtttttggtcttgtcttttccttgttaaattcaaagtgattttggaggagcatacatatgctgtacatacatagtagaattgaaaaatcatgaagtga

SEQ ID NO: 22515 - DNA, 201 bp, Homo sapiens
gaaatgcaaacgcgatttctctgtggagccttcacggaattgctgcttttcactatgattattgctgcataacaggccacttctgtgtgtaggaagtgcgygtgcaagtccaaagggaattgaggcctgaatgggtgggttatcccaattaacaaatacaaagttttcagtacattttgttttaagccaggtgcacaagtt

SEQ ID NO: 22516 - DNA, 201 bp, Homo sapiens
ctgttggaatttgtatgatgaagacattatgtagcagaagtgagatcatttcattatttgcaatgaattaagcagattattttctgaacttgaaattcagwtgaatttattttggttcctttcattttataacagcaggtaatttgttaaaatctattaagcaatagaatagatgtcaaacaaatgatttttaaaaatatt

SEQ ID NO: 22517 - DNA, 201 bp, Homo sapiens
gaatattaagtgagaaatgtaaagcagcttagcgggattgctggcacacaccaaggctaaatcagtgttctttcctccaaggacccttcttcccatggagytaatatgtttaattgtttgagattttacccctcagtgccacagttttagtatattcagttccattgtaggcatttgtgttctaggagtgattaaatgagt

SEQ ID NO: 22518 - DNA, 201 bp, Homo sapiens
cagcctccatagtaggtgggaccacaggcacgtgccaccacacccagctattttttgtaatttttgtagagacaaggtttcgccatgttacccaggctggwctcgaactcctggcctcaagcagtcctcccgccttggcctcccaaagtgctgggattataggtgtgagccaccgcatccggccccagtaattattcacta

SEQ ID NO: 22519 - DNA, 201 bp, Homo sapiens
gatttacaatctggacagcaagtaaataccagggtgcaattaatttttacacagagcagcagattctaaaacattttcctgtgttgagcagtttgtttctrattacagattggaagctgcttttctatttaatactgttatcatgattattttttactttttgatggtgatcttcaggttccttgtatctgtgtgactttc

SEQ ID NO: 22520 - DNA, 201 bp, Homo sapiens
tctattgattttcatgctctctccagagttgccatttgcctgtgacacgtgaggaaactgaggcccagagagtcataaagacctggctgaagccacacagstgatacgtgactacagttagagtctcactagtcagaaacggagcttatctggcccagcatcctatttgactcatgagggaactgaggctccgaggaggga

SEQ ID NO: 22521 - DNA, 201 bp, Homo sapiens
agagtcatcctgtgtggggagaagcggggccacgcgtggactctcagtcaaggctccctccacatcttctcccacttgcagtgggggacccagggtcacaygtgtactagtttgatcttttttggtgaaacagggcaagtggagtgagcgcagtctccattcaccacccttggctaattgcagccattcagtgcatttgta

SEQ ID NO: 22522 - DNA, 201 bp, Homo sapiens
aggctgtcccagggcagatgctgccattgtctgagaaacctgcagcagccagcctggagccaggaggctgttgcgtgggctggagcatctttggggacccrgaaatgtgttagaaagttcttactgtaaccaagaccacttccaccactgctattagctctggccctagcactggcctgttttgaaactgacaatgaaaag

SEQ ID NO: 22523 - DNA, 201 bp, Homo sapiens
aggccccggcatgcccagcccctcaaccctgcctaggctttagctgtcaaccgggccagaccagtaaactgggttgtggagatgttggtctttatttcaakgatttctagtctttgcactgtgtaagttataataaggtggaagtctggtgggtttgtgatgacagagagagtcgcccttgtagggccaggtcttgaggcc

SEQ ID NO: 22524 - DNA, 201 bp, Homo sapiens
tgccccacctcaaagttaggcagtggaggctgtcccagggcagatgctgccattgtctgagaaacctgcagcagccagcctggagccaggaggctgttgcrtgggctggagcatctttggggacccagaaatgtgttagaaagttcttactgtaaccaagaccacttccaccactgctattagctctggccctagcactgg

SEQ ID NO: 22525 - DNA, 201 bp, Homo sapiens
gcctgtgggagctgaggggtagaataggaagtcctggtcagacccaaaagggctgtcacaagaccctagtctacccagccttgtgcagatggtgagattgwggcccctcttcccagtgccccatctggtgtggtttttaactgtgaggatctcactgggcatctttttgtaagagcaaagacttcccagaagcagtggcag

SEQ ID NO: 22526 - DNA, 201 bp, Homo sapiens
tccccggtggtttacagctttcagcaaaccctcagggccccagacacatagctcagaagcctgcctcctcgcctgcttcctgggacaacctcacctttgcrcttccttcctgcgtcatgctgggaaagagagaggccccggcatgcccagcccctcaaccctgcctaggctttagctgtcaaccgggccagaccagtaaac

SEQ ID NO: 22527 - DNA, 201 bp, Homo sapiens
agcggctcatgcctgtaatcccagaacgttggaaggccaaggcgggtgggtcacttgaggtcaggagtttgagaccagcctggccaacatggcaaaacccygtctatactacaaatacaaaaattagctgggcatggtggtgcacacctgtaatcccagctactcgggaggctgaggcgggagaattgcttgaactcggga

SEQ ID NO: 22528 - DNA, 201 bp, Homo sapiens
tcactcaggtgcttcacctagtgtaatcttcttatctacaagtgccttcctgaggctgaggcaggcagatcgcttgagcccaggagtttgagaccagcctrgtcaacgtagagaaaacccatctctactaaaaatacaaaaattagccgggtgttatggcatgcacctgtggtcccagcaactgggaggctgagacgggag

SEQ ID NO: 22529 - DNA, 201 bp, Homo sapiens
  misc_feature (1)...(201): n = A,T,C or G, or insertion/deletion polymorphism (see Tables 1-2)
cttctcaaccacctgccatggctctgggacacctggcggtgctcttgatgctgccactgaagaagatggagacagggagatcagctggccctggttttccntgtgacatacttgggaggcccgtccccacaggattgaatacctccccggtggtttacagctttcagcaaaccctcagggccccagacacatagctcagaa

SEQ ID NO: 22530 - DNA, 201 bp, Homo sapiens
gtgtgggccagagcgaggatggatcgtttgctctgcgttcgtttgctgcctcaatttcctctgtctcctgaagcattttggtggggctcttccgctccatrtggtggaacgaaacccaaacgtgaacagcgagggcagcactgggcttctcgccactgaagacaaacccctagaaagttcgctctgggccaggcacagcgg

SEQ ID NO: 22531 - DNA, 201 bp, Homo sapiens
ctcaagccgaagaccctcattgtgcagatgggcccagagcaagcaagacttccccagggcatgcccagcacaaggcggctggagccaaagccaggcacccycgtcctgccaggtacgtcctggacctgcgctgcctcatggcatgtctggttgtctcctgccacctgcggaccctgtgaggcccagcaccagcaagggtga

SEQ ID NO: 22532 - DNA, 201 bp, Homo sapiens
tgtgaattactgttttttataggcggtaaaaaagatgaccattgattacttgatgcttcagatgattgggcattgtttgacctctcagtgtctctctgtgrctctccttgcccacctttggggacgtcttgccggatgagtttctgtaacgtctgcgtggactcagaaaccactctcagatgatagatgatgatgactgtg

SEQ ID NO: 22533 - DNA, 201 bp, Homo sapiens
ggtgcacctgagaatgcacctgtagcaaggtgcagccgtcagggctccctgaattgccttctttgctgctccagttggtgtggtggctctgcccaagggcrttcagccttgtagttgggaatttttaccaagcagcaggcaaggcttgctgggggttcctaggggtagaaagtgattttctgccatcctgaattctggtat

SEQ ID NO: 22534 - DNA, 201 bp, Homo sapiens
ccagatagaagatcaaaccagccatagcattctctcaagccacagcctaatccagagcaaggccttgactcttttcaattctgtgaaggctgagagaggtmaagaagctgcagaagaaaagtttgaagctagcagtagttagttcatgagatttaagaacagaagccatcttggctggacacagtggctcacgcctgtaat

SEQ ID NO: 22535 - DNA, 201 bp, Homo sapiens
atcctggaagctgtcctcctagtccttccagccagggtctgagtcctccaggtgagacactcaaagcactttctggacacaagttcaaaaagagcagcccygggactcttctgtgtgttttaactattttggtcccctacggtgcctgagtgaagggacaggcactggtgtgtggtttacaactccaacattgagaatttc

SEQ ID NO: 22536 - DNA, 201 bp, Homo sapiens
gctgtcactgggtaagggctgtgtgccatgactgtgctagcccagctaactcggtgagctagctctccttaccagcattttccaattgaggcaggctcggwggggccaagtgaccaggcggtagacaaatagctgcaaagtggccaggcctgggtaccctcttcccccaactataagcagctcaaggcctggtggcttgtg

SEQ ID NO: 22537 - DNA, 201 bp, Homo sapiens
tagtgggttctccctcgtgaagccccatggcaattattcttgaggtctcatggcattcctatgaggcaggcaggacgaggtcattattgccattttacagrtgggggaggctcccaaggaggggggagatgtgtgatgatgttatggcaggtggtggagagccaggccaggacacagcaggccgcagcccatcctacccca

SEQ ID NO: 22538 - DNA, 201 bp, Homo sapiens
  misc_feature (1)...(201): n = A,T,C or G, or insertion/deletion polymorphism (see Tables 1-2)
tgccgtcagctgggccagtgtcctggcaggggcccgcagcccatcttgttcttgcaagacctcttgaaagtgtaacacggagagtgaggcctggccatccnggaccctggcagtgcctgggtattttcagctctgtgagatgcccctgttgagtccatcagggtccccacgccagagcccttctggcaagcccctgcttta

SEQ ID NO: 22539 - DNA, 201 bp, Homo sapiens
  misc_feature (1)...(201): n = A,T,C or G, or insertion/deletion polymorphism (see Tables 1-2)
ggagctggttgcggctctagctgtgggactttgagcaagtcattggatttctctgatcctgtttcctcattcgtaaaatgggcatgaaaagagggagttangtgaaatgtctgtctcatgctcagggctaacagcacacaacaaatgctcaattcatggtaaatggtaatattcttgttagtagagggcacaaacacttgt

SEQ ID NO: 22540 - DNA, 201 bp, Homo sapiens
  misc_feature (1)...(201): n = A,T,C or G, or insertion/deletion polymorphism (see Tables 1-2)
ctgtctgctgggtgagcctgggaactgacctggttctttgactgtgggagaaaagtcaccagtcacaaccaagatgctgccaaagtgcccacccagttccntggtcttggtaatatttgtggttagtatgacctacatatcgtcacagctgctttcagtggccgcgtagaaaagcaagcaagcagaaaggaaccttcctgg

SEQ ID NO: 22541 - DNA, 201 bp, Homo sapiens
ctctttgctggacaggtcctccccaggtgaagccccccagccagcttccactttccatcttttgtgctggtggggccgcctttgagggacagtggcccttsttggtcgccatggggttggctacatgacttcttgcgctggcacccccagcagctgcaggccagctgtgcctttccttggccaagttcctgtgcggcaggc

SEQ ID NO: 22542 - DNA, 201 bp, Homo sapiens
tcagcagagcccgggacacacggctgaggccacccaggctgggccatcttgcccctgttttgtgccccctactcagttctccttctgtcctggctcaggtstaggccagtcaagagggtggctgagaagcaggaggagcctcagagaccctcccctcgaaagcactggggcttccacctcacaagcggcaggttcgctttg

SEQ ID NO: 22543 - DNA, 201 bp, Homo sapiens
  misc_feature (1)...(201): n = A,T,C or G, or insertion/deletion polymorphism (see Tables 1-2)
agtggccgccctccctgtacttgtaattacaaccacttggttccacagagcaggttgtccaaaggcagctcagaggactggctatgctgcgatccctgcgnaagcccggccccgtgggcctcctgcacagctttcctccttacgtggtgtttttggccctcctggctggtgttctctgtgaggctgcagccttccttttgc

SEQ ID NO: 22544 - DNA, 201 bp, Homo sapiens
aggccctgacgcatcctggcctcaccctaggcctcctctgtcggggcagcctggctcagcagagcccgggacacacggctgaggccacccaggctgggccrtcttgcccctgttttgtgccccctactcagttctccttctgtcctggctcaggtctaggccagtcaagagggtggctgagaagcaggaggagcctcagag

SEQ ID NO: 22545 - DNA, 201 bp, Homo sapiens
gggtctgggatcctggggtgggcatttgtgccgtcgccttcgccgccgcgctcgccttgcaggagcgggtgcagatggagccaggctgacggttgttcaasaggaacaaatgtttgttcaattgttggatggtggagaaaagggactgtttcctattgactgctgcaggagttggaatggcattgtttattggcctgggaa

SEQ ID NO: 22546 - DNA, 201 bp, Homo sapiens
ccgggctgctctggccttgactggacatgattatttatccttacacaccgtggctgctctacaggccaagaaacaggctgctcagccagggtcaggagaargtgggtcaggctccccggggacctcaggccctgacgcatcctggcctcaccctaggcctcctctgtcggggcagcctggctcagcagagcccgggacaca

SEQ ID NO: 22547 - DNA, 201 bp, Homo sapiens
tggctaggatgggaggaaatcttccagaggaaacttggcttctgggtgtcttggagtgatgcgaggaggctggagctgaagattttattttctttcccctyacagtgattggagatacttgagcttttctgaaaaatagagacgtccttgggtttttcttgtcgttttttttgtttgtttgtttttttgttaaatgtgggt

SEQ ID NO: 22548 - DNA, 201 bp, Homo sapiens
gatgggggacagcttggccagaccacgctggactatcatggagaccacattgcctcttgggcatctgtaagtctcgggaaggacttttttcacggtgccastctcaggagggtgaaagcaaatcatgttggtaaacagcccatttgacctcagaacgcagtggcaggctaactcctgacttctccactcactctttttgtt

SEQ ID NO: 22549 - DNA, 201 bp, Homo sapiens
ggactatcatggagaccacattgcctcttgggcatctgtaagtctcgggaaggacttttttcacggtgccagtctcaggagggtgaaagcaaatcatgttsgtaaacagcccatttgacctcagaacgcagtggcaggctaactcctgacttctccactcactctttttgttctcttgttaaacaaagaaacagattcttc

SEQ ID NO: 22550 - DNA, 201 bp, Homo sapiens
ggaccgagagggtgagcacagacaagcgctgtgcggcgtctgtccgattgcgcaggctgcgctcctgctgcgttcacgtgcgaggccacagaaaacactcrcagcaggccacgccccaggcccctcacatgacagctcgcagaaaacgctggcacgcgttcgggcgtcaggcacacgcatctcaacagatgtggctgacac

SEQ ID NO: 22551 - DNA, 201 bp, Homo sapiens
gtgtgcgtgtgttttgaaggaagaataaggagacccatctctagcaaggcctgcctggccaggcatgctgtcctttctgcccctgaagagtttgtaggagmgtgctggggcccctgtgctctgaacttctagaagctagagtaaagtaatggttctgaatattggctgcacattagagtcacctgggaaggttggaaaaaa

SEQ ID NO: 22552 - DNA, 201 bp, Homo sapiens
ctgacctcagccccttccagggcgcagtgaggcaaaagccacacgtctgtgaaaggtctagctaatgggtctccagtgcccgtgcctggctatggctaatgcataaagtgtcttactttgtttgggctgctgtgacaaagatgccttagactggggaacgtataaaccgcagaaatgtatttcttagttagaagctgggaa

SEQ ID NO: 22553 - DNA, 201 bp, Homo sapiens
agagtcacctgggaaggttggaaaaaaaaaaaaatccagatgcccaggctgcattcaggcccaattacatcacaatcttggagaggggggcagcaacccarcattggtatctttaaagttcctgagtcgattctcttgtgcatccaagactgaggagtgagggctgtaatagaccccatgcatacctacgggtcggttcct

SEQ ID NO: 22554 - DNA, 201 bp, Homo sapiens
ctcatgacgtggaaccttaattcctgcttgcaagacagcctgctttagcgtagaccagcaggtgaacttgatcattgctcacagagttcattagccaagtkaaacatgctacccatcccccgtccccaccccccagtcccaatggaaggtgctgaaaccttgtaaaggtgagcttgctgaaaaaggttttggcctctttgc

SEQ ID NO: 22555 - DNA, 201 bp, Homo sapiens
ttgagtaagccacttaatttttctaggcttctgttctttcctaagggttgtgactaggtgattgctattggtttcttgtagctcaaaactctagaaatgcwtatatatatatatatataaaatatatatatatatatataatagatgaccttttgcaattccagtaggacatacgtatcttatcttataggtaagcatatg

SEQ ID NO: 22556 - DNA, 201 bp, Homo sapiens
gtccccaccccccagtcccaatggaaggtgctgaaaccttgtaaaggtgagcttgctgaaaaaggttttggcctctttgccaaaagtgtgtcagtctgccyggctgtgttgtggtggtggtgagtagtgaataagggctcttccccctgtggggagttgggtttgggccgagtgaagggagaagaggagaattgctatttt

SEQ ID NO: 22557 - DNA, 201 bp, Homo sapiens
ctttgtcaccggatgcccactcctgcatgtggggccgtagctcatgagttctagggacagcagtccctagacaaatgctggggctgtttccccctccactycccaggccttgcccttcggagcccagagtgggttctgggtcactactgataaaacatgtggtttagttcagctcaggagatgtttctagcgtctctatta

SEQ ID NO: 22558 - DNA, 201 bp, Homo sapiens
ctagcccgatttcattgctgaagacatgctgcctgcagaaatcactcaccccaggttgggatttgaacttggcccagctgacctcagccctgtattctttstaccacaccctgctgcttttccatccagtgctcaccaggggaggagagttcctgctgtaagacacgtgcattgcccagtgggcgttccctggcaactcct

SEQ ID NO: 22559 - DNA, 201 bp, Homo sapiens; identical to SEQ ID NO: 3504

SEQ ID NO: 22560 - DNA, 201 bp, Homo sapiens
atatatcaatacaaagcaaagcatttctgcatgagaatgccacactttgctatgatgggcctgaaagtgggaacaagaaaatccagcttcatttggattaygcccatttgaggaaactgcgacttaagatgtttaaattaagtaactcactcaaggtcatactttgtatggagtaagttgtgattcaagttcaagtcagtt

SEQ ID NO: 22561 - DNA, 201 bp, Homo sapiens
actgtgtggagcaggatggccatgggcccttctctctggcagcttccatctagtgtagacagatagacaatattaagagcaaagcagattgtgttggacaragtaagtgctgcaaagacaaggagcatgggtagtgggacagaggcgacgagcagagaagtagaaggatcttctgcgtggaatgagagacctccaaggctg

SEQ ID NO: 22562 - DNA, 201 bp, Homo sapiens
cctcgtccggctgctaccctcccctccacgccacaaaacagggtctggccaggggacttgggtgctgggaggagtgttgattgttctccctcaactccttrctgaaatgtcagtctgatcatccagggagagtttctgtttaaacttgtccaacggatacactttccaaaaatcattgactctctttctctgattaatttg

SEQ ID NO: 22563 - DNA, 201 bp, Homo sapiens
ccacctgggcttcagtgatcctcccacctcagcctcccgagtagcggggaccacaggcatgcgccactatgtcaggctaatttttagtttttttggtagaratggggttttgccatgttgcccaggctgatctcaaactcctgggctcaagcaatccacctgccttggcctcccaaagttgtgggatgacaggtgtgagcc

SEQ ID NO: 22564 - DNA, 201 bp, Homo sapiens
cctacttcaccagagggatgggccatcatatagccaggcccttgttaatggaatttagcttgtttccctttaaacacatttgagaggatggccgcttgggygtccattgccgagaggaggatctggactcccagcctcccccatgaaactgctagcagtagctgctgctgattgagcactctcctggatgagcgagacact

SEQ ID NO: 22565 - DNA, 201 bp, Homo sapiens
cacatgacttgagtatgctgcagggacagcagattgttagccacccagaccctgagatagatcttaaaggtatcatgcggctggaccccaatttgttgttstatccaccaggccattttacaagtgaggcagcccaaggctggcatggcaggggtgggcggggggactctgagaaggtaactctgggccttggtgactctc

SEQ ID NO: 22566 - DNA, 201 bp, Homo sapiens
ctcccccatgaaactgctagcagtagctgctgctgattgagcactctcctggatgagcgagacactgggcaaaggacttgggctctgttttcatcagatacagtaaccttgtgaggcaagcactgttttccctgttgtacagagagggaaactgaggctctgagagtaacttggcaaaggccactcaaacaatgtatttca

SEQ ID NO: 22567 - DNA, 201 bp, Homo sapiens
agaccatggcagggtgtgtgccccagaggtggcctgtgggagggctttgcgaggcttccacctcgcgccctgtgggatcacccagttattgtctttttctkggccatgcccccggcttctctttgagaagaccctgaccctgtttgcagactgggctcgaagtctccggcctggtcctggcattccccagtgaagttggcc

SEQ ID NO: 22568 - DNA, 201 bp, Homo sapiens
atgcactatccatatgggtgtgtgtttatgtatgtgtatgtgtccacatctgttgatatgcgtgtgtgtgtatctgtatctgtatgtacacacactccccycagtgcattggctggcacaggccgggtgctgacagatacttatgatcatcgtcacagtcgcaggacttggagggagggtgtgggctgtttctgggtgtct

SEQ ID NO: 22569 - DNA, 201 bp, Homo sapiens
  misc_feature (1)...(201): n = A,T,C or G, or insertion/deletion polymorphism (see Tables 1-2)
acctgccttctcctttccatgcctgccacgtgtgctgaccacccagttacccaggcgcttttggtgcttctgctgcctctctgagccctggccccttgtcnggactctgctggggatggagctagagagagctggggtgccccgtctttgcctcgttctggcttcctgcttcatgcagagctgtgtctggatgggctaatg

SEQ ID NO: 22570 - DNA, 201 bp, Homo sapiens
gtagagatggagtcttgctgtgttgcctaggctggtcttgaactcctggtctcaagcagtccttttgcctcaacctctcaaatgctgggatcactggtgcragccactgtgaccagcctcagccccattttaaagatgaggaaactgaagtcgagtgatttcatggcgaaggccagggccgctaaattccacacacacgtt

SEQ ID NO: 22571 - DNA, 201 bp, Homo sapiens
atgtctgtgcagcagatgccaccaccgccacaggactgtgggaggagcaagggaaacaacatgtgtggataatgcactatccatatgggtgtgtgtttatrtatgtgtatgtgtccacatctgttgatatgcgtgtgtgtgtatctgtatctgtatgtacacacactccccccagtgcattggctggcacaggccgggtgc

SEQ ID NO: 22572 - DNA, 201 bp, Homo sapiens
gtagagtttgcaacactttcttgtatgtattaattcattagcatgcaatcctcttttgaagtggatgagccaggtggggctcccacttgctggaagctgakagtcccaggccacagtgatatcagatagctgtgttcagcggttgcaaacaaatgaagacacattgaagactgtagaacaaaagcaagaaaatttcatgtt

SEQ ID NO: 22573 - DNA, 201 bp, Homo sapiens
tactgacttagcagatagacatcagtcaggttgctgctgtgggcaggctctgtgctgaggccacaggatgactgagggagggcaacacctaggctgcacaygtggagggggggctccccacaaacaacctggaaatgaactttgagagaaggacagggtggcagtgggggaggcataggcaggaggcacaggacctgagga

SEQ ID NO: 22574 - DNA, 201 bp, Homo sapiens
gagcaagtgccctggggtgtagactctgctagaagcagaggatatcaggagatgtgacctcagagcttgtccattccagtctctcttgaggaaactgaagwtctcttggtccctgtgcccatcagagtttttctgggcatggtgttcacttttggatctgcatttagaaggtgacattgacaaaccagaaggcctccagag

SEQ ID NO: 22575 - DNA, 201 bp, Homo sapiens
  misc_feature (1)...(201): n = A,T,C or G, or insertion/deletion polymorphism (see Tables 1-2)
tgctgggagctgccttccttggcaagcaagaccctggcctgacttccctctctgagcctgcaaactgggcgcctgcctggcgtccacaggctgagctctcngctgtgcaggcagtgcagccccagcagcagtgctctcatgcgcttgtcatccacttgccattggatgacttcggtgtgttctcagctgcacctctcagct

SEQ ID NO: 22576 - DNA, 201 bp, Homo sapiens
cagtgcacattgctgaagcaggtgccaggtaccccagtgttccccccagcaaggatgtgggttggcctgtgtgggtcttggctgcctggcatatgaggctygtctttcctttcattttcccactgcatcttattttctgggaaacttgagactagattcccggagatgttttgttttccgttcagccatcttcatggaagc

SEQ ID NO: 22577 - DNA, 201 bp, Homo sapiens
ttccttactgcttttttgagacctggtttgaccacccagcattggttggctcccagcaagacttgagccatacgcggccatttagacatggatcacgtgtrtgtgagcaaagatttcagaaaaaagcaacaattaaaaagttcacccattgaatgcagtccccctaggtgtcatagtccctgctgtatttttaactccaag

SEQ ID NO: 22578 - DNA, 201 bp, Homo sapiens
  misc_feature (1)...(201): n = A,T,C or G, or insertion/deletion polymorphism (see Tables 1-2)
ccacctgggcctcccagatctggaggggatgtcagatttggggcaagataccttgtccacagaaaaggaaaaatggcgcctgccctgtgagtctgaccagnctgagacagtgccgccaaagtctgtcccctgctgtactggcttctggaacggggtgaccacagtctggctggcatgtggcaggcgctcagtacacatttg

SEQ ID NO: 22579 - DNA, 201 bp, Homo sapiens
  misc_feature (1)...(201): n = A,T,C or G, or insertion/deletion polymorphism (see Tables 1-2)
gggatggctgggggtgtggagaccatggagagagccccaagctggtgccacccttcccgaagtgactcagcgtggcctggactggccgccacacagcatanctggctctggcaccacctgggcctcccagatctggaggggatgtcagatttggggcaagataccttgtccacagaaaaggaaaaatggcgcctgccctgt

SEQ ID NO: 22580 - DNA, 201 bp, Homo sapiens
ctccggaggccataggtaattttccttagagtccttgtccccagctgggtcctaggcctcgagttaccgtaggcaaggctacactgtgtaaagaatccagygggaggggtgcccccaggatgcacagcatgagggccccaagagagccaccagagcggggacagcaaggccaagggatggctgggggtgtggagaccatgg

SEQ ID NO: 22581 - DNA, 201 bp, Homo sapiens
cctcacaaattctgagaacgtgcccagatcatttcacatgttgctgtaatttagctggattctggaaatgtgtattgagctgctagggtatgtgagggatygtggtaggtgttgcaaagggttcagaaaaaattgctctcccaacagatcaaagcagccagctccagcttctaacctcctttgggagcccccacagctgca

SEQ ID NO: 22582 - DNA, 201 bp, Homo sapiens
  misc_feature (1)...(201): n = A,T,C or G, or insertion/deletion polymorphism (see Tables 1-2)
tcggccccccgccagaaccctgtgtgctttggaaaggtcccttgacttttgttaggcaaagaattctcttcacgccaagctgcgagcgaggtggtttcacnagtcctgtcctgagtgtgtgctggctggaatgtacaccacagaaacaaaatgtttgttttccaattgtgagagcaccgggaggccctttggcgtcagctc

SEQ ID NO: 22583 - DNA, 201 bp, Homo sapiens
gcacagtccctttgaaccaccttctttccagattgaagggggcagattttactcaggctgtggtttcagggcagttctcatgcaggccctgcctccccacygtcctagtggtcttgttctttctggggatttggcataccgtgtgcccctggggctcaggggaggaaagatgcagttaggttccagggcatatcctggcaa

SEQ ID NO: 22584 - DNA, 201 bp, Homo sapiens
agcactctcctggatgagcgagacactgggcaaaggacttgggctctgttttcatcagatacagtaaccttgtgaggcaagcactgttttccctgttgtayagagagggaaactgaggctctgagagtaacttggcaaaggccactcaaacaatgtatttcaagagctgggattccaactcagttgtgcttgactcaggac

SEQ ID NO: 22585 - DNA, 201 bp, Homo sapiens
  misc_feature (1)...(201): n = A,T,C or G, or insertion/deletion polymorphism (see Tables 1-2)
ttaagaaattcacaggctagtatgtaggctaaatgttcttttcgtactgctcccaggaatgttctgccttttagaactagaggctgatttcttttcttganattttaaatccaaaggattcagcctttagattgggtttttaagctctgtgaaatcaccaactgtatctagttttagtttcctttctacctaatgaaaatg

SEQ ID NO: 22586 - DNA, 201 bp, Homo sapiens
ctttactttaatcattacgcacaaggatttccatctgcctttttttttttttattattggagacagagtctcactctgttgccaggctggagtgcagtggygcaatctcggctcactgcaatctccgcctcccaggttcaaatgattcccctgcctcagcctcccaagtagctgggactacaggcgcgcgccaccatgcct

SEQ ID NO: 22587 - DNA, 201 bp, Homo sapiens
tgtgcagtcctggggctgcgggaggggagtaacccttagtaacctgtgtgtctgcccctccacagaactgtcagaccttcagcagcctcagctgcctgagygcagggacagaggactgcggtccccagagccccttcgcccgccacgtcagcaacaccagggcctggaccgccctgctctcagcctccggcccagggggca

SEQ ID NO: 22588 - DNA, 201 bp, Homo sapiens
taagggttgtgactaggtgattgctattggtttcttgtagctcaaaactctagaaatgcatatatatatatatatataaaatatatatatatatatataatagatgaccttttgcaattccagtaggacatacgtatcttatcttataggtaagcatatggtttgaaaagtgcattttgtccatggaactgtgtttcggta

SEQ ID NO: 22589 - DNA, 201 bp, Homo sapiens
aagggttgtgactaggtgattgctattggtttcttgtagctcaaaactctagaaatgcatatatatatatatatataaaatatatatatatatatataatwgatgaccttttgcaattccagtaggacatacgtatcttatcttataggtaagcatatggtttgaaaagtgcattttgtccatggaactgtgtttcggtaa

SEQ ID NO: 22590 - DNA, 201 bp, Homo sapiens
ccgttatgagtaaccctctgttgctgatagcccacgggatgagtggagtccacagggcacctgctggagcccacgcttgccttccttgggtctggcagggmagatagtaggctgggcctgctggccctaggtccgtcttcagaggcctgggattttaggtgtctgggctggggatgggctgtccccaagatcaactcctcc

SEQ ID NO: 22591 - DNA, 201 bp, Homo sapiens
tatatataaaatatatatatatatatataatagatgaccttttgcaattccagtaggacatacgtatcttatcttataggtaagcatatggtttgaaaagygcattttgtccatggaactgtgtttcggtaaacattccactgctagctaaaccatcactgttgtatgcctgcagtgtgctcttgctatgctgtgtgctgt

SEQ ID NO: 22592 - DNA, 201 bp, Homo sapiens
gtgtagctgggaccacaggtgtatgccaccatacctggctattttttaaattttttatagagatggggatttctccatgttgcccagctggtcttgaactsttgggctcaagcatttcacctgcgtcagcctgcccaagtgcagggattataggcgtgagccactgcgcctggcggtgaagcccttctttgcagaaatctc

SEQ ID NO: 22593 - DNA, 201 bp, Homo sapiens
tgctggtattataggtgtgagccactctgcctggcctgaacttcttttttttttttttgagacggagtctcactctgtcccccaggctggagtgcagtggsgcgatctcggctcactgcaagctccgcctcccggattcacgccattttcctgcctcagcctcctgagtagctgggattacaggcacccaccaccacgcct

SEQ ID NO: 22594 - DNA, 201 bp, Homo sapiens
gtacaaccaagcctggttcagatggctccactagggggacagtgacagctatagccgcagctggtgtacttggcagtctttcaagcattttggggtgtgckgcggacaaacaatagaatgaatctttgtttctggagcctgggccatttctaacgaggaagatgattactcatttttggaagttgggttaactcttccaga

SEQ ID NO: 22595 - DNA, 201 bp, Homo sapiens
ctaaaatgcctgatctcgtgattttccccccttggctccccaaagtgctgggggtgcaggggtgagccaccgcgcccagcctaccttttacatttagacctttttttttttttttttaagatggaatcttgctctgtcttccaggctgtagtgcagtggtgtgatcttggttcacttcaacctctgcctttggggttcaaa

SEQ ID NO: 22596 - DNA, 201 bp, Homo sapiens
ttgtcaagacgaggtctcactatattgcctaggctggtattattattatttttaagtctgagaacatatctatgccacctcccttgggtctgctcctgatsgaggtggccagtgttggtggtttgtttgtttttttttttttttttagatgaagtctctcttttgtcacccaggctggagtgcaatggcgcgatctcggct

SEQ ID NO: 22597 - DNA, 201 bp, Homo sapiens
agttggtagttatttttatctattctaacaatctctaacctttaactggtgtatttagaacatttatgttcaatgtgattattgatacgtttggatttagktctacattttattgttttcccttttttacctctgtttttttttttttgagacagagtttcactcatgttgcccaggctggagtgcaatggagggatcttg

SEQ ID NO: 22598 - DNA, 201 bp, Homo sapiens
agccttggcttgcctaagtgattctcttgcttccgcctcctgagtatctggggctgcaggcacatgccaccatgcctggctaatttatttttttgtcaagmcgaggtctcactatattgcctaggctggtattattattatttttaagtctgagaacatatctatgccacctcccttgggtctgctcctgatcgaggtggc

SEQ ID NO: 22599 - DNA, 201 bp, Homo sapiens
taacctttaactggtgtatttagaacatttatgttcaatgtgattattgatacgtttggatttaggtctacattttattgttttcccttttttacctctgtttttttttttttgagacagagtttcactcatgttgcccaggctggagtgcaatggagggatcttggctcactgcaacctccacctcctgggttcaagtga

SEQ ID NO: 22600 - DNA, 201 bp, Homo sapiens
tctagtcatcctacagtgctatagaacactagaacgtactccttctatctggctgtaattttgtatcctttaacaaatctcttcctgttccccgccttccscctacccttcccagcctctagtctcctctgttctgctttttacttctatgagatcaaaattttttaagcttccacatattctcgtagcctcttagaaagc

SEQ ID NO: 22601 - DNA, 201 bp, Homo sapiens
agtagctgggattacaggtacccgccaccacacacggctactttttgtatttttagtacagacggggtttcgccctgttgtccaggctggtcttgaactcttttttttttttttttttttttgagacggagtctcgctctgtcgcccaggctggagtgcagtggcgcgatctcggctcactgcaagctccgcctcccaggt

SEQ ID NO: 22602 - DNA, 201 bp, Homo sapiens
taaaattaaaatttaaattgacacataattgtacttatttatggggtacatagtgatgttgcaacacatataatgtatgatgatcggctcagggtgattarcatttccaacatctcaaacgtttatcatttctttgtgtcaggagtgttcaatatctttcttctaactatttgaaactacataatattgttaactctagtc

SEQ ID NO: 22603 - DNA, 201 bp, Homo sapiens
cttcttggaaattattttagagagggttttcttgcaacaaattttttttgttttcctttacctgagaatagctttatttcaccttcattcctaaggagtgttttttttttttttttggctgaatatagaatcttttttttttttgagacacagtctcactctgtcacccaggctggagtgcagtggcacaatctcacaatc

SEQ ID NO: 22604 - DNA, 201 bp, Homo sapiens
tatgctctgctactgtggaacccagaaaacttttgagcccagcccctccgtgaatcaggaggtgctgtgctttgaattagtgttaacaacattttgatagytatcggaaaccccctgcaagcaagacagatttcagtatctctggcaccaagaatgttgagacttgacttaacgtggtgattgtgttctttgtttcagcag

SEQ ID NO: 22605 - DNA, 201 bp, Homo sapiens
ttgcgatatttctagcttttgttttttctattttttttttctgtattactgtctttctcctttcattttgggagtctatacacatgaaatgtcaatttttytgttgctccacaggtccccgtgaactccacaggttcaattttttaaaagtcatttttgtctttgtcggccaaatgttatatttcaattgatctgtcttca

SEQ ID NO: 22606 - DNA, 201 bp, Homo sapiens
gcacagccagcctagtgcgtgttggacttgggacgagactgataccgggaggaaataatgcccagagagaagcacaacacagggagtacatgagatttgcyggttcaactacagtcacctagaaatactttttgtttctgagtaaaagtctgttctaaggagcgcagcgtcacatgtgtatataatcttcccattgaccca

SEQ ID NO: 22607 - DNA, 201 bp, Homo sapiens
acaaaacaggcatagggagttttaaaaaaacttctctttaaaaatcgctttttggatacaaggtcaataaaataacatacaccagtaggaaggagtaatgsgaaatctagggcttcacaaggaaaacaatccccctcccccaggtgagcagcacaatgaaaatactctgcttattctatcagggttacattcctgaactta

SEQ ID NO: 22608 - DNA, 201 bp, Homo sapiens
cctcctctgacacctgacaacagcatgaactcagcccatcccggtgttgcccagggcctcagtttcctgatctgtgaattgggcatgagttccttgctcayttcacccctgggcacggctggatgtgaacgtattgtgcacatggtaagaccctggctagtcctaagccctggtattatggttgacacctactgagtagaa

SEQ ID NO: 22609 - DNA, 201 bp, Homo sapiens
aaagttgactctggcctgggacccagaaaactctgtcagccagatatcttctggccccttaggtggacagccagctcagaagttgctagaggagatgagcytgtggtaatggagcttggcccggcaaggtggttttgcagccactctgtgaaaataagggtggggatggttggctcagatttaaaagcctcagctggctgt

SEQ ID NO: 22610 - DNA, 201 bp, Homo sapiens
ctgtaaccagaaacttcttatattttccaaagaagtatattttgctaacatatttccagtcacctatctttttgaaaatacttaaggtggacttggtgatrtctgtcttctcataatttattataagcaattttaaaaaggttctgcttttaaaaagatcttttcaaatgtagaaagaacagtgtgaaatgtgaatgactg

SEQ ID NO: 22611 - DNA, 201 bp, Homo sapiens
ggaaaaccttgattggcgttttattttactttaattttaaaatttattttgagacagagtctggctctgttgcccaggctggagtgcagtgggataatctyggcttaccacagcctccatcatccaggcatctcccacttcagcctcccaagtagctgggactacaggcgcacaggcacaggccaccacaacggcttattt

SEQ ID NO: 22612 - DNA, 201 bp, Homo sapiens; identical to SEQ ID NO: 3496

SEQ ID NO: 22613 - DNA, 201 bp, Homo sapiens; identical to SEQ ID NO: 3498

SEQ ID NO: 22614 - DNA, 201 bp, Homo sapiens
tcaattgatctgtcttcagattcactgactttttctctgtcaccttcattttgctgttaagtccacacattgcaattggctgacatgtcttaattttttaytgcatgatttctttatttaccattacgatttattttttgtaggaggtagttcatttgtctgaatggtttttcacaatgtgaattttctaattacatctct

SEQ ID NO: 22615 - DNA, 201 bp, Homo sapiens
tgttagctataagccttatcatcatccttttaaaggtaatctgtcgccttgtatcccacatccctactccctggatgtttttgagatttttctgtttttctttttttttttttttggtacggagtctcacgccgtcacccaggctggagtgccatgtgccatctctgctcactgcaacctctgcttccggggttcaagtga

SEQ ID NO: 22616 - DNA, 201 bp, Homo sapiens
tcagaagtcgtggggctttctgtgtgttttcaaagcccattaactcgatggactccataactcactagagacttgggacaaaaaatctgggcctaattttrtgcagatgttttctctttgaataccttttcctcctttccctgatctgacattggcaaaggacagtcacccttttattgtgactttagaagggatcagtag

SEQ ID NO: 22617 - DNA, 201 bp, Homo sapiens
ccatttaggtttttgtaagtacactccatggtgacacatgactgtgtgtgtgtatgtgttacatcttatattctgtgctatattctgtctttttttctttytttttttttttttgagtcagagttttgctcttgtagcccaggctggagtgcaatggcgcgatcttggctcactataacctccacctcctgggttcaagca

SEQ ID NO: 22618 - DNA, 201 bp, Homo sapiens
ttattttttcttctgtatgtttgttcatacactactgctcctgatgtttgcaaatacacataatacttaactatggattaaccagatcaaaagggttttcyttttttttttttttttttttttttttttgagactgagtctcgctcagttgcccaggctggagggctggagtgcggtggcgccatctcggcttactgcaag

SEQ ID NO: 22619 - DNA, 201 bp, Homo sapiens
ccattctcctctctcagcctctgaagtagctgggactacaggcgcctgcagccacgcccagctaattttttgtatttttagtagagatggggtttcaccgkgttagccaggacggtctcgatctcctgatctcgtgatctgcccgcttcggcctcccagagtgctgggattacaggcgtgagccaccgcgccctgcccaca

SEQ ID NO: 22620 - DNA, 201 bp, Homo sapiens
ccaggctggtcttgaactcctgaccttgtgatccacccgcctcggcccctcaaagtgctgggataacaggtgtgagctaccacgcccggccatttttgtatttttttagtagagacgagatttcatcatgttgaccagggtggtatcaaactcttgatctcagatgatccctccaccttggcctcccaaagtgttgggatt

SEQ ID NO: 22621 - DNA, 201 bp, Homo sapiens
atctcagatgatccctccaccttggcctcccaaagtgttgggattacaggcatgagccaccactcctggcctacaataaagtattttttaaggcacccaatttttttttttttttttttttttttgagatggagtttcgctcttgttgccctggctggaatgcaatggtgtgatctcggctcaccacaacctctgcctccc

SEQ ID NO: 22622 - DNA, 201 bp, Homo sapiens
tcactcagccccactcaagcttgctttctctagcatctagaacctagaaaagatcaaaacaaccgcttgcccagggcagcactaattggccgggtcatccrgtggttttattgctctgtaataaggttacctaagttctttcttgaattttattttattttatttatttatttatttttgagacaaagtttcactctgtcg

SEQ ID NO: 22623 - DNA, 201 bp, Homo sapiens
tcttttcttttcttttcttttttttttttttttgaggcagtgtctcgccctgtcgcctagacagtagtgcagtggtgcgatctctgctcactgcaacctcygcttcccagttcaagcaattctcctgcctcagcctcccaagtagctgggactacaggcacatgccaccacgcccggctaattttttgtatttttagtaga

SEQ ID NO: 22624 - DNA, 201 bp, Homo sapiens
gggtttcaccgtgttagccaggatggtcttgatctcctgacctcatgatccgtctgccttggcctccctaagtgttgggattacaggcgtgagccactgcrcccggccaatataaggtatgttttcatacagggaccttttctattttgtttactgtttttttttttttttttttttttaagatggagtctagctttgttt

SEQ ID NO: 22625 - DNA, 201 bp, Homo sapiens
ctaagtgttgggattacaggcgtgagccactgcgcccggccaatataaggtatgttttcatacagggaccttttctattttgtttactgtttttttttttktttttttttttaagatggagtctagctttgtttcccaggctggagtgcaatggcgtgatctcggctcactgcaagctctgcctcccgggttcacgccatt

SEQ ID NO: 22626 - DNA, 201 bp, Homo sapiens
  misc_feature (1)...(201): n = A,T,C or G, or insertion/deletion polymorphism (see Tables 1-2)
gaccttcagccgtgaactggtgaggacctggcaggcttcctgctttccatgaccatttctgaggcctgatgtacagacagggctgtggactgagcacctangcttagcaaatcgagtccagagtccccaagagcaaagctctgtgaggcgtcccgggctggggcaacagggcacaggagcagagcttgactgagaacttgc

SEQ ID NO: 22627 - DNA, 201 bp, Homo sapiens
  misc_feature (1)...(201): n = A,T,C or G, or insertion/deletion polymorphism (see Tables 1-2)
ctgcacattcgttaagggctgggacggtgctttctcttctcagggcggcttcccacaattgctaatcccggccagaccccttagcagcaaaaggagccccnaacaggcgggacaggtggactagctctgagttctgtttcatctgtaggaccttgggcaagttacttaacctttctgagcctgtttgctcatctgcaaagc

SEQ ID NO: 22628 - DNA, 201 bp, Homo sapiens
cttcgtgggatgagatgtcttggtggggaaagccaaggaggtagcaagttcaaggagcccctagtcttcctgttgacacccaggagggtgtggctttcagycccctccccaggccagcaggtcctgacacctgaattcatgtggaaatgctgagcctctgaatggcctcctgctgtgtgagactgggtggtgtccaggagg

SEQ ID NO: 22629 - DNA, 201 bp, Homo sapiens
ggagcacacttggtgcctgggagcacacagagggagcacacttggtgagcggagaagcttctgcgcagcctactctctctctggggcctcaaagggcccakcaaggcaggcagggagcatcatgcacctcttccagatgaggcccccagctggcgagcaccagaacctggagcctggcccctcctcagcagatcagacctc

SEQ ID NO: 22630 - DNA, 201 bp, Homo sapiens
gccagttttttatgtagtgcacaggcatttctgggaaagtatcttgagaatctacagatatttgcttgttttttcttagaatccttttcagattagtttgtttttttttttttttgatcctgcactttttaaaggataggataaattttcaggatggagtcttgggtaaataatatggtactcaatatttggttaaatttt

SEQ ID NO: 22631 - DNA, 201 bp, Homo sapiens
aggcagaggttgcagtgagctgagcttgtgccactgcactccagcctcggtgatggagtgagactccgtctcaaaaagcaaacaaacaaacaaaaaaactygacacatgctagctgcttcctacaaaccaggtgatagaggctaacagagatacagctttgcagagatgacaaacaggaagtggaggaaatgggaggtgga

SEQ ID NO: 22632 - DNA, 201 bp, Homo sapiens
gagtttgattcacaaaaagcttagaatggttctttgttgaaaagcttttcgagtcactatttggggcatgttagtgccatttgcaaaggtgaaggttttcttttttttttttttttaaccatagagcttttgataaggttaggaaaaggaagttgtcatctcttcttattactctaatcctgctggaagctagcttcttag

SEQ ID NO: 22633 - DNA, 201 bp, Homo sapiens
cagattacctaatttgccactctaagatgagtatagtatatgggtatagtatatgggtctgcccttctttttttttttttttttttttgagatggagtctygctctgtcgcccaggctggagtgcagtggcgcgatctcggctcactgcaagcttcgtctcctgggttcacgccattctcctgcctcagcctcctgagtag

SEQ ID NO: 22634 - DNA, 201 bp, Homo sapiens
atattataatgccagattttcatgaaatgtcctttatgatgtgtcagcagagactaagaatacccctcggatttagatcgttacctgttttaagtggtaattttttttttttttttttttggagacagggtctcactatgtcacccaggttggagtagggtggtgcaatcatggctcattgcaacctcaacctcctgggct

SEQ ID NO: 22635 - DNA, 201 bp, Homo sapiens
tgccagttttttatgtagtgcacaggcatttctgggaaagtatcttgagaatctacagatatttgcttgttttttcttagaatccttttcagattagtttktttttttttttttttgatcctgcactttttaaaggataggataaattttcaggatggagtcttgggtaaataatatggtactcaatatttggttaaattt

SEQ ID NO: 22636 - DNA, 201 bp, Homo sapiens
tggccagttctaagtaatttaaagccaaatgcctggacttagctttgaattaggacttcatgaagcctttcttcgtcttcttccttctttcttcttcttctttttttttattttttttgtgagacaggatctttctctgtcacttaagctgtagtgaagtgttgctatcatagctcactgcagccttgaccttcctggctc

SEQ ID NO: 22637 - DNA, 201 bp, Homo sapiens
ttgctttggctaatattttcctcatgctgctttaaaaggtaggctctgtgtcacctgttacttctgcactagcaaagtactgatgaaagaggttttctttktttttttttttttttttgaggtggagtctcgctctgtcacccaggctggagtgcagtggcacgatcttggctcactgcaagctctgcctcccgggttccc

SEQ ID NO: 22638 - DNA, 201 bp, Homo sapiens
agtcatacttggagaagtcagatagtacaaaagggaggctacatggattgtgagagaacctaggcaatctgagtcctagtcttgactcttttggctatagycttaaccttgagtaagccacttaatttttctaggcttctgttctttcctaagggttgtgactaggtgattgctattggtttcttgtagctcaaaactcta

SEQ ID NO: 22639 - DNA, 201 bp, Homo sapiens
aatattcaaacctcacatagggttggacgtggttcctctccggaactgtcattcccttctccaggcaaccactgtgtgggaccatgctggactccttctatttttttttttttttctttttttgaggcagagactcactctgtcactcaggctagtggactcgctcttcttgcctttgtcactttataggatttcttggag

SEQ ID NO: 22640 - DNA, 201 bp, Homo sapiens
ggtcttatttcactgcagacctcagctagggctcgggtgctcgcagagtgcagacactgagtgtcttgtgaaacctcagagggccgaggggttccctcggmctggtggggcctccacaccgtgattggctcattcttcccactgtgggtgcaggaggttcaaagtgttggaaaggccgtgtgtataggaatggtaaatacc

SEQ ID NO: 22641 - DNA, 201 bp, Homo sapiens
gtcttatttcactgcagacctcagctagggctcgggtgctcgcagagtgcagacactgagtgtcttgtgaaacctcagagggccgaggggttccctcggcctggtggggcctccacaccgtgattggctcattcttcccactgtgggtgcaggaggttcaaagtgttggaaaggccgtgtgtataggaatggtaaatacca

SEQ ID NO: 22642 - DNA, 201 bp, Homo sapiens
atggctgttcttggtggagcgatttgtctggctaattccgataataaacgagactctggcatgctaactcattatgcgaccccagagtggtcagcgtcctsaaacttcttagagggacaagtggcattcagccacccgagattgagcagtaacaggtctgtgatgcccttagatgtccggggctgcatgtgtgttacactg

SEQ ID NO: 22643 - DNA, 201 bp, Homo sapiens
ggcccggttggagccactgcaggtgcagaacttggtggtagtagcaaattttcaaatgagaactttgaaggcctaagtggagaagggttccatgtgaacarcagttgaacatgtgtcggttggtcctgagagatgggtgagtgccgttccgaagggacaggtgagggcctccattgacctcagccggttgaaagggagacg

SEQ ID NO: 22644 - DNA, 201 bp, Homo sapiens
ggcatgggcccggttggagccactgcaggtgcagaacttggtggtagtagcaaattttcaaatgagaactttgaaggcctaagtggagaagggttccatgwgaacaacagttgaacatgtgtcggttggtcctgagagatgggtgagtgccgttccgaagggacaggtgagggcctccattgacctcagccggttgaaagg

SEQ ID NO: 22645 - DNA, 201 bp, Homo sapiens
agaactttgaaggcctaagtggagaagggttccatgtgaacaacagttgaacatgtgtcggttggtcctgagagatgggtgagtgccgttccgaagggacrggtgagggcctccattgacctcagccggttgaaagggagacgggttcagatccctgaatccagagtggcagagatgggcaccatgaggcttccagtgcgg

SEQ ID NO: 22646 - DNA, 201 bp, Homo sapiens
cataattcccaccataaacgatgctgactggtgatgtggtggcattattcccatgacctgccaggcagcttccgggaaaccaaagtctttgggttccggtrggagtatggttgcaaagctgaaacaaaggaattaacagaagggcaccaccaggagtggagcctgtggcttaatttgactcaacacgggaaacctcacccg

SEQ ID NO: 22647 - DNA, 201 bp, Homo sapiens
tagacagcaggacagtggccatggaagttggaatctgctaaggagtgtgtaacaactcacctgctgaatcaactagccctgaaaatggatggtgctggagygtccggcccatacccggccgttgctggcagttgagagtggacgggagcggcaggggcgttatgcccgtgtgagtgtggtgggggtcctctcctgcaccct

SEQ ID NO: 22648 - DNA, 201 bp, Homo sapiens
gagggccgctgcggtaagctttgaagtctagggcatgggcccggttggagccactgcaggtgcagaacttggtggtagtagcaaattttcaaatgagaacwttgaaggcctaagtggagaagggttccatgtgaacaacagttgaacatgtgtcggttggtcctgagagatgggtgagtgccgttccgaagggacaggtga

SEQ ID NO: 22649 - DNA, 201 bp, Homo sapiens
tgggttccttggggtgtgtggctagggggttcccttgcagggtctgccggggccctccatccccccaagtacagacccagcgatgttcgcccttccgctgygcacgccccttccccctcaccctgtgggccctgtgtggtcacgtgttggtggcagggggaaggggggcccggctgggagagagatggtggtgtcaccgcc

SEQ ID NO: 22650 - DNA, 201 bp, Homo sapiens
gaactggcattgtgggatgaacagaatgccgggttaaggtgcccgatgccaacaatcatcagacccgagaaaatgtgttggttgatatagacagcaggacrgtggccatggaagttggaatctgctaaggagtgtgtaacaactcacctgctgaatcaactagccctgaaaatggatggtgctggagcgtccggcccatac

SEQ ID NO: 22651 - DNA, 201 bp, Homo sapiens
ccgatcgcacgccccctgtggcagtgacgacccattcgaacgtctgccctatcaaattttgatggcagtcaccatgcgtaccatggtgactatggatgackgcatcagggttcgattccagagagggagcctgacaaatggctaccacatccagggaaggcagcaggcacgcaagttacccactccggacctggggatgta

SEQ ID NO: 22652 - DNA, 201 bp, Homo sapiens
cccgagccacctggattctgaagctaggaataatggaagaggaccgtggttctattttgtgggtttttgaactgaggccatgattaagagggacggccggkgggctttcatattgcacctctagaggtgaaattcttggaccggcacaagacggaccagagcgaaagcatttgccaagaatgttttcattaatcaagaatg

SEQ ID NO: 22653 - DNA, 201 bp, Homo sapiens; identical to SEQ ID NO: 3558

SEQ ID NO: 22654 - DNA, 201 bp, Homo sapiens
tgcctgtctgagcgtcacttgctgatcaattgcccctgggggtgcctctgggttccttggggtgtgtggctagggggttcccttgcagggtctgccggggycctccatccccccaagtacagacccagcgatgttcgcccttccgctgcgcacgccccttccccctcaccctgtgggccctgtgtggtcacgtgttggtgg

SEQ ID NO: 22655 - DNA, 201 bp, Homo sapiens
ccacctgggggtggcgggggctaccctacccctgttcgatctccactgtgggcacctggggcggccgtcacaaccccatgatgttggctctgtgctgtgcrtgtcaggcattctcgtctccattgggttgtccgccgtcccttccccagagtgaggaatggctgggctgatcggctctctcgctggcaggctggctgaccc

SEQ ID NO: 22656 - DNA, 201 bp, Homo sapiens
ctctgtgctgtgcgtgtcaggcattctcgtctccattgggttgtccgccgtcccttccccagagtgaggaatggctgggctgatcggctctctcgctggcrggctggctgacccccgctcctgggggtgctctttgtgatcaatgtggtgatgtcatgctctcccaggcagggtgccagccgcgacgggtgaggggcggat

SEQ ID NO: 22657 - DNA, 201 bp, Homo sapiens; identical to SEQ ID NO: 3556

SEQ ID NO: 22658 - DNA, 201 bp, Homo sapiens
aattattccccatgaatgagcaattcccagtaagtgtgggtcataagcttgcgttaagtccctgccctttgtaccacacagccagtcgctaataccaagtsgatggtttaatgaggccctcagaacccaaatcgacctcataggactcttagcagtggatcactcagctcgtgcatcaaagaatgcagctagctatgataa

SEQ ID NO: 22659 - DNA, 201 bp, Homo sapiens
gagaaactaaggagcaaaagccctgcattccacgtccagctctgccttcaactctgcatgtagccttggacaaggtccctctgtaggcctcaattttcccrctttgagacactctgttgcccaggctggggtgcagtggcacgatcatggctcactgcagcctcaacctcctgggctcaagtgatcctcccacctcagcct

SEQ ID NO: 22660 - DNA, 201 bp, Homo sapiens
tagattacggaacttaatttcggattctatgaaggcgaagattactgcatatgtgatcatacttgccttgcacatacatgacttccaaattgacctgacartgttacagagggacttgaagctcagtgagaaaaggtgagcacaacagaataaagagctccctgcagggtgtctcgatgtcttatttctggtaccactgga

SEQ ID NO: 22661 - DNA, 201 bp, Homo sapiens
gcggaaaggcagcattgcagaaaagggcagcccaactcggtgactctggggaaagacccgcaggccctgcccctgggcttccttcctgccatttgcatggmgtgtgttttctgctcttgagtgtgcttggaagaatcagcacagctgatttcgggatgattgttttcccagcagccctgctgggcaggcggggacagactc

SEQ ID NO: 22662 - DNA, 201 bp, Homo sapiens
cctccgctttgccaggcggtctgaggtctgggctggaggcagcgggagggacagggtgcccagtttgtgatcttcttcactgccggcggccacagacaccyttcttttggagatcttcagcctcatggctttggctatctccatcatcctaaggaagacataaacagaagaactggagagacccctcaacatgactgttca

SEQ ID NO: 22663 - DNA, 201 bp, Homo sapiens
ccaagcccctgctcctcactcccaacccccacctactttctcctgcacaagaaaaatcccagcaaccaccccctgacctgccattgttgtaggtcaagcargtaaagtgcttcagcagtttggtgttgatgatgtggggaactccaggtcccagagcacctacaacacaaagttgagtttgatcattttctctcaaaaccc

SEQ ID NO: 22664 - DNA, 201 bp, Homo sapiens; identical to SEQ ID NO: 3562

SEQ ID NO: 22665 - DNA, 201 bp, Homo sapiens; identical to SEQ ID NO: 3563

SEQ ID NO: 22666 - DNA, 201 bp, Homo sapiens; identical to SEQ ID NO: 3559

SEQ ID NO: 22667 - DNA, 201 bp, Homo sapiens
taaacatcctcagttcccttggtggtgcctcatgctttccagtggtaccagaaataagacatcgagacaccctgcagggagctctttattctgttgtgctyaccttttctcactgagcttcaagtccctctgtaacactgtcaggtcaatttggaagtcatgtatgtgcaaggcaagtatgatcacatatgcagtaatctt

SEQ ID NO: 22668 - DNA, 201 bp, Homo sapiens; identical to SEQ ID NO: 3561

SEQ ID NO: 22669 - DNA, 201 bp, Homo sapiens
ctagaatcacttcccgccatcagaagtaaatctgctctttcctgagaagagtctgggtttggtgtgtgtaaaacacagttccttagaactcagagaaaatsctgaccaaaagcttcagcatttgagcttcccccgctcttcacaatctttatagacttcgagtgactggaaacccaccagcttctatcccttctccctgaa

SEQ ID NO: 22670 - DNA, 201 bp, Homo sapiens
tggaatggaaaaaggacattaggtaacaaactaaagaaatctgaggccaggcacagtggctcatgtttgtaatcccagcactttgggggattgaagcaggyggatcacttgagcccaggagtttgagaccaggctaggcaacatggcaaaaccccgtctctacaaaaaaatacataaattagccaggcgtggtggtgcatg

SEQ ID NO: 22671 - DNA, 201 bp, Homo sapiens
ccagtatatgcccagactaaggaaaggcttccaaaagtgccttttttaaaatatagaactttattttggttactgaggtttttgttactgttggttcacagaaaagtcatttcttagaaaatagtaacggcagcattttttacagcgactcacattggggccaccaaacaagtgcaaaggacagtgccagggatagaagag

SEQ ID NO: 22672 - DNA, 201 bp, Homo sapiens
gctggcccttaaagcttctacccagaagtgaccattaaccacttctgcctacattcactgggcaaatcaggtcccatggcaacgtgagagggcatgtactytccctgaggggcagcaaacagtaactaccaaaaccaatgaatattttcattttaatagtttaatgtatgtttatagtaatataaaaagtcttttcagtgt

SEQ ID NO: 22673 - DNA, 201 bp, Homo sapiens
tggagaaattgtctgagagtttaattttgtttctcctttattgccactgattttctagattacggaacttaatttcggattctatgaaggcgaagattacygcatatgtgatcatacttgccttgcacatacatgacttccaaattgacctgacagtgttacagagggacttgaagctcagtgagaaaaggtgagcacaac

SEQ ID NO: 22674 - DNA, 201 bp, Homo sapiens
tttggagagaaagcttgctctgtgttgtcagaagggagattgaagaaggtgggcccaggggtgctgttgacagtataggctcatgtgctgttccaaggctyatctctggctcttgcctggtctggccataccatgtccacatccgctgtacttaggacttcctctgggcaccagggcagtggcctcaccaagacctggagg

SEQ ID NO: 22675 - DNA, 201 bp, Homo sapiens; identical to SEQ ID NO: 3560

SEQ ID NO: 22676 - DNA, 201 bp, Homo sapiens
ctcactcccaacccccacctactttctcctgcacaagaaaaatcccagcaaccaccccctgacctgccattgttgtaggtcaagcaagtaaagtgcttcascagtttggtgttgatgatgtggggaactccaggtcccagagcacctacaacacaaagttgagtttgatcattttctctcaaaaccctcaggccacacctc

SEQ ID NO: 22677 - DNA, 201 bp, Homo sapiens
aggtttgcgccaccatacctggctaatttttgtgtttttagtagagatggggtttcaccatgttggtcaggctggtcttgaactcctgacctcaggtgttstgcctgcctcggcctcccaaagtgttgggattacaggcgtgagccaccgcgcctggccacttagttcttattttcacattccaattccacctttccccct

SEQ ID NO: 22678 - DNA, 201 bp, Homo sapiens; identical to SEQ ID NO: 3569

SEQ ID NO: 22679 - DNA, 201 bp, Homo sapiens; identical to SEQ ID NO: 3570

SEQ ID NO: 22680 - DNA, 201 bp, Homo sapiens; identical to SEQ ID NO: 3571

SEQ ID NO: 22681 - DNA, 201 bp, Homo sapiens; identical to SEQ ID NO: 3572

SEQ ID NO: 22682 - DNA, 201 bp, Homo sapiens
aaggctggtctcagccatttggtcacgggagtttctgtgagccacagacagattgagagaggagtcaacacaagcaggagtgcatgtcacaggggtctcakccacctgttcacacactgacacgtgccttctggattttctccaacccatcctctcatacccgatcttcacttgatgacagcttacagctgcatgtgccca

SEQ ID NO: 22683 - DNA, 201 bp, Homo sapiens; identical to SEQ ID NO: 3573

SEQ ID NO: 22684 - DNA, 201 bp, Homo sapiens
aaaacaaaaaaaaagggggggcgaggggattttttttacttgtttgagaaattataataaaataattgagtatctcctgtgagtaatgcctttttgttttyaattattccacagcaggtggagttttcagtaatttgttcaagttttgcataagtggttccttaaatcaaaaattatttattaaataggatctttaagaaa

SEQ ID NO: 22685 - DNA, 201 bp, Homo sapiens
aatcaaaaattatttattaaataggatctttaagaaattttttgaaagttttacttttcctgctgaacaatattttcaatgtgtggtaattactgtactawcatccatgtccctaatattactggggtttcttttattactcagaaaacaaaagtggttttttaaaaatctcatggagagggtctgtggcagctttctgga

SEQ ID NO: 22686 - DNA, 201 bp, Homo sapiens
  misc_feature (1)...(201): n = A,T,C or G, or insertion/deletion polymorphism (see Tables 1-2)
aaaatattgctctgtggcatgttctgaaaataatacaaaaataatttttatagtacagtttaaacttggcttgtaaaatttcaacgtaacacagcataaantctaccaacagaatacactgaaaaacaccttcccttaacaatattttaaaaaaatcatttacccagataacaaatgtgcaggaaatgtaaagtaaatttc

SEQ ID NO: 22687 - DNA, 201 bp, Homo sapiens; identical to SEQ ID NO: 3574

SEQ ID NO: 22688 - DNA, 201 bp, Homo sapiens; identical to SEQ ID NO: 3575

SEQ ID NO: 22689 - DNA, 201 bp, Homo sapiens
aggtggagttttcagtaatttgttcaagttttgcataagtggttccttaaatcaaaaattatttattaaataggatctttaagaaattttttgaaagttttacttttcctgctgaacaatattttcaatgtgtggtaattactgtactaacatccatgtccctaatattactggggtttcttttattactcagaaaacaaa

SEQ ID NO: 22690 - DNA, 201 bp, Homo sapiens; identical to SEQ ID NO: 3576

SEQ ID NO: 22691 - DNA, 201 bp, Homo sapiens
tttgaacaagcagcaaaaagcgtttaaccccccggagcccacagtggagctccttcccacctccagttacccttccaagggacaaccctgtggcaataacrggtgcaaaatattgctctgtggcatgttctgaaaataatacaaaaataatttttatagtacagtttaaacttggcttgtaaaatttcaacgtaacacagc

SEQ ID NO: 22692 - DNA, 201 bp, Homo sapiens
gcaagagtatttttgttcctcagtaagagaaataaagaaattcgcagccctttgttttaagaagggagtgttttacatgctttttttgcttttttttttttctcctaccctagcgatgacctcttccaggtagcggtcccttgtgcgcggttggtagtacccagggcttagagcgagcgcgcacccggggctgcggtggag

SEQ ID NO: 22693 - DNA, 201 bp, Homo sapiens
tgcgttacaccctttcttgacaaaaacctaatgcgcagaaaataagatgagattggcatggctttgtttgtgtgtgtgtgtgtgtttgtgtttgtgtttgyttttggcttgactctgggtttaaaaactgaaactgtgaaggtgacagcagtcggttggagtgagcatcctccaaagttctacagtgtggccaaggacttt

SEQ ID NO: 22694 - DNA, 201 bp, Homo sapiens
gccactccacagccggtccgcatgtgccgccagctcaccagggtgatatcactgggctccagcaagggcaaggccagcttcgcaggtgacgatgccccgtyggccgccttcccctccatcttggggcgcccgcgacaccagggcatgatggtgggcatgggccagaaggactccaatgtgggcgatgaggcccagagcaag

SEQ ID NO: 22695 - DNA, 201 bp, Homo sapiens
ctcttagggcaaggaagggggaagggacagtcaagaaccagaggaagaagagagacaagtgagatcctgttaagattaatccaagtgagagatgaaagtgrtttggaataggatgagggagtagagatagagaaaagtggataaattctggatgtgttttgaacacgctagaaggtaaagtgtagagcatgaggggaaaag

SEQ ID NO: 22696 - DNA, 201 bp, Homo sapiens
tgtatttttttagtagatacggggtttcaccatgttggtcaggtttttaattttttttgtatttttttagtagagatggggtttcaccatgttggtcaggttttttttgtctttttttagtagagacggggtttcaccatgttggtcaggctggtctcaaactcttgacctcaaatgatctgcttgcctcatcccccaaag

SEQ ID NO: 22697 - DNA, 201 bp, Homo sapiens; identical to SEQ ID NO: 3578

SEQ ID NO: 22698 - DNA, 201 bp, Homo sapiens; identical to SEQ ID NO: 3579

SEQ ID NO: 22699 - DNA, 201 bp, Homo sapiens; identical to SEQ ID NO: 3580
  misc_feature (1)...(201): n = A,T,C or G, or insertion/deletion polymorphism (see Tables 1-2)

SEQ ID NO: 22700 - DNA, 201 bp, Homo sapiens
agtctagtatgtcagatagctaaaaccatattttatcatagtttttctttttttggtgtgtgagatttgaaataaataagaatgttaattgttttcctaastctggtaggataaaggatcatagacttaattttccaaaacataagcttcattatattacttattctacgttatctatcaggatttaaaataaaaagtcat

SEQ ID NO: 22701 - DNA, 201 bp, Homo sapiens
agatgtgtagtaactaaaaaataataataataataataataataataataattactaagtggctctttctttcttgggatctgtgtagggccaaggcctartgagtcagattctgatgatctggatgatgaagactttgaatgtttagatagtgatgatgacttggactttgaaacacacgaacctggcgaagaggcttcc

SEQ ID NO: 22702 - DNA, 201 bp, Homo sapiens
aggtgcagtggcgcgatcctggcttactgcaagctccacctcctgggttcacgccattcatctgcctcagcctcctgagtacctgggacaacaggtacccrccaccacgcccagctaatttttttttttttttttttttttagtagagacggggtttcactgtgttagccaggatggtctcgatctcctgacctcgtgatc

SEQ ID NO: 22703 - DNA, 201 bp, Homo sapiens
tccctaatacctataccaaaataaattccaattggatcaaatatttgaacataaaaattgaaactatacaatttgaaaaaaaaccaagaaccttttataayttgaataggaaaggcctttctatgcatgacttgaaaccagaagctataaagggaagactgatgaatttgattatgcaaaaattaagcatttctgcacggg

SEQ ID NO: 22704 - DNA, 201 bp, Homo sapiens
tttttctgactgcaagaaatcccttgtgactgcctcaccactctgggccagtttccttgaaagtctgaaaaagaatgattactttaaggtaggacttgcartatatttgcttttaagtattcaatccagggaaaatcaagccagcgacttaaagtcctatagtccatatttaaatgtatgacataattatggaagctagac

SEQ ID NO: 22705 - DNA, 201 bp, Homo sapiens
aactcgtcatttatattagatatatctcctaatgctgtccctcccccctccccccaccccacaacaggccccggtgtgtgatgttcgccttcctgtgtccrtgtgttctcattgttcaattccccacctatgagtgagaacatgcggtgtttggttttttgtccttgcaatagtttgctgagagtgatggtttccagcttc

SEQ ID NO: 22706 - DNA, 201 bp, Homo sapiens
ggtagtgtcttccaagaggtatagaaaggttcaaacttggaaccttcactttgaataatctttttaaaggaaatatccaagaagtggaaaagtcccgaagmatatgatgatgataaagatggcacagcaatacgaaaagtactaatgatattatagtatatatatggtatttttttttttttgagatggagttttgctctt

SEQ ID NO: 22707 - DNA, 201 bp, Homo sapiens
caagactccgtctcaaaaaaaaaacaaaacaaaaaaaactgttacttgtgtatcaaatatatcattattagtgttgatgctcttgaacctgatgaaagatmtaaatttatatttggtattctctctttaagaaagcagggataagggaagatatgttcttgtttattttttaagctttagttcttaaaagaacaggcttta

SEQ ID NO: 22708 - DNA, 201 bp, Homo sapiens
ggtgtatatgtgccacattttcttaatccagtctatcattgttggacatttgggttggttccaagtctttgctattgtgaatagtgccacagtgaacataygtgtgcatgtgtctttatagcagcatgatttataatcctttgggcatatacccagtaatgggatggctgggtcaaatggtatttctagttctagatccct

SEQ ID NO: 22709 - DNA, 201 bp, Homo sapiens
ggatttttaaaacttaaactacaacttttcttgctgtgcctccttagaaattctatctttggtagctttcctaagaatggcaccactttagaaaagtttcraagagttgtatttagaataaattaattgtctttgtcctttaatattgcagagaaccttctgaggctccaatcacttttgatgcagattcttttcttaatt

SEQ ID NO: 22710 - DNA, 201 bp, Homo sapiens; identical to SEQ ID NO: 3587
  misc_feature (1)...(201): n = A,T,C or G, or insertion/deletion polymorphism (see Tables 1-2)

SEQ ID NO: 22711 - DNA, 201 bp, Homo sapiens
ggtctcggactcctgacctcaggtgatccatccgccttggcctcccaaagtgctgggattacaggcgtgagccaccgtgcccagctattactgttgttgttattgttgttgtatagggtcttgctttgtcacgcaagccagtgttgtggtaggatcatagctcactgcagcctcgatctcctaggctcaagtgatcctcct

SEQ ID NO: 22712 - DNA, 201 bp, Homo sapiens
gtctcggactcctgacctcaggtgatccatccgccttggcctcccaaagtgctgggattacaggcgtgagccaccgtgcccagctattactgttgttgttattgttgttgtatagggtcttgctttgtcacgcaagccagtgttgtggtaggatcatagctcactgcagcctcgatctcctaggctcaagtgatcctcctg

SEQ ID NO: 22713 - DNA, 201 bp, Homo sapiens
cattctaattattttgagatgtgtagtaactaaaaaataataataataataataataataataataattactaagtggctctttctttcttgggatctgtrtagggccaaggcctaatgagtcagattctgatgatctggatgatgaagactttgaatgtttagatagtgatgatgacttggactttgaaacacacgaacc

SEQ ID NO: 22714 - DNA, 201 bp, Homo sapiens
aagcaagtattttttctgaatgtgctgtgattatattcaatgcttgtggaattgttgggggtgtggtgggtaaccaagattctgctccagattttcttggwgcagggataatacacaattccccatggcagaaaaatacctgcaaacggtacatttcaattttcacagtgggcactggcaaactgcaggtacatatgaatg

SEQ ID NO: 22715 - DNA, 201 bp, Homo sapiens
tcttttcttaattattttgataagattttaggtaagtagtggtgtgatgttgactttcattttgaaactgttagtagtatggctgttgctagagcattggkttatgagatatctcagaagccaaaatgtttgctttctcttcctggtttgagttgctttcaaccatgaattactacccatgaataattttgtagaggctgc

SEQ ID NO: 22716 - DNA, 201 bp, Homo sapiens
ctcaccagatcagctggaccagctgctgcaggaagctgttggcaaaaaagaatccgagtctgtttccaaggaggagaaggagcagaactatgacttaactsaagtctcagagagcatgaaagctttcatatccaaagtctcaacccacaagggagcagagctgcctcggtaatttgtgttaaagtataaatatataaatag

SEQ ID NO: 22717 - DNA, 201 bp, Homo sapiens
  misc_feature (1)...(201): n = A,T,C or G, or insertion/deletion polymorphism (see Tables 1-2)
tttgcctactgcgtatatgcaatgacactgttttccttggtatgttcccagctatgccctgcaatgtttgggttctcaggacctgctcctctgctaggcangatggctttggcttgccagctggcctttgaagtttaagcagcagacatatacccttaagtagtctggtggggaactggtcacattacagttctatcattt

SEQ ID NO: 22718 - DNA, 201 bp, Homo sapiens
tttcttctttttcagatgaccagtggttagatctctcaccagatcagctggaccagctgctgcaggaagctgttggcaaaaaagaatccgagtctgtttcyaaggaggagaaggagcagaactatgacttaactgaagtctcagagagcatgaaagctttcatatccaaagtctcaacccacaagggagcagagctgcctc

SEQ ID NO: 22719 - DNA, 201 bp, Homo sapiens
taactgtacattgattttcgtgtgttgaaccatccttgcatcccaggaataaatctcgcttggtcgtggtgaataatctatttaatgtgttgttgaattcwgattgctgatattttgttaaggatttctgcattgatactcatcagggatattgatctacagctttctcatattgtctttgtctggctttggtattagggt

SEQ ID NO: 22720 - DNA, 201 bp, Homo sapiens
gcagtattatgctttcttctttttcagatgaccagtggttagatctctcaccagatcagctggaccagctgctgcaggaagctgttggcaaaaaagaatcygagtctgtttccaaggaggagaaggagcagaactatgacttaactgaagtctcagagagcatgaaagctttcatatccaaagtctcaacccacaagggag

SEQ ID NO: 22721 - DNA, 201 bp, Homo sapiens
ttttaaatatacaaaatactatacaggctgggcgcagtggctcacacctgtaatgccagcattttgggaggccaaggcgggtggatcacgaggtcaggagytcaagaccagcctggccaatatggtgaaaccctgtctctactaaaaattcaaaaattagctgggcgtgttggcacgcccctgtaatcccagctgctcggg

SEQ ID NO: 22722 - DNA, 201 bp, Homo sapiens
aaagaaagataatggaaggcttcagggaggaggtatttgagttaagtcttaaagaatgaggattttttttctttttatggagtctcttttttttttgagamggagtcttgctctgtgcccaggttggaggtgcagtggcgcgatcctggcttactgcaagctccacctcctgggttcacgccattcatctgcctcagcctc

SEQ ID NO: 22723 - DNA, 201 bp, Homo sapiens
ctggcttactgcaagctccacctcctgggttcacgccattcatctgcctcagcctcctgagtacctgggacaacaggtacccaccaccacgcccagctaatttttttttttttttttttttttagtagagacggggtttcactgtgttagccaggatggtctcgatctcctgacctcgtgatccgcccgccttggcctccc

SEQ ID NO: 22724 - DNA, 201 bp, Homo sapiens
tgggttcacgccattcatctgcctcagcctcctgagtacctgggacaacaggtacccaccaccacgcccagctaatttttttttttttttttttttttagkagagacggggtttcactgtgttagccaggatggtctcgatctcctgacctcgtgatccgcccgccttggcctcccaaagtgctgggattacaggcgtgag

SEQ ID NO: 22725 - DNA, 201 bp, Homo sapiens
tttagatagtgatgatgacttggactttgaaacacacgaacctggcgaagaggcttccctgaaaggaacacttgataatctcaagtcatacatggcccagatggaccaggaactagcacacacctgcatcagcaaaagtttcaccactaggaaccaagtggtatgtgtgtttttaacctctttctctttctgagtctagta

SEQ ID NO: 22726 - DNA, 201 bp, Homo sapiens
aattgtgcaaccatccctaccatctaattctagaatattagaaaccccatactcactaatagtctctcattcccttctactcccagcccctagaaaccacwagtctactttctgtctctatggatttgcctattttggatatttcatacctgatactgtacttaattgttttaattaattaattggtttgatatttaatat

SEQ ID NO: 22727 - DNA, 201 bp, Homo sapiens
ttccctctatgaataaggaacctgtatcccagactaccgataacaattcagatgaggaagattctggtacgggagaatctgttatggcaccagtagatgtwgacctgaacctggtttcaaatatattggaatcctatagctcccaagctggactggcaggacctgcttccaatcttttacaaagcatgggagtgcagctgc

SEQ ID NO: 22728 - DNA, 201 bp, Homo sapiens
aaaacaaacaaaaatcaaagaaagactgaactacacgaaaccaaaaggttccttaattagcaatgaaagtgatatttttcttaccctctgatgcgcctatrcacagcagctcgtatagattctgaagcaagtattttttctgaatgtgctgtgattatattcaatgcttgtggaattgttgggggtgtggtgggtaaccaa

SEQ ID NO: 22729 - DNA, 201 bp, Homo sapiens; identical to SEQ ID NO: 3582

SEQ ID NO: 22730 - DNA, 201 bp, Homo sapiens
tgggagaccgagatgggtgaatcacctgaggtcaggagtttgagaccaacctggccaacatggtgaaaccccatctctactacaaatacaaaaaattagcyggatgaggtggtgggcacctgtaatcccagctactcaaattaaaaataaataaatagccaggcacagtggctaatgcctgtaatcccagctacttgctga

SEQ ID NO: 22731 - DNA, 201 bp, Homo sapiens; identical to SEQ ID NO: 3583

SEQ ID NO: 22732 - DNA, 201 bp, Homo sapiens
tcacagcacattcagaaaaaatacttgcttcagaatctatacgagctgctgtgaataggcgcatcagagggtaagaaaaatatcactttcattgctaattmaggaaccttttggtttcgtgtagttcagtctttctttgatttttgtttgttttccttaaagctctgttggagttgatcagtctttctttgactataaaat

SEQ ID NO: 22733 - DNA, 201 bp, Homo sapiens
  misc_feature (1)...(201): n = A,T,C or G, or insertion/deletion polymorphism (see Tables 1-2)
gacacagtggagtactgcctgttcctgataccagatgagtcaagggactcagataaacataaagagattcttcagaagtacattgagagaataatcactcngtttgcacctatgctggtcccctacatctggcagaatcagcctttcaatcttaaatataaacctgggaaaggtaaggctcttttacttgtttggattagt

SEQ ID NO: 22734 - DNA, 201 bp, Homo sapiens
aatctcagctactttggaggctgaggcaaggagaatcgcttgaacccgggaggcggaggttgcagtgagctgagatcacgccactgcactccagcctgggygacagtaggaaactccatctcaaaaaaaaaaaaaaaaaaaaaagtagaaacctaatggagcacaaacaaggtgctcaggttttttctgttgttctgggtc

SEQ ID NO: 22735 - DNA, 201 bp, Homo sapiens
aaactcctgacctccagtgatctgcctgtctcggcctcccaaagtgataggattacatgcatgaaccactgtgcccggcctaactaaattttagaaaacartgttcatagaaccatctaaaagagttcagatgttacttctgcattgttctatgtggtttatattttggaactttaaacatagttttcaaagaagaatgga

SEQ ID NO: 22736 - DNA, 201 bp, Homo sapiens
accatttgtagaagggatttttgtgaagtagactgactgtgtgtattagtctttttctgtgggtaacattctaattattttgagatgtgtagtaactaaawaataataataataataataataataataataattactaagtggctctttctttcttgggatctgtgtagggccaaggcctaatgagtcagattctgatga

SEQ ID NO: 22737 - DNA, 201 bp, Homo sapiens; identical to SEQ ID NO: 3586
  misc_feature (1)...(201): n = A,T,C or G, or insertion/deletion polymorphism (see Tables 1-2)

SEQ ID NO: 22738 - DNA, 201 bp, Homo sapiens
agctttcctaagaatggcaccactttagaaaagtttcaaagagttgtatttagaataaattaattgtctttgtcctttaatattgcagagaaccttctgargctccaatcacttttgatgcagattcttttcttaattattttgataagattttaggtaagtagtggtgtgatgttgactttcattttgaaactgttagta

SEQ ID NO: 22739 - DNA, 201 bp, Homo sapiens
ccatgcaacctaatgatacattagcccataattttcttttccctctatgaataaggaacctgtatcccagactaccgataacaattcagatgaggaagatkctggtacgggagaatctgttatggcaccagtagatgtagacctgaacctggtttcaaatatattggaatcctatagctcccaagctggactggcaggacc

SEQ ID NO: 22740 - DNA, 201 bp, Homo sapiens
taatacctcacaaacagaggcagccaaaacaaaaatggacaaatgggagcacatcaagttaaaaagcttctgcacagcaaaggaaacaatcaacaaagtgragagagaacccacagaatgggagaaaatatttgcaaactacccatctgacaagggattaataaccaaaatatataaggagttcaaacaactctctaggaa

SEQ ID NO: 22741 - DNA, 201 bp, Homo sapiens
gatcatttggttgtcttgttttaccctgagctcctcaggagtaggcttcttcttcaggattgcaacccctgctccccagtacttagagcaatcagtcaatkaatgtgtattcagttgaatgattatgtgcattttatttgcagtaacaaatttatctggttacatggttgcttttctcttgtttttaggaggtgttcctgc

SEQ ID NO: 22742 - DNA, 201 bp, Homo sapiens
gtgcagtcactatggagaacagttttggagattcctcaagaaactaaaaatagagctactatatgatccagcagtcccactgttgggtatttacccaaaaraaaggaaatcagtatatcaaagagatatctgcactcccatgtttatcgcagcactattctcagtagccaagatttggaagcaacctaagtgtccatcaac

SEQ ID NO: 22743 - DNA, 201 bp, Homo sapiens
ctgcacactcctgttctagagttcattatcttgttttgagatcatttggttgtcttgttttaccctgagctcctcaggagtaggcttcttcttcaggattrcaacccctgctccccagtacttagagcaatcagtcaatgaatgtgtattcagttgaatgattatgtgcattttatttgcagtaacaaatttatctggtta

SEQ ID NO: 22744 - DNA, 201 bp, Homo sapiens
agagttcagatgttacttctgcattgttctatgtggtttatattttggaactttaaacatagttttcaaagaagaatggaagaaaccatgaagcttgctamgatggaagacacagtggagtactgcctgttcctgataccagatgagtcaagggactcagataaacataaagagattcttcagaagtacattgagagaata

SEQ ID NO: 22745 - DNA, 201 bp, Homo sapiens
acgcttttccacaacattaaatgcacacatatctgccagcattaccatttgtagaagggatttttgtgaagtagactgactgtgtgtattagtctttttcygtgggtaacattctaattattttgagatgtgtagtaactaaaaaataataataataataataataataataataattactaagtggctctttctttcttg

SEQ ID NO: 22746 - DNA, 201 bp, Homo sapiens
ctatctttggtagctttcctaagaatggcaccactttagaaaagtttcaaagagttgtatttagaataaattaattgtctttgtcctttaatattgcagaraaccttctgaggctccaatcacttttgatgcagattcttttcttaattattttgataagattttaggtaagtagtggtgtgatgttgactttcattttga

SEQ ID NO: 22747 - DNA, 201 bp, Homo sapiens
tggtctcggactcctgacctcaggtgatccatccgccttggcctcccaaagtgctgggattacaggcgtgagccaccgtgcccagctattactgttgttgttattgttgttgtatagggtcttgctttgtcacgcaagccagtgttgtggtaggatcatagctcactgcagcctcgatctcctaggctcaagtgatcctcc

SEQ ID NO: 22748 - DNA, 201 bp, Homo sapiens
tggcaagtagatgagtttattaggacttacagacaagacactcctgggcagcatcaggacagctctagaaatccaccccacctcccatatttaagttgctwgtaagctaattttttggctctttgcctactgcgtatatgcaatgacactgttttccttggtatgttcccagctatgccctgcaatgtttgggttctcagg

SEQ ID NO: 22749 - DNA, 201 bp, Homo sapiens
gagcctagactggggaaagagcactagactccaagtcaagcccctgctgcttggtcgcttctttttctgtactctgggttttctcatatgtacagtgaggyattagcctgagtgatcatagagtcccttccagttctgacaccaaattctgcatgatgacgtgtgtttggcgttatggggtggatgggtaaaattactgtc

SEQ ID NO: 22750 - DNA, 201 bp, Homo sapiens
cttgggaataagtttatatttttcataaaattcaaaaagtgttataattgtccaaatgcccatgtatccagtcatctagttctagagtgtggctcaatggraaaaaagtaatgtgttataataagatacgggaaaaaaggaacttagtaacaaaaattctacctatctcatctaggctcatggatttgagatcttatgctc

SEQ ID NO: 22751 - DNA, 201 bp, Homo sapiens
gcggtcaggggcctgtggaaccctagaggatggagcaggtggacagcaggggtgggcaaccctgccagctgggtactagggctattggggctggagggtcyaccccactgtactctagccacaaggctgtggggtggctgctttgcccaccagctgtccccctgataggggatctgggctgcaatacttctgtatcctccc

SEQ ID NO: 22752 - DNA, 201 bp, Homo sapiens; identical to SEQ ID NO: 3629

SEQ ID NO: 22753 - DNA, 201 bp, Homo sapiens; identical to SEQ ID NO: 3630

SEQ ID NO: 22754 - DNA, 201 bp, Homo sapiens; identical to SEQ ID NO: 3631

SEQ ID NO: 22755 - DNA, 201 bp, Homo sapiens; identical to SEQ ID NO: 3632

SEQ ID NO: 22756 - DNA, 201 bp, Homo sapiens
ttacagtctctcaaacactgtggtactttctatctgcatttagtaagggggagaaaaaacaagtataaagtggaccagcgcagctactagtgttcaagggyaaccttagtttacctattataaaacaagtgacttaatatatttaataccacaaaataacatatttattgtgtaattctgagttctcttgggaaataacta

SEQ ID NO: 22757 - DNA, 201 bp, Homo sapiens
ccggtcccgtagcaggtcgcgctctcggggaaggtcgtactgcggaagggcgtacgcgatcgcgcggggacagcgctactacggctttggtcgcacagtgyacccggaggagcacagcagatggagggacagatccaggacgaggtcgcggagcagaaccccctttcgcttaagtgaaaaaggtgggtgggtcatttacct

SEQ ID NO: 22758 - DNA, 201 bp, Homo sapiens
gatgtatataatgtgctaaattcaaagtagcaaatctgaagataggcaatgtcaaacccatgaaaatgggagattaatgagctttatttggccgtgcatgrtgcctcatgcctgtaatgaggcagatggcttgagtccaggagttcaagactagcctgggcaatgtggcaaaaccgcgtgtttacaaaaaatacaaaaatt

SEQ ID NO: 22759 - DNA, 201 bp, Homo sapiens
ggctaaagcatcagaggtttaatttgaagtttatgttcacacactgaaaacttagtttttttgttggtagatccatgtgcatgctagaatttgggacaggyactatttgcataaagtattaaagtcaatttttaaactaagcaaaggtacacgttgtaacggtggggcatctgtgaaaaagatgtccctttcataatatat

SEQ ID NO: 22760 - DNA, 201 bp, Homo sapiens
aaagcagggactaaaagccccacttcgtcttacgttccgaaaggaaggcgtctgttgagcctttctctcagtcgtgagggaggcgtcgacggcgtgcggtwagttttctgctgacggggtctctcaggaccaccgcagtggtctctcaggagtgagggacgggaaacgtgccgggccccgcgtttggggaacgcagcgttt

SEQ ID NO: 22761 - DNA, 201 bp, Homo sapiens; identical to SEQ ID NO: 3644

SEQ ID NO: 22762 - DNA, 201 bp, Homo sapiens
ggatttagaaaccaagggtatgtgttttaaaattacactttttcttaacctgtctagctgtcggaaaaggtaacagaagatggaactcgaaatcccaatgraaaacctacccagcaaagaagcatagcttttagctctaatgtaagtatatccaggcattgaacactcaaaaattggatttaggatgtatttttgcatctt

SEQ ID NO: 22763 - DNA, 201 bp, Homo sapiens
ggtcgtactgcggaagggcgtacgcgatcgcgcggggacagcgctactacggctttggtcgcacagtgtacccggaggagcacagcagatggagggacagmtccaggacgaggtcgcggagcagaaccccctttcgcttaagtgaaaaaggtgggtgggtcatttacctttccatttgtggtaatgtatggtggcagtata

SEQ ID NO: 22764 - DNA, 201 bp, Homo sapiens
ggcatggtggtgcatgcctgtagtcccagctgtttgggaggctgaggcaggaggatctttgagcctaggatgctaaggttgcagtgagccaagatggcaccattgcactctagcctgggcagcagagcgagaccctgtctcaaaaaatacatttatttttttcattttcagttaacagtgtactcttataacaccgttatt

SEQ ID NO: 22765 - DNA, 201 bp, Homo sapiens; identical to SEQ ID NO: 3648

SEQ ID NO: 22766 - DNA, 201 bp, Homo sapiens; identical to SEQ ID NO: 3653

SEQ ID NO: 22767 - DNA, 201 bp, Homo sapiens; identical to SEQ ID NO: 3654

SEQ ID NO: 22768 - DNA, 201 bp, Homo sapiens; identical to SEQ ID NO: 3655

SEQ ID NO: 22769 - DNA, 201 bp, Homo sapiens; identical to SEQ ID NO: 3656

SEQ ID NO: 22770 - DNA, 201 bp, Homo sapiens
aatgacacatatgttggaattacctgacaaagattttaaagaaaacatcataaaaattcaccaatgagtaaagagaaacatgcttcaaacaaatgaaaaarccccagcaaaaccactggagacatgaaccaaatggaaattttagaatcgcaactgataataactggaagttcttaaatttcgtattagagggccgggcat

SEQ ID NO: 22771 - DNA, 201 bp, Homo sapiens
tgggttcaagtgattctcctgcctcagcctcctgagtggctgggattacaggcgcacaccatcacgcccggctaatttttttttttttttgagaccgtttsgctcttattgcccaagctgcagtgcaatggcacaatctcggctcactgcaacctccgcctcctgggttcaagtgattctcctgcctcagcctcctgagta

SEQ ID NO: 22772 - DNA, 201 bp, Homo sapiens
ttgctgtctctacaaataattttaaaaattagcctcgtgtggtggtacacacctgtggtcccagctactcaggaggctgaggtgggagcatcactgatccyaggaggttgaggccacagtgagccgtgtgattgggccactgaactccagactgggtggcagagcgagacactgtctcaaaaaaaaaattaaaagactgta

SEQ ID NO: 22773 - DNA, 201 bp, Homo sapiens
aggaggctgaggtgggagcatcactgatcccaggaggttgaggccacagtgagccgtgtgattgggccactgaactccagactgggtggcagagcgagacrctgtctcaaaaaaaaaattaaaagactgtaattaaagatagccttttgtataagcattcatttttgtactaattgtatcagcttcaccaatgtgtaatac

SEQ ID NO: 22774 - DNA, 201 bp, Homo sapiens
gcattctctgtctcctctctctcctcctttgaccttctcctcgaccagccatcatgacatttaccatgaatttacttcctcccaagagtttggactgcccrtcagattgttgctgcacatagttgcctttgtatctctgtatgaaataaaaggtcatttgttcatgtttgtgtttttctcagtttcattgttaacagttcc

SEQ ID NO: 22775 - DNA, 201 bp, Homo sapiens
ggctgaagtacagtggtgcagtcatagctcactgcagcctcaaattcctaggctcaagtgatcctcctgagttgtttttttttttttttaatagagatggrgtctcactatgttgcccaggctggtctcgaactcctggcctcaagccatcctcctcctttagccttccaaagtgctgggattgcaggactgagccactgc

SEQ ID NO: 22776 - DNA, 201 bp, Homo sapiens
ggttattgtagccttgtagtatagtttgaagtcaggtagcatgatgcttccagctttgttcttttggcttaggattgtcttggcaatgcgggctctttttkggttccatatgaactttaaagtagttttttccaattctgtgaagaaagtcattggtagcttgatggggatggcattaaatctataaattaccttgctcag

SEQ ID NO: 22777 - DNA, 201 bp, Homo sapiens
tgtggtgtctgcagaatgtttgaaagcagaggcaaggctcgagcatgattccaccttgtgacaaagtgacacaaagaattagcaaggatttactaagcackggtcttgttgtattagtatagttataacatttatacagctatgtttttaataaaattaaatggcttccatgtctcaaaatgtggtagagaaaaatgactt

SEQ ID NO: 22778 - DNA, 201 bp, Homo sapiens
tctcgtcacactgtatgtgttaggtgattcaagtattatcttagacttgcatcatcttatatttgtattatttccccccaatatctcctctctttattacrctgactctttccaccctcccaaaacttcaggggaaagctctggcaatttaaatgacccaaataaggaggcactggctaagacggaagtgtctctcaccct

SEQ ID NO: 22779 - DNA, 201 bp, Homo sapiens
cagaaatgtttaataattgtctcattcatatatatatatatatgtatatatatatatgtatatgtatatatatatatgtatatatatatatatatataatktttgagacagagtttgtatatataatttttgagacagagttttgctctgttgcccaggttggagtatggtggcacgatcataactcactgcagccttgac

SEQ ID NO: 22780 - DNA, 201 bp, Homo sapiens
ttgtaaacattttgttaacaaggcacgtcctgcacagccctggatcacttaaaccttgattttatacaacacatgtttttgtgagctccaagttgggtcamagtggttgggtcaaagtggctggggcaaagctacaaattaacaacatctcagcaaagcaattgtttaaagtacaggtctttttcaaaatggagtctctta

SEQ ID NO: 22781 - DNA, 201 bp, Homo sapiens; identical to SEQ ID NO: 3677

SEQ ID NO: 22782 - DNA, 201 bp, Homo sapiens
tctgggacttacaacatagtttgatttacttactttagacattcgtggatttgtttagcaataattgcttgttaacaatcttttgtgtttctatgcctccrttttaattatttatcttcagtcagccgcttgttcctacactgacagtagcatcatagtagtctgtttggctacagtttcactctttcaccctattacatg

SEQ ID NO: 22783 - DNA, 201 bp, Homo sapiens
attcacaggattctgtggctcagtggttgaaaactgttgccatggtccgggtccagtggctcacacctgtaatcccagcactttgggaggctgaggtgggyggatcacttgaggtcaggagtttgagaccagcctggtcaatatgacgaagccccgtctctactaaaaatacaaaaattagctgggcatggtggtgcatgc

SEQ ID NO: 22784 - DNA, 201 bp, Homo sapiens
  misc_feature (1)...(201): n = A,T,C or G, or insertion/deletion polymorphism (see Tables 1-2)
tgtcatttatattgaaaatgagtcattctatgttacttctttcctgtttagtacttgtgtttcagatctgacatcacctttttaaaaattttgcatttgantgagatttgctaaagcagttctggggttaaacttgaagagaaaatattgaatatttatatttaatatcccatgtgagaggagagattaagaaccctgttg

SEQ ID NO: 22785 - DNA, 201 bp, Homo sapiens
tgcctggagtcccagctactcaggaagctgaggcaggagaattgcttgaacccgggaggcggaggttgcagtgagctgagatcatgccactgcactccagsctgggcaatagagtgagactttgtctcaaaagaaaaaagaagaaaaggaaaaaaaaaccattgccataaatgatctttagttacctatgtttccgttggt

SEQ ID NO: 22786 - DNA, 201 bp, Homo sapiens
cttatttaatcctcaatgacaaaccttggaagatcctgttagccttttttaacaaatgaaagaactggtcaagtggcttgctgtctttctcggtaagtgcsagagacaggacatggaaccagatctttccaagtccatggccagtgctactcacattatgcttttatttttacgttctcttgctccaggaggcagcttagg

SEQ ID NO: 22787 - DNA, 201 bp, Homo sapiens
tgttcagtttaagcttctccaaggagaatggaaataaagcttaaaatctctaaggaaaagttctgaccttccctttctttttttgcatcctctctcctttkgtgcaggtggatggaagcatgcctaggggaagatctgcctcccaccacagaactggaggaggggcttaggaatggggtctaccttgccaaactggggaac

SEQ ID NO: 22788 - DNA, 201 bp, Homo sapiens
ggggccgacccaaagtgatcactggctctcacatgagacccaggagcctccccagtttgaagcccgatatcacatttcccagaatacttgatgccctcgcrcgcctcctctggctatcaaccagacggaaaggggatgtgcctgggagtttgatgccaagggaaggatgcggaatgtctgttttctactaagggcttctgc

SEQ ID NO: 22789 - DNA, 201 bp, Homo sapiens
tgtatacaaatatgtatattatatagataaatatatgacttatacaatatattacaatatagaatatattgtaatataattttacaatattatataatatmcaatatataattacatattgtaatatataatcatatatacaatatattatatattatatatacacaatatattacaacatgtaattatatattacgtata

SEQ ID NO: 22790 - DNA, 201 bp, Homo sapiens
ggcagaggttgcagtgagctgtgatggtgccattgcactccagcctgggcgacagggcaagactctgtctcaaaataaataaataaataaataaataaatwaattcagttatagcaagtgctgaagtctttctgtcttttcatgctccttgaagtcctttcacagtttttcctggctcttctacgcctcctctcggccacg

SEQ ID NO: 22791 - DNA, 201 bp, Homo sapiens
ttatacaatatattacaatatagaatatattgtaatataattttacaatattatataatatacaatatataattacatattgtaatatataatcatatatmcaatatattatatattatatatacacaatatattacaacatgtaattatatattacgtatatagtatattgatatgtatacaatatacaacagatatgca

SEQ ID NO: 22792 - DNA, 201 bp, Homo sapiens; identical to SEQ ID NO: 3658

SEQ ID NO: 22793 - DNA, 201 bp, Homo sapiens
aaaaattacttaggattttgataccttttatggtttatttccccttttggcctgtgaacttcatgaaggtaatggttatgtatgattcccgagtaatcacrgttcccagaacgatcttttttttttttctttctttttttcttttttgagacggagtcttgctctgtcgctcaggatggagtccagtggcgcgatctcggc

SEQ ID NO: 22794 - DNA, 201 bp, Homo sapiens
tatcaagttcagacttgtctgactttcaagttgcttataataatctgattttatcctacctatccaaccttatttttctgttattttctagaacgtattcygtagattttaaaaaacaatagggtatattgccttactgtctcacaaacacatcatgattatttttgctttatttattctggctatttctcttatttggaa

SEQ ID NO: 22795 - DNA, 201 bp, Homo sapiens
ggtatatgtccagtaagaactaaattttgggggaggtgaattgaacatgatctgttatttttaaatgctgttataacaagtagtcctgacactacatggarttaggttgaattgcacaggttgtaggcatggtcctccacaagactcctctcacttcagacacaagctgaaagctgcagggttcccaggccactgtacttc

SEQ ID NO: 22796 - DNA, 201 bp, Homo sapiens; identical to SEQ ID NO: 3663

SEQ ID NO: 22797 - DNA, 201 bp, Homo sapiens
attactgttatttattagctgtagcattctctgtctcctctctctcctcctttgaccttctcctcgaccagccatcatgacatttaccatgaatttacttyctcccaagagtttggactgcccgtcagattgttgctgcacatagttgcctttgtatctctgtatgaaataaaaggtcatttgttcatgtttgtgtttttc

SEQ ID NO: 22798 - DNA, 201 bp, Homo sapiens
atctgggatttacagtaactctaaggccaggaataaagatcatagagattggagggagaaaagcttcccctcttcagttctatttataatacctctacttytactaaaagctccaccttttagtacagtggccccattgtgtatcctagggcactccattttctcctctgcctgtaacagagctctttcttgggaaaagag

SEQ ID NO: 22799 - DNA, 201 bp, Homo sapiens
ggcgtgttctcagctcactgcaatctccacttcccaggttcaagcgattctcctgcctcagcctcctgagtagctgggactacaggcggctgccaccacayctggctaattttttgtgtttttagtagagacggaatttcaccatgttaggcaggtctcaaactcctgacctcaagtgatccgcccacctcggcctcccaa

SEQ ID NO: 22800 - DNA, 201 bp, Homo sapiens
aagatgtacaaaaactagccgggtgtgctgatcccagctacccagaggagacgggagaattgcttgaacccggaagccagaggttgcaatgagctgagatygtgccattgcactctagcctgggcgacaaagcgagactccatctcaaagaaaaattttttttaataaagtcttcataaagctaaatttataaaaaagcta

SEQ ID NO: 22801 - DNA, 201 bp, Homo sapiens
ttcctgtgtagaatttccaggcctagtgtaatctcccagccggagcagaaagaagagccatgggtcctaccactccaaaactttgaggcgaggaagatccygagggaaagccacacaggtgagatgtgagtgctccccagtggaaggaaatctagcatttcagccttgtttagatgaagaatttggaatgctgccttagaa

SEQ ID NO: 22802 - DNA, 201 bp, Homo sapiens
aacatcataaacagaaactttccttaaacaaaaagacttatatgttcagtgggttttttttgttgttggttggttggttggtttttgttttgagacagggwcttgctgtgtcacccaggctagagtgcagtaatgccatcatggctcactgcagccctgacctccctaggctcaagcaatcctcccacctcagcctcccta

SEQ ID NO: 22803 - DNA, 201 bp, Homo sapiens
attaacatatataaaacataataatgttaacacataacactaaatgttcgggtatgttgaaaaaagctttataactatctttccctttccattccagcaarcatctgttgtgggcaaagcaagagggagagtggggagtgagatgacacaaagatgccaatttagtaattttaaaatttaagcttatttgggtgggtgttt

SEQ ID NO: 22804 - DNA, 201 bp, Homo sapiens
atagacatacaaatgagtacttttagggcagcttgattagagcaagatgccaagagcacatgtggtgcagtcatagaataaagaagggaatgatgacttckgcttagaagtttgagcaggttttcagtgtacatggatcttcacagggatccttaggatagataagagggtgaggataaggcagaattccctataaaagga

SEQ ID NO: 22805 - DNA, 201 bp, Homo sapiens
  misc_feature (1)...(201): n = A,T,C or G, or insertion/deletion polymorphism (see Tables 1-2)
agtctagtttgttatctacattgattttattttctgtccctagctactatgaaagctccttgaggacaggatatttgtttttttcacaattatatttgcancatatagcagatcctcagtaaatatcattgaaggaatggatgattagttggctaacagccacatatacctgcagacatgacttgagaagccaccaccttg

SEQ ID NO: 22806 - DNA, 201 bp, Homo sapiens
gtggaaagtttaaaattgcaacagcatttaaccttttttgaccagcatactgttgttgagcacatagactgtgccccttagggggttcctatgtcacttgsaagtcaccagaaaagactaggggatgttgaatgtggaaaaagtaaatcacagcagtaaaaaaagaagaaaaggggccggcgtagtggctcacacctgtaa

SEQ ID NO: 22807 - DNA, 201 bp, Homo sapiens
cgcctcccaggctcaagcaattcccatgcctcagcctcccaagtagctgggattacaggtgtgcaccaccacacgtggctaatttttgtatttttagtagagacaggatttctccatgttggacaggctgctcttaaactcctggcctcacaagtgatccaactgccttggtctcccaaagtgctgggattacaggtgtga

SEQ ID NO: 22808 - DNA, 201 bp, Homo sapiens
ctgtcatccaggctggagtgcagtggcgcgatctcgattcactgcaatctgtgcctcctgggctcaagcgattctcccacctcaacctcctgagtagctgsgatcacaggcatgtgccaccatgcctagctaattttttgtgtttttagtagagacaggattttgctatgttggcaaggctggtctcactatgctgtccag

SEQ ID NO: 22809 - DNA, 201 bp, Homo sapiens
ggcagatcacgaggtcaggagtttgagatcagcttgaccaacatggtgaaaccatgtctctactaaaaatacaaaaattagccaggcgtggtggctcatgygtgtagtcccagctattcaggaggctgaagcagaaaaatcccctgaacctgggaggtggaggttgccgtgagccaagattgtgccactcactccagcctg

SEQ ID NO: 22810 - DNA, 201 bp, Homo sapiens
aggaggaccacttgagctctggagttccagaccagcctgggcaacataatgagaccctgtctctacaaaaagttacattaaccaggtgtaggggcttgtgyctctggtcccagctacttgggaggctgaggtgagagaatcgcttgagccaggagctcgaggatgcagttaactgtgattgtaccagtgctctccagcctg

SEQ ID NO: 22811 - DNA, 201 bp, Homo sapiens
tatagttggcccatggtagcactagtgggagggatagtgttgttgacaaagaagaataaggcgtcctcaggtctcaggtggattctcttccggattaaaasgtagaactggccatcggtaaggtcggagggcactaggtacttcctcctgtccagatcaggcacccttgcttttggagccttctctacaatcaaggggacc

SEQ ID NO: 22812 - DNA, 201 bp, Homo sapiens
tcaaatatcatggctacccttcctcctgctttacttctttctttcttttttttttttgtggcagagtctcgctgtgtcgcccaggctggagtgccatggcrtgatctcggctcactgcaacctctgcctcctaggttcaagcgattcctggataattttttgtatttttagtagagatgggttatctccatgtggtcaggc

SEQ ID NO: 22813 - DNA, 201 bp, Homo sapiens
tcctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttttccaagaaa

SEQ ID NO: 22814 - DNA, 201 bp, Homo sapiens
gaattgcttgaacctgggaggcataggttgcagtgagctgagatggtgccactgtactccagactgggcaacagtgagactctgtctcaaaaaaaaaaaawtatttttctatttttttaaagtaacattatatttttgtttttcctttaaagaataatgcaagctgtctagaaataaaaaataaaccacaaaaattagact

SEQ ID NO: 22815 - DNA, 201 bp, Homo sapiens
acaaatcaaggtgagatttgtgtggggacacagccaaaccatatcagtgtgccaaccttacaattccccttggcattgacctagtagaggttctctgtgarggctccacccctgcagcagtcttctgcctggacacccagacttgtccatacatcctctgaaatcaaggtggagggtggcaagcctcaagtcttgtgctct

SEQ ID NO: 22816 - DNA, 201 bp, Homo sapiens; identical to SEQ ID NO: 3669

SEQ ID NO: 22817 - DNA, 201 bp, Homo sapiens
cctggccctgacgcttaatttggccagactttcatcttctcccagcctcaagttttacctacctcacaaggttgttgtgaggatctaaaaatacacacacacacacacacacacacacacacacacacactttgttggttaactataaatgtaatatctctatgttataattctgttgctaatgtcttttttccaagaaaa

SEQ ID NO: 22818 - DNA, 201 bp, Homo sapiens
gaaataaaaaataaaccacaaaaattagactccttcacttagaaataatcatcacttaggaataatcattactggcatttttttgtatgtccttcaaaackgtgtgtgtgtgtgtgtgtgtgtgtgtgtgtgtgtgtatatatatatttttttttttctttaagagacagagttacactttgttgtttaggctgcagttgc

SEQ ID NO: 22819 - DNA, 201 bp, Homo sapiens
agtagaggttctctgtgagggctccacccctgcagcagtcttctgcctggacacccagacttgtccatacatcctctgaaatcaaggtggagggtggcaarcctcaagtcttgtgctctgtacaccgcaggcttaacactacatggaagccaccaaggcttttggcttccaccatctggaactgcagcccaagctgtactt

SEQ ID NO: 22820 - DNA, 201 bp, Homo sapiens
cttagaaataatcatcacttaggaataatcattactggcatttttttgtatgtccttcaaaactgtgtgtgtgtgtgtgtgtgtgtgtgtgtgtgtgtgtrtatatatatttttttttttctttaagagacagagttacactttgttgtttaggctgcagttgcgattatggtttactgcagcctcaaactcttgggctca

SEQ ID NO: 22821 - DNA, 201 bp, Homo sapiens
tagaaataatcatcacttaggaataatcattactggcatttttttgtatgtccttcaaaactgtgtgtgtgtgtgtgtgtgtgtgtgtgtgtgtgtgtatrtatatatttttttttttctttaagagacagagttacactttgttgtttaggctgcagttgcgattatggtttactgcagcctcaaactcttgggctcaaa

SEQ ID NO: 22822 - DNA, 201 bp, Homo sapiens
gaaataatcatcacttaggaataatcattactggcatttttttgtatgtccttcaaaactgtgtgtgtgtgtgtgtgtgtgtgtgtgtgtgtgtgtatatrtatatttttttttttctttaagagacagagttacactttgttgtttaggctgcagttgcgattatggtttactgcagcctcaaactcttgggctcaaacc

SEQ ID NO: 22823 - DNA, 201 bp, Homo sapiens
taatcatcacttaggaataatcattactggcatttttttgtatgtccttcaaaactgtgtgtgtgtgtgtgtgtgtgtgtgtgtgtgtgtgtatatatatwtttttttttttctttaagagacagagttacactttgttgtttaggctgcagttgcgattatggtttactgcagcctcaaactcttgggctcaaaccatcc

SEQ ID NO: 22824 - DNA, 201 bp, Homo sapiens
aatcatcacttaggaataatcattactggcatttttttgtatgtccttcaaaactgtgtgtgtgtgtgtgtgtgtgtgtgtgtgtgtgtgtatatatatatttttttttttctttaagagacagagttacactttgttgtttaggctgcagttgcgattatggtttactgcagcctcaaactcttgggctcaaaccatcct

SEQ ID NO: 22825 - DNA, 201 bp, Homo sapiens
atcatcacttaggaataatcattactggcatttttttgtatgtccttcaaaactgtgtgtgtgtgtgtgtgtgtgtgtgtgtgtgtgtgtatatatatatwtttttttttctttaagagacagagttacactttgttgtttaggctgcagttgcgattatggtttactgcagcctcaaactcttgggctcaaaccatcctt

SEQ ID NO: 22826 - DNA, 201 bp, Homo sapiens
gcttgctgaggaaaatgaagttggggagaatcaaaagctttccagaaatcaaattacacctgccaactctctcctttgtttaccttgttcatcgtggacamtttgttcctcaaaaagtcaatgtgtctaaaagactgggttctgtcgatgtgtttgggaggcctaggcctctcttagtaatgggaaagttggccaggagaa

SEQ ID NO: 22827 - DNA, 201 bp, Homo sapiens
caaacaggcggttccgggggaccggtagctggggaattgggtttagcactttccaacgcttggaactggacatccacggctccgagtcctttgaggtcttsctcgggactacgtttcccagaaggctaggcgataattgacagctctatcagcctatggacagagaaaaattctagccatggaaactgaaaagccaatagc

SEQ ID NO: 22828 - DNA, 201 bp, Homo sapiens
gaacagaactagacaatggaaatctgcttaataggaggatagtttcttatataacaataagaaatttccaaacggtgtctgagctgctttgggaaaacccrtgttgcagattttcaggtttagactgtgtaacagtttaatggaagattgttatgttctaacctaagtattttctcgttatttaaaaacaatttttatttc

SEQ ID NO: 22829 - DNA, 201 bp, Homo sapiens
ggtggtcccagggtttcagctgatctgtgaccctctgaccgccgcaccccggttagggcgcgagcaccgagaagaagaacggggttcggccccacgcgtgyagtcatgttcctattaataaacccggtgaacgcactggagcttctcacagtggcacttagtcacagcccctcagcgctgtggggcctttgaggtcacctg

SEQ ID NO: 22830 - DNA, 201 bp, Homo sapiens
acatgaacatcctcacccattcaagatacacttccttactcctagataccctgattgttttcccctctttgttctttcaaggaaaatttcctatattcactttttttttttttttttttttagataaggtctggctctatcactcaggctggagtgcagtggcacgatctcggttcattgcaacctccacctcccggcttc

SEQ ID NO: 22831 - DNA, 201 bp, Homo sapiens
agttttaaaccagagagatggtttttagatccttaaaaactcaatactttataaatgaccaataataatgtctgtaaatacaaaaatatttcccccaaaaktgtgtgtgtgtgtgtgtgtgtgtgtgtgtgtgtgtgtgtgttccagtagtaaataggtgatttgtagtgggacaaaagatgtgaaagagtaaaacttctt

SEQ ID NO: 22832 - DNA, 201 bp, Homo sapiens
agctggctaccctgcagcgacaaagtcctgaagtgagttcactaaacctgtcctgtttgtgagcaaagttgggtggacgtgagtgtaatacccacttcttyctgtggttaggtagaacttttttgcataaacttggttttcttacagttttattaaacttataactccctgggtcttggagaatgtctttcctcactgttt

SEQ ID NO: 22833 - DNA, 201 bp, Homo sapiens
gaggtgggagcatcactgatcccaggaggttgaggccacagtgagccgtgtgattgggccactgaactccagactgggtggcagagcgagacactgtctcaaaaaaaaaattaaaagactgtaattaaagatagccttttgtataagcattcatttttgtactaattgtatcagcttcaccaatgtgtaatactaggcctc

SEQ ID NO: 22834 - DNA, 201 bp, Homo sapiens
gctgcaaaacctttcctcaatgcccagaggttcatctttgaaagctttctgatctatttattggtttttgtttataggatgtggtttcccacagtaaaaarcttaccaaaaaaaataaggaacagttgtctgatatgatgatgataaataaacagaagggaggtctcaaggctttgagcaaggagaagagagagaagttgg

SEQ ID NO: 22835 - DNA, 201 bp, Homo sapiens
tatatccttagtcttctttctctagctattcagttattttccccacatggaactgctatcatgattgtgtctctttccggagatattctgtgcatgtaaawacaaattactttgatttgtttagaagtggttgcacactgtacattttgctttacatctttttgttgttgttttttgagatggagtcttgctctgttgccc

SEQ ID NO: 22836 - DNA, 201 bp, Homo sapiens
tgctgctgagtgcccgtaccctagctcaaggaatagggcacacccctcttgtagaagggaaggtaggaacgctggctggttggagactgtcagcaactccmcggtgataagtcgagcttagcactaagtagaagtatgtcactttctgtaatttagaggaattgaaaaggtatcttggaaagaaattagttcttgggaaca

SEQ ID NO: 22837 - DNA, 201 bp, Homo sapiens
cactccagcctgggcaacagagcaagactctgtctcccaaaaaaaaaatggggatgttgacaaggaccaaattttcttgtctacagaggttacctgtgaayccttatttgaaaaatgatgactatgaaagatagtggagaattgcattaccaagaccaaatgtaagggtggtcagctgtaataactgggcccaaactcaga

SEQ ID NO: 22838 - DNA, 201 bp, Homo sapiens
cactgcaacctctgactccctggttcaagcgattctcctctctcagcctcctgaggagctgggattacaggcacgtgccaccacacctagctcatttttgyatttttagtagagacggggtttcaccgtgttgaccaggatggtctcgatctcctgacctcgtgatccacctgccttggcctcccaaagtgctgggattac

SEQ ID NO: 22839 - DNA, 201 bp, Homo sapiens
tccttgtactttcctgtagagttcaaatttttgtaaccaaaggaaaatttattttaaaaaagtgaggtgtagggtatcagaaggtggctaaaaccattttwtattttgtattttgttcaatatagaaatattgtatacattttatattttgtattttgtgcaatatataaatattgtatacaaatatgtatattatataga

SEQ ID NO: 22840 - DNA, 201 bp, Homo sapiens
tctgatgaccagccaagtttgggaaacactaatctaataaaatgaatcaaagacagagacttccatttctagcttccctagagccaactacttcttatccragtaagtaaaatcagttgatctcaatttcctggctatgaaatagcagttgtgattcaaccctctccacagcatcaagtgacattctgcataattatatct

SEQ ID NO: 22841 - DNA, 201 bp, Homo sapiens
actaaaagtcatccctgcaaacctttctaactagcagctgcagtggataaccaagaagggaagcagctggccatcacatagcattcctgtgagtgtgagamtgaagggacagcagcatgggagcgagaatcctgaatgagtgagaggtatagataatctacctcacttcatacctgccccttccctacataagacatctct

SEQ ID NO: 22842 - DNA, 201 bp, Homo sapiens
ttgcttttggagccttctctacaatcaaggggaccctgtccggatatttcttccggatcttttctccttcctttttccgatactcaaagggatggacctcyttgtactggaacttcatggtgaatcacagggcttccgtgatccccgcgcagggcctgcctccttcgccgctgaccgctggccacgtcccgctccctccgc

SEQ ID NO: 22843 - DNA, 201 bp, Homo sapiens
  misc_feature (1)...(201): n = A,T,C or G, or insertion/deletion polymorphism (see Tables 1-2)
tgccaggagataataacagcaagtgggtgaagcactgggtaaaaggtggatattattattaccacaatctggagacccaggaaggaggatgggatgaaccnccaaattttgtgcaaaattctatgcagctttctcgggaggagatccaggtaggttacctttcttcacgtaagaagaagctgagagaaagtgttttcaagc

SEQ ID NO: 22844 - DNA, 201 bp, Homo sapiens
ttattcttctgcatatggttatccagttttctcaacaccatttattgaagagactgtctgtctcagcccattttacgtggctataaagggatacttgaagyggggtaatttattagctcacagctctgcaggctgtgcaagaagcaaggcaccagcatctgctcagcttctggtgagggcttttgtgctgcatcaaaatat

SEQ ID NO: 22845 - DNA, 201 bp, Homo sapiens
cttcaatgataaggtagcacaatgtcctggaaagaattctgagttaggaatgatggctgcactactgccagacagtggtgaatctccaagtctttgtcccyatctgtaaaaggggaatgccccattgtatcttatcttcctcacctggtttgttgtaagaagccagtaaatgaatctgtatggctgcactgtaaaaggtgt

SEQ ID NO: 22846 - DNA, 201 bp, Homo sapiens
atgccccattgtatcttatcttcctcacctggtttgttgtaagaagccagtaaatgaatctgtatggctgcactgtaaaaggtgtgcagggctgtgctgaygttggggaagtagaatgtagccatcgtgttcttccagtggagggatggcccgtgcccttgttcccctgtcactgctggaagtggtccttcctaaaacttc

SEQ ID NO: 22847 - DNA, 201 bp, Homo sapiens
tctactttccatgtacccggatgccaggcaaacagggagttttacgctgggtggagaacggaacattctgctgactccttgaaagggcttatctcaccagscatggtagctcacgactgtaatcccagctctttgggaggctgaggtgggaggattgcttgagctcaggagtttgagaccagcctgggtaacatagggata

SEQ ID NO: 22848 - DNA, 201 bp, Homo sapiens
tcactgcatccaactttttaccagttttttgatgcctccttcttccatttgactaacccacgtgtctcatattttttaagcctgttcttccatatttaatkgagtctaggaagcccccttcttcacatgtatgttacatgtaccctgatttcatgactttaatattttgcttttaatgatatgtaggaaatccaggatgag

SEQ ID NO: 22849 - DNA, 201 bp, Homo sapiens
gatgcctccttcttccatttgactaacccacgtgtctcatattttttaagcctgttcttccatatttaattgagtctaggaagcccccttcttcacatgtrtgttacatgtaccctgatttcatgactttaatattttgcttttaatgatatgtaggaaatccaggatgagtcagctgtgttatggttggatgaaattcaa

SEQ ID NO: 22850 - DNA, 201 bp, Homo sapiens
agtcctgttccatttcaggctggtcagaccatacttggaacacagtattcagtaggagaatgaattcagccaggtttgtttgtttgtcttttaagacagasacttgctctgctgttgcccaggctggagtgcagtgatgcaatctcagctcatgcctcagttttccaagtagtggctgggattgcaggcatactccaccac

SEQ ID NO: 22851 - DNA, 201 bp, Homo sapiens
catttgactaacccacgtgtctcatattttttaagcctgttcttccatatttaattgagtctaggaagcccccttcttcacatgtatgttacatgtacccygatttcatgactttaatattttgcttttaatgatatgtaggaaatccaggatgagtcagctgtgttatggttggatgaaattcaaggtggaatctggcag

SEQ ID NO: 22852 - DNA, 201 bp, Homo sapiens
ttattttgttttttactaatgaaaacatttgcaattgataagtactattatgccccagatatttttatttttggtattttattgatttctttttgctactktgataaaatcagatgtttatctgtgagtggtggtagggacaggcattttctcttcaaaaaataaggaaacggaaagtaaaaaagtaattatgattcctta

SEQ ID NO: 22853 - DNA, 201 bp, Homo sapiens
gtagatatcatctcttctaggtggaaagagatgtgcctctgcttcatgcaatttttcatctatcatttggcagggggcagaatttgtttccttctgtttcraggttggagtttaagaactgtataagttcaggtgcaaatgtgctatataaattcaagtttaggattagtgtggtaaacttgctaagaacttctttttccc

SEQ ID NO: 22854 - DNA, 201 bp, Homo sapiens
cctaacccttcttttacctcgaaataattcctcctagaccctatcatcgcattccttctcttccccttttgtcaaacttccactcacatgtagatattctsagggttatcatgcctaggcctttttaatagggccacttaccctagcatgcttctacaactggaccctcaaaggtcttttagggctgagtgtggtggctca

SEQ ID NO: 22855 - DNA, 201 bp, Homo sapiens
acctcccttacttgctgcagaatcttttttttttttttttttttttttttgagacaggtcttgctctatcactcaagctggagtgcagtggcacgatctcrgctcactgcaacctccgcctcccaggttcaagcaattcttctgcctcagcctctcgagtagctgggattacaggtgcgcaccaccatgcccagctaattt

SEQ ID NO: 22856 - DNA, 201 bp, Homo sapiens
cacacctgtaatcccaacattttgggaggctgaggcaggaggatttcttgagctcaggagttcaagaccagcctggacagcatagtgagaccccatctctaaaaaaaaaaataaaaattatctggcgtggtggctgatgtctgtagttccagctactcaggaggctgaggtgggaggatcacctgagcactggaggtcaag

SEQ ID NO: 22857 - DNA, 201 bp, Homo sapiens
gttggagtttaagaactgtataagttcaggtgcaaatgtgctatataaattcaagtttaggattagtgtggtaaacttgctaagaacttctttttcccatscgtaggaagcagaacatcagagagccatgcagagacgtgctatccgtgatgccaaaacacctgacaagatgaaaaagtcaaaatctgtaaaggaagacag

SEQ ID NO: 22858 - DNA, 201 bp, Homo sapiens
  misc_feature (1)...(201): n = A,T,C or G, or insertion/deletion polymorphism (see Tables 1-2)
ctcctctctctcctcctttgaccttctcctcgaccagccatcatgacatttaccatgaatttacttcctcccaagagtttggactgcccgtcagattgttnctgcacatagttgcctttgtatctctgtatgaaataaaaggtcatttgttcatgtttgtgtttttctcagtttcattgttaacagttcctgctaaacacc

SEQ ID NO: 22859 - DNA, 201 bp, Homo sapiens
acagctccatcaggaacatgcgggctgtgacagacaagtttctctcagccattgtcagctctgtggacaaaatcccgtgagtgccatcagttgtcatgacycccagtagaacccagcactaagtgcctttctgctccttggcccttctcactaagttttgtccatcccgcagttatgggatgcgcttcattgccaaagtgc

SEQ ID NO: 22860 - DNA, 201 bp, Homo sapiens
agtagtactttttattctgtattatagcactttattccttgcaattcttatgatgaaatgtctgttcaccctaatgaagttatttgctgaatgccaccgatgttttctaagaatgccaccgatgttttctaactgtccatagtttgatttggattattgatgattggtgaatgtcagatgaacacagtgaatggatatctt

SEQ ID NO: 22861 - DNA, 201 bp, Homo sapiens
ttatgtgtagaattaggcctcatactcagagttaatttgtcataaaagagtttttcttttccttgtttgtagaacatttgtctcaggtcatgttcacttayttgggtctgatcttaatttttcctcattaaagcaggaagccattccttggatttcttctgtttctgaaccaagaataaattaagagtaacaataagagga

SEQ ID NO: 22862 - DNA, 201 bp, Homo sapiens
tagcaggtaattttcttctaaaaacatggtatctttcataattgatctagtatttctgtgaactatgcattcacttggggtgcagtctcttgtttagttakgtaggtccttgccattgttaagccatttgttcattcattcaataatttttataagccggatgcggtggctcacgcctgtaatcccagcattttgggaggc

SEQ ID NO: 22863 - DNA, 201 bp, Homo sapiens
ggcatgcagtggcacgatcttgtctcaccgcaacctccacctcctgggttcaagcaattctcctgcctcagtctcccgagtagctaggattacaggcatgygccaccatacccggctaattttttgtatttagtcgagatggggtttcgccatgttgggcagactggtctcgaactcccgacctcaggtgatcctcccacc

SEQ ID NO: 22864 - DNA, 201 bp, Homo sapiens
gttgaggctacagtgagctgtgttcgcaccactgcactgtagcctgggcaacagagtgagaccctgcctcaaaaaattaattaattaattttttttttttwaaaaagaatctggctctgaagtggtactgacctggtatttgatctcttgttcctctgttaaaagctgtgtaacattgggcacctgcagtagcgttgttag

SEQ ID NO: 22865 - DNA, 201 bp, Homo sapiens
agcaaccttaaaacttggacctagaaattcactgtggattctgagttctgcaactggaagagaatgtcagcaacaaattaaagcttctgaacagttgaaarggtggcttcagttaccaatggcttttcttaggatttgttaaagagcaacttaaggactgagggaaagggtctgaggttctgggagcagtcaggatctggg

SEQ ID NO: 22866 - DNA, 201 bp, Homo sapiens
gtaaaaaagtaattatgattccttagtggctatcatttctgaaatcagaaattatcttattctgtctttcaggctaagaatacctttttgttttgttttgktttttttacaatatataaagtgcttttatgtatatgattttatttaatcttaaaaatattcctatgacggaaggtatcttcattatcattttcagatgaa

SEQ ID NO: 22867 - DNA, 201 bp, Homo sapiens
tgtgctatctaacactagacctattccttgtatctaatggtaattttgtacccgttagccaacctctctatgtcctcctccccactacccttcccagcttytgggaaccaccagtcaactctacctctgtgagatccacttttttagctcccatatatgagtgagatcaggaggtatttgcctttctgtgtctggcttatt

SEQ ID NO: 22868 - DNA, 201 bp, Homo sapiens
gtgcaagaagcaaggcaccagcatctgctcagcttctggtgagggcttttgtgctgcatcaaaatatgaaggagaagatcaaagggcaagtgggctcatgygaagagagactgatccccggggtagtgagtaggggtcctggctttataacaacccattctaatgagaactgatccgttctccccaagaaccaatccaatc

SEQ ID NO: 22869 - DNA, 201 bp, Homo sapiens
ttcatatacctgttggccatttgtgtgtcttcttttgataaaaatctattcagcttatttgcccatgtaaaaattggattatttgtggggtttttttttgtttttttttttttggctgttgtttgaatttcttatatattatggttattgttctcttctcagatggatcgtttgcaaatgttttctcctgttctatatgtt

SEQ ID NO: 22870 - DNA, 201 bp, Homo sapiens
tggaagctttccttgctttttccattctgagttgaagccctttccctatggtcctgtggcacttttggtgaactgatttacagcacaataggtttataatmatctgtttgtgtgtcgctcccaccagactgtaaaagactgaagagaaggtgtcatgtcttgtataacttttattcccaagtgcctgttattgtgcctggc

SEQ ID NO: 22871 - DNA, 201 bp, Homo sapiens
tcaccttttccagatttattaaaactagtgacccataacatggatgaaatgggaaaatgtcattgtgacttctgaaataaaaagcttagatgtgtgtggcwattgaacatgtttctttttctttccatgtatgatgaattttgatatgaacaacatgacttcctaactccaaatcaaccagaagcctcccttggccaatgt

SEQ ID NO: 22872 - DNA, 201 bp, Homo sapiens
tcaccatgttggccaggctggtctcgaactcctgacctcagatgatccgccctcctcggcctcccaaagtgctgggattacaggcgtgagccaccgcgccyggtctgagccaccgcgcccggtctgagccaccacacccggtctaatttttgtatttttagtagaggtggggtttcaccattttggccaggctggttttga

SEQ ID NO: 22873 - DNA, 201 bp, Homo sapiens
tagttttcagttctgttctcattgttttcctgtattgaacaaagggatatttcatttagttccaggccatgagagagagtgtgtatatgtgcatgcatgcrtgtgtatatgtattttttatttattttttcctcataggactgcattttctgcttttctttgctagcaaagtcatttatagcttccttggtggtatgtctt

SEQ ID NO: 22874 - DNA, 201 bp, Homo sapiens
gtagcgggtaagacaaacattttaaaagatgagtttatgttacaattactttaacaactttatcttcatagtagcattattcctgatagccacagtggaaraaaacagtatgtctatcaagtcaggaatagataaagtgtaaataattcaaaaggctgtgtgtgcgttttgtttgggtcatcggagtaaaactttttgagg

SEQ ID NO: 22875 - DNA, 201 bp, Homo sapiens
tcggtacgtggcacacagccctgttgggtacctgtcactctgttcttgtctacagtgaccccagatcagccagcacagtgcccagcctagtcagtgttggrtaggtagataagtgagatgacatatgaagtaaaagaagatcaagtttttgtttatgaagtgttttctaggtgggaggacgtgtgtgagaacaacctagtc

SEQ ID NO: 22876 - DNA, 201 bp, Homo sapiens
tcattgttttcctgtattgaacaaagggatatttcatttagttccaggccatgagagagagtgtgtatatgtgcatgcatgcgtgtgtatatgtatttttyatttattttttcctcataggactgcattttctgcttttctttgctagcaaagtcatttatagcttccttggtggtatgtcttttaatacccatctttctg

SEQ ID NO: 22877 - DNA, 201 bp, Homo sapiens
tgctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgaggtgatctcagctcaccacaacctccacctcctgggttcaag

SEQ ID NO: 22878 - DNA, 201 bp, Homo sapiens
gatcaaaagggaatgtgacagaaaagtgttgtaattgtcacctcctctattttttgcactataccaaactctggatatacattgagaaataaaatagatgkgatcctgatagtttcataagagagaaaacaacaacaacaacaaaagcccagatgtgatcaatatctataaggaactggagtcagaggaaaagatcatttt

SEQ ID NO: 22879 - DNA, 201 bp, Homo sapiens
aagattgagataataatgcatgtaaagtatttggcttcatgtctgccacatggtgtgaagattattttttaagtgtcatttatattgaaaatgagtcattytatgttacttctttcctgtttagtacttgtgtttcagatctgacatcacctttttaaaaattttgcatttgagtgagatttgctaaagcagttctggggt

SEQ ID NO: 22880 - DNA, 201 bp, Homo sapiens
gctggggatacaggtataaacatgacagttctcttgaggagcacagagtggttgtgggaaacagacatacagacacacagtttctttctttcttttttctttttttttttttttttgagacagagtctcactctgtccttcaggccggaatgcagtgaggtgatctcagctcaccacaacctccacctcctgggttcaagc

SEQ ID NO: 22881 - DNA, 201 bp, Homo sapiens
agtggtgcagtcatagctcactgcagcctcaaattcctaggctcaagtgatcctcctgagttgtttttttttttttttaatagagatggagtctcactatrttgcccaggctggtctcgaactcctggcctcaagccatcctcctcctttagccttccaaagtgctgggattgcaggactgagccactgcacccagccaga

SEQ ID NO: 22882 - DNA, 201 bp, Homo sapiens
gtaatctttgtactttgggaggctgaggcaggtggatcacgaggtcaggagatcaagaccatcttggctaacacagtgaaaccccatctctactaaaaacmcaaaaaaaaaaaaaaaagaaaaagaaaaaaaaaattagcccggcatggtggtaggcgcctgcgcctttagtcccagctactcgggaggctgaggcaggag

SEQ ID NO: 22883 - DNA, 201 bp, Homo sapiens
gcctttatcatttggcataacattttatttctcagtaaaagttgttctcgtcacactgtatgtgttaggtgattcaagtattatcttagacttgcatcatyttatatttgtattatttccccccaatatctcctctctttattacgctgactctttccaccctcccaaaacttcaggggaaagctctggcaatttaaatga

SEQ ID NO: 22884 - DNA, 201 bp, Homo sapiens
gtatctgtaaagtcactctaccccagctttggcaaaggcatttggctctacctggggctgccaccttggctgcatgtagcctgagctgtcacttatgactrtggctctctctgtccctagtgactgcttttgagagatgagaaccttaaggcctggagtcataggaatgagtaatctttacataattttctttgctttgct

SEQ ID NO: 22885 - DNA, 201 bp, Homo sapiens
ggaatctggcagtccaacaaagacacccaagaagcacagaagtgtatgtatcacctgttttatttctgttttggtggaggctggggtgacaaggtgctccrtacagcttgaccaagataggtatgggggaacaatttgccagtagatatagttaggtgaagcagtatgtgaatttagacactctctaaactattctggtaa

SEQ ID NO: 22886 - DNA, 201 bp, Homo sapiens
aaaaaataataataaataaataaataaataaataaataaataaaatgttgtagtatttgcatatacttacgttctcccatatactttaaatcatctctagrctacttataatacctactacaatataaatgctgtgtaaatagttgttactgtatttttaaaatttgtattattttgtattgttgtatttttttttcaaac

SEQ ID NO: 22887 - DNA, 201 bp, Homo sapiens
agctacttgggaggctgaggcaggagaattacctgaacctgggagatggaggttgcagtgagccacgattgcatcactacactccagcctgggcgacagarcaagactctggaaaaaaaaaaaaatcttcttggccttagaaattaaaatcatgaaaggagatcatctgctggtcccagaatcacttaaggaatattatac

SEQ ID NO: 22888 - DNA, 201 bp, Homo sapiens
tggaaaaaaaaaaaaatcttcttggccttagaaattaaaatcatgaaaggagatcatctgctggtcccagaatcacttaaggaatattatacaaatttggrtccccttgctcctctctatacttcctggggacaagatcacaggctctgattttttttcctgggtgctgaggaaagtctgatccagccttcttggcactgg

SEQ ID NO: 22889 - DNA, 201 bp, Homo sapiens
cagcttgaccaagataggtatgggggaacaatttgccagtagatatagttaggtgaagcagtatgtgaatttagacactctctaaactattctggtaacarttctttcccgaaatagttgccttaggaatctttgccattaatgaggcagtagaaagtggtgatgttggcaaaacactgagtgcccttcgctcccctgatg

SEQ ID NO: 22890 - DNA, 201 bp, Homo sapiens; identical to SEQ ID NO: 3665

SEQ ID NO: 22891 - DNA, 201 bp, Homo sapiens
attaatatattaatgattggtttcagcccctaagagttgtgttttgtgcttattcccactttcacttatttttacaacctatccatgtcttcttttttttwaaaaaaaaatgtctttttcagtcttatttctgactccattaagatcttgaaatagaatggtatccaacacagttccctttggggttctgtataatctgtc

SEQ ID NO: 22892 - DNA, 201 bp, Homo sapiens
cctggcctcttatccctattttattgatgaagacattgagacacagagtttaagtaactttcttaaggccacacagcttgtaagaggcaggatgatgactyagacccaggcagtgtgactcttgagtttgcactcattacctctacactatattgcctcagtgtatcattgttataatggaatttctttgattatagtgag

SEQ ID NO: 22893 - DNA, 201 bp, Homo sapiens
ctttctgatattccttcctgataactgataactttattctctgttacttacattaatttttcagactgtgagcatcaggtggcaaagctcaatcaggacarttctgaaacagcagaacaatgtggaacatcctcagaaaggaccaataaagatctttctcatactcttagttggggaggaaactgggagcaaggcctagaa

SEQ ID NO: 22894 - DNA, 201 bp, Homo sapiens; identical to SEQ ID NO: 3682

SEQ ID NO: 22895 - DNA, 201 bp, Homo sapiens; identical to SEQ ID NO: 3670

SEQ ID NO: 22896 - DNA, 201 bp, Homo sapiens; identical to SEQ ID NO: 3660

SEQ ID NO: 22897 - DNA, 201 bp, Homo sapiens
gaataaaatggaaatgcactgccagttcagtgctgtgcaggcattagtcaccagaggtctcactgccatgacaaggccaaattatcgtagaggatgtttgyggtcttgtgacttggaggctgaaagaatttcagaagctcttttaaatggcagtgtatggcagtgtatctaccagaggtttgctgtcatctgacacagaga

SEQ ID NO: 22898 - DNA, 201 bp, Homo sapiens
ttttcatcaaagtccttacacctgtctggcaatttcttattaattgatttgtttttggtaaactccacgaaaggtgggagtcatttctcttgtttccattytttccacagcacttagaacagtgcctggcacatggtaggtgctcaatatgtgtttactggatgaattaatgagtgcatgctcatgggcaaggatctcatt

SEQ ID NO: 22899 - DNA, 201 bp, Homo sapiens
acaatatattgcttaagcaataaggatacacaaactaatgaaaatcaaaggatttactaatacaaacttcagtatagtaattaattggaatgggagagaargatgcaaagtttctatttctttttttgttttgttttgagacagtgtctcattctgttgccaaggcaggagtgcagtggcaggatctcagatcactgcaag

SEQ ID NO: 22900 - DNA, 201 bp, Homo sapiens
atctgaaggcctcttgttagtcttcttctgattcaacaactctttactgtttgatgccatttacatatgtttattattttttagagatggggtctcattcktttgctgaggctggagagcagtggtgcgatcatggctcactgcagcctcaacctcccagactcaagcaatcctcctgtctcagcctcctgagtaacagct

SEQ ID NO: 22901 - DNA, 201 bp, Homo sapiens
ctaatttttgtatttttagtagagacaggcttttgccatgttggccaggctggtctcaaactcctgaactcaggtgatccgcctgcctcggcctcccaaartgctgggattacaggtgtgagccaccatgcccggcccagacacatagtttcaatacaagaagtatatgtcagccagagaagggctatcttgagagtcaag

SEQ ID NO: 22902 - DNA, 201 bp, Homo sapiens
  misc_feature (1)...(201): n = A,T,C or G, or insertion/deletion polymorphism (see Tables 1-2)
gtagtttattatttattcctaactttttattttaagagttttcaaatctcagatcgaatgaatagaacaataagcacccatgtgcccttcacctagattcncccatttttaatattttgccatatctgcttcccatttccctggctcttgcatgtcctctgtttctctctttccatggaagactctctggggtcaggcatg

SEQ ID NO: 22903 - DNA, 201 bp, Homo sapiens
gtgattccgatgctccttccttggcccccactcctccccctgttgagaaacaagatttaaaactctgccttatgctgggatatcatgacctcagtagaatkttacacttcatcctatttcttcatcaggttctgcattagccaggcattttattttcagctactctagagcgtctttttttctgtcaggtgtttttttcca

SEQ ID NO: 22904 - DNA, 201 bp, Homo sapiens
  misc_feature (1)...(201): n = A,T,C or G, or insertion/deletion polymorphism (see Tables 1-2)
atatctgcttcccatttccctggctcttgcatgtcctctgtttctctctttccatggaagactctctggggtcaggcatgggtgatggaagggatgaaaancaggcccacctaaccctgcttgcagatctgactcctgtgagcttttgatgtgttttcattgttccttgtgcacttcctgactttctgacacaagatgttt

SEQ ID NO: 22905 - DNA, 201 bp, Homo sapiens
  misc_feature (1)...(201): n = A,T,C or G, or insertion/deletion polymorphism (see Tables 1-2)
ctggggtcaggcatgggtgatggaagggatgaaaaacaggcccacctaaccctgcttgcagatctgactcctgtgagcttttgatgtgttttcattgttcnttgtgcacttcctgactttctgacacaagatgtttcatgttcaacctgtagtttcccctccccagggccagaatgaactgtttctccaagcatgcctggt

SEQ ID NO: 22906 - DNA, 201 bp, Homo sapiens
  misc_feature (1)...(201): n = A,T,C or G, or insertion/deletion polymorphism (see Tables 1-2)
ccagatttgtcatggcctccaggccttctaagcagacagacctagattctcatttttttttaatgctgcatattattccattatgcagatagatataacanttgacttcagcagttctccattgatggacatttaagttgtttccagttgtttgttattattttttaaattctgcagcaaataacctcttgtacatatgtc

SEQ ID NO: 22907 - DNA, 201 bp, Homo sapiens
agaaactaaatagccaactaaatctggtaaaattatttatcacttaagataaatatgtttaaggaataacccgtgaggcgttccagttgaataagatgcaygtgtgtttcagtgcatgggtttttgtgacttctttaactctcagtgacctttttgcatctttcatggttctcagccctgttcgtaataggtaaggcagct

SEQ ID NO: 22908 - DNA, 201 bp, Homo sapiens
ggatgggggcggtactttccggccgctggctgtcgaagccggagtcccacctgtgtccccacagccctgtcacgaatcccggtcgggttctgggaggcacmgcctcggggttgcgggccgggtgcggctcggcggtggaggactcacttcctgctccatccccggctgggccctggggcggtgagtgattcaaggagggag

SEQ ID NO: 22909 - DNA, 201 bp, Homo sapiens
acaggtctttttcaaaatggagtctcttatgtctttcctttctacatagacacagtaacagtctgatctctcttttcccttcacttggcctgacagcattsacttcattacacaagaacttgcagctgacagaactgacacacagatttcccccaagaggaagaacccttttcatttgcagagatgaattgaaatgtcatg

SEQ ID NO: 22910 - DNA, 201 bp, Homo sapiens
aaattagtcattacaaagccataatttaatgggagcttagcatgcccctttactctcacagatccaaggagcagcttttggagtggtcttcatttagactrtgagactaactaataatcctgcagttctggacgtacagctggggagtgtggctctggatgtcttctatctttcctttattttctgccaggagataataac

SEQ ID NO: 22911 - DNA, 201 bp, Homo sapiens
ttcttgattgaagaatgtttctatctttttttttttttttttgtacagtctcgctctgttgcccaggctggagggcagtggcgcaatcttggctcattgcracctccacctcccgggttcaagcgattctcctgcctcagcctcctgagtagctggaattacaggcatccgccactacgcctggctaatttttgtatcttt

SEQ ID NO: 22912 - DNA, 201 bp, Homo sapiens
tatgtccaggctggcaccctgggatcatgaaaatagaagttaagacatttaagaagcaagaaaacaaaatgggtaggtgaggtgactaggaagaatatcakgcccagcacttctagaattctcaaaatgaggagcatcacttaaattttgagggggatcatttttaggatggtgacccaagctctctttgtacagatgaga

SEQ ID NO: 22913 - DNA, 201 bp, Homo sapiens
tcccatgctgtcatttaaagatatatatgctgcctttgtttttcccccaatacgactttttcctctgcatataaattagtttaaaaaaaaatcctcaggtraaatacacattgtcttcagctcacttttgcttttagagctatgaatcctcttttaagataaacagacaatacccacccatccccagtctaatcactcctt

SEQ ID NO: 22914 - DNA, 201 bp, Homo sapiens
gtacaaaagtaaacatttcataaatctttgttgaatcaaatcctactcctcccctgcttataaaatcttaaatcatttcctattgtctacagacgaaagtrgaatctcgtttaatgtagaatttaagacccttccacgggctctagcatcaaccttcctttcttgctcttctcctgggaggaccttgctttccgccccaga

SEQ ID NO: 22915 - DNA, 201 bp, Homo sapiens
  misc_feature (1)...(201): n = A,T,C or G, or insertion/deletion polymorphism (see Tables 1-2)
agtccctggcaaggatgcaccaagctcgaaagcgctatcgagatcgcctgcagtacttccgggaccatgtaagcacccttggatcatacaggccattaggngcaattttgccatatttttggtagacagatgaacagagaaatttcttcttttttgttccttagataaatgacattatcaaaatccaggcttttattcggg

SEQ ID NO: 22916 - DNA, 201 bp, Homo sapiens
ggcatgatcttggctcactgcaacctccgcctcctgtattcaggcaattctcctgcctcagcctcccgagtagctgggattataggcaactgccaccatgyccggctaatttttgtatttttagaagagacggggtttcaccatgttggccaggctggtctcgaactcctgacctcagatgatccgccctcctcggcctcc

SEQ ID NO: 22917 - DNA, 201 bp, Homo sapiens
ctgcccgcctcggcctcccaaagtgctgggattacaggcttgagccactgcgtccagcccaaactctttaagagaaaatctcttgggatcttgaagccagragcttgcttttattactgagtttgccctgaatctgtcacttatgtactaaaaatacataaatttccttatccaggtgacttgggctcaactgaaggaaac

SEQ ID NO: 22918 - DNA, 201 bp, Homo sapiens
gggccaaggaagcaacaaaaaatatcagttgagcatgtgaaaatgcgttgacggtgtgtgcggtgtaaagtttctatatgtcttcaccttctgtctcctcycggtgggagccgccctctctttccccaagtcacacacacacccctcccctacccctaagtccaggtgcttccatctgctgggcttccaaccactcatttc

SEQ ID NO: 22919 - DNA, 201 bp, Homo sapiens
aaacagacatacagacacacagtttctttctttcttttttctttttttttttttttttgagacagagtctcactctgtccttcaggccggaatgcagtgargtgatctcagctcaccacaacctccacctcctgggttcaagcgattctcctgcctctgactccccagtagctgggattacagtaatgcgccaccacaccc

SEQ ID NO: 22920 - DNA, 201 bp, Homo sapiens
tgtagatgtttcaggggtttgccgtggggaaccctgccatgcaggcttgtctcaggttctgaccctgtgatggggtctggtgttccctgcctcgtttaccrctctttccccatactttggtctgactctccaatgagctcatgattcctatgagcgatttctgtctcttgatgaatctttagatttgtcctttgtcttagg

SEQ ID NO: 22921 - DNA, 201 bp, Homo sapiens
tcgaggctgctctcaagtcctttccatgtggacccctccatattcaataccagcaatggcccattgaaccatcccatgctttgagtctctgacttcttttrccagctaaaggaatctctctacttataaatggctcatgtgatgaccaggataatttccccatcttaagatcaactgtttagtgccttaattgcatctgca

SEQ ID NO: 22922 - DNA, 201 bp, Homo sapiens
tgctacaggccccatgcaagtttgaaagctggaagggcagtcattagatcttaaagctctaacataatctttgactccatgtcccatatgctgggcatacyggtgcagtgggtgggctcccaaggcatggagcagctctgtccctgtggctttgcaggattcatcacccatgactgctctcatgggctcgagttgagtgcc

SEQ ID NO: 22923 - DNA, 201 bp, Homo sapiens
tagagcttgtgtgacctcaggttctatgattagaagagagaatgtggaaaggggaagatgacccctttcactctgcacaggttggaccacccttgatagcwgggcactgactgttgtgggtggagtgtgttcaggaagtatcagggtaatgagaggattcaaaatggtgctatgtaagacatggttaaaggaaataaggct

SEQ ID NO: 22924 - DNA, 201 bp, Homo sapiens
tgctgcagcagaggaaagtggggtggagaagaaagtggcattcatgctcaggaattttcctaagttccccgcctctgagatctgactgggccaggcagggwaaggatgtgtgtggaactgattgtaaaagagtgctattatgttcagtttaagcttctccaaggagaatggaaataaagcttaaaatctctaaggaaaagt

SEQ ID NO: 22925 - DNA, 201 bp, Homo sapiens
taatcccagctactcaggaggctgaggcaggagaatcgcttgagcccaggaggcagaggttgcaatgagccaagattgtgccattacactccagcctgtgygacagagtgagactccgtctcaaaaaaaaaaaaaagttttgaaaaagttttatacgattgaatgaactaaaaagaaaatctaggccaggtgcggtggctc

SEQ ID NO: 22926 - DNA, 201 bp, Homo sapiens
atgcctgtaatcttagcactttgggaggccgaggccagtggatcacaaggtcaggagtttgagaccagcctggccaatatagtgaaaccccatctctaataaaaaaatatatatatatataaaattagccaggtgtggtggcgggtgcctgtaattccagccacttgggaggctgaggcagaagaatcccttgaacccggg

SEQ ID NO: 22927 - DNA, 201 bp, Homo sapiens
tcagtttttatggctgaataatattccattatgtgtatacactacctttttttttttttttttttttttttttttttttaccatttattcattgatggacscttaggttgatttcatatcttggctattgtgaatacagctgcagtaaacatgggagtgctgatttcctttcttttggccatatacctagcaatgggattg

SEQ ID NO: 22928 - DNA, 201 bp, Homo sapiens
gcactgacaccaaccaagaagcactgacgtatgatattttgatacatgcatacaatgtattatgatcaaatcagggtaattggaatatttgtcacctaacrcatttatcttttgttgatgttgggaacattccagttcttctgttttgaactatacattattgttaactatcatcatcctactgtgctatctaacactaga

SEQ ID NO: 22929 - DNA, 201 bp, Homo sapiens
tatctttatggcagtgccctactccttggtaccaattttctgtgttggtccatttttgcattgctagaaagaaatacctgagactgggtaattccttttcytttttctgagacagagtcttgctctgttacccaggctggagtgcagtggtgcaatcttggctcactgcaacttccacttcctgggttcaagtgatcctcc

SEQ ID NO: 22930 - DNA, 201 bp, Homo sapiens
gagtcttgctctgttacccaggctggagtgcagtggtgcaatcttggctcactgcaacttccacttcctgggttcaagtgatcctcctgcctcagcctccsgagtagctgggattataggcacacaccatcacaccttgctatttttttttctttttttagtagagatggggtttcattgtgttgatcaggctggtcttga

SEQ ID NO: 22931 - DNA, 201 bp, Homo sapiens
gaaaaccgcccccatgatccaatcacctcccaccaggccccatctccaacactggggattatagttcaacatgagatttggatggggaccaatatccaaaytatgtcaacaattgtgttacttctccatctacttttctcctggtagctggctagtttctcttaacactgattgtaagacctatcctgatttcagaggcat

SEQ ID NO: 22932 - DNA, 201 bp, Homo sapiens
tttaagtgatttatttgttcttgcattctatttatctgtttactctttccctttcccaagactgtgagcttcttaaaattgggacagtgcctcttagaatrgtaaggccagcacctaccataattaggttaaatgatctttctaaaagactgcatttaagagaaatcactgctttcaatttcagatgctttcctttggcct

SEQ ID NO: 22933 - DNA, 201 bp, Homo sapiens
tgtaatagcactgcctggagaagccactgttaatatattggtgtatatacttcaaggctttatctattcatatgcacatatccatcaatgtatctatctakctagctacatttaaaacaaaatggtatcatatttattagtcataatttgatatattaacttaaccacaatattaaaatattgtactgccagcctgtacat

SEQ ID NO: 22934 - DNA, 201 bp, Homo sapiens
tgaggcaggataatcacttgaacttgggaggctgaggttgcagtgagccgaaatcacgccactgcactccagcctgggtgacagagtgaaactctgtctcaaaaaaaaaaaaaaaaaaagaagaagaagaagaaatatttcacattttatgtattcgcaatgtttaagaaaatttggccgacttgaatgacagcttttttg

SEQ ID NO: 22935 - DNA, 201 bp, Homo sapiens
aggctttatctattcatatgcacatatccatcaatgtatctatctatctagctacatttaaaacaaaatggtatcatatttattagtcataatttgatatwttaacttaaccacaatattaaaatattgtactgccagcctgtacattttttgcctgcccagcctcccactgaaggaaattatgcccagctcatagttctc

SEQ ID NO: 22936 - DNA, 201 bp, Homo sapiens
tattaaaatattgtactgccagcctgtacattttttgcctgcccagcctcccactgaaggaaattatgcccagctcatagttctctatgcttaattatctrtatctcctgatcatagttgattgaagtaaaggatcagcatccaatctaagggcagcctgcctgtgggtggtcagagatttacccacagggtggaaagctg

SEQ ID NO: 22937 - DNA, 201 bp, Homo sapiens
gtaaaggatcagcatccaatctaagggcagcctgcctgtgggtggtcagagatttacccacagggtggaaagctgagctgggtcaatcatatgccactctrtgggttatggagttaggcaattgagatgatcctcaatggagctgatgatgtaaggataccatgaccttcagtcaaagccatggcaaggcaagcagaaaca

SEQ ID NO: 22938 - DNA, 201 bp, Homo sapiens
tgtatagctgccatcactgatttaaacacctactgatggacatttgagtaatttccaaggagcatcttcatggataacttttgcacatttaataaaagcaygatatccttatgatacattccaagaagtgaagttttttggttgaagaatagatgcataatgataagctggtctttagaaagactatattaatttattgcc

SEQ ID NO: 22939 - DNA, 201 bp, Homo sapiens
agggaaagggtctgaggttctgggagcagtcaggatctggggagccagctggctgtgttgctgcagcagaggaaagtggggtggagaagaaagtggcattratgctcaggaattttcctaagttccccgcctctgagatctgactgggccaggcagggaaaggatgtgtgtggaactgattgtaaaagagtgctattatgt

SEQ ID NO: 22940 - DNA, 201 bp, Homo sapiens
tgaaataactttttactttgtaggcttaataaatgaaacccttgcccacttttctacaggggtgttttgttcttacaggttttcaagtatctttaatagtytgaaggaagagtgaatacattgaaaatagctggagcaaaacatctggagtcaggctatgatttggcatgctaaatcatgctgaacttggcccattatctt

SEQ ID NO: 22941 - DNA, 201 bp, Homo sapiens
  misc_feature (1)...(201): n = A,T,C or G, or insertion/deletion polymorphism (see Tables 1-2)
aaagaagaataaggcgtcctcaggtctcaggtggattctcttccggattaaaaggtagaactggccatcggtaaggtcggagggcactaggtacttcctcntgtccagatcaggcacccttgcttttggagccttctctacaatcaaggggaccctgtccggatatttcttccggatcttttctccttcctttttccgata

SEQ ID NO: 22942 - DNA, 201 bp, Homo sapiens
aagagctgtaacactcactgcgaaggtgtgcggcttcactcctgaagtcagtgagaccacgaacccactggaaggaagaaactccggacacatctgaacarctgaaggaacaaactccggacacaccatctttaagagctgtaacgctcaccgtgaaggtccgtggtttcattcttgaagtcagcgagaccaagcatccac

SEQ ID NO: 22943 - DNA, 201 bp, Homo sapiens
atctgaagggcaagccacaaggtgcagggggcagaggcatccctgatacgggaaaagagttattttaaaaagaacttgcaaagaacaatgtcaagggatcyaaaggtagggaatttggacagagttcggctttagcatccgcatctcaaatacctgggtacctgggtaatctggtgactgctgccgaatctaagaggactg

SEQ ID NO: 22944 - DNA, 201 bp, Homo sapiens
gagaccacgaacccactggaaggaagaaactccggacacatctgaacatctgaaggaacaaactccggacacaccatctttaagagctgtaacgctcaccytgaaggtccgtggtttcattcttgaagtcagcgagaccaagcatccaccaaaaggaataaattccagacgcagtatttacagcccagtgtccacccattc

SEQ ID NO: 22945 - DNA, 201 bp, Homo sapiens
taaggcgtcctcaggtctcaggtggattctcttccggattaaaaggtagaactggccatcggtaaggtcggagggcactaggtacttcctcctgtccagawcaggcacccttgcttttggagccttctctacaatcaaggggaccctgtccggatatttcttccggatcttttctccttcctttttccgatactcaaaggg

SEQ ID NO: 22946 - DNA, 201 bp, Homo sapiens
agtaggagaaatagataaagaggagactcatctgaggaaagctgtctacattcagcagtgagctaggctccacactgcggggaaagaagctgagggtttcwgcatgtctggtttggtgtgtgcgctctggagagcttttgcagatgtcactcttcagaaaacatttagctgaagcttccacttagtgctgccactaaatcg

SEQ ID NO: 22947 - DNA, 201 bp, Homo sapiens
tgaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgtt

SEQ ID NO: 22948 - DNA, 201 bp, Homo sapiens
gaggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttg

SEQ ID NO: 22949 - DNA, 201 bp, Homo sapiens
aggtaggaggatcatttgagcccagaaagtcgaggctgcagtaagccatgattgtgccactgcactcgagccggagtgacagaacaagaccctgtctcaaaaaaaaaaaaaaaaaagtttgatagggcatgtggaacaagagacaggacctgagggaagagcataaacaaaggtattgaaagtagagggatactgtgttgg

SEQ ID NO: 22950 - DNA, 201 bp, Homo sapiens
gaggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccct

SEQ ID NO: 22951 - DNA, 201 bp, Homo sapiens
aggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattacccta

SEQ ID NO: 22952 - DNA, 201 bp, Homo sapiens
ggcaggagaattgcttgaacccgggaggcagagcttgcggtaagctgagacagtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctag

SEQ ID NO: 22953 - DNA, 201 bp, Homo sapiens
agtgccattgcactccagcctgggcatcaagagtaaaactctgtctcaaaaaaaaaaaaaaaaaaaaaaggcagtggagacatttgtgatgatcttcaggtttttttttttttttttaagggagggcataatagtggcatattaccctagcacaccctgcccattggcctggcatcatggaaaggtgcctggtctatttta

SEQ ID NO: 22954 - DNA, 201 bp, Homo sapiens
tctctagtgattccgatgctccttccttggcccccactcctccccctgttgagaaacaagatttaaaactctgccttatgctgggatatcatgacctcagyagaatgttacacttcatcctatttcttcatcaggttctgcattagccaggcattttattttcagctactctagagcgtctttttttctgtcaggtgtttt

SEQ ID NO: 22955 - DNA, 201 bp, Homo sapiens
cacttatgccagttggtacatgaatgagtaaatgcaaacaagccatgatactgaaataaagctttgtttaattaaccttcacatgtaaattcagccacagragacattctgatacatgggggcattgccagtgattccacgaaactggataatgtcattgatgcttgtggttgagagagcttgtttctgtattgtaaggaa

SEQ ID NO: 22956 - DNA, 201 bp, Homo sapiens
ggtttggacctcctgacctgaggggttccacctgcctcggcctctcaaagtgctgagattacaggagtgagccaccttgtctagctctttttttttttttyttttgagacaagttcttgctctgtctcccaggctggaacgcagtggtgcaatcacagctccctgcagcctcgacctccccagctcaagtgatcttcccac

SEQ ID NO: 22957 - DNA, 201 bp, Homo sapiens
gatccacccacctcagcctcccaaagtgctgggattacaggcgtgagccaccacgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttg

SEQ ID NO: 22958 - DNA, 201 bp, Homo sapiens
ggctggagtgcagtggcacaatcttggctcactgcaggcttcacctcccgtgttcacgccattctcctgcctcagcctcccgagtagctgggattacaggygcccgccaccacgcccagctaattttttgtatttttagtagagatgggagttctccgtgttagccaggatggtctcgatctcctgacctcatgatccacc

SEQ ID NO: 22959 - DNA, 201 bp, Homo sapiens
tcagtcttatgcttattgtgcatgttttgggcgttaccaactgtggggtggaaatagcatttttaggatttgaagttattggctttaatgtttcacttatkcttcatgaattttgatttatatatgaattgagtctcctcctcctatgacctgcggagtggctgcttggtttgggaggcttagaagcgtggtgctgttggt

SEQ ID NO: 22960 - DNA, 201 bp, Homo sapiens
tagcatttttaggatttgaagttattggctttaatgtttcacttatgcttcatgaattttgatttatatatgaattgagtctcctcctcctatgacctgcrgagtggctgcttggtttgggaggcttagaagcgtggtgctgttggtgtaggtccatctgtttggcaatattcagagtcagcatcctctgcattctttgtg

SEQ ID NO: 22961 - DNA, 201 bp, Homo sapiens
cttttctgagcttaaaacttccaggaaactggagcttgggtttcagtgatgacttaagtgaggaggataacacttgtctttctaaataatagaagatgacrtagcaaggcatgctatatcactagaaaagggggcattttctcatatgaagtttataagaaaacaaaaactgtaagatctctgccatttaaattgtggatt

SEQ ID NO: 22962 - DNA, 201 bp, Homo sapiens
tctctagattacttatcatacctgatccaatgtaaatgctacataaatagttgttacactgtattgttttatttatatctttctttatttttttctgactrtttttgatccatagtttgttgaatccatggatgcagaacccatggataaggagggccgactgtattttaaatgtctctagtgattccgatgctccttcct

SEQ ID NO: 22963 - DNA, 201 bp, Homo sapiens
  misc_feature (1)...(201): n = A,T,C or G, or insertion/deletion polymorphism (see Tables 1-2)
cacatatgtggtgaggtgacttggaaggcagcttcaggtttgagcagttgtttagaaacaatgtattttgcctccctgtttattctagctcattctttctntttaataactttcaccaaatcacagttggcctttcttctctgacctgacacctgtgttatataaagagcattctacccagctataggaaacatctaagtc

SEQ ID NO: 22964 - DNA, 201 bp, Homo sapiens
gagcgtctttttttctgtcaggtgtttttttccagtataggaaagtagcccatttcctttaaagaccacccagcaggcatgatcccctgaggtgttttttwgttgagtgcttttgcatacttaaggagtaactgacctggcccggtggctcacgcctgtaatcccagcactttggaaagctgaggtgggcggatcacctgg

SEQ ID NO: 22965 - DNA, 201 bp, Homo sapiens
aaaagagaggagtgtgtagagagtgaatatgactgtgtagaggcagtgagtataagtaagagagtataagtgtagagagacgaaagttttctgtggctgtrggtttgtgtttccctgaaaggttaactgggaaaatttaggggtaattcctataaatgagcactgggagtggttgagaaatagaaaatgtagagatttctg

SEQ ID NO: 22966 - DNA, 201 bp, Homo sapiens
tgtcactttctgtaatttagaggaattgaaaaggtatcttggaaagaaattagttcttgggaacaaagtcttttttgtgcatatgtctttactgttggcayagagcattttctgggatgggctcttcagatctcctctccctgtaagtgatttcagaattccatgaatgttgggatatgtccaggctggcaccctgggatc

SEQ ID NO: 22967 - DNA, 201 bp, Homo sapiens
ttcagatctcctctccctgtaagtgatttcagaattccatgaatgttgggatatgtccaggctggcaccctgggatcatgaaaatagaagttaagacattyaagaagcaagaaaacaaaatgggtaggtgaggtgactaggaagaatatcatgcccagcacttctagaattctcaaaatgaggagcatcacttaaattttg

SEQ ID NO: 22968 - DNA, 201 bp, Homo sapiens
taagactttcttcagagactatttcaaataagaatttgggagatgttcatggtcacttctcagctattttgtgttttatgatagttagtttacattctccrttgagttatcctgttcttggcttatagagcttaaattaaagccataattgtactaattggataggtataattgctcagtgatctttaaggcattgcaaag

SEQ ID NO: 22969 - DNA, 201 bp, Homo sapiens
gatatcaaaattggactgctagtgaaaaataagattacgttgcaggtatggcccagtgccagcgggggccttggaacggttcatcctgctttgtaacccctgcattcccctttctgactggtggggagggtggaggctgactttctcctcagctactgccataagagctttttttttttcttttgactgagtctcactctg

SEQ ID NO: 22970 - DNA, 201 bp, Homo sapiens
actgtaatcccagctctttgggaggctgaggtgggaggattgcttgagctcaggagtttgagaccagcctgggtaacatagggataccttgtccctacttaaaaaaaaaaaaaaaaaaaattagctgggtgtggttgtgcacacctgtagttccagctattccagaggctgaggcaggaggataggttgagcatgggaggt

SEQ ID NO: 22971 - DNA, 201 bp, Homo sapiens
tttgcatcttaaaattcattccatatgagtgaatgtggaatgaagtgcctctttttttccttcacagttttagttttcggttttgaagttaacctgtcaayggacattttctcctcagcttttgctgttataaaaagtcactttgtaggtatgccattgtgcatgtatgagtattcttgcaggataaatttctaaaagtgt

SEQ ID NO: 22972 - DNA, 201 bp, Homo sapiens
aagactcttcgtgaatcctttgtgactcaagaatgtttttgattacacattccagtgtacctgaaagctatacagtaaggccagtttcataaaaatcctcktcgcttttaagttagagcaattaaaaatgaaacaaaaggacttgagcattcaataggaatatgaatacaagtgagtttagttgaaataaatactaattaa

SEQ ID NO: 22973 - DNA, 201 bp, Homo sapiens
ccttgctttcttttgttcttattcctgtatctttagcccctccttcacgtgttcttttcttgcagactataaaaatatgctttttccacaatcatttaaamaaaataaaaagacactttcccaggacatgtcaccatctcagactaactccttctccgttccccctagtttttcctcttcctttcttacacttctagaaaa

SEQ ID NO: 22974 - DNA, 201 bp, Homo sapiens
tccctctgctggtgacctggcgaatagtagcaggcacagttgtttctgctaaggctgttgctgataactctttcttactcagctatgctcttctcttttctttttttttttaatctgaatgcttttttcttctctctcctagttctgtgctttcctacagtgaggcctcgattctagactttctgttcaggtgaattaatt

SEQ ID NO: 22975 - DNA, 201 bp, Homo sapiens
catagtattccatggtgtatatgtgccacattttcttaatccattctatcattgatggacatttgggttggttccaagtctttgctattgtgaatggtgcygcagtaaacatacgtgcgcatgtgtctttatagcagcatgatttataatcctttgggtacatacccagtaatgggatggctgggtcaaatggtatttcta

SEQ ID NO: 22976 - DNA, 201 bp, Homo sapiens
cactgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacg

SEQ ID NO: 22977 - DNA, 201 bp, Homo sapiens
actgtcttccccaatggttgaagcagtttacagtccctccagcagtgtaaaagtgttcctatttctccacatcctctccagcacctgttgtttcctgactttttttttttttttttgagacggagtcttgctctgttgcccaggctggagtgcagtggcacaatcttggctcactgcaggcttcacctcccgtgttcacgc

SEQ ID NO: 22978 - DNA, 201 bp, Homo sapiens
cagtgcttcagcttttacatttttctccacagcctctttctctgtgggcttatctactcttgtggtgccattttccagatttaggtcttcagcaacaggtrtccctcctgagacctgtgtttccaactgcctacaagatgccactgtctggacgtcccgttgacatttcaagctgaacatgtttcaaccgtgaattgctca

SEQ ID NO: 22979 - DNA, 201 bp, Homo sapiens
  misc_feature (1)...(201): n = A,T,C or G, or insertion/deletion polymorphism (see Tables 1-2)
atatccttataaaaccctaaaaggtaaatgccattttatcccattgcatagttgaggaatatgtttccttctcttggttatggaagggtgcttagcttgantgactgattattaattccctcctgtagaagaagaaatcaacaacatgaagactgagttggagaagtatggcatccagatgcctgcctttagcaagattgg

SEQ ID NO: 22980 - DNA, 201 bp, Homo sapiens
tagccaggatggtctcgatctcctgacctcatgatccacctgccttggcctcccaaagtgctgggattacagacgtgagccgctgtgcccagcctgtttcytaactttttaatgatcactattctaactggtgtgagatggtatctcgttgtggttttgatttgcatttctctgatggccagtgatgaccattttttcatg

SEQ ID NO: 22981 - DNA, 201 bp, Homo sapiens
ctaactggtgtgagatggtatctcgttgtggttttgatttgcatttctctgatggccagtgatgaccattttttcatgtgtctgttggctgcataaatgtsttcttttgcaaagtgtctgttcatatccttcccctactttgtgatggggttgtttgtttcttttaaatttgtttgagttctttgtagattctggatatta

SEQ ID NO: 22982 - DNA, 201 bp, Homo sapiens
tatgtcctgaatggtattgcctaggttttcttctagggtttttatggttttaggtctaacatttaagtctttaatccatctcgaattaatttttgtataasgtgtaaggaagggatccagtttcagctttctacatatggctagccagttttcccagcaccatttattaaatagggaatcgtttccccatttcttgttttg

SEQ ID NO: 22983 - DNA, 201 bp, Homo sapiens
agggtttttatggttttaggtctaacatttaagtctttaatccatctcgaattaatttttgtataacgtgtaaggaagggatccagtttcagctttctacrtatggctagccagttttcccagcaccatttattaaatagggaatcgtttccccatttcttgttttggtcaggtttgtcaaagatcagatggttgtggata

SEQ ID NO: 22984 - DNA, 201 bp, Homo sapiens
  misc_feature (1)...(201): n = A,T,C or G, or insertion/deletion polymorphism (see Tables 1-2)
tggcctcacaaatctttcaactcagccctctaggtcctcatgtgcattagtggagaatagcgttcacatatgtgggctttgggtccaatgcagtttgaatnctgagtatgtcactaactagttgtgtaatttttggaacattgttaacctttctgatttcagtttccttatccttaaattgaaaattctagtagttcctac

SEQ ID NO: 22985 - DNA, 201 bp, Homo sapiens
acgcctggccactcgtggagtcttttaagtgcatacagtgttgcccagaaaaaaaaaaaaatcgaggctctggtaccaaggagaaaggagaaggtagatgtggataagtaactagatgttcctaaccattcttactgctgctgcccttgttcaagcccaggccatctgtcacttggatcacaatagcagcattgtaattca

SEQ ID NO: 22986 - DNA, 201 bp, Homo sapiens
ccagacctcagccttgtgagtagctgggactgcagatgcatgccaccatgctggcttaacatgccatcttgacctctttccctgtagcagtgggaaaaacrtatttttctcctaacacttaaccttctatgtgtgatctagatcctatcccttcttgtcttctagggttcttattccaatattattttcccaactataact

SEQ ID NO: 22987 - DNA, 201 bp, Homo sapiens
taaccattcttactgctgctgcccttgttcaagcccaggccatctgtcacttggatcacaatagcagcattgtaattcacccacttggttgaagtctcttstcactctaatctgtcagctgctttcctaacagtattgtttttctaaaaataatctccaccctgggcaatataatgaggactcacctctacaaaaaatatt

SEQ ID NO: 22988 - DNA, 201 bp, Homo sapiens
gtagcagtgggaaaaacgtatttttctcctaacacttaaccttctatgtgtgatctagatcctatcccttcttgtcttctagggttcttattccaatattrttttcccaactataacttgcactttttttcctgctgcttctttctctttagcacatgaacatcctcacccattcaagatacacttccttactcctagata

SEQ ID NO: 22989 - DNA, 201 bp, Homo sapiens
cactgcactccagcctggatgacagaatgaaaccttgtctctaaagtaaataataaacatctgattgttttattcctttgcttgacaaaatttcctggctstccagtatctttagtaacagtccaaaccctctaggctacttttcaagaccatttgcaatctgcctggagaagcaattttcagtcctcacctctggtctct

SEQ ID NO: 22990 - DNA, 201 bp, Homo sapiens
aaaacgtatttttctcctaacacttaaccttctatgtgtgatctagatcctatcccttcttgtcttctagggttcttattccaatattattttcccaactrtaacttgcactttttttcctgctgcttctttctctttagcacatgaacatcctcacccattcaagatacacttccttactcctagataccctgattgttt

SEQ ID NO: 22991 - DNA, 201 bp, Homo sapiens
tctctgctccttggtcatgccaaggttgtgtgctctttagacccttggtactaactgttccctctgcccagaatgttcctcgcccagtcctttgtgttgcrtcctatttgtcaaccaggtttcagcctaaacctatctccttaggaagactttccctaactatcccatctaaattagtcaccctccatcacattatcctct

SEQ ID NO: 22992 - DNA, 201 bp, Homo sapiens
cactttttttttttttttttttttagataaggtctggctctatcactcaggctggagtgcagtggcacgatctcggttcattgcaacctccacctcccggsttcaagcgattctcctgcctcagcctcctgagtagctgagattatgggtgcccgccacaacagccagctaatttttgtatttttagtagagatggggtct

SEQ ID NO: 22993 - DNA, 201 bp, Homo sapiens
aggctggagtgcagtggcgtgatctcggctcactgcaacctctgcctcgcaggttcagcgattctcctgcctcagcctcccaagtagctgggattacaggygcatgccactacaccctggtaatttttgtatttttactggagatggcgtttcgccatgttgaccaggctggtcttgaagtcctgacctcgggtgatccac

SEQ ID NO: 22994 - DNA, 201 bp, Homo sapiens
  misc_feature (1)...(201): n = A,T,C or G, or insertion/deletion polymorphism (see Tables 1-2)
aacttaaagcaggagcttaagggtagtttggaccatattagccaataggtcatgataaatgattacatttttagacgtaatgtcagcaagggttgcacagngagtttcggcatggcattccagagatgtatagaaagtctagttgcttacaaattttaggttgaaaagagagctggaaccaggtgccgattttagataaca

SEQ ID NO: 22995 - DNA, 201 bp, Homo sapiens
aacaacaaaagcccagatgtgatcaatatctataaggaactggagtcagaggaaaagatcattttaaacgcagatacatactgccagcttgtgtttttttaaaaaaattgcagatacataaattaaaagtcctctaaaggaaagaatttttttgtttgtttgttatgagacagggtctccctctgttgcccaggctgaagt

SEQ ID NO: 22996 - DNA, 201 bp, Homo sapiens
gatggatttttcctgttttcagatgagtttctttgagtcctatcttttcgctgtagtattgttccctctgctggtgacctggcgaatagtagcaggcacarttgtttctgctaaggctgttgctgataactctttcttactcagctatgctcttctcttttctttttttttttaatctgaatgcttttttcttctctctcc

SEQ ID NO: 22997 - DNA, 201 bp, Homo sapiens
cggcctcccaaagtgctgggatgacaggcgtgagccaccacacccggccttgtggggtcctttcaagacttttgacccttgctttctcatcaccactcttmtaaagttcagaagtgagaccactcagatttcttaaacttgttcaggacaatggtgaaagtagcaggaaaagcgggagcattgcagtcagatctggattta

SEQ ID NO: 22998 - DNA, 201 bp, Homo sapiens; identical to SEQ ID NO: 3666

SEQ ID NO: 22999 - DNA, 201 bp, Homo sapiens
cctcgtgggttcaagtgattctcctgcctcagcctcctgagtggctgggattacaggcgcacaccatcacgcccggctaatttttttttttttttgagacmgtttggctcttattgcccaagctgcagtgcaatggcacaatctcggctcactgcaacctccgcctcctgggttcaagtgattctcctgcctcagcctcct

SEQ ID NO: 23000 - DNA, 201 bp, Homo sapiens
tcctcaaatataacaactgtcattcaatacacatgtttgagcacccagtgagctaagttttaaggattcaaagatgaaaagtcatgctgtctcctctgcaragggtgctcagactagtgatggaaacagtatgggatgaaagaaagcagaaggccattgctgagcaggcagtggactcagcagaggctgaaactatacaag

SEQ ID NO: 23001 - DNA, 201 bp, Homo sapiens
atgtggtcctcaaatataacaactgtcattcaatacacatgtttgagcacccagtgagctaagttttaaggattcaaagatgaaaagtcatgctgtctccyctgcaaagggtgctcagactagtgatggaaacagtatgggatgaaagaaagcagaaggccattgctgagcaggcagtggactcagcagaggctgaaacta

SEQ ID NO: 23002 - DNA, 201 bp, Homo sapiens
gtcatcttcactcatcagctgaccatgttgcctcttacggtgtaaacttgtaccagtcttatggtccctctgggcagtacagccatgaatttgatggagaygaggagttctatgtggacctggagaggaaggagactgtctggcagttgcctctgttccgcagatttagaagatttgacccgcaatttgcactgacaaaca

SEQ ID NO: 23003 - DNA, 201 bp, Homo sapiens
tcagtcacagaaggtgtttctgagaccagcttcctctccaagagtgatcattccttcttcaagatcagttacctcaccttcctcccttctgatgatgagakttatgactgcaaggtggagcactggggcctggatgagcctcttctgaaacactggggtaaggatgagtttcaccattttttgatgctttcttgtctgtca

SEQ ID NO: 23004 - DNA, 201 bp, Homo sapiens
aaatataattttccatatttttatggaggaaggcgtccacacaagcaagagtgcttggggctcacatgtcagaacgcaaccctgatcatggctgatcctgrccttcgtgtggttctgctaactatgtgcctgtcagtcttccccaaaatctatgtggtcctcaaatataacaactgtcattcaatacacatgtttgagcac

SEQ ID NO: 23005 - DNA, 201 bp, Homo sapiens
tctttataccaattcagtcataaaatataattttccatatttttatggaggaaggcgtccacacaagcaagagtgcttggggctcacatgtcagaacgcawccctgatcatggctgatcctggccttcgtgtggttctgctaactatgtgcctgtcagtcttccccaaaatctatgtggtcctcaaatataacaactgtca

SEQ ID NO: 23006 - DNA, 201 bp, Homo sapiens; identical to SEQ ID NO: 13717

SEQ ID NO: 23007 - DNA, 201 bp, Homo sapiens
ggcactcagtcacagaaggtgtttctgagaccagcttcctctccaagagtgatcattccttcttcaagatcagttacctcaccttcctcccttctgatgakgagatttatgactgcaaggtggagcactggggcctggatgagcctcttctgaaacactggggtaaggatgagtttcaccattttttgatgctttcttgtc

SEQ ID NO: 23008 - DNA, 201 bp, Homo sapiens
catgatgtgccaggcactcaggaaatagtgaaaattggacacgcgatattctgcccttgtgtagcacacaccgtagtgggaaagaaagtgcacttttaacyggacaactatcaacacgaagaggggaggaagcaggggctggaaatgtccacagactttgccaaagacaaagcccataatatctgaaagtcagtttcttcc

SEQ ID NO: 23009 - DNA, 201 bp, Homo sapiens; identical to SEQ ID NO: 3695

SEQ ID NO: 23010 - DNA, 201 bp, Homo sapiens
gaaagaaagcagaaggccattgctgagcaggcagtggactcagcagaggctgaaactatacaagtgacttggttccagctgggccagcaggataaccagaygaaaagaaggattgcatatattccatatatatttatgtttgaacaaagagtcaaggtttattgcaaggataaggaggttttgttggtggcctgttaagac

SEQ ID NO: 23011 - DNA, 201 bp, Homo sapiens; identical to SEQ ID NO: 3696

SEQ ID NO: 23012 - DNA, 201 bp, Homo sapiens; identical to SEQ ID NO: 3706

SEQ ID NO: 23013 - DNA, 201 bp, Homo sapiens; identical to SEQ ID NO: 3707

SEQ ID NO: 23014 - DNA, 201 bp, Homo sapiens; identical to SEQ ID NO: 3708

SEQ ID NO: 23015 - DNA, 201 bp, Homo sapiens
ggaggccctgctggtgccaggctatggtgggtccagcagggtggcagggagggagaaccctctccaggacagagcggtgacatggaggctaggccgcagcrggtcacagcctcagctggatgctggcccgagttccctggggaaggagttccctgggccttggcctgagggacctgcatggtcacagggggcatgggcatc

SEQ ID NO: 23016 - DNA, 201 bp, Homo sapiens; identical to SEQ ID NO: 3948

SEQ ID NO: 23017 - DNA, 201 bp, Homo sapiens; identical to SEQ ID NO: 3721

SEQ ID NO: 23018 - DNA, 201 bp, Homo sapiens; identical to SEQ ID NO: 3722

SEQ ID NO: 23019 - DNA, 201 bp, Homo sapiens; identical to SEQ ID NO: 3723

SEQ ID NO: 23020 - DNA, 201 bp, Homo sapiens
ctttaaggagccctccaggggctgccatgtgcctgagtgtgagaaccagtgtagtgagcagctccttgcaggctgcccatctgcgtctcctgtcagactgyggcgctccatgagccagcttcatgggcccccatggtcagggtcttctggccgctgcccccaccttccctcccgctgccagcacgtctcaacaggtgggag

SEQ ID NO: 23021 - DNA, 201 bp, Homo sapiens; identical to SEQ ID NO: 3724

SEQ ID NO: 23022 - DNA, 201 bp, Homo sapiens; identical to SEQ ID NO: 3725

SEQ ID NO: 23023 - DNA, 201 bp, Homo sapiens; identical to SEQ ID NO: 3726

SEQ ID NO: 23024 - DNA, 201 bp, Homo sapiens; identical to SEQ ID NO: 3730

SEQ ID NO: 23025 - DNA, 201 bp, Homo sapiens; identical to SEQ ID NO: 3731

SEQ ID NO: 23026 - DNA, 201 bp, Homo sapiens; identical to SEQ ID NO: 3734

SEQ ID NO: 23027 - DNA, 201 bp, Homo sapiens
cacccagacccctcaccaagccagccccgccctgtgggccgtgaccgagagcccctcgctcacaggtgaagctggtgaacatcaggaatgatgacatcgcygacggcaaccccaagctgacccttggcctcatctggacaatcattctgcacttccaggtagaacggctgcccccaggacccccaccccctgcaggagttt

SEQ ID NO: 23028 - DNA, 201 bp, Homo sapiens
aggcttctgcgcagcacaggctgactcacccgctgcttgtcctggctgcacaggaaaccacaaatctgagagctgagcaggcagagcctggtgctggcacrgcagctgagtcacacaggctggcaggacgacaggcagctaggggtgggtgggcagaacctggcctgagcatgccactgagtgtaaagccaggctgccaga

SEQ ID NO: 23029 - DNA, 201 bp, Homo sapiens; identical to SEQ ID NO: 3741

SEQ ID NO: 23030 - DNA, 201 bp, Homo sapiens; identical to SEQ ID NO: 3747

SEQ ID NO: 23031 - DNA, 201 bp, Homo sapiens; identical to SEQ ID NO: 3756

SEQ ID NO: 23032 - DNA, 201 bp, Homo sapiens; identical to SEQ ID NO: 3757

SEQ ID NO: 23033 - DNA, 201 bp, Homo sapiens
actgagctcgcactgagccccaccctgcgcaggggtggcctccagagcatggaaggctctcctcccacctgtcccgcagcatccgcagaggccgggctgtygttgggccaaggctgcgaggcagaagcctggggcaggtgaggtggctcctgtggacctgccgcaggctcaggcggggagcagagcaggggtctgtgcctc

SEQ ID NO: 23034 - DNA, 201 bp, Homo sapiens; identical to SEQ ID NO: 3760

SEQ ID NO: 23035 - DNA, 201 bp, Homo sapiens; identical to SEQ ID NO: 3768

SEQ ID NO: 23036 - DNA, 201 bp, Homo sapiens
ggtcttgtctcccccagatgagcgggatcgtgtgcagaagaaaaccttcaccaagtgggtcaacaagcacctcatcaaggttggtggcgcatgctggtgcstgtcacaggggctgaggctgtgggaggcgctgagggagggtggcccctgccgcccaaggctgtccccatgctgcctgtgtgctcacctttcatctctgaa

SEQ ID NO: 23037 - DNA, 201 bp, Homo sapiens; identical to SEQ ID NO: 3769

SEQ ID NO: 23038 - DNA, 201 bp, Homo sapiens
aggtgcctccgtggggcagggtgtgttccgtgggctcccgggagactcagcccccgcctccttccctctgggaccagcacccactctgtagatcagccacycagggcctattggtggctctgggggactggccacctcagccgctgctgtccccacaggcccagaggcacatcagtgacctgtatgaagacctccgcgatg

SEQ ID NO: 23039 - DNA, 201 bp, Homo sapiens
cagagctcgtgggccaactgtgctggtccaggatggccctgttggatgggctgcccctctccacccagccctggctagggagcaccagctgtacccctgcmgtgaggcccctgccctccctgtgccctggtggtctgcttgtccctgggtggggcccatgggggcctgccagcaacacatctgtgtgggaagccatccgtc

SEQ ID NO: 23040 - DNA, 201 bp, Homo sapiens
ggggccaggtagccgccaccacggtgagcgctgtacacgcacagcacctagagctgcttcccacagcaaagggcaggggttgggtagccaccatgacttcscctctacacggaggacacgcctgtgccttgacctccccccttgaccctctgtggccctgcgtcaaggaggaagcctggaggtggcctggctgccttgccc

SEQ ID NO: 23041 - DNA, 201 bp, Homo sapiens
ggatcactggcttggccgagtcacccgtttgcgggatttctgtagatcgccggcaggcttctaaggggtagttacgatgggatttgatttgcacttcactsgtcagcaagcacctgggtggagaggtatggagaggggaggcaggtgtcaccattgcccctggacagatgcctggggctgtgctggttggggaggactcag

SEQ ID NO: 23042 - DNA, 201 bp, Homo sapiens
ctgaaaagagagcggtgttgccaggggctgggtgagaaaatatcctggaattgacagctacacaactccgaatctactgaaaccactgaattggacgcttygaatgggtgaatggtgtggcatgtgaattacctctcaataaagctattaaaaaatactaataatcagcatgaggtcaacctaattggtactgacatgaaa

SEQ ID NO: 23043 - DNA, 201 bp, Homo sapiens
tggcctgtgtggcagccatggacaggtacagcatggaggagctgattcagctgggccaaggtagggcaggcagagctgggggctgtgggaggcagaggagrgggccggggccgcctctggcagacctgtctcttcccgttgtccaccgttctgtgccgtcagacctgggatgcagggataggcacagccccctctcggagc

SEQ ID NO: 23044 - DNA, 201 bp, Homo sapiens
gggtgtgtgccgaggccgcgggcagtgctggggggctgcggcttggccaggcgtgcggctggcccctcctcccggcgggtgtggccgcggggacgcagggrttaaggccaactaaccttgagcgtcagtagccctgcgcagggacagctgagccggccgggtggggagcgagggtggggaggcgccgagggccggacccgc

SEQ ID NO: 23045 - DNA, 201 bp, Homo sapiens
gcccctcctggggcttcccgatgctccattcccccatgaggcccggcctccgtgagtcagccctcagctacgcgcctccgacgtgaggtgtctgcctgggscagggtgggctccgcaggtgggcactgctccaggatgtgccaggtgggcagcttgggaggggccaggcctggggtgggaccccactggccccagggccag

SEQ ID NO: 23046 - DNA, 201 bp, Homo sapiens
ccatgtggccaccgttccaggcaggctgggctgggcagtctcaggctccttcatgggaacttgctgctgctgcagcttgtcgataagcctctggctgcgggagaccacaggtgaccatggtggccactcacaggcgggcagcttgacttcaggggggaagttaaaggcggagtcggtgcatgaaaagctgtgtgttccttc

SEQ ID NO: 23047 - DNA, 201 bp, Homo sapiens
gctcctgtggacctgccgcaggctcaggcggggagcagagcaggggtctgtgcctccggagggctgagtgtgtgctggatgtatctggcaggatttcactrggcctggtctccctggggctattgtcgggggccccaggtggaggtatctgccagcagggtgtctgcctgtcgcaggtcgcctctgcatggggtcactggg

SEQ ID NO: 23048 - DNA, 201 bp, Homo sapiens
cttcccgccgggacactcccctccctggcggcggcctgggcagggtggggcctcgggggcgggccggcctcgccggggagtacagcaggcagggagtggcygcaccgactggggctctgagctgagcctgtgccgagtgagcgtctcgtggggccgccagccttcagctgcctgtgtgccacacggggctgcccagagcac

SEQ ID NO: 23049 - DNA, 201 bp, Homo sapiens
agggttccatctcaccacctgttgtgtcccacacacagccacaggagctgcctgaggccacctctcgtggccctccccactctccccactggcgctgccascaccccctgcccccagctcagcctgccccaggctgccccacctgtggcctgcccccctggcctggtgtggctacactgctcccccacagtggctggtgcc

SEQ ID NO: 23050 - DNA, 201 bp, Homo sapiens
ggtgtggtggagacagtgggcacaggacaggtttgagagatatttgggaacgatgggccccctaatggatggtcatgtgggtgggacccaggaccttccccgcaaattggtctctagcagacacctggtattgagatactcttgtactgggctgcaggggagagaggagaaggatgtggctcggagagatgacctctgtgc

SEQ ID NO: 23051 - DNA, 201 bp, Homo sapiens
cccaggaggcagaggttgcagtgagccaagatcacaccattgcactccagcctgggtgacagagcgagattctgcctcagttaaaaaaaaaaaaaaaaaaagtctccctaggctgaggaaaatttttatgcattaaattaaaaaaattgatctggaccaggcagtgtggctcacacttgtaattccagcactgggaggtgg

SEQ ID NO: 23052 - DNA, 201 bp, Homo sapiens; identical to SEQ ID NO: 3775

SEQ ID NO: 23053 - DNA, 201 bp, Homo sapiens; identical to SEQ ID NO: 3776

SEQ ID NO: 23054 - DNA, 201 bp, Homo sapiens; identical to SEQ ID NO: 3779

SEQ ID NO: 23055 - DNA, 201 bp, Homo sapiens; identical to SEQ ID NO: 3780

SEQ ID NO: 23056 - DNA, 201 bp, Homo sapiens; identical to SEQ ID NO: 3781

SEQ ID NO: 23057 - DNA, 201 bp, Homo sapiens
gccgggggctgcggagctggggagtgggccgtccgagcgctcctggatccggcctggtgacctggcagtctggctggggttagcggggtcgcgtgccccakaaccacaggctgggggggaggggtgcgcggtgcggccgggagcatgcgcccggggcggccctgtccggcgcattgatcagctgaagccccgcccctggcc

SEQ ID NO: 23058 - DNA, 201 bp, Homo sapiens
tcaggctcccgagtagctgggactacaggcgcccgccaccatgcccagctaattttttgtatttttagtagagacggggtttcaccgtgttagccaggacrgtctcgatctcctgacctcgtgatctgcccacctcggcctcccaaagtgctgggattacaggcgtgagccaccgcgcctggcctaattctgtctgtggtt

SEQ ID NO: 23059 - DNA, 201 bp, Homo sapiens; identical to SEQ ID NO: 3787

SEQ ID NO: 23060 - DNA, 201 bp, Homo sapiens; identical to SEQ ID NO: 3788

SEQ ID NO: 23061 - DNA, 201 bp, Homo sapiens
ctgctccgcgctgtctgagtgaactgtgccggtgcgtgccccgtcagcgcctgcccgtgttcacactctctctgcttctcttcttctctctgctgtggccrcagaggctggctgagcagcagcgggcagaggagcgcgagcggctggccgaggtggaggccgcgctggagaagcagcggcagctggccgaggcgcacgccc

SEQ ID NO: 23062 - DNA, 201 bp, Homo sapiens
gcaggaaagccttggcaccgctggggggctggtcttggagatgggggtcgggggccagccatccccacccaacacggagtgggccgacaggcgcccgcgargctgacgggggcctccgagcgtcagatgtcgggcctggaagggcgaggaactctgcgctctggggaaggttcgctgccctgtcagcagcacacgcggctt

SEQ ID NO: 23063 - DNA, 201 bp, Homo sapiens; identical to SEQ ID NO: 3789

SEQ ID NO: 23064 - DNA, 201 bp, Homo sapiens
ggtcttggagatgggggtcgggggccagccatccccacccaacacggagtgggccgacaggcgcccgcgaggctgacgggggcctccgagcgtcagatgtmgggcctggaagggcgaggaactctgcgctctggggaaggttcgctgccctgtcagcagcacacgcggcttcccttccaacaccccagcgggcccgggccc

SEQ ID NO: 23065 - DNA, 201 bp, Homo sapiens; identical to SEQ ID NO: 3714

SEQ ID NO: 23066 - DNA, 201 bp, Homo sapiens; identical to SEQ ID NO: 3715

SEQ ID NO: 23067 - DNA, 201 bp, Homo sapiens; identical to SEQ ID NO: 3716

SEQ ID NO: 23068 - DNA, 201 bp, Homo sapiens; identical to SEQ ID NO: 3717

SEQ ID NO: 23069 - DNA, 201 bp, Homo sapiens; identical to SEQ ID NO: 3718

SEQ ID NO: 23070 - DNA, 201 bp, Homo sapiens; identical to SEQ ID NO: 3796

SEQ ID NO: 23071 - DNA, 201 bp, Homo sapiens; identical to SEQ ID NO: 3720

SEQ ID NO: 23072 - DNA, 201 bp, Homo sapiens
agtgatacagcttgggcatctctctgtgacattaatttacaatacagcattcccctgtatggaaaccatatcatatttaaccaatcaatcctttctcctargacacggagtttaattttggatttttgtattagaaatgactgcagtgaacagtgttgtagctgggtcattgtgcatctctatgactgttgttaaaaaggg

SEQ ID NO: 23073 - DNA, 201 bp, Homo sapiens
ttggccaggctggtctcgaacttctgacctcaggtgatccgcccgccttgacctcccaaagtgctgaattacaggcatgagccactgggcttggcctaagwttttattttattttattgtttattttattattattattattattatttgagacggagtttcgctcttgttgcccaggctggagtacaatggcatgatctc

SEQ ID NO: 23074 - DNA, 201 bp, Homo sapiens
caggctgggtcctgagtgtccttgtgttacagaggctcccaacctccttctccccaaggctgttcttctcctgaagcaagcctctgaccacagggtcagcygacccccagggttgggtctgggcttggcaggcagcaccctgggtcgctgtggcttgggttccattcccttgggctattgctcgagccccatgtcatggcc

SEQ ID NO: 23075 - DNA, 201 bp, Homo sapiens
ggttgggtctgggcttggcaggcagcaccctgggtcgctgtggcttgggttccattcccttgggctattgctcgagccccatgtcatggccctgagccccrctttcccgccaggctcaagaccatcagcctggtgatccgcggcacgcagggggccgaggaggtgctcagggcccacgaggagcagctcaaggaggcccag

SEQ ID NO: 23076 - DNA, 201 bp, Homo sapiens
tggtgatccgcggcacgcagggggccgaggaggtgctcagggcccacgaggagcagctcaaggaggcccaggccgtgccggccaccctcccggagctcgargccaccaaggcctctctgaaggtatcgtttcgaggcttgggcttcatggcggggtgggggtacagcgggcccagctgaagccgcacatgtccctcctgtc

SEQ ID NO: 23077 - DNA, 201 bp, Homo sapiens; identical to SEQ ID NO: 3728

SEQ ID NO: 23078 - DNA, 201 bp, Homo sapiens
gcagaccccttgggcgcctggctgcaggacgccaggcggcggcaggagcagatccaggccatgccgctggccgacagccaggctgtgcgggagcagctgcrgcaggagcaggtgggcttgggtcggtggggacggggcggctgggcgtgccctgcggccacggctctgaccacaccatcacccaggccctgctggaggaga

SEQ ID NO: 23079 - DNA, 201 bp, Homo sapiens; identical to SEQ ID NO: 3732

SEQ ID NO: 23080 - DNA, 201 bp, Homo sapiens; identical to SEQ ID NO: 3733

SEQ ID NO: 23081 - DNA, 201 bp, Homo sapiens; identical to SEQ ID NO: 3735

SEQ ID NO: 23082 - DNA, 201 bp, Homo sapiens; identical to SEQ ID NO: 3736

SEQ ID NO: 23083 - DNA, 201 bp, Homo sapiens; identical to SEQ ID NO: 3737

SEQ ID NO: 23084 - DNA, 201 bp, Homo sapiens; identical to SEQ ID NO: 3740

SEQ ID NO: 23085 - DNA, 201 bp, Homo sapiens; identical to SEQ ID NO: 3739

SEQ ID NO: 23086 - DNA, 201 bp, Homo sapiens
cacagccacaggagctgcctgaggccacctctcgtggccctccccactctccccactggcgctgccagcaccccctgcccccagctcagcctgccccaggmtgccccacctgtggcctgcccccctggcctggtgtggctacactgctcccccacagtggctggtgccgcctctcctccctcgtgagcgtcccccctgcag

SEQ ID NO: 23087 - DNA, 201 bp, Homo sapiens; identical to SEQ ID NO: 3742

SEQ ID NO: 23088 - DNA, 201 bp, Homo sapiens; identical to SEQ ID NO: 3743

SEQ ID NO: 23089 - DNA, 201 bp, Homo sapiens
aggctgtgcgggagcagctgcggcaggagcaggtgggcttgggtcggtggggacggggcggctgggcgtgccctgcggccacggctctgaccacaccatcrcccaggccctgctggaggagatcgagcgccacggcgagaaggtcgaggagtgccagaggtttgcgaaacagtacatcaacgccatcaaggtgaggcccag

SEQ ID NO: 23090 - DNA, 201 bp, Homo sapiens; identical to SEQ ID NO: 3744

SEQ ID NO: 23091 - DNA, 201 bp, Homo sapiens
agaaggtcgaggagtgccagaggtttgcgaaacagtacatcaacgccatcaaggtgaggcccagccgcctgcaccaggccccaagtccgggaccgttgccrggatgatggcgggctttccctgagcctgggccatgccagggaaagcccatgtgagggtttaggggctgggcaggggccatcggagggcagagctggtggc

SEQ ID NO: 23092 - DNA, 201 bp, Homo sapiens; identical to SEQ ID NO: 3745

SEQ ID NO: 23093 - DNA, 201 bp, Homo sapiens
gctgagcgcgagtacggctcctgcagccaccactaccagcagctgctgcagagcctggaacagggtagggcacggcagggctggggcggttgggctggtgygaggtgggcggtggagtgacccacatgtgttccccaggtgcacaggaagagtctcgctgccagcgctgcatctccgagctcaaagacatccggctgcagc

SEQ ID NO: 23094 - DNA, 201 bp, Homo sapiens
cgcgacgtgcagctcatccgctcctggtccctggccacggtacgcctgcccccgagccgggggctctctgggtgggaggaggggagaggcgttgtgcaggkcacggccgcctcgcccggcactcagccccacgtgcttcccccagttccgcaccctgaagccagaggagcagcgccaagccctgcacagcctggagctgca

SEQ ID NO: 23095 - DNA, 201 bp, Homo sapiens
caggaggcccaggaggccgtcaccaggtgggtggcgggggctcagcaggtgggggctggaaggcgggtggggcgctggtgacgctgactgtagccctgacmtgccaggctggaggcccagcaccaggccctggtcacgctgtggcaccagttgcacgtggacatgaagagccttctggcctggcagagccttcgccgcgac

SEQ ID NO: 23096 - DNA, 201 bp, Homo sapiens; identical to SEQ ID NO: 3746

SEQ ID NO: 23097 - DNA, 201 bp, Homo sapiens
acttctgacctcaggtgatccgcccgccttgacctcccaaagtgctgaattacaggcatgagccactgggcttggcctaagtttttattttattttattgkttattttattattattattattattatttgagacggagtttcgctcttgttgcccaggctggagtacaatggcatgatctcggctcactgcaacctccgc

SEQ ID NO: 23098 - DNA, 201 bp, Homo sapiens
tcaatgcaacctccacttctcctgcctcagcctcctgagtagctgggactacaggcgcccgccaccacacccggctaatattttgtatttttagtagagayggggtttcactgtgttagccaggatggtctcaatctcctgacctcgtgatctgcccgccttggcctcccacagtgctgggattacaggcgtgagccacca

SEQ ID NO: 23099 - DNA, 201 bp, Homo sapiens
cctcagcctcctgagtagctgggactacaggcgcccgccaccacacccggctaatattttgtatttttagtagagatggggtttcactgtgttagccaggmtggtctcaatctcctgacctcgtgatctgcccgccttggcctcccacagtgctgggattacaggcgtgagccaccacaccaggtttcagacacaattttt

SEQ ID NO: 23100 - DNA, 201 bp, Homo sapiens; identical to SEQ ID NO: 3748

SEQ ID NO: 23101 - DNA, 201 bp, Homo sapiens
acaatttttaaacaatttctaagttgctggctaggtactgcagtcgtcgtccctccagcagtgcccaagtgggccgactcctcccacctgcccagcacccrgtgttggagcttcagacaagtcacatggcctcgctgtctgacgggaacttgtgtaaggagtctcctggcagagccagcgggagggtgagcagaactgcgg

SEQ ID NO: 23102 - DNA, 201 bp, Homo sapiens; identical to SEQ ID NO: 3749

SEQ ID NO: 23103 - DNA, 201 bp, Homo sapiens
gtcgtcgtccctccagcagtgcccaagtgggccgactcctcccacctgcccagcacccggtgttggagcttcagacaagtcacatggcctcgctgtctgaygggaacttgtgtaaggagtctcctggcagagccagcgggagggtgagcagaactgcggccgcgtcaggttagcgcggcatctgccacctgggcctctgca

SEQ ID NO: 23104 - DNA, 201 bp, Homo sapiens; identical to SEQ ID NO: 3750

SEQ ID NO: 23105 - DNA, 201 bp, Homo sapiens; identical to SEQ ID NO: 3751

SEQ ID NO: 23106 - DNA, 201 bp, Homo sapiens; identical to SEQ ID NO: 3752

SEQ ID NO: 23107 - DNA, 201 bp, Homo sapiens; identical to SEQ ID NO: 3753

SEQ ID NO: 23108 - DNA, 201 bp, Homo sapiens
cagagtgcaggaggggtgtgggtgccagtgtccaggcgagaggctgggtggggagagttcagtgtctaggttaagaaggtggtgggtgggtcggcgtgcakagtccactcctgaacaggcagagatgtgacccctcctgctccccttccaggaggccatgtcgggtgaggacgctgaggtccgggcagtctctgaagatgt

SEQ ID NO: 23109 - DNA, 201 bp, Homo sapiens; identical to SEQ ID NO: 3754

SEQ ID NO: 23110 - DNA, 201 bp, Homo sapiens; identical to SEQ ID NO: 3755

SEQ ID NO: 23111 - DNA, 201 bp, Homo sapiens; identical to SEQ ID NO: 3758

SEQ ID NO: 23112 - DNA, 201 bp, Homo sapiens
cacctcccgcacgccagtgctcttggggacgggggctggggagtgtgcgcgcgtgggtatgcgtgcgtcctggttgcgtccgcggtgccggtgtacgcgcycccactgtgggccgctggagctgcggcccgggctccctcccggcctcgctgcagcagagctcccgcggcccacgccgctgcggctgcagctatttatagg

SEQ ID NO: 23113 - DNA, 201 bp, Homo sapiens; identical to SEQ ID NO: 3759

SEQ ID NO: 23114 - DNA, 201 bp, Homo sapiens
gagggcagggaggcccctgcgggaggccaggagagggctgcaaggccaggtgctgagccctggggggatgttgcagacgacgggaagcggggctggtaggmgcaggaaagagggaaggagagggtcactgctgtgcacccagctccagccccagggtctggttccatctgcatgaccttcagggcttttcacagcacacac

SEQ ID NO: 23115 - DNA, 201 bp, Homo sapiens; identical to SEQ ID NO: 3762

SEQ ID NO: 23116 - DNA, 201 bp, Homo sapiens; identical to SEQ ID NO: 3761

SEQ ID NO: 23117 - DNA, 201 bp, Homo sapiens
gctgctgccccctggggaagacccttggctcggttgctgcggcgctttggggcatgctgagggtggggcccgggagctgcagctgcactgtgggtgctgastgtgcctccccacagccccgggagaaggggaggatgcgtttccacaagctgcagaatgtccagattgccctggactacctccggcaccgccaggtaaggc

SEQ ID NO: 23118 - DNA, 201 bp, Homo sapiens; identical to SEQ ID NO: 3763

SEQ ID NO: 23119 - DNA, 201 bp, Homo sapiens
cgcagaggggtgggatgggaggaggcagtaccttctgcagcccgcaggggaggggcaaggggcgagggcattgtagggaccagagcgtagctgggaggacrtggtgggtgagctggggtgagaggagggtgccctgtctgggttgggaaggagcgagggtgcatgggtctgcttggggccaacccccggggcctgtcccag

SEQ ID NO: 23120 - DNA, 201 bp, Homo sapiens; identical to SEQ ID NO: 3764

SEQ ID NO: 23121 - DNA, 201 bp, Homo sapiens
ctggagtctgggctgcacgggtactctggagactagggggcaactggaggggccagcaggagttgggaggcaccatgggaggtgtagaggtcagccgaagsgggaatgaggcaggatgttctgggctgcatgggtactctggagactagggggcaactggaggggccagcaggagttgggaggcaccatgggaggtgtaga

SEQ ID NO: 23122 - DNA, 201 bp, Homo sapiens; identical to SEQ ID NO: 3766

SEQ ID NO: 23123 - DNA, 201 bp, Homo sapiens; identical to SEQ ID NO: 3765

SEQ ID NO: 23124 - DNA, 201 bp, Homo sapiens
gcctggagtctgggctgcacgggtactctggagactagggggcaactggaggggccagcaggagttgggaggcaccatgggaggtgtagaggtcagccgargcgggaatgaggcaggatgttctgggctgcatgggtactctggagactagggggcaactggaggggccagcaggagttgggaggcaccatgggaggtgta

SEQ ID NO: 23125 - DNA, 201 bp, Homo sapiens; identical to SEQ ID NO: 3767

SEQ ID NO: 23126 - DNA, 201 bp, Homo sapiens
tctgttgcagggccagctctcccccgccacccggggtgcctaccgtgactgcctgggtcggctggacctgcagtacgccaagctgctggtgagtgggggcrgggccagccgggggaggtgggtagcccgcggcctgctgacacgcaccctcctgcccacagaactcctccaaggcccgcctcaggtccctggagagcttgc

SEQ ID NO: 23127 - DNA, 201 bp, Homo sapiens
gggcgactggacacctcttggcagctgggccgactgtctaagtcaccagcccacagccctcagcacggaggcctctcccatagggtgcccagagctctccygccacaggctgcagtagcctcagccccagaggaatctgccctggatgggggacagggagaatgggggggctgaggggctcaggcagacaggaatggttat

SEQ ID NO: 23128 - DNA, 201 bp, Homo sapiens
tgccccagggtgtaccgtctgcacgagcgcctggtagccatccgcaccgagtacaacctacggctgaaggcaggcgtggcggcccctgcaacccaggtggyccaggtgactctgcagagtgtgcagaggcgccccgagctggaggactccactctgcgctacctgcaggacctgctggcctgggtggaggagaaccagcac

SEQ ID NO: 23129 - DNA, 201 bp, Homo sapiens
aggggcggggcatgtggtggggaatccaggcctgagctcctccctcctcgtgtgcagctaactctcactgcctgctttgggcagagttggtttctggccayggggcagaacccacgctgggctgccttgcccccgccaggccccctccccgacagcggcttactgttaggggaggggttgggggagggcccaacccactgc

SEQ ID NO: 23130 - DNA, 201 bp, Homo sapiens
gagggggctgtccccctgggctcctggggcaggggcaggggcaggggcggggcatgtggtggggaatccaggcctgagctcctccctcctcgtgtgcagcyaactctcactgcctgctttgggcagagttggtttctggccacggggcagaacccacgctgggctgccttgcccccgccaggccccctccccgacagcggc

SEQ ID NO: 23131 - DNA, 201 bp, Homo sapiens
gcaagctgcacgtggccatcctggagcgggagaagcagctccgcagcgagtttgagaggtgggtggggccctgtggtggcaggggaaccacccgagggtgwgtcactgcctgggaaggaaacccccctccccgccccgcccccggcgggggaacccaagctcccactcgccttaggacagtgggccacagccagggagacc

SEQ ID NO: 23132 - DNA, 201 bp, Homo sapiens; identical to SEQ ID NO: 3771

SEQ ID NO: 23133 - DNA, 201 bp, Homo sapiens
ccccctgccccctgcctatagggcctgagtgtggcccctgtctacagggagcggtgcaagcaggccagctcaaggtgccccctggctaccacccgctggaygtggagaaggagtggggcaagctgcacgtggccatcctggagcgggagaagcagctccgcagcgagtttgagaggtgggtggggccctgtggtggcaggg

SEQ ID NO: 23134 - DNA, 201 bp, Homo sapiens
ggaggtgagtgggaccgctggaggggtgggtggtgtcctggaacgccccaggcctgaaaggttcttccggagccgacctggccctgcctttgggaccaggrctgtcccaggtctggtgggctggggtctgaaggcccagcgccccaccccctgccccctgcctatagggcctgagtgtggcccctgtctacagggagcggt

SEQ ID NO: 23135 - DNA, 201 bp, Homo sapiens; identical to SEQ ID NO: 3773

SEQ ID NO: 23136 - DNA, 201 bp, Homo sapiens; identical to SEQ ID NO: 3774

SEQ ID NO: 23137 - DNA, 201 bp, Homo sapiens
ggccttgctttccagtagctccccatccagggagaacgatgggaagcatccagcgagatgcttggggaagggggagggcaggagggaagtgggtgacctakagctgtgctaggagagggaggagcagtagctctctaggctttggcttgagagtcctgacctgttccagccggagggcagggaggcccctgcgggaggcca

SEQ ID NO: 23138 - DNA, 201 bp, Homo sapiens; identical to SEQ ID NO: 3777

SEQ ID NO: 23139 - DNA, 201 bp, Homo sapiens; identical to SEQ ID NO: 3778

SEQ ID NO: 23140 - DNA, 201 bp, Homo sapiens; identical to SEQ ID NO: 3936

SEQ ID NO: 23141 - DNA, 201 bp, Homo sapiens
tgagccaggatccggtgtctgtggccagcagacacatgggtcaaggctgagccatcccctgccccacctctggggcgcgtctgcatggaacaggggcagcyccgccgcctggcaatgggtcacatagttgccgcctctcctcacctccctaaactggcgagggcctgggctgccacccttccttggcagggcacccccccc

SEQ ID NO: 23142 - DNA, 201 bp, Homo sapiens
agccgatcagagcagactccagctccacgtggctggttttgctggctctgcccccaagggcagctcagggagagaggtcctgctggggccccgtggtgccrctctccaccacaaccttgcccagctgggtaggtttcatggtgccccgaactcatctccttcaggcgtcctccagcgacggctctggggcagggtggatgt

SEQ ID NO: 23143 - DNA, 201 bp, Homo sapiens
ggcaggcccagggctggcaaggggtcctgaagagagtgcaggccacaggctgggcacacgccctgtggagacccaacacacccagcccctctccaggcccrcttttcccccagaccaatgcaggcctcccacccctggcccctgccccacaccaacgccacccactcaccaacggtactcaccccggcctcattctcaccc

SEQ ID NO: 23144 - DNA, 201 bp, Homo sapiens; identical to SEQ ID NO: 3782

SEQ ID NO: 23145 - DNA, 201 bp, Homo sapiens; identical to SEQ ID NO: 3783

SEQ ID NO: 23146 - DNA, 201 bp, Homo sapiens; identical to SEQ ID NO: 3784

SEQ ID NO: 23147 - DNA, 201 bp, Homo sapiens
cacacggccgcctttgaggaacgcaggttcccctccagcttcgaggagattgaggtgggcctgccgtggggggcggggtcctgggcctgccctgagagccsggcgtggttgccgacagcctcgtccctggcagatcctgtggtctcagttcctgaagtttaaggagatggagctaccagccaaggaggccgacaagaacag

SEQ ID NO: 23148 - DNA, 201 bp, Homo sapiens; identical to SEQ ID NO: 3785

SEQ ID NO: 23149 - DNA, 201 bp, Homo sapiens
gtgtaccggcagaccaacctggagaacctggaccaggccttctctgtggcggagcgggacctgggagtgacgcggctcctggaccctgagggtacgtctgygtggccttcctccctgtcccttcccctgctgcctgccccagagccaccgctgagctgcccttccctgcagacgtggatgtccctcagcccgacgagaagt

SEQ ID NO: 23150 - DNA, 201 bp, Homo sapiens; identical to SEQ ID NO: 3786

SEQ ID NO: 23151 - DNA, 201 bp, Homo sapiens
tgcgcagtcctctgtgctgtgcccctgggcttctgggtgtgggggtggcagggtgctctcagctctgcccatgtgacagtgtatttttcagggtgagtgtkgggggggtccatggttgctgggatgtgtgaggagccggcctgtgcacccgcctgtgtggtgtggccgctggtcttgtcccacccacctgaccagccacct

SEQ ID NO: 23152 - DNA, 201 bp, Homo sapiens
cctggcaccctcagctctgcgcagtcctctgtgctgtgcccctgggcttctgggtgtgggggtggcagggtgctctcagctctgcccatgtgacagtgtayttttcagggtgagtgttgggggggtccatggttgctgggatgtgtgaggagccggcctgtgcacccgcctgtgtggtgtggccgctggtcttgtcccacc

SEQ ID NO: 23153 - DNA, 201 bp, Homo sapiens
ctccccgtgtccccaggtccccctagggggctgcagtggtcggggtgggtgaggaaaccccggtttcctgtttctggcgggccgagggcgtgtctgtgggsgagggggctgcttgctccttcccgccgggacactcccctccctggcggcggcctgggcagggtggggcctcgggggcgggccggcctcgccggggagtac

SEQ ID NO: 23154 - DNA, 201 bp, Homo sapiens
gacggcctgtgttcctctgcggtcctggcaccatttggtgtgcagtgaagtgccagctccccgtgtccccaggtccccctagggggctgcagtggtcgggrtgggtgaggaaaccccggtttcctgtttctggcgggccgagggcgtgtctgtgggggagggggctgcttgctccttcccgccgggacactcccctccctg

SEQ ID NO: 23155 - DNA, 201 bp, Homo sapiens
ccttcagtctgttggggggtccttctgggtggctgtggggacggcctgtgttcctctgcggtcctggcaccatttggtgtgcagtgaagtgccagctcccygtgtccccaggtccccctagggggctgcagtggtcggggtgggtgaggaaaccccggtttcctgtttctggcgggccgagggcgtgtctgtgggggaggg

SEQ ID NO: 23156 - DNA, 201 bp, Homo sapiens
tgacccgtcagtcggctgggcttcatctctgcttactgactaaggggtggctgcgaggaggagccgctgctaccagggcatgagtgggccctccctctgcytcccaccccttccctccttcctgcctcgccttcctccctgccggctctcggagcagcctggcctgtgtggcagccatggacaggtacagcatggaggagc

SEQ ID NO: 23157 - DNA, 201 bp, Homo sapiens
ggacggtctcgatctcctgacctcgtgatctgcccacctcggcctcccaaagtgctgggattacaggcgtgagccaccgcgcctggcctaattctgtctgkggtttctttagccatatcaatttttaacactcaccagtcttttatgatttctggattttatgctatgcttaaaatggccttcttttagaaaaacatctgc

SEQ ID NO: 23158 - DNA, 201 bp, Homo sapiens
taattctgtctgtggtttctttagccatatcaatttttaacactcaccagtcttttatgatttctggattttatgctatgcttaaaatggccttcttttaraaaaacatctgctgagagttgcttccagcactgctgcatttttttaaacatctctgtcgttaatctttgtggaatttgcttggggctgaggtcgagatgt

SEQ ID NO: 23159 - DNA, 201 bp, Homo sapiens
ccaccaatccggcttcctgacgcaggggctgtgtattgcttcacttctgtgcccccgagccgagccctgccctgtcctgtggcagaatccagcttcctgamgcggggactatgtgttgcttcacttttgtacccccccagccgagccccgccctgtcctgtggcaggtgtggcttgaaacaagcgttgggtgggagggata

SEQ ID NO: 23160 - DNA, 201 bp, Homo sapiens; identical to SEQ ID NO: 3790

SEQ ID NO: 23161 - DNA, 201 bp, Homo sapiens; identical to SEQ ID NO: 4026

SEQ ID NO: 23162 - DNA, 201 bp, Homo sapiens
tgtgattcatcccataaacagaactaaagacaaaagccacatgattatctcaaatgcagaaaaggccttcaataaaattcaacatctcttcatgttaaaamctctcaataaactagacattgaaggaacctatgttaaaataacattttgtgtctttcttttccattgaatctattcaaagcatcttgattttcacttcct

SEQ ID NO: 23163 - DNA, 201 bp, Homo sapiens; identical to SEQ ID NO: 4027

SEQ ID NO: 23164 - DNA, 201 bp, Homo sapiens
gctgggctgggtttagagccagtgaactagggtagcatgtgacccagagagacaccagcccagtgggctaagggagtgcttgtgccacccctttcaaaacyccaggcagagctgcttgtagcaaagaaattgactcctttcttctgcttgagaggatagcgaagagtaaagaggactttgtcttgcagctcagccacagta

SEQ ID NO: 23165 - DNA, 201 bp, Homo sapiens; identical to SEQ ID NO: 4028

SEQ ID NO: 23166 - DNA, 201 bp, Homo sapiens; identical to SEQ ID NO: 4029

SEQ ID NO: 23167 - DNA, 201 bp, Homo sapiens; identical to SEQ ID NO: 4030

SEQ ID NO: 23168 - DNA, 201 bp, Homo sapiens; identical to SEQ ID NO: 4031

SEQ ID NO: 23169 - DNA, 201 bp, Homo sapiens
gccaggcaaacatcctgtgtctgctttgatggaaatctgaaataagagaaggtggcaaccacctgaatttctattggtccatgatagtggccctgatcatygcaaacgttttctctttagggtattgagaaatggaagcccttaccagcccagttgtatgtttttcttgaatagggattgataaatggaagtgcttaccag

SEQ ID NO: 23170 - DNA, 201 bp, Homo sapiens; identical to SEQ ID NO: 4034

SEQ ID NO: 23171 - DNA, 201 bp, Homo sapiens; identical to SEQ ID NO: 4033

SEQ ID NO: 23172 - DNA, 201 bp, Homo sapiens; identical to SEQ ID NO: 4035

SEQ ID NO: 23173 - DNA, 201 bp, Homo sapiens
agagagctgtgcaaaataaccacaagtccccaactatgccctcttaattatccctatcatctaagactgttgttcccatccatcactgaacttccccgtcytcttccttcaacccctgtgttagtcaatggttgaaattttgatttggtaaaaaacctctggcgaaaaccagcaaaaagggctcacaaatcaggtctcagg

SEQ ID NO: 23174 - DNA, 201 bp, Homo sapiens; identical to SEQ ID NO: 4057

SEQ ID NO: 23175 - DNA, 201 bp, Homo sapiens; identical to SEQ ID NO: 4058

SEQ ID NO: 23176 - DNA, 201 bp, Homo sapiens
tcttgcgccggtttagacaaaggaggccgtgaggacctgcatgcttttctttctcaggcatgcttcggaaactggacatcaaaaacgaagacgatgtgaartcgttgtctcgagtgatgatccatgttttcagcgacggcgtaacaaactggggcaggattgtgactctcatttcttttggtgcctttgtggctaaacact

SEQ ID NO: 23177 - DNA, 201 bp, Homo sapiens; identical to SEQ ID NO: 4060

SEQ ID NO: 23178 - DNA, 201 bp, Homo sapiens; identical to SEQ ID NO: 4047

SEQ ID NO: 23179 - DNA, 201 bp, Homo sapiens
aaggacacaaagccaatgggcaggtctggggccaccagcaggaaggcgctggagaccttacgacgggttggggatggcgtgcagcgcaaccacgagacggycttccaaggtaagggggttcattaatcgccaaggcctcactcccttttttccatctctccccggactcacccgccaagggtgggttggaaaccgaaacga

SEQ ID NO: 23180 - DNA, 201 bp, Homo sapiens; identical to SEQ ID NO: 4064

SEQ ID NO: 23181 - DNA, 201 bp, Homo sapiens; identical to SEQ ID NO: 4039

SEQ ID NO: 23182 - DNA, 201 bp, Homo sapiens; identical to SEQ ID NO: 4040

SEQ ID NO: 23183 - DNA, 201 bp, Homo sapiens; identical to SEQ ID NO: 4042

SEQ ID NO: 23184 - DNA, 201 bp, Homo sapiens; identical to SEQ ID NO: 4043

SEQ ID NO: 23185 - DNA, 201 bp, Homo sapiens; identical to SEQ ID NO: 4041

SEQ ID NO: 23186 - DNA, 201 bp, Homo sapiens
atatagtaaaaaatagtaaaattactctagtaaatttttcatttcagttattgcacttttcagctccaaaatttctatttggtttctttttaaactttctrtctttttattgatgttctctatttgagttaagatagttcttctgatttcctttagttttttgcccatagtttcctttagctctgtgaacatatttaagca

SEQ ID NO: 23187 - DNA, 201 bp, Homo sapiens
acccaggacgtggagctcgtggagaccaggcctgcaggggatggaaccttccagaagtgggcagctgtggtggtgccttctggagaggagcagagatacaygtgccatgtgcagcatgaggggctgccggagcccctcatgctgagatggagtaaggagggagatggaggcatcatgtctgttagggaaagcaggagcctc

SEQ ID NO: 23188 - DNA, 201 bp, Homo sapiens
cccaggacgtggagctcgtggagaccaggcctgcaggggatggaaccttccagaagtgggcagctgtggtggtgccttctggagaggagcagagatacacrtgccatgtgcagcatgaggggctgccggagcccctcatgctgagatggagtaaggagggagatggaggcatcatgtctgttagggaaagcaggagcctct

SEQ ID NO: 23189 - DNA, 201 bp, Homo sapiens
tcatatatattcatttctgttaggtttctcagtgaaagcctcctcaaaacaactgtgaagtaaagacatgtaaataaattcatggtgctcccatgtattcrtgctcattgcatcttacaaatgtgtcagccccactgcaacagatggtgcatcaacaaatggtgctggaaacctggatatccacatgcaaaagaatgatgc

SEQ ID NO: 23190 - DNA, 201 bp, Homo sapiens
cacattcaacatctttcaattattttctttactttgtctaagcagagaatttaaacttgtttctgaagcagaaaaccagggactggttatttgagctatcrccccactctgtggctctcttatgcaataagcataagagattgtgggccaacagaatttgtagcaagataaacataaacccttcatttcagcctatgtttc

SEQ ID NO: 23191 - DNA, 201 bp, Homo sapiens
gttgatttattaaggttaccaagaaagaaagaaccaatagcataggtacatagatgatagatagataatagatagatagatgatagatgatagatagatgwtagatgatgatagatagatagatagatagatagatagatagatagacagacagatagatagataggtgatttattgggctaattggctcacacaattatg

SEQ ID NO: 23192 - DNA, 201 bp, Homo sapiens
tgatttattaaggttaccaagaaagaaagaaccaatagcataggtacatagatgatagatagataatagatagatagatgatagatgatagatagatgttagatgatgatagatagatagatagatagatagatagatagatagacagacagatagatagataggtgatttattgggctaattggctcacacaattatgga

SEQ ID NO: 23193 - DNA, 201 bp, Homo sapiens
tgaatcttccaggcttaagcaaccctcccacctcagacacccaagtagctgggactacaggcatgtgccaccaagcccggctaattcttttgaattttttstagagacagggtttctctatgttgcctaggctggtcacaaactcaggggctcaagcaatctgccagcctgagcctcccaaagtgctggaagtacaggcat

SEQ ID NO: 23194 - DNA, 201 bp, Homo sapiens
tttgggatgatgagacaggagaattgtttgagcctgggagttcaagactagcctgggaaacatagtgagaccttgtctctaagaaaaaaaataaaacacayaaattgggagaattaatattgttaaatattaattttaaaaatgagacacataaatttcatgcacataaattgggagaatattgttaaaatgttcatacta

SEQ ID NO: 23195 - DNA, 201 bp, Homo sapiens
tgggcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgg

SEQ ID NO: 23196 - DNA, 201 bp, Homo sapiens
ggcctgcaggggatggaaccttccagaagtgggcagctgtggtggtgccttctggagaggagcagagatacacgtgccatgtgcagcatgaggggctgccrgagcccctcatgctgagatggagtaaggagggagatggaggcatcatgtctgttagggaaagcaggagcctctctgaagacctttaacagggtcggtggt

SEQ ID NO: 23197 - DNA, 201 bp, Homo sapiens
gggcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatggg

SEQ ID NO: 23198 - DNA, 201 bp, Homo sapiens
acttttgctgttctctgggtctcagagtccattctttgggtttggatgggtgcgtttgtttctcataatctagttgcctatatggggatctctgtgcttgygtgaagtgagtgagactctgcctgaaaggagaaacacgtaccaattgattcatgtggcccattctatctggatgtcctggctcctcgcagaagccataga

SEQ ID NO: 23199 - DNA, 201 bp, Homo sapiens
ggcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgggt

SEQ ID NO: 23200 - DNA, 201 bp, Homo sapiens
gcaatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgggtt

SEQ ID NO: 23201 - DNA, 201 bp, Homo sapiens
cattggctacaaataggtcatttgatccttggctccctggcatctctctagattttcaatgatacaatgttcaatctgctgtgcaagataatttcatcttscaaagatttgatgttacattttaccacacattaaactgaaataaacttttacagattggaaatgcacatcattgatcaaaataaatgaaacatgaaaaga

SEQ ID NO: 23202 - DNA, 201 bp, Homo sapiens
atttgatgttacattttaccacacattaaactgaaataaacttttacagattggaaatgcacatcattgatcaaaataaatgaaacatgaaaagagtaggraggaatacccagtgatggaatagcaaatatgaatggaaaacagaataggactgctaaaaagaaaaaaaaattcagaagcatgtaatagcagcgctattta

SEQ ID NO: 23203 - DNA, 201 bp, Homo sapiens
gagcagaagggtggagctgctgtcagtggagatggggagactctggcaggagcatacagaggagagggcattgcaggcatccagtggaggtgacatctacraggaatgaaggtgaggggcccagatgcctctgcagctacagattcatcatccaatcactatcctacttccaccacccctgtgtctcagagccagagcatt

SEQ ID NO: 23204 - DNA, 201 bp, Homo sapiens
cagaaaaggggctgggatgtctccgtctctgtctcaaatttgtggtgcactgagctataacttacttctgtattaaaattagaatctgagtataaatttastttttcaaattatttccaagagagattgatgggttaattaaaggagaagattcctgaaatttgagagacaaaataaatggaagacatgagaactttccac

SEQ ID NO: 23205 - DNA, 201 bp, Homo sapiens
cccaaccaggtgttgacccaggccttgcaggctcacgcgctctggaaaaaagagagaaaccaataaatgctcccctgggtgcagagtgctgctttttattycctgaggagttctccctcctcagtcactcccaaatcagatttaccctttctctgacggaagatgacgtccccacttttttctccctcccatggcactttt

SEQ ID NO: 23206 - DNA, 201 bp, Homo sapiens; identical to SEQ ID NO: 4102

SEQ ID NO: 23207 - DNA, 201 bp, Homo sapiens; identical to SEQ ID NO: 4083

SEQ ID NO: 23208 - DNA, 201 bp, Homo sapiens
ccctcatgctgagatggagtaaggagggagatggaggcatcatgtctgttagggaaagcaggagcctctctgaagacctttaacagggtcggtggtgaggsctgggggtcagagaccctcaccttcacctcctttcccagagcagtcttccctgcccaccatccccatcatgggtatcgttgctggcctggttgtccttgc

SEQ ID NO: 23209 - DNA, 201 bp, Homo sapiens
gttctgtgctcccttccccaccccaggtatctggttcattcttaggatggtcacatccaggtgctgctggagtgtcccatgagagatgcaaagtgcttgarttttctgactcttcctttcagacccccccaagacacacgtgacccaccaccctgtctttgactatgaggccaccctgaggtgctgggccctgggcttcta

SEQ ID NO: 23210 - DNA, 201 bp, Homo sapiens
aatcgtatagtatgtgtgttttaccacaattttaaaaatatatatcaacaccaaatccaatcacttctcactcctctgccacctccaccccagaaccatcmtcactaggatagaaaaccggaagggccttccagctgggctgcctgctgactctcatgcccactgtccatcacccacacaacagagagagcgtgcctttcc

SEQ ID NO: 23211 - DNA, 201 bp, Homo sapiens
aagaacccagaattttgcaaaattttcagagagagggattcccctcttgtctcttagtgctagggttatgcatgactcgtgcttgaattacagtgtgtacwcagctgaaagtcttaattattagaatataagaggcccaaactactgctgttacagatatgtaaaactacacagtataagtttaaacaacccacaaccaat

SEQ ID NO: 23212 - DNA, 201 bp, Homo sapiens
caatgaagtcaacactgagaatatcatcaatttatggaatactgattatctcttttatagatatataaattataattatgtatatatatattatattataatatatataattaccatcacacctgagagagtgagatggattcttttcttccacagatgaaaatctgagtccctgagaacctagggttttggtatgggttc

SEQ ID NO: 23213 - DNA, 201 bp, Homo sapiens
tcatcactctctagttccagagtgtttttatcacctcagggggaactctgcacccattaagcagtcaccctccatttccacctgccagcagaccctgtcgycacaaatccacttctttctctatcgacttgcctcttatgaatatttcacaaaaatgggctcataagttacgtagcctcctgtgactggcttccttcactt

SEQ ID NO: 23214 - DNA, 201 bp, Homo sapiens
tgtaggaaaaaactatatgttgtttctccattcattggtcgatggacattttcttttaaatcaaataggaaaaacaagagaggaattacaaatatatatakgtgtgtgtgtatatatatatgtcttgtagggttgagacaatctcagtcagctttttttaacctgtgaatgtcgtgatttctccatcatttctgaaggaga

SEQ ID NO: 23215 - DNA, 201 bp, Homo sapiens
agcacactccagaaggtgaaggtaaaccttacagagcttcaagagtggccactgaagtgaagttttatgggtgaacaagtgccaagtgtttaggggaatgyaggtgtgtcccctccaaggtaaaagacaaactgtttcatcttgcatcctcaccagaaggaaggaagcacactgcctgatgagcctctttgagttctgatg

SEQ ID NO: 23216 - DNA, 201 bp, Homo sapiens
tgtcgtgatttctccatcatttctgaaggagagttttgcagacatacaattcttggttgatagtccttttactttctcagctttaaatttgtcatcccaaygcctcctgaaccccatggtttctgatgaaaatttgtatgttaatcttattgaggatccattgtacctgaaaagttccttctctgttattgctttcaagat

SEQ ID NO: 23217 - DNA, 201 bp, Homo sapiens
gtgcatatacacatggaatattaatcagccttaaaagtgaagaatatttggattggatggaaccttgaaaacacgctaaataaaataagccaaaaaaaagrcaaatatgatatttcacttatatgaggcacctagaataagcaaattcacaaaaacagaaagtagaatacaggttaccaggggctgaaggcaggaacaatg

SEQ ID NO: 23218 - DNA, 201 bp, Homo sapiens
tgttctctatttgagttaagatagttcttctgatttcctttagttttttgcccatagtttcctttagctctgtgaacatatttaagcagtcaattcaaagttgtttgtccagtaagtatgttcaatggcctttctcaggaacagtttctgtcaattcctcttttttcttgagaatgggtcttactgtctagtttaattgca

SEQ ID NO: 23219 - DNA, 201 bp, Homo sapiens
aaccaccatcaattgtaaatgtgcttaatgccaatgaattgtacactgaaaaaaattgttagaaggtaaatcgtatagtatgtgtgttttaccacaatttwaaaaatatatatcaacaccaaatccaatcacttctcactcctctgccacctccaccccagaaccatcctcactaggatagaaaaccggaagggccttcca

SEQ ID NO: 23220 - DNA, 201 bp, Homo sapiens
aacagctctccgagggaatttttttttttttttttttgatggagttttgctcttgttgcccagggtggagtgcaatggcatgatcccggctaactgcaacmtctgcctcccgggttcaagcgattctccttcctcacctcccgagtagctgggactacaggcgcgagccaccacacccagctaattttgtatatttagtag

SEQ ID NO: 23221 - DNA, 201 bp, Homo sapiens
tcattctggttacctgctccaccctgactcattccagtcacctgctccaccctgactcattctgattacctgctccaccctgactcatcctgattacttgycccagcctgactcattccagttacctgcaccaccctgactcattctgatcacctgtttcactctctttaaattagccaatctgaattagtttagcctgtg

SEQ ID NO: 23222 - DNA, 201 bp, Homo sapiens
cattccagtcacctgctccaccctgactcattctgattacctgctccaccctgactcatcctgattacttgccccagcctgactcattccagttacctgcwccaccctgactcattctgatcacctgtttcactctctttaaattagccaatctgaattagtttagcctgtgcggtctaaccctagccaataggggaataa

SEQ ID NO: 23223 - DNA, 201 bp, Homo sapiens
gggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgacttttcttct

SEQ ID NO: 23224 - DNA, 201 bp, Homo sapiens
ttttctgtttttgttttgtttttgttttttgaaggaaaatttatattattttaattatttttacatacagaaaactcaacagcatacatttcacccaattyagtggcatgttctttaccctttgcctttttgagcttggcaatgcaaaccacatacttgagacccaggacactgtctccccagtgatggcggatctcatcg

SEQ ID NO: 23225 - DNA, 201 bp, Homo sapiens
ggttaccaaggttctgctatccaatgtatttaataaacaaataaataaataaactggtctctattctgtctcatgcactcaggcacaacttttcccaataaaaaaaaaaaaaaaaaggaaaacaaaaaacagtttctacacctccattcccagagcaagctcactctctgtcaccaaactccgtgggtgacttttcttcta

SEQ ID NO: 23226 - DNA, 201 bp, Homo sapiens
atcattgatcaaaataaatgaaacatgaaaagagtagggaggaatacccagtgatggaatagcaaatatgaatggaaaacagaataggactgctaaaaagaaaaaaaaattcagaagcatgtaatagcagcgctatttagaatcatagtggtgtccaaatcacttctatcacatctcattcaataccacaacaaaagatgt

SEQ ID NO: 23227 - DNA, 201 bp, Homo sapiens
tgtgactgatccatgtttcatgtgaatcctcagccccagtgaagccctcagatgatgcagcccttggctgacaattggactgcaaccttgtgagaggcccsgagcaagaagcactcagggaaacctctcctggactcctgaccattggaaactgtggcagatgaggaatatttgttgttttaagctaagttttacataatt

SEQ ID NO: 23228 - DNA, 201 bp, Homo sapiens
cttgcggccggtagtctctcctccccgcccatgggcggtggttggaggcaggggtgcggaatccggccgacctcgctgtcctcgccctctaccttgtggcrtcggtggggttggggagatgagttctccgacgcagcaggcacccctgctcatctcctatggctgttgccttttgggcagcccctcttcgcggcggtgggg

SEQ ID NO: 23229 - DNA, 201 bp, Homo sapiens
ataccaacttaggaaaagagcacatgaatttattgaaaatatattagcatgtgcttactatgaaaaagagatgcagaaaactgtgagacaaaaagagagayccttgctaccccagctattatccatgaaccagcagaaccagcatctcatgaaactggacagaaaggctcacaggcccagccttgacaggttgatcagtct

SEQ ID NO: 23230 - DNA, 201 bp, Homo sapiens
gcggtgtatggattggggaggccccgccttggggattcgccacctccgcagtttctcttcttctcacaacctgcgacgggtcctttttcctggatactcasgaagcgggcacagttctcattcccactaggtgtcgggtttctagagaagccaatcggtgccgccgcggtcccggttctaaagtccccacgcacccaccgg

SEQ ID NO: 23231 - DNA, 201 bp, Homo sapiens
tggagagtccagctcagggagagtgattggagagacagaataataagaagagtgggcagactggatcactctgatggttctggggcttctcttccaggagagaagaagacaaaaattatgtcaccatcaaggaaagtatccaaagtctctggcttaaacctgggcgtctccagctctgggacaggtggctgggcagggaag

SEQ ID NO: 23232 - DNA, 201 bp, Homo sapiens; identical to SEQ ID NO: 4113

SEQ ID NO: 23233 - DNA, 201 bp, Homo sapiens
aatgcaggagagcatgacagagatgacaggacctcaaggtgccaggaaagctggtgctgggccaggaccaaggagccatcagcaggacactcactcataawgctcacctataataatacaattactgcatatgtaatatatcaaaatataataaaataacaaaataacaaaaataatatggcacagctgcaaataccccat

SEQ ID NO: 23234 - DNA, 201 bp, Homo sapiens
taaattaacaacctttgtaaatttaaaacaagattggcaaccctttagaaaaaaaatgagacttttgcaaaacaatctaaatgatacactaataacaaacsttcatgaaaatgacatttcaaccatctgaatttctgctttaagttataaactccaaaatgaactaactcccaataatttacagtagggagctctaagcca

SEQ ID NO: 23235 - DNA, 201 bp, Homo sapiens
gccccacagggtcagcccctgaacactggctgcaaatgtccccccatcccttcccagccctttcggtgttgctgtgaatctgtccctcactgagaactggyggggagatgtgggggaggaggggaggtttctttatgctgtgtcaaagcatggagacagacctctccttctctcctgaacctcacactatcccttcccaga

SEQ ID NO: 23236 - DNA, 201 bp, Homo sapiens
tacaaacatgaaataatatgtctataaacacatctctagatagatagcttatgaatgaattccctaccccagctcccttactggttgccctgtgaacacarggagtcagggaacaggacccagctagggtccctcatccttctcttgcatccaggcaggtcctgcatccactctggctgcacagaaggctcccatccctgc

SEQ ID NO: 23237 - DNA, 201 bp, Homo sapiens
acttttcccctcaggccttgttctctgcctcacactcaatgtgtgtgggggtctgactccagctcctctgagtcccttggcctccactcaggtcagaaccrgaggtccctgctcccccgctcagagactagaactttccaaggaataggagattatcccaggtgcccgtgtccaggctggtgtctgggttctgtgctccct

SEQ ID NO: 23238 - DNA, 201 bp, Homo sapiens
tgaactaactcccaataatttacagtagggagctctaagccacaaataaaggtgtcaggacagacctgagacctggagtgagcacatccctcagggtcatragtcaatcctgtaagacccttcctccctcagacactccatccagtcatcaggaggtcaagaaaagttccccacagcactaagacccaaccacctcactgt

SEQ ID NO: 23239 - DNA, 201 bp, Homo sapiens
ggaagactgatcaggggttccctttgaccccacagcagccttggcaccaggacttttcccctcaggccttgttctctgcctcacactcaatgtgtgtgggrgtctgactccagctcctctgagtcccttggcctccactcaggtcagaaccagaggtccctgctcccccgctcagagactagaactttccaaggaatagga

SEQ ID NO: 23240 - DNA, 201 bp, Homo sapiens
aagaaaagttccccacagcactaagacccaaccacctcactgtcctcacctccatggacagagcccaggtgaaagccacccctgctcctcctcccgcatcycccacaggctcagcaccatcgtcggcctggagtgcacctggactgagctcatcatgctctgtccctgtttgtgtcagtcacactgggtcccccacatact

SEQ ID NO: 23241 - DNA, 201 bp, Homo sapiens
agatcctgtaccagagagtgattctgagggcccgtcctgctctctgggacaattaagggatgaagtctctgagggagtggaggggaagacaatccctggargactgatcaggggttccctttgaccccacagcagccttggcaccaggacttttcccctcaggccttgttctctgcctcacactcaatgtgtgtgggggtc

SEQ ID NO: 23242 - DNA, 201 bp, Homo sapiens
ggtttggatgggtgcgtttgtttctcataatctagttgcctatatggggatctctgtgcttgtgtgaagtgagtgagactctgcctgaaaggagaaacacrtaccaattgattcatgtggcccattctatctggatgtcctggctcctcgcagaagccatagacaaacttgaaactgttattcaggacacaatgaaagtga

SEQ ID NO: 23243 - DNA, 201 bp, Homo sapiens
gcagcgcgcgggtaccaggggcagtggggcgcctccctgatctcctgtagacctctcagcctggcctagcacaaggagaggaggaaaatgggaccaacacyagaatatcgccctccctctggtcctgagggagaggaatcctcctgggtttccagatcctgtaccagagagtgattctgagggcccgtcctgctctctggg

SEQ ID NO: 23244 - DNA, 201 bp, Homo sapiens
agttttttattcatctaaagaaggcaacagaagaaaaatagttgagcaagaaagataatattagaaggcagtaaatgaaaatggacagacttaaacccaaygaggtcaacaatgacattaaacgtaatggactcagacactccaattacaagacaaatagtgcagagggataaaaataaataagtaaataaataaataacc

SEQ ID NO: 23245 - DNA, 201 bp, Homo sapiens
tgcaccacatgtcaggcgttttaccatgtgagggactgttgtgggttaacccttctgctcccagccagagccagaccctcttctggtgccccaattgccaycccttatcatctacttaaaggtgtcagttcatcaattaataccatttttatctttatcgtcaacctttttcctctctccccactggatcattgtggcagt

SEQ ID NO: 23246 - DNA, 201 bp, Homo sapiens
accaaatccaatcacttctcactcctctgccacctccaccccagaaccatcctcactaggatagaaaaccggaagggccttccagctgggctgcctgctgwctctcatgcccactgtccatcacccacacaacagagagagcgtgcctttccaatgggaattagggcatatcctatgaacgctccagctccttcccttctt

SEQ ID NO: 23247 - DNA, 201 bp, Homo sapiens; identical to SEQ ID NO: 4084

SEQ ID NO: 23248 - DNA, 201 bp, Homo sapiens
aggagggaaacggcccctgcgcggaggagggaggggccggcccggcgggggcgcaggactcggcagccgcgccgggaggagggtcgggcgggtctcaaccyctcctcgcccccaggctcccactccatgaggtatttcagcgccgccgtgtcccggcccggccgcggggagccccgcttcatcgccatgggctacgtggac

SEQ ID NO: 23249 - DNA, 201 bp, Homo sapiens
gatacaataggaaagaaggtcgcctacaagtcgtggtggagctgggcttgcacgcagacaatcctgccccagggccatgctcacatctctgcactatccaraatgtgagggtgggtggagagtccagctcagggagagtgattggagagacagaataataagaagagtgggcagactggatcactctgatggttctggggc

SEQ ID NO: 23250 - DNA, 201 bp, Homo sapiens
cctgctgctctcgggggccctgaccctgaccgagacctgggcgggtgagtgcggggtcaggagggaaacggcccctgcgcggaggagggaggggccggccyggcgggggcgcaggactcggcagccgcgccgggaggagggtcgggcgggtctcaacccctcctcgcccccaggctcccactccatgaggtatttcagcgc

SEQ ID NO: 23251 - DNA, 201 bp, Homo sapiens
aaaaccggaagggccttccagctgggctgcctgctgactctcatgcccactgtccatcacccacacaacagagagagcgtgcctttccaatgggaattagrgcatatcctatgaacgctccagctccttcccttcttaggcacaaggaaaccccagtttcccaccatttcctatgcactccttatcacagggtcccctctg

SEQ ID NO: 23252 - DNA, 201 bp, Homo sapiens
tcttcctgctgctctcgggggccctgaccctgaccgagacctgggcgggtgagtgcggggtcaggagggaaacggcccctgcgcggaggagggaggggccsgcccggcgggggcgcaggactcggcagccgcgccgggaggagggtcgggcgggtctcaacccctcctcgcccccaggctcccactccatgaggtatttca

SEQ ID NO: 23253 - DNA, 201 bp, Homo sapiens
acaccattaaggtccctgcttaaatgtcccatggtcaagtgttcagaaatgtcttgtccagtgacctcttctgaaatctatcccctgccattcccaccacygccaccaatcttctaacccaagcatatttttcttaatggcaattatcagtgatactatgacaggttttatttgtttattgtctgttgatttattaaggtt

SEQ ID NO: 23254 - DNA, 201 bp, Homo sapiens
ctgtgtcgggtccttcttcctggatactcaccgggcggccccagttctcactcccattaggtgacaggtttttagagaagccaatcagcgtcgccgcggtyctggttctaaagtcctcgctcacccacccggactcattctccccagacgccaaggatggtggtcatggcgccccgaaccctcttcctgctgctctcgggg

SEQ ID NO: 23255 - DNA, 201 bp, Homo sapiens
atcacctgtttcactctctttaaattagccaatctgaattagtttagcctgtgcggtctaaccctagccaataggggaataacacagcagcaggggccacrtgcatcagggataagaaccccttccccttccttgtccaggggtgtgctcaccattgctccatctgtgagggcacacccttgtatagaagtaattgccttg

SEQ ID NO: 23256 - DNA, 201 bp, Homo sapiens
gatcttatcaacactaaaaactgttgttctgtgagagacctatgaagagcataaaaagacaagctacagaatgagagaagatatttgcaggcaacatattmtgtaaagactgtattcagaatatatgaagaaattttaaacaacaataaaaatgaaatccaaatacaaaacaggcaatgagcaagacatgaacagacattt

SEQ ID NO: 23257 - DNA, 201 bp, Homo sapiens
agcctgtgcggtctaaccctagccaataggggaataacacagcagcaggggccacgtgcatcagggataagaaccccttccccttccttgtccaggggtgygctcaccattgctccatctgtgagggcacacccttgtatagaagtaattgccttgctgagaagaaaaaaagaaaattttatatttgagtgctatttcttt

SEQ ID NO: 23258 - DNA, 201 bp, Homo sapiens
aaaaccaacagcgataatatcatacactgtcatggtgctatgtgttaatctgtgtccttagcactttcaaaatatgaattcatttaattgtcactatacawctatggggtgtgcctgctaattttccgttttcaggtgatacaataggaaagaaggtcgcctacaagtcgtggtggagctgggcttgcacgcagacaatcc

SEQ ID NO: 23259 - DNA, 201 bp, Homo sapiens
aaaaaaaaaaccaacagcgataatatcatacactgtcatggtgctatgtgttaatctgtgtccttagcactttcaaaatatgaattcatttaattgtcackatacaactatggggtgtgcctgctaattttccgttttcaggtgatacaataggaaagaaggtcgcctacaagtcgtggtggagctgggcttgcacgcaga

SEQ ID NO: 23260 - DNA, 201 bp, Homo sapiens
gtgtttgcttccacttctgtcatgactgtaagtttcctggggcaggctcctcagccatgcagaactgtgagtcaattaaacctctttcctttataaattasccagtctcaggtatttcttcatagcagtgtgagaatggactaatataacttctaacttatagaataatgctgacataatggtttgtaactctgggtgtag

SEQ ID NO: 23261 - DNA, 201 bp, Homo sapiens
aagcactcagggaaacctctcctggactcctgaccattggaaactgtggcagatgaggaatatttgttgttttaagctaagttttacataatttgttatgyaatagtaaataaataacacattttcacaagagaggatgtattattacacattaaattgcatttgctttaaatgtatcatcgtcatcattattatttttga

SEQ ID NO: 23262 - DNA, 201 bp, Homo sapiens
actggtacaaaaacaggcacatagaccaatggaacagaacagagaactcagaaataagaccacacatctaaataaaggaataataatcacaagactcaggrtggagtctccttttgggggatgtgaatgggcagcagcccagggtagtttacaggttctgtgttttacaacagtgctggctaaagtccaaacaacatatca

SEQ ID NO: 23263 - DNA, 201 bp, Homo sapiens
agtttacaggttctgtgttttacaacagtgctggctaaagtccaaacaacatatcatccattcccttttaaaatggaacttttaaaataaatgtgtaatayttgatgttgatgatgtgttctgaaaacattgagttgaaagaattgacttaaattcctaattccttaaacagattttttcaaagtaaaatatgcttggttt

SEQ ID NO: 23264 - DNA, 201 bp, Homo sapiens
tccatgccccacggacgccccgggtactcccgagtctccgggtctgggatccaccccgaggccgcgggacccgcccagaccctctacctgggagaaccccmaggcgcctttaccaaaatccccgcgggtgggtccgggcgagggcgaggctcggtgggcggggctgaccgagggggtggggccaggttctcacaccctcca

SEQ ID NO: 23265 - DNA, 201 bp, Homo sapiens
gctggtggtgccagtggtggggaaagatgcaggatggagctgaaccaagcaccagtgggagagtcacaatggagggcctgggattctggagtaagatcatrtcatccacagcagagacatatgccccctgttagaagcaacatttagtgttacttgtcctgatttgatagaatgcttgaccaagagacaccaaacaacaat

SEQ ID NO: 23266 - DNA, 201 bp, Homo sapiens
ggagagtcacaatggagggcctgggattctggagtaagatcatgtcatccacagcagagacatatgccccctgttagaagcaacatttagtgttacttgtmctgatttgatagaatgcttgaccaagagacaccaaacaacaatgtggttccaagtggctgtgtgacccacaaagtcataaattgcacaggcccaacagca

SEQ ID NO: 23267 - DNA, 201 bp, Homo sapiens
tttgccttctctggtaggtctggggacattgtatcccttataaccttggttcctggcatatgacactggtaccaagctctgttggactagtgaggctcccyacacacctcctgaactagagcaaaagctctgtgcacacaccgtgcatgtgtgagcctgtgaggagacggtgccttcctgcaggctgttctgaaggggtgt

SEQ ID NO: 23268 - DNA, 201 bp, Homo sapiens
gggcagttggtcgaggacccacatctgctttccttgtttttcctgatcccgccctgagtctgcagtcacacatttctggaaacttctcgagggtccaagaytaggaggttcctctaggacctcatggccctgccacctttctggcctctcacaggacattttcttcccacagattgaaaaggagggagctactctcaggct

SEQ ID NO: 23269 - DNA, 201 bp, Homo sapiens
ttttacataatttgttatgcaatagtaaataaataacacattttcacaagagaggatgtattattacacattaaattgcatttgctttaaatgtatcatcrtcatcattattatttttgagacatggtctcgctctgtcacccaggctggagtgcagtggcatgatcaccatgcactgcagtgtcgacctcctgggttcaa

SEQ ID NO: 23270 - DNA, 201 bp, Homo sapiens
ccctcctctcaagcctggccagctctgacagcaggaggactccccaaagagaggctctggccctggctccatgtccttccaggactgggctgggtcacackcacagtccttctcttcctcagtccccagtcccacctcacctgtagagacacctgcacacaaaggcaggccctaaacactgtggttctgccctccacctgc

SEQ ID NO: 23271 - DNA, 201 bp, Homo sapiens
tcagcctcctgagtagctgggactaccatcatgaactactatgcctggctaattttctaattttttgtatagatgggggttttgcccaggctgatcttgamcttctggagtcaacaaatctgccttcctctgccttccacagtgctaggatggcaggcgtgagccaccatacctggcgtaaattaattataagatattaaa

SEQ ID NO: 23272 - DNA, 201 bp, Homo sapiens
tcacttcccagacggggtggccgggcagaggcgccccccacctcctggacgaggtggctggccgggcgggggctgccccccacctccctcctggacggggyggctgccgggcagagacactcctcacttcccagacggggtggctgctgggcggaggggctcctcacctctcagacggggcggccggggagagacgctcct

SEQ ID NO: 23273 - DNA, 201 bp, Homo sapiens
cccccacctccctcctggacggggcggctgccgggcagagacactcctcacttcccagacggggtggctgctgggcggaggggctcctcacctctcagacrgggcggccggggagagacgctccttacctcccagacggggtggctgctgggcggaggggctcctcacatcccagacagggcggcggggcagaggcgctcc

SEQ ID NO: 23274 - DNA, 201 bp, Homo sapiens
agtgcctcaattttcttactcttcccttcagaatcccagaatacatgtgtgatccactaccccatctcggaccatgaggccgccctgaggtgctgggtccygggcttctaccatgtggaaatcacagtgacccaactgtgggatggggaggaccaaatttaggacgcagagcttgtggggaccagacctgcagggtataga

SEQ ID NO: 23275 - DNA, 201 bp, Homo sapiens
atatacgtaagtcctttagtacagctctctttcagaggtgcagcttaattccctctcttaagtgtggcttggacttaatgatgcacttctgatatggcctrtctctgtgttcccacccaaatctcattttgaattgtcatgcgaattctaatccccacatattggcggagggacttcatgggaggtgatcgaatcatgggg

SEQ ID NO: 23276 - DNA, 201 bp, Homo sapiens
ttcctcagtattctaaagacactctaatcactcaagagattctaaggtttttaggagaaaccagggacaaaactaaatgtttttgtgataactcatattayccccttttctttgaccacatatttttcatacgaaaaggattataacagtaaagaagcattggcatattatccaagtctcattcggtcattcaaaattagg

SEQ ID NO: 23277 - DNA, 201 bp, Homo sapiens
attctcaaggtatccaggatccactcagccaagagtcctttcctcagtattctaaagacactctaatcactcaagagattctaaggtttttaggagaaacsagggacaaaactaaatgtttttgtgataactcatattacccccttttctttgaccacatatttttcatacgaaaaggattataacagtaaagaagcattg

SEQ ID NO: 23278 - DNA, 201 bp, Homo sapiens
ggagagtccagctcagggagagtgattggagagacagaataataagaagagtgggcagactggatcactctgatggttctggggcttctcttccaggagagaagaagacaaaaattatgtcaccatcaaggaaagtatccaaagtctctggcttaaacctgggcgtctccagctctgggacaggtggctgggcagggaaga

SEQ ID NO: 23279 - DNA, 201 bp, Homo sapiens
gagagtccagctcagggagagtgattggagagacagaataataagaagagtgggcagactggatcactctgatggttctggggcttctcttccaggagagaagaagacaaaaattatgtcaccatcaaggaaagtatccaaagtctctggcttaaacctgggcgtctccagctctgggacaggtggctgggcagggaagac

SEQ ID NO: 23280 - DNA, 201 bp, Homo sapiens
tttttttttttgccttcaagcatctgtttaacaaagcacatcttgcaccgcccttaatccatttaaccctgagtggacacagcacatgtttcagagagcasggggttgcgggtaaggttatagattaacagcatcccaaggcagaagaatttttcttagtacagaacaaaatggagtctcctatgtctgcttctttctaca

SEQ ID NO: 23281 - DNA, 201 bp, Homo sapiens
gacctccccagccacagaaatcttcccagtgcaccccctggatttctcagtccacatcagcaaaacctcctcagcctctctcaggatgttcctgcatctcrcagctccagcagcaacctgggtctccctgaggacatgaccccctccgaagtcctcccacatgggggagtttccccagggacttgtacccctgggttcaga

SEQ ID NO: 23282 - DNA, 201 bp, Homo sapiens
tatcgtctgacaggtatgtcccctaataaaatgttgtaactttaatcccatgatggcacttgctttttggaggatttggactacaaaatcattttcatctrcacaccagtgtcctcttattccaatttgtaaaatccttttgtttattcaacttcttctacttgcgttggctccattttgctggtatttgtattatgtttt

SEQ ID NO: 23283 - DNA, 201 bp, Homo sapiens
tcccagtgcaccccctggatttctcagtccacatcagcaaaacctcctcagcctctctcaggatgttcctgcatctcgcagctccagcagcaacctgggtytccctgaggacatgaccccctccgaagtcctcccacatgggggagtttccccagggacttgtacccctgggttcagaggtgaggtggggtccttgctcct

SEQ ID NO: 23284 - DNA, 201 bp, Homo sapiens
ttcttaggatggtcacatccaggtgctgctggagtgtcccatgagagatgcaaagtgcttgagttttctgactcttcctttcagacccccccaagacacaygtgacccaccaccctgtctttgactatgaggccaccctgaggtgctgggccctgggcttctaccctgcggagatcatactgacctggcagcgggatgggg

SEQ ID NO: 23285 - DNA, 201 bp, Homo sapiens
agaatcctgagccaaatgaaccttgtttatataaattagtcagtctcagacatttctttatagcaacacaaaacggaataagacaaccctctcatcatagstatgtgtctgtggcagccagcccccattctcaaggtatccaggatccactcagccaagagtcctttcctcagtattctaaagacactctaatcactcaag

SEQ ID NO: 23286 - DNA, 201 bp, Homo sapiens; identical to SEQ ID NO: 4077

SEQ ID NO: 23287 - DNA, 201 bp, Homo sapiens; identical to SEQ ID NO: 4079

SEQ ID NO: 23288 - DNA, 201 bp, Homo sapiens
ctaaatgctcaaacatttccagacatcagaatcctgagccaaatgaaccttgtttatataaattagtcagtctcagacatttctttatagcaacacaaaayggaataagacaaccctctcatcataggtatgtgtctgtggcagccagcccccattctcaaggtatccaggatccactcagccaagagtcctttcctcagt

SEQ ID NO: 23289 - DNA, 201 bp, Homo sapiens; identical to SEQ ID NO: 4082

SEQ ID NO: 23290 - DNA, 201 bp, Homo sapiens
tgtttataaattacccagtctcaggtatttctttataaaagtgtgagaatgaactaattcagaaaatcggtaccaggagttgggtattactataaaaattsttgaaaatgtggaaacagctttggaactgggtaacaggcagaggttggaagagtttggagagttcagaagacaagaaaatgggggaaaatttgcaacttc

SEQ ID NO: 23291 - DNA, 201 bp, Homo sapiens
cttcttcacgacagcaggggctggagccaccttcttctccttggccttctttccttttggcatcttggatggtgggaggagaaagaaagaaacctattttstttataaattacccagtctcaggtatttctttataaaagtgtgagaatgaactaattcagaaaatcggtaccaggagttgggtattactataaaaattct

SEQ ID NO: 23292 - DNA, 201 bp, Homo sapiens
tcactctgatggttctggggcttctcttccaggagagaagaagacaaaaattatgtcaccatcaaggaaagtatccaaagtctctggcttaaacctgggcrtctccagctctgggacaggtggctgggcagggaagacaaactaagccaagggcccagctcggaagagtttcctttcctgagaattctgcaggagtttccc

SEQ ID NO: 23293 - DNA, 201 bp, Homo sapiens
gcatcgatgctgtgtaaaaagataatgagaatctgcggattgttgacagctatgactggctacatttgacaccctcggcagtgtctcatggacaggtcttyatctcctgtagcaaaagggcagatagcaaggaatgttagctctacatcactatgagggccacagtgctccagagatgtttgacactcagccaaggcaggc

SEQ ID NO: 23294 - DNA, 201 bp, Homo sapiens
tgtgtcttttctcacttattcttctgcaaggaaggaattatatcactggttggatgagacaattggctcagatgggttcattgagcactcacccactgggmaagtgtctgtcggggccagctctgggccagatgtgcccaaggctctatagctagttggtggaaaggcctggagggttcatattcaagtccacctgacttg

SEQ ID NO: 23295 - DNA, 201 bp, Homo sapiens
gatcttctgggcatgcagaggaggctcacccttctctagtaatggttcccactttcactgctggaagatgctacacaatcctcacccctatgatgccgcgvgaatcccactcaggaggtttgcaggaactagccagcacgtccccataggagcccagggactacttctgggattggaatttgagggtgtttgatcaaggaa

SEQ ID NO: 23296 - DNA, 201 bp, Homo sapiens
gagcttggcaatgcaaaccacatacttgagacccaggacactgtctccccagtgatggcggatctcatcgtatctgtcattgtaattggtcctgagaactyccaccagcttagccaaagcacctttgtcttccgagttaacctgtgtgaaggtgacagtggtgcaggtcttcctatggactagatgtcccagtcttgcctt

SEQ ID NO: 23297 - DNA, 201 bp, Homo sapiens
attttatgacacaggacaggcaagaagacaaccagcttgatgggatctacatcatgtgcaatcaccaccagctgagctttcttgttctccaccaaggtggygatggtgttaactcctgctcgaaggacaggtggactcttagtggggaatgtcccctttgccagcagctttcttcttggcccgggccaacagcctctgctt

SEQ ID NO: 23298 - DNA, 201 bp, Homo sapiens
tgttctccaccaaggtggtgatggtgttaactcctgctcgaaggacaggtggactcttagtggggaatgtcccctttgccagcagctttcttcttggcccrggccaacagcctctgcttcttctcttggtttgtctctggtctgtattgtgggccagcttaagcagcagagtagctgtttggctgtctggtgcctgggtga

SEQ ID NO: 23299 - DNA, 201 bp, Homo sapiens
tactgatggctcctccagagagtaaaaaaaatattgttcctctacaatccatgactcatccttctgttacagtgttcacctgggcaatgaagtcaacactragaatatcatcaatttatggaatactgattatctcttttatagatatataaattataattatgtatatatatattatattataatatatataattaccat

SEQ ID NO: 23300 - DNA, 201 bp, Homo sapiens
cccagtcttgccttccctttgataatgcagtaagggaccccattttatgacacaggacaggcaagaagacaaccagcttgatgggatctacatcatgtgcwatcaccaccagctgagctttcttgttctccaccaaggtggtgatggtgttaactcctgctcgaaggacaggtggactcttagtggggaatgtcccctttg

SEQ ID NO: 23301 - DNA, 201 bp, Homo sapiens
aactggttaatctcaggaggcactttcagccacttatagaggatggttctctgctgctgcaacctgatatagcagggccatttcacaaagtgggtgaggtstcttttgggctggatatcctgtccagtgccaaaattcttaggccttttctcaaacaagggatttaccactttcttggcctcctgcttcttcacgacagca

SEQ ID NO: 23302 - DNA, 201 bp, Homo sapiens
tgttcacctgggcaatgaagtcaacactgagaatatcatcaatttatggaatactgattatctcttttatagatatataaattataattatgtatatatayattatattataatatatataattaccatcacacctgagagagtgagatggattcttttcttccacagatgaaaatctgagtccctgagaacctagggttt

SEQ ID NO: 23303 - DNA, 201 bp, Homo sapiens
ttatagaggatggttctctgctgctgcaacctgatatagcagggccatttcacaaagtgggtgaggtctcttttgggctggatatcctgtccagtgccaarattcttaggccttttctcaaacaagggatttaccactttcttggcctcctgcttcttcacgacagcaggggctggagccaccttcttctccttggccttc

SEQ ID NO: 23304 - DNA, 201 bp, Homo sapiens
gcctcagacactaactttccaaggaataggagattatcccaggtgcctgtggccaggaggtgtctgggttctgtgctcccttccccaccccagatgtcctdtccattctcaggatggtcacatgggtgctgctggagtgtcccatgaggaatgcaaagtgcctcaattttcttactcttcccttcagaatcccagaataca

SEQ ID NO: 23305 - DNA, 201 bp, Homo sapiens
gggaggagaaagaaagaaacctattttgtttataaattacccagtctcaggtatttctttataaaagtgtgagaatgaactaattcagaaaatcggtaccrggagttgggtattactataaaaattcttgaaaatgtggaaacagctttggaactgggtaacaggcagaggttggaagagtttggagagttcagaagacaa

SEQ ID NO: 23306 - DNA, 201 bp, Homo sapiens
cagctctgcatcatcacatgagggctccaactctgtagggcaggtgtactctcacagcttcaggccctgaacatttgcttcagatgtccccccatcccttyccagacctgtctgtgttgctctgaatctgtccttccctgagaactggcggggagatatcagggaggaggggagatttctttgtgctatgtcaatgcatct

SEQ ID NO: 23307 - DNA, 201 bp, Homo sapiens
gtctcaggtatttctttataaaagtgtgagaatgaactaattcagaaaatcggtaccaggagttgggtattactataaaaattcttgaaaatgtggaaacrgctttggaactgggtaacaggcagaggttggaagagtttggagagttcagaagacaagaaaatgggggaaaatttgcaacttcctagagatttgttaagc

SEQ ID NO: 23308 - DNA, 201 bp, Homo sapiens
tttggtgctattcttgtgataattctcataagatctggtgtttaaaaatctgtgtcacctccctgctctctctccctcctgctccaggcatgtaagtaatrtctgcttccccttagccttccagcataatcgaaagttccctgaggccctctcataagatgagcagatgccagaatcatactttctgtatagcctgcagaa

SEQ ID NO: 23309 - DNA, 201 bp, Homo sapiens
ctgaatgtgtctatgtctacagtaacaggtaagaaatgggagaccagcccatcctcatgtccaccatgacccctgatattgtttggatctgtgtccccacmcaaatctcatgttcaattgtaatccctaattttggaggtggtgtctggtggcaggtgatcggctcatgaggatggatccttcatgaacggtttagaacca

SEQ ID NO: 23310 - DNA, 201 bp, Homo sapiens
taagcattcaatgttcacccatgagagcagctatatggattatgttcaccaaagccacggatatgaggctgaagatggcattgtgagtccattgcttgcascagccagtgtgctcagggttcaagatatagagtcaaaggagattattttagagctttaagttttaatgtctgccatgatgagtttcaaccttgtgaggac

SEQ ID NO: 23311 - DNA, 201 bp, Homo sapiens
gttttttctaagattgccttgtgagggactgagatgcaagatttgttcatgcctcctctttgtgacattaagggcctctggcttctctttctgccaaagcrtctgaatgtgtctatgtctacagtaacaggtaagaaatgggagaccagcccatcctcatgtccaccatgacccctgatattgtttggatctgtgtcccca

SEQ ID NO: 23312 - DNA, 201 bp, Homo sapiens
caagatatagagtcaaaggagattattttagagctttaagttttaatgtctgccatgatgagtttcaaccttgtgaggacactgcattcatttcttttggyccatttatttcttttggaatggaaatgtataggaaatgtctctaccactgttgtattaatattttagaagtaaataactttttttaattttacaggtgca

SEQ ID NO: 23313 - DNA, 201 bp, Homo sapiens
tgactgacctggattagtttatgactatgttttttctaagattgccttgtgagggactgagatgcaagatttgttcatgcctcctctttgtgacattaagrgcctctggcttctctttctgccaaagcgtctgaatgtgtctatgtctacagtaacaggtaagaaatgggagaccagcccatcctcatgtccaccatgacc

SEQ ID NO: 23314 - DNA, 201 bp, Homo sapiens
tcgggggccctggtcctgacccagacctgggcaggtgagtgcggggtcgggagggaaacggcctctgtggggagtagctaggggcctgcccggcgggggckcaggaacccggttgcggtgccgggaggagggtcgggagagtctcagccccctccttgctcccaggcttccactccttgaggtatttccacaccaccatgt

SEQ ID NO: 23315 - DNA, 201 bp, Homo sapiens
tcaacaaggtagacatgtcttagttgccctggaacatgtagaggatggaataacaagctgaggggagtgggcttggtgaaggcctaccaaaaccatgctcyacaagagggcccagaggacacaccttccaccagagcctcaggaacttgatggtgagagggacctgcatcactaagaagtgtcagggtattgtcctttgta

SEQ ID NO: 23316 - DNA, 201 bp, Homo sapiens
ccattcaagtggcatttgttgtctgctaggtatttgactgtttttgcatttagaaaacatcgttaaagtaaaaacagaaaaatttctggccttgtcgtgtrtacattctagatgcaagcttgtccaacctgcagctctcgggatgcatgtggcccaggacagctttagaatgtgacgatttttttgcttatctgtagtggc

SEQ ID NO: 23317 - DNA, 201 bp, Homo sapiens
tttctaatatcactggggagagtgtggccctgaagagacaaagaccaagtggtggcagtgacttgcaaaagccagagggcacggttactatggcaacctckgaggagaagccaagaggactcaagctgcagggaatgtggggaagtataatagagggtggtgtcccagggttaggacaggcagctggttgatatctatgat

SEQ ID NO: 23318 - DNA, 201 bp, Homo sapiens
atggccacatgcgtgctggtggagtgtcccatgacagatgcaaaatgcctgaattttctgactcttcccgtcagacccccccaagacacatatgacccacyaccccatctctgaccatgaggccaccctgaggtgctgggccctgggcttctaccctgcggagatcacactgacctggcagcgggatggggaggaccagac

SEQ ID NO: 23319 - DNA, 201 bp, Homo sapiens
acactcaatgtgcctgggggtctgagtccagctcttctgagtccctcagcctccactcaggtcaggaccagaagtcgctgttccctcctcagggactagarttttccacggaataggagattatcccaggtgcctgtgtccaggctgttgtctgggttctgtgctcccttccccaccccaggcgtcctgtccattctcaag

SEQ ID NO: 23320 - DNA, 201 bp, Homo sapiens
tatattatattataatatatataattaccatcacacctgagagagtgagatggattcttttcttccacagatgaaaatctgagtccctgagaacctagggktttggtatgggttcactgaaaatgttggccttgagaattaggaaacagcttcctgcaggcctgcctggatgtgagccacaccaatggagtctccacaaca

SEQ ID NO: 23321 - DNA, 201 bp, Homo sapiens
caatgtaagaagatgagcaactcaactaaaaatgagcaaaacatgctcaactgacttttacaaaagcacaaaagcaattcaatgaaggaaggagagctttyccatcaaatggtgatggaacaactggacaaccacagtggaaaaaaaataacctgagccaaaacctcatgcttcatacaaaaataactcaaaatgagtcac

SEQ ID NO: 23322 - DNA, 201 bp, Homo sapiens
agcacaaaagcaattcaatgaaggaaggagagctttcccatcaaatggtgatggaacaactggacaaccacagtggaaaaaaaataacctgagccaaaacytcatgcttcatacaaaaataactcaaaatgagtcacaagctttcatgtaaagcacagagttaaaatggcaaacattgagccaggtgtggtatcacaggcc

SEQ ID NO: 23323 - DNA, 201 bp, Homo sapiens
tacattgtctgggaaagtgaaacttaggagctttgtgattcctgttgtaatgcttttagacacatttatatgtcaagggaccaaagtcacatttttggccrattagattcctgatcattaggagttaccaagattctgctacccactgtagttaataaacaaaaagcaaactggtctctattctatctcatgcactcaggc

SEQ ID NO: 23324 - DNA, 201 bp, Homo sapiens
ctgctacccactgtagttaataaacaaaaagcaaactggtctctattctatctcatgcactcaggcacaacttttccagatttaaaaaacaaacaaacaayaacaacaaaaaaccctgtctctacacctccattcccagggcaagctcactctctggcaacaagctccctggagtgatttttcttctagaagagtccacgg

SEQ ID NO: 23325 - DNA, 201 bp, Homo sapiens; identical to SEQ ID NO: 15447

SEQ ID NO: 23326 - DNA, 201 bp, Homo sapiens
cgccgcggtcctggttctaaagtcctcgctcacccacccggactcattctccccagacgccaaggatggtggtcatggcgccccgaaccctcttcctgctrctctcgggggccctgaccctgaccgagacctgggcgggtgagtgcggggtcaggagggaaacggcccctgcgcggaggagggaggggccggcccggcggg

SEQ ID NO: 23327 - DNA, 201 bp, Homo sapiens; identical to SEQ ID NO: 15448

SEQ ID NO: 23328 - DNA, 201 bp, Homo sapiens
ccctgaccctgaccgagacctgggcgggtgagtgcggggtcaggagggaaacggcccctgcgcggaggagggaggggccggcccggcgggggcgcaggacycggcagccgcgccgggaggagggtcgggcgggtctcaacccctcctcgcccccaggctcccactccatgaggtatttcagcgccgccgtgtcccggcccg

SEQ ID NO: 23329 - DNA, 201 bp, Homo sapiens; identical to SEQ ID NO: 15455

SEQ ID NO: 23330 - DNA, 201 bp, Homo sapiens; identical to SEQ ID NO: 15458

SEQ ID NO: 23331 - DNA, 201 bp, Homo sapiens
ggtactcccgagtctccgggtctgggatccaccccgaggccgcgggacccgcccagaccctctacctgggagaaccccaaggcgcctttaccaaaatcccygcgggtgggtccgggcgagggcgaggctcggtgggcggggctgaccgagggggtggggccaggttctcacaccctccagtggatgattggctgcgacctg

SEQ ID NO: 23332 - DNA, 201 bp, Homo sapiens
cgcccagaccctctacctgggagaaccccaaggcgcctttaccaaaatccccgcgggtgggtccgggcgagggcgaggctcggtgggcggggctgaccgarggggtggggccaggttctcacaccctccagtggatgattggctgcgacctggggtccgacggacgcctcctccgcgggtatgaacagtatgcctacgatg

SEQ ID NO: 23333 - DNA, 201 bp, Homo sapiens
tcctcaatgcctagacctcagccaagatgcagattcagatctcagtgacagaggaagagtccatatctctaggcggaatactctgcaaccccgtggaagtrtatgctgggacaattccctcagtccttcggcaaaggaccatatagccatttactcaggagattgtacactggggaaaggaaacaggcagaactgggggga

SEQ ID NO: 23334 - DNA, 201 bp, Homo sapiens
agaaccccaaggcgcctttaccaaaatccccgcgggtgggtccgggcgagggcgaggctcggtgggcggggctgaccgagggggtggggccaggttctcayaccctccagtggatgattggctgcgacctggggtccgacggacgcctcctccgcgggtatgaacagtatgcctacgatggcaaggattacctcgccctga

SEQ ID NO: 23335 - DNA, 201 bp, Homo sapiens
ccctggaatactgatgagtggttccctttgacactggcagcagccttgggccccgtgacttttcctctcaggccttgttctctgcttcacactcaatgtgyctgggggtctgagtccagctcttctgagtccctcagcctccactcaggtcaggaccagaagtcgctgttccctcctcagggactagaattttccacggaa

SEQ ID NO: 23336 - DNA, 201 bp, Homo sapiens
agtgactctgagggtccgccgtgctctctgacacaattaagggatgaaatctctgaggaaatgaagggaagacaatccctggaatactgatgagtggttcyctttgacactggcagcagccttgggccccgtgacttttcctctcaggccttgttctctgcttcacactcaatgtgcctgggggtctgagtccagctcttc

SEQ ID NO: 23337 - DNA, 201 bp, Homo sapiens
agagctttcccatcaaatggtgatggaacaactggacaaccacagtggaaaaaaaataacctgagccaaaacctcatgcttcatacaaaaataactcaaartgagtcacaagctttcatgtaaagcacagagttaaaatggcaaacattgagccaggtgtggtatcacaggcctgtactctcagctactcaggaagctgag

SEQ ID NO: 23338 - DNA, 201 bp, Homo sapiens
aggcaacatattctgtaaagactgtattcagaatatatgaagaaattttaaacaacaataaaaatgaaatccaaatacaaaacaggcaatgagcaagacaygaacagacatttcactgaagaggataaatactgggctaataagcagatgaataggtgctcaacatcattatccagtaggaaaatacaaattaaaaccaca

SEQ ID NO: 23339 - DNA, 201 bp, Homo sapiens
attctgtaaagactgtattcagaatatatgaagaaattttaaacaacaataaaaatgaaatccaaatacaaaacaggcaatgagcaagacatgaacagacatttcactgaagaggataaatactgggctaataagcagatgaataggtgctcaacatcattatccagtaggaaaatacaaattaaaaccacagtgatgaga

SEQ ID NO: 23340 - DNA, 201 bp, Homo sapiens
tttccagatttaaaaaacaaacaaacaataacaacaaaaaaccctgtctctacacctccattcccagggcaagctcactctctggcaacaagctccctggrgtgatttttcttctagaagagtccacggggacaggtaaggagtaggaggcagggagtccagttctgggacggggattccgtgatgcaaagtgaagagaga

SEQ ID NO: 23341 - DNA, 201 bp, Homo sapiens
ctggcacagtgttacttgcaccttggtctttaatgcattctgtggggctgtctaaaacctaattgcctctctaagataaaaaggttaaaaaaggccgggcrcggtggctcacgcctgtaatcccagcactttgggaggccgaggcgcgtggatcacaaggtcaggagatcgagaccatcctagctaacatggtgaaacccc

SEQ ID NO: 23342 - DNA, 201 bp, Homo sapiens
atgtcaatgcatctagacagagctctcattctcccttgaacctcaactctatccgttcccagacacttgaaataaaacacagaccagaaatgtctatttaraagctaaatatctatagtataaaatatgaagacagagtagaatggggtaatgcaggagagtgtgacagggcgaggggacctcaacgtgccaggaaagttg

SEQ ID NO: 23343 - DNA, 201 bp, Homo sapiens
aatacagtgttttatagatttttaatgcatttatccgcaaagcctggcacagtgttacttgcaccttggtctttaatgcattctgtggggctgtctaaaasctaattgcctctctaagataaaaaggttaaaaaaggccgggcgcggtggctcacgcctgtaatcccagcactttgggaggccgaggcgcgtggatcacaa

SEQ ID NO: 23344 - DNA, 201 bp, Homo sapiens
tatgaatttaagaaataaaaaataaaataacataacatgtctctttatagatacaggtagacatgtttgtatagcatgtgtgtgaatgtgtgtgtgtgcckgtgtgtgtgtccgcctgtgtgtgtgtgtccgtgtagagaggcagcacaaattaagagattaagattttgtgactgagctattccaaagtaacttaaacat

SEQ ID NO: 23345 - DNA, 201 bp, Homo sapiens
agctttgagtgcggactagacaggaaaggacactgcagcagatccaggcggtggtgtaccaggtcatcaactctcagtcccctggtgctgggggtgacagygtggggaaagatgctagatggagctgaaccaagcagctgagatcaagtgagctgagatcccgcccctacactccagcctgagcaacaagagtgaaactcc

SEQ ID NO: 23346 - DNA, 201 bp, Homo sapiens
gggcgaggctcggtgggcggggctgaccgagggggtggggccaggttctcacaccctccagtggatgattggctgcgacctggggtccgacggacgcctcmtccgcgggtatgaacagtatgcctacgatggcaaggattacctcgccctgaacgaggacctgcgctcctggaccgcagcggacactgcggctcagatctc

SEQ ID NO: 23347 - DNA, 201 bp, Homo sapiens
gccgaggcagcggaacctggagaccctttacccgggagaggcccaggagccgttacccggtttcattttcagccaaaatccccgcaggttggtcctggcgrgggcggggctcggtgggcggggctggccgcgggggcggggccagggtctcacacccatctagaggatgtctgtctgcgacgtggggtcggacgggcgcct

SEQ ID NO: 23348 - DNA, 201 bp, Homo sapiens
ggaatataaatcattctattataaaggtatatgcatgtgtatgttcattgcagcactattcacaatagcaaagacatggaatcaacccaaatgcccacaartgaggaactggataaagaaaatatggtacatatacaccacggaatattatgcaaccataaaaaggaatgagatcaagtcctttgcagagatacgaatgaa

SEQ ID NO: 23349 - DNA, 201 bp, Homo sapiens
taaaacacagaccagaaatgtctatttaaaagctaaatatctatagtataaaatatgaagacagagtagaatggggtaatgcaggagagtgtgacagggcraggggacctcaacgtgccaggaaagttggtccttggctcccctggaggagccgtcaccaggacactcactcataaagctcacctgtgataatacaactac

SEQ ID NO: 23350 - DNA, 201 bp, Homo sapiens
ggccgggcagaggcgccccccacctcctggacgaggtggctggccgggcgggggctgccccccacctccctcctggacggggcggctgccgggcagagacrctcctcacttcccagacggggtggctgctgggcggaggggctcctcacctctcagacggggcggccggggagagacgctccttacctcccagacggggtg

SEQ ID NO: 23351 - DNA, 201 bp, Homo sapiens
cgggcgagggcgaggctcggtgggcggggctgaccgagggggtggggccaggttctcacaccctccagtggatgattggctgcgacctggggtccgacggwcgcctcctccgcgggtatgaacagtatgcctacgatggcaaggattacctcgccctgaacgaggacctgcgctcctggaccgcagcggacactgcggctc

SEQ ID NO: 23352 - DNA, 201 bp, Homo sapiens
ccctgcttctgctgctctcgggggccctggtcctgacccagacctgggcaggtgagtgcggggtcgggagggaaacggcctctgtggggagtagctagggkcctgcccggcgggggcgcaggaacccggttgcggtgccgggaggagggtcgggagagtctcagccccctccttgctcccaggcttccactccttgaggta

SEQ ID NO: 23353 - DNA, 201 bp, Homo sapiens
tgatgaatatttgctgttttgagctgctaagttttacataatttgttacacaatagtaaataactaatacattttcacaagagaggatgtattattacacrttaatttgcatttgctctaaatttatcatcatcatattactatttttgagacagggtcttgctctgtcacccaggctggagtgcagtggcatgatcacca

SEQ ID NO: 23354 - DNA, 201 bp, Homo sapiens
cgggtgggtccgggcgagggcgaggctcggtgggcggggctgaccgagggggtggggccaggttctcacaccctccagtggatgattggctgcgacctggkgtccgacggacgcctcctccgcgggtatgaacagtatgcctacgatggcaaggattacctcgccctgaacgaggacctgcgctcctggaccgcagcggac

SEQ ID NO: 23355 - DNA, 201 bp, Homo sapiens
taactaatacattttcacaagagaggatgtattattacacgttaatttgcatttgctctaaatttatcatcatcatattactatttttgagacagggtctygctctgtcacccaggctggagtgcagtggcatgatcaccatgcactgcagtgtcgacctcctgggctcaagggatcctctgatctcagcctcttgagtag

SEQ ID NO: 23356 - DNA, 201 bp, Homo sapiens
aactaatacattttcacaagagaggatgtattattacacgttaatttgcatttgctctaaatttatcatcatcatattactatttttgagacagggtcttrctctgtcacccaggctggagtgcagtggcatgatcaccatgcactgcagtgtcgacctcctgggctcaagggatcctctgatctcagcctcttgagtagc

SEQ ID NO: 23357 - DNA, 201 bp, Homo sapiens
tttttattccctgaggagttctccctcctcagtcactcccaaatcagatttaccctttctctgacggaagatgacgtccccacttttttctccctcccatsgcacttttccagcccctgccagtcccctcccgtgactccatcaacatcagcacctgccctgtgtccaccatccattgtgcagtgagtgaaaggacccagg

SEQ ID NO: 23358 - DNA, 201 bp, Homo sapiens
ccccacttttttctccctcccatggcacttttccagcccctgccagtcccctcccgtgactccatcaacatcagcacctgccctgtgtccaccatccattktgcagtgagtgaaaggacccaggactaaggaacaagacccaagaggaaactcagtgccctttcctcctcctctcaagcctgaccagccctgacacagtga

SEQ ID NO: 23359 - DNA, 201 bp, Homo sapiens
ccagtcccctcccgtgactccatcaacatcagcacctgccctgtgtccaccatccattgtgcagtgagtgaaaggacccaggactaaggaacaagacccavgaggaaactcagtgccctttcctcctcctctcaagcctgaccagccctgacacagtgagaggcctccccaaagagaggccctggccctgtctccatgtcc

SEQ ID NO: 23360 - DNA, 201 bp, Homo sapiens
cttccaggtctgggccaagtcacacacagtccttctcttcctgagaccccaggccctcttcacctgcagaggcacctgcataccagggcaggccctgcacrctgtgggttctgccctccaccagcagctcactgttcctcccctcccagctctgagcagacagctcctaactagagatcctatcaggaagccctggggctc

SEQ ID NO: 23361 - DNA, 201 bp, Homo sapiens; identical to SEQ ID NO: 4109

SEQ ID NO: 23362 - DNA, 201 bp, Homo sapiens
gcacctgcataccagggcaggccctgcacactgtgggttctgccctccaccagcagctcactgttcctcccctcccagctctgagcagacagctcctaacwagagatcctatcaggaagccctggggctcacaggccctgcatggaaatatgtggctgccatggagtctgcacctgacctgatgctggggacccccttgct

SEQ ID NO: 23363 - DNA, 201 bp, Homo sapiens
cataccagggcaggccctgcacactgtgggttctgccctccaccagcagctcactgttcctcccctcccagctctgagcagacagctcctaactagagatmctatcaggaagccctggggctcacaggccctgcatggaaatatgtggctgccatggagtctgcacctgacctgatgctggggacccccttgctcaaggag

SEQ ID NO: 23364 - DNA, 201 bp, Homo sapiens
taccagggcaggccctgcacactgtgggttctgccctccaccagcagctcactgttcctcccctcccagctctgagcagacagctcctaactagagatccyatcaggaagccctggggctcacaggccctgcatggaaatatgtggctgccatggagtctgcacctgacctgatgctggggacccccttgctcaaggaggc

SEQ ID NO: 23365 - DNA, 201 bp, Homo sapiens
cagggtctcacacccatctagaggatgtctgtctgcgacgtggggtcggacgggcgcctactccgcgggtatcaccagcttgcttacgatggcaaggattmcatcgtcctgaacgaggacctgtgctccttgacagccgcagacacggcggctcagatcacccagctcaagtgggaggcggcccggggggcggaggttcat

SEQ ID NO: 23366 - DNA, 201 bp, Homo sapiens
atggtgtcatggcgccccgaaccctgcttctgctgctctcgggggccctggtcctgacccagacctgggcaggtgagtgcggggtcgggagggaaacggcstctgtggggagtagctaggggcctgcccggcgggggcgcaggaacccggttgcggtgccgggaggagggtcgggagagtctcagccccctccttgctccc

SEQ ID NO: 23367 - DNA, 201 bp, Homo sapiens
tgcggggtcgggagggaaacggcctctgtggggagtagctaggggcctgcccggcgggggcgcaggaacccggttgcggtgccgggaggagggtcgggagrgtctcagccccctccttgctcccaggcttccactccttgaggtatttccacaccaccatgtcccggcccggccgcgcggatccccgcttcctctccgtgg

SEQ ID NO: 23368 - DNA, 201 bp, Homo sapiens
cagaaggtgaagataaaccttacaaagcttccagagtggccactcggccaggtgcagtggctcacgcctgtaatcccagcactttggaaggctgaggtggvtggatcacctgaggttgggagttggagactagcctgaccaacacggagaaaccccgtctctactaaaaatacaaaattatccaggcatggtggcccatgc

SEQ ID NO: 23369 - DNA, 201 bp, Homo sapiens
gaggctgagggaggagcattgatcacatgagccaaggaggtcgaggcttcagtgagtcatgagcgtgccactgcactttagccagggtaacagagtgacgmcctgtctgtaaataaataaaaaataaaaaaattaataataaagggagtgcatgagcactggcgaagggcactttggctgcattaagcacttgcaattctg

SEQ ID NO: 23370 - DNA, 201 bp, Homo sapiens
gaggagtttttgcttttctgtggcggacctgagacctggagtgagtgcacccacctccctcaggatcaggagtgaatgctttaggaaccctcctttgcagygacctgcaaaagatagagggcacggttactgtgagaacccagagtagcagccaaaggggctcaaccttcatggagttttgggaaaggttagtaaaaggtg

SEQ ID NO: 23371 - DNA, 201 bp, Homo sapiens
tagggttatctttcctgaagagaaaaatatggttgtgtgctgcagtgtgcaggagggttggtgtgggaggaggtagggagggagggaggacacacaagcastcctggtgagaaaagcactggcggcatcgatgtccacatgagatgatgttgttctttagctgccacaaaacagcatttgccctgaggctaccttaacaaa

SEQ ID NO: 23372 - DNA, 201 bp, Homo sapiens
ctgctcagctgggtcatctttgctccttcattctccttggcccttcagtagaaccttgtcccaccaccacctgtgatcacagggacttggatgtcacctasggtggtccctgcatacaaatctcattgtggtatcaagagactaattttcagacctgtccagctcttgccctcctcccagggctctttcctggattgtagt

SEQ ID NO: 23373 - DNA, 201 bp, Homo sapiens
gactttatgtggtcactgctcagctgggtcatctttgctccttcattctccttggcccttcagtagaaccttgtcccaccaccacctgtgatcacagggasttggatgtcacctacggtggtccctgcatacaaatctcattgtggtatcaagagactaattttcagacctgtccagctcttgccctcctcccagggctct

SEQ ID NO: 23374 - DNA, 201 bp, Homo sapiens; identical to SEQ ID NO: 15392

SEQ ID NO: 23375 - DNA, 201 bp, Homo sapiens
tctgagtaaacatttactttttcaaattcttgccatgagaggttgatgacttaattaaaggagaagattcctaaaatttgagagacaaaataaatggaacmcatgagaaccttccagagtccatgtgtttcttgtgctgatttgttgcaggggaggagaatagatggggctgtgcctagtgggtgctcaggccagtatgga

SEQ ID NO: 23376 - DNA, 201 bp, Homo sapiens
aaattcctcctttagtcacatcacctgtgggctctgaccagattttgtttttgttccaccccaaacaggaacagtacccagggctctgatgtgtctctcamggcttgtaaaagtgacaccttagagggcctgaagtgaaagaggagttgggcagaggggacacaactaagctctggagattctttgatttggaatttttca

SEQ ID NO: 23377 - DNA, 201 bp, Homo sapiens
aattcttcctctagccacatctactgtgggatctgaccaggtcctgtttttattctactccaggcggcaacagtgcccagggctctgatgtgtctctcacrgcgtgaaaggtgagaccttggggggcctgatgtgtggggggtgttgggggggaacagtggacacagctgtgctatggggttctttgaatttgatgttttg

SEQ ID NO: 23378 - DNA, 201 bp, Homo sapiens
gaacagtacccagggctctgatgtgtctctcacggcttgtaaaagtgacaccttagagggcctgaagtgaaagaggagttgggcagaggggacacaactargctctggagattctttgatttggaatttttcaaggtgtggtgggctgttcagtgtcacaacttactgtgactgacctggattagtttatgactatgtttt

SEQ ID NO: 23379 - DNA, 201 bp, Homo sapiens
ttttcccaataaaaaaaaaaaaaaaaaggaaaacaaaaaacagtttctacacctccattcccagagcaagctcactctctgtcaccaaactccgtgggtgrcttttcttctagaagagtccaggtggacagggagtccagttcagggacggagattcctggatgaaaagtgaagggagagggacagggcccatgccgaggg

SEQ ID NO: 23380 - DNA, 201 bp, Homo sapiens
catcactgggggtcacacttgcatctcggcctgttgcctttcccagggtaacctgactccctcacaatatcgtctgacaggtatgtcccctaataaaatgytgtaactttaatcccatgatggcacttgctttttggaggatttggactacaaaatcattttcatctgcacaccagtgtcctcttattccaatttgtaaaa

SEQ ID NO: 23381 - DNA, 201 bp, Homo sapiens
gaaactcagagctatggaatgatggcaaatttaaaatatgacaagcgggagtcacaggtacactgcaaaagtgaaacttagaagctttgtgagtcctgttstaacgcttttgggcacatttatacatcatggggccaaagtcacattttttaccgattagattcctgatcattcaggggttaccaaggttctgctatccaa

SEQ ID NO: 23382 - DNA, 201 bp, Homo sapiens
aagcctgaaggaggattcaaaatgaaaacacaggtttaggaagaccggaacagagattccatccacatcatgcccagatttctgattaagaaactataaasaacaaatgagtgttatttggccaggcgtggtagtgcacacctgtatcctaacatttgaggagctgacacaggaggaacacttgcagccaggactttgaga

SEQ ID NO: 23383 - DNA, 201 bp, Homo sapiens
gtcttataaaattcatacacagactcaaaagactcctggaatgaactgatgaattgatacgcacactagttacataaaataaaatcttttttaactttttyagtgttttacattttataattttctgtgatgcaatttaatacactcataattcattcattcagccaagaaaaaataatttagtccctacaatgaaccagg

SEQ ID NO: 23384 - DNA, 201 bp, Homo sapiens
tacttcttgctttccctttcatgcactggccaggcacctatcggttggggccccctcaacgaccccttccccacctcaccaaaaaatgtagtttaggctarcttgcaacatagataattgtaccctttcttatcaactaagtgcagccattagggacataagtcaaatgtttaaagagtcctgagacaatcacaatgcatt

SEQ ID NO: 23385 - DNA, 201 bp, Homo sapiens; identical to SEQ ID NO: 4111

SEQ ID NO: 23386 - DNA, 201 bp, Homo sapiens
ggacataagtcaaatgtttaaagagtcctgagacaatcacaatgcattatgggctgcaacaaaatgcagcaaaaaaaaaaaaaaccctaaggaacatactwgaagtcttaaactaccaataggtgacatccgggaagatcgtaagtccttggtactcagctaatgagcaactgggggagggagttgcgcactagggaataa

SEQ ID NO: 23387 - DNA, 201 bp, Homo sapiens; identical to SEQ ID NO: 4112

SEQ ID NO: 23388 - DNA, 201 bp, Homo sapiens
ctctagtgtagatgctgctgtgaagggatttagcagatataactaagggcctcaattagttgactttaggctgggtttatcctgctttgactgtcctaatwaggtgagtccttgaaaggtctgtgttctttctgagcatagagatttgcagtgtgagagggattcagcatgaggggtttcctctaccgtgggctttgaaaa

SEQ ID NO: 23389 - DNA, 201 bp, Homo sapiens
ggtcacatcaccatgagagagctgaaggatgtggggtggtgttggggctgtctatcgtctctacgtaatccagcaaactgtccctgagggagcctgatgakgcctaaagaatgaatgagattactctaggtatggccaagtaggagttataattgcagcttttatgttgtctggatatcactggtagagcagattaataaa

SEQ ID NO: 23390 - DNA, 201 bp, Homo sapiens
ttttaagtgaagaaatgaaacaatctgactcacattagcaggattgctgacctttgtggggagaacagtcatgggcagcaggcaagggacagagctagggmcacaattcagtagtgacagagtagtagagactaaggggagaggagggcctgaaggatgacagggacagagagaagggctggagaagcaggaggtgaggta

SEQ ID NO: 23391 - DNA, 201 bp, Homo sapiens
acagtcatgggcagcaggcaagggacagagctagggacacaattcagtagtgacagagtagtagagactaaggggagaggagggcctgaaggatgacaggracagagagaagggctggagaagcaggaggtgaggtaaaggaacagagagaaagaattctaaagcaatggaattctcagacttaaatacagtgttttatag

SEQ ID NO: 23392 - DNA, 201 bp, Homo sapiens
ctcgtcctaaaccaggaactgctctcttggaccgcagcggaaaaggcggctcagatgttttggaggaggaacatgcagagctgctcaaaacctacctgccsggaaggtgggcggagtggctcagcaaaggccttaagaatgagaaggagaggctgcaatgcgcaggtaccagaggccacgggtcgcctccctgatctcctg

SEQ ID NO: 23393 - DNA, 201 bp, Homo sapiens
ttctggagtaaggtcatgtcattcacagcagagacatatgccacctattagaagcaacttttagtgtcccttgtcctgattagatagaatgcttgaccackggacaccaagcaactatgtggttcgagtgcctgtgtgacccacagagtcatagattagacaggcccaacagcatccatcatgaggtgaaaatggtccacc

SEQ ID NO: 23394 - DNA, 201 bp, Homo sapiens
tcacacttgcatctcggcctgttgcctttcccagggtaacctgactccctcacaatatcgtctgacaggtatgtcccctaataaaatgttgtaactttaaycccatgatggcacttgctttttggaggatttggactacaaaatcattttcatctgcacaccagtgtcctcttattccaatttgtaaaatccttttgttta

SEQ ID NO: 23395 - DNA, 201 bp, Homo sapiens
gatggagtctccttttgggggatgtgaatgggcagcagcccagggtagtttacaggttctgtgttttacaacagtgctggctaaagtccaaacaacatatcatccattcccttttaaaatggaacttttaaaataaatgtgtaatacttgatgttgatgatgtgttctgaaaacattgagttgaaagaattgacttaaatt

SEQ ID NO: 23396 - DNA, 201 bp, Homo sapiens
ctcccctgacctctatagtatagtcttaagactatactaaacatactggatatccaataggatattaaatcagctcatatcattgacaacttcctgttgayctggctggatgagcagcaggtagaaagtgcactgtagtgcttggcaaaacacgggcactccagaaggtgaagataaaccttacaaagcttccagagtggc

SEQ ID NO: 23397 - DNA, 201 bp, Homo sapiens
aataaatgtgtaatacttgatgttgatgatgtgttctgaaaacattgagttgaaagaattgacttaaattcctaattccttaaacagattttttcaaagtaaaatatgcttggtttttataaaaatgaaagagaaaagaataccaaagttcattgcaagcatccttaacaagaactacttacattggaacaaaaccacaca

SEQ ID NO: 23398 - DNA, 201 bp, Homo sapiens
ccacgaggccatgaaaatggctttggctacaaataggtcatttgatccttggctcactggcatctctgtagattttcatgtatacaatcttcaatctgatgtgcaaggtaattccatcttgcaaaggatttgatgttacattctaccacacataccactgaattaaacttttacagaattggaaatgcacatcattgatca

SEQ ID NO: 23399 - DNA, 201 bp, Homo sapiens
cgaggccatgaaaatggctttggctacaaataggtcatttgatccttggctcactggcatctctgtagattttcatgtatacaatcttcaatctgatgtgcaaggtaattccatcttgcaaaggatttgatgttacattctaccacacataccactgaattaaacttttacagaattggaaatgcacatcattgatcaaaa

SEQ ID NO: 23400 - DNA, 201 bp, Homo sapiens
catgactgtaagtttcctggggcaggctcctcagccatgcagaactgtgagtcaattaaacctctttcctttataaattacccagtctcaggtatttcttyatagcagtgtgagaatggactaatataacttctaacttatagaataatgctgacataatggtttgtaactctgggtgtagaacctaaaactcactgcggc

SEQ ID NO: 23401 - DNA, 201 bp, Homo sapiens
agtcttccctgcccaccatccccatcatgggtatcgttgctggcctggttgtccttgcagctgtagtcactggagctgcggtcgctgctgtgctgtggagraagaagagctcaggtaaggaaggggtgacaagtggggtctgagttttcttgtcccactgggggtttcaagccccaggtagaagtgtgccctgcctggtta

SEQ ID NO: 23402 - DNA, 201 bp, Homo sapiens
gttacattctaccacacataccactgaattaaacttttacagaattggaaatgcacatcattgatcaaaataaatgaaacaagaaaagagtagaaaggaayaaccagtgacggaatagcaatatgaatagaaaacacaataggactgcgaaaacaaagaaacaaacaaaaccacttcagaagcacctgatggcatgctatt

SEQ ID NO: 23403 - DNA, 201 bp, Homo sapiens
tgtggcttggacttaatgaggcacttctgatatggcctggttctgtgttcccacccaaatctcatcttgaattgttatgcgaattgtaatcgctacctatwgggggagggaccacatgggaggtgattggataatgggggcggtgcccccatgctgttctcgtgatactgagggaattctcatgagatctgatggttttat

SEQ ID NO: 23404 - DNA, 201 bp, Homo sapiens
tgaactacacattatggttgtcacgagagaagttttgatagtttgtgcccagagaccacctggtgaaaagaggattctcctcctctccaggcccaggtaayagatcctcatcttcaggagaaggcatggctactttcacacaatgagggcggaagtgtgtgtggaaaccagagatccacctgggggccttctggtttccct

SEQ ID NO: 23405 - DNA, 201 bp, Homo sapiens
caaaatccccgcgggtgggtccgggcgagggcgaggctcggtgggcggggctgaccgagggggtggggccaggttctcacaccctccagtggatgattggytgcgacctggggtccgacggacgcctcctccgcgggtatgaacagtatgcctacgatggcaaggattacctcgccctgaacgaggacctgcgctcctgga

SEQ ID NO: 23406 - DNA, 201 bp, Homo sapiens
ctgcccagcctagcgggctctcccttaatcaactgtagcgaaaactgtctccttctcacgttcctggaaggtgctttttgacacaagaaagaggatgtgaytgctagggtcatcatgtcattgtttattgtgttgccagtaaagtgaaatcaaaatacacaataaataataaaataacccatgataagccaatgtttataa

SEQ ID NO: 23407 - DNA, 201 bp, Homo sapiens; identical to SEQ ID NO: 3162

SEQ ID NO: 23408 - DNA, 201 bp, Homo sapiens; identical to SEQ ID NO: 3180

SEQ ID NO: 23409 - DNA, 201 bp, Homo sapiens
cacaaggaaaccccagtttcccaccatttcctatgcactccttatcacagggtcccctctggccactttggcctcatcccattactctcagcctagctcaytcttctccactcacaccagtttcttgtctactccaccctgtctccaccacctgcccctgctgtgactcccacatgcatgtgctgcccagtgatccacatg

SEQ ID NO: 23410 - DNA, 201 bp, Homo sapiens
ggccactttggcctcatcccattactctcagcctagctcattcttctccactcacaccagtttcttgtctactccaccctgtctccaccacctgcccctgytgtgactcccacatgcatgtgctgcccagtgatccacatggctcactcctcacaccattaaggtccctgcttaaatgtcccatggtcaagtgttcagaaa

SEQ ID NO: 23411 - DNA, 201 bp, Homo sapiens
ggatggtggtcatggcgccccgaaccctcttcctgctgctctcgggggccctgaccctgaccgagacctgggcgggtgagtgcggggtcaggagggaaacrgcccctgcgcggaggagggaggggccggcccggcgggggcgcaggactcggcagccgcgccgggaggagggtcgggcgggtctcaacccctcctcgcccc

SEQ ID NO: 23412 - DNA, 201 bp, Homo sapiens
tttagagaagccaatcagcgtcgccgcggtcctggttctaaagtcctcgctcacccacccggactcattctccccagacgccaaggatggtggtcatggcrccccgaaccctcttcctgctgctctcgggggccctgaccctgaccgagacctgggcgggtgagtgcggggtcaggagggaaacggcccctgcgcggagga

SEQ ID NO: 23413 - DNA, 201 bp, Homo sapiens
tccagaggctgccagccacaaggaatgctggacaggtcttctacaggcaaaactcagtgccagcctggaggaagcactctgagaggtgggtgccatctttyaggacacggtgcattgtttgaatcagagatgtctctagagtgctgtgttctcaataggaagaacatgtgtgtccagggatcaaaagatggaagcaggttt

SEQ ID NO: 23414 - DNA, 201 bp, Homo sapiens
tacaagaaagttgacccacgctggtgtcccctgaagaaatcacaggcacagaggagggacaggtggatttcagggctgtgcttgatctgggaaaggaagaktgcagaccgccaggtggcgccgctgcactgcttctgcgcccaggaggtgcctgctggggctgagattgaaggtggggagaaggatgtcacagctcatcgc

SEQ ID NO: 23415 - DNA, 201 bp, Homo sapiens
ctgagaggtgggtgccatcttttaggacacggtgcattgtttgaatcagagatgtctctagagtgctgtgttctcaataggaagaacatgtgtgtccaggratcaaaagatggaagcaggtttggctccacgtccaatcccttagattcacccaatggggtattttgcacgttttatcttccaacactgggctgtgcaggg

SEQ ID NO: 23416 - DNA, 201 bp, Homo sapiens
cataataaggacagggttggaagaaacctacaaagacagtggctttggctagttacttctcagctgcatcgatgctgtgtaaaaagataatgagaatctgyggattgttgacagctatgactggctacatttgacaccctcggcagtgtctcatggacaggtctttatctcctgtagcaaaagggcagatagcaaggaatg

SEQ ID NO: 23417 - DNA, 201 bp, Homo sapiens
tccaccctgtctccaccacctgcccctgctgtgactcccacatgcatgtgctgcccagtgatccacatggctcactcctcacaccattaaggtccctgctyaaatgtcccatggtcaagtgttcagaaatgtcttgtccagtgacctcttctgaaatctatcccctgccattcccaccaccgccaccaatcttctaaccca

SEQ ID NO: 23418 - DNA, 201 bp, Homo sapiens
catgcactcaggcacaacttttccagatttaagggggaaaaaaaaccctgtctttacacctacaatcccagggcgagctcactctctggcaacaagctccstggggtgatttttcttctagaagagtacaggaggacaggcaaggagtgggaggcagggagtccagttcagggacagggattccgggatgaaaagtgaagg

SEQ ID NO: 23419 - DNA, 201 bp, Homo sapiens
aaagtagggcagaaactaaggcaggacattcctcttctgaaggctgactgaagctccagggctccctgccacccttactgaacttcccttagcctgcacasggtctaggatgcttccagctgaccttcctgcactctctacatcactgaggctcagagttgctttgtggtccagtggctttcccagcattttctgtctcat

SEQ ID NO: 23420 - DNA, 201 bp, Homo sapiens
ccagtgacctcttctgaaatctatcccctgccattcccaccaccgccaccaatcttctaacccaagcatatttttcttaatggcaattatcagtgatactrtgacaggttttatttgtttattgtctgttgatttattaaggttaccaagaaagaaagaaccaatagcataggtacatagatgatagatagataatagata

SEQ ID NO: 23421 - DNA, 201 bp, Homo sapiens
tatcgtcaacctttttcctctctccccactggatcattgtggcagtcatgagaatgcacatcccagcccctcatctagaagaagcagaattgatgatggcyccagctcttgaagtctgaaatctattgccacatttgctctgagactatgcccacccctggctttttccagccaatgattgaggaaagtagggcagaaact

SEQ ID NO: 23422 - DNA, 201 bp, Homo sapiens
tgtgagtcctgttgtaatgcttttagatgcatttatataccaacaggccaaagtcacattttttaccgattagattcctgatcattcaggggttaccaagrttatgctacccactatagttaataaacaaaaagcaaactggtctctattctatctcatgcactcaggcacaacttttccagatttaagggggaaaaaaaa

SEQ ID NO: 23423 - DNA, 201 bp, Homo sapiens
gggctacggaatgaaggtaaatttaaaataaaacaagcgggagtcacagatacactgtctgggaaagtgaaacttaagagctttgtgagtcctgttgtaakgcttttagatgcatttatataccaacaggccaaagtcacattttttaccgattagattcctgatcattcaggggttaccaaggttatgctacccactata

SEQ ID NO: 23424 - DNA, 201 bp, Homo sapiens
tacagtagggagctctaagccacaaataaaggtgtcaggacagacctgagacctggagtgagcacatccctcagggtcatgagtcaatcctgtaagacccytcctccctcagacactccatccagtcatcaggaggtcaagaaaagttccccacagcactaagacccaaccacctcactgtcctcacctccatggacagag

SEQ ID NO: 23425 - DNA, 201 bp, Homo sapiens
tggtactttgtcttgaggagatgtcctggactcacacggaaacttagggctacggaatgaaggtaaatttaaaataaaacaagcgggagtcacagatacaytgtctgggaaagtgaaacttaagagctttgtgagtcctgttgtaatgcttttagatgcatttatataccaacaggccaaagtcacattttttaccgatta

SEQ ID NO: 23426 - DNA, 201 bp, Homo sapiens
gtctgcagtcacacatttctggaaacttctcgagggtccaagactaggaggttcctctaggacctcatggccctgccacctttctggcctctcacaggacrttttcttcccacagattgaaaaggagggagctactctcaggctgcaagtaagtatgaaggaggctgatccctgagatccttgggatcttgtgtttgggag

SEQ ID NO: 23427 - DNA, 201 bp, Homo sapiens
gatgagagggacggagggaagggctggaggagcaggaggtgaggaaaaggagcagaggaaagaattccaaagcagcagaactcttaggtttaaacacattrttttatagattttaatacatccatctacagagcctcgctgggtgttctttgcagttggcctttaatatcttatgtgggtctgcctagaaactaattgttt

SEQ ID NO: 23428 - DNA, 201 bp, Homo sapiens
aaacaacccacaaccaattaacagtgaagataaattaacaacctttgtaaatttaaaacaagattggcaaccctttagaaaaaaaatgagacttttgcaaracaatctaaatgatacactaataacaaaccttcatgaaaatgacatttcaaccatctgaatttctgctttaagttataaactccaaaatgaactaactcc

SEQ ID NO: 23429 - DNA, 201 bp, Homo sapiens
taagtttaaacaacccacaaccaattaacagtgaagataaattaacaacctttgtaaatttaaaacaagattggcaaccctttagaaaaaaaatgagactkttgcaaaacaatctaaatgatacactaataacaaaccttcatgaaaatgacatttcaaccatctgaatttctgctttaagttataaactccaaaatgaac

SEQ ID NO: 23430 - DNA, 201 bp, Homo sapiens
aattattagaatataagaggcccaaactactgctgttacagatatgtaaaactacacagtataagtttaaacaacccacaaccaattaacagtgaagatarattaacaacctttgtaaatttaaaacaagattggcaaccctttagaaaaaaaatgagacttttgcaaaacaatctaaatgatacactaataacaaacctt

SEQ ID NO: 23431 - DNA, 201 bp, Homo sapiens; identical to SEQ ID NO: 4085

SEQ ID NO: 23432 - DNA, 201 bp, Homo sapiens
cctggaatactgatgagtggttccctttgacactggcagcagccttgggccccgtgacttttcctctcaggccttgttctctgcttcacactcaatgtgcstgggggtctgagtccagctcttctgagtccctcagcctccactcaggtcaggaccagaagtcgctgttccctcctcagggactagaattttccacggaat

SEQ ID NO: 23433 - DNA, 201 bp, Homo sapiens; identical to SEQ ID NO: 4086

SEQ ID NO: 23434 - DNA, 201 bp, Homo sapiens
gtggttcacgcctgtaatcccagcactttgggaggctgaggtgggtggaccacctgaggtcaggagttcaagaccagtctggctaacatggtaaaaccccrttgtcgcaatcggttactatgggatataatgaagggggatgaacacagaaataaagacaaagacaaaaagatctgttctaaaagaaggggtcgggggctt

SEQ ID NO: 23435 - DNA, 201 bp, Homo sapiens
gctcagctgggtcatctttgctgctccattgtccttggcccttcagtagaaccttgtcccaccaggacctgtgatcacatagacttggatatcacctaggrtggtccctacacgtagaagttcctgtgttatcagaagaaaaattttcagacccctacacctcttcccctccttccaggtctctttcaattgtattttcca

SEQ ID NO: 23436 - DNA, 201 bp, Homo sapiens
ttgctccatctgtgagggcacacccttgtatagaagtaattgccttgctgagaagaaaaaaagaaaattttatatttgagtgctatttctttgtggcatcragactttatttacaataatacatttccttaatattttaagataacctctttctggaatgcctctttccatttactcacttctcttcttctaggaatttaa

SEQ ID NO: 23437 - DNA, 201 bp, Homo sapiens
aggccctgtctatcaacacttactcttttgtaaagcacctgtgaaaatgaaggacaaatttatcaccttgattgtggtcatgggaacctgactcccagcartcacaggtcaggggaaggtccctgctgaggacagacctcaggaggacaactggtccagcctcaacacatcctcttcccttgggttttctgatcctgacct

SEQ ID NO: 23438 - DNA, 201 bp, Homo sapiens
atctttgctgctccattgtccttggcccttcagtagaaccttgtcccaccaggacctgtgatcacatagacttggatatcacctagggtggtccctacacktagaagttcctgtgttatcagaagaaaaattttcagacccctacacctcttcccctccttccaggtctctttcaattgtattttccatcttttttttttt

SEQ ID NO: 23439 - DNA, 201 bp, Homo sapiens
catttcacccaatttagtggcatgttctttaccctttgcctttttgagcttggcaatgcaaaccacatacttgagacccaggacactgtctccccagtgayggcggatctcatcgtatctgtcattgtaattggtcctgagaacttccaccagcttagccaaagcacctttgtcttccgagttaacctgtgtgaaggtgac

SEQ ID NO: 23440 - DNA, 201 bp, Homo sapiens
tagtggcatgttctttaccctttgcctttttgagcttggcaatgcaaaccacatacttgagacccaggacactgtctccccagtgatggcggatctcatcrtatctgtcattgtaattggtcctgagaacttccaccagcttagccaaagcacctttgtcttccgagttaacctgtgtgaaggtgacagtggtgcaggtct

SEQ ID NO: 23441 - DNA, 201 bp, Homo sapiens
ggaaacagcttcctgcaggcctgcctggatgtgagccacaccaatggagtctccacaacagcaggaagagcaactgagaaccctggaagcttcacacttgyaatgttccatgtccagcggcattcagttgatggatgggccaagataagaatacagctccttccttcaattgggggtggcagaggggtgaatcagtcagct

SEQ ID NO: 23442 - DNA, 201 bp, Homo sapiens
taattttttgtatagatgggggttttgcccaggctgatcttgaacttctggagtcaacaaatctgccttcctctgccttccacagtgctaggatggcaggygtgagccaccatacctggcgtaaattaattataagatattaaacatgtaacttagttttaaaaggtaaggagaatttccatggctgaagaggatgtattt

SEQ ID NO: 23443 - DNA, 201 bp, Homo sapiens
gactgaggtaggagggtcccttgagcccaggaatttgaggctgcagtgagccatgatcatgtgactgcacttcatcctggatgacagagggagactctgtmtctaaaaataaatcaatgaatacaataaatgggtgctgtttaaagccaatgtttgtgacaatttgttacccagtcttataaaattcatacacagactcaa

SEQ ID NO: 23444 - DNA, 201 bp, Homo sapiens
gtatcctaacatttgaggagctgacacaggaggaacacttgcagccaggactttgagaccagctaggataatatagtgagacactcgtctctacatttctytttaattagctgggcatggtggcacttgcctgcagtcctagctactctgaagactgaggtaggagggtcccttgagcccaggaatttgaggctgcagtga

SEQ ID NO: 23445 - DNA, 201 bp, Homo sapiens
ggaggattcaaaatgaaaacacaggtttaggaagaccggaacagagattccatccacatcatgcccagatttctgattaagaaactataaacaacaaatgrgtgttatttggccaggcgtggtagtgcacacctgtatcctaacatttgaggagctgacacaggaggaacacttgcagccaggactttgagaccagctagg

SEQ ID NO: 23446 - DNA, 201 bp, Homo sapiens
cctgacctcatggccacctctcatactttgctcttgttttttccccagggccgatgagggcgtcgtatctggtttccagtggggtctaaagacgccatcasagtgagtggagattgggcttcataaagtgggagatctccaggatccttcctggaatccaagattcccagagaagccggatcccgcgtcccggaacccaac

SEQ ID NO: 23447 - DNA, 201 bp, Homo sapiens
aaaattatgtcaccatcaaggaaagtatccaaagtctctggcttaaacctgggcgtctccagctctgggacaggtggctgggcagggaagacaaactaagscaagggcccagctcggaagagtttcctttcctgagaattctgcaggagtttccctgacctcatggccacctctcatactttgctcttgttttttccccag

SEQ ID NO: 23448 - DNA, 201 bp, Homo sapiens
aagaagagtgggcagactggatcactctgatggttctggggcttctcttccaggagagaagaagacaaaaattatgtcaccatcaaggaaagtatccaaartctctggcttaaacctgggcgtctccagctctgggacaggtggctgggcagggaagacaaactaagccaagggcccagctcggaagagtttcctttcctg

SEQ ID NO: 23449 - DNA, 201 bp, Homo sapiens
catgcaaaaatactttaaatatgtgctatcagaagtagctactaaaacattaattccactgaaatgagggaggctgtaaaaaagaaaaacattgcataccygtattcacagcaacattactcaccatagccaagacaaggaagcaaacaaagcacccatcaacacatgaatagatgaagaacatgtggtctatgtaggcaa

SEQ ID NO: 23450 - DNA, 201 bp, Homo sapiens
ctcaacagaaagaaatgataaatgcttgaggtcatggataccctaaatatcttgactgatacacacattctatgcatgtatcaaaatgtcacatgtatccyataaatatgtacaaatattatgtaccaattttaaaaaatttaaaaaataaacaacacaatatggggcatttaaaaaggtacaaaaattatgagcatgata

SEQ ID NO: 23451 - DNA, 201 bp, Homo sapiens
aaaagtacaatgccacggtatatgagaaacaagtaaacaacagaaagttattgacagaatctaaataaaaatgcctgctataattctgcagccaagacagyggctttcaactcaattccttcaactcagtgttttcagaacacatcatcaacatcaagtattacgcacttatttcaaaagtttaagccaggcgtggtggtt

SEQ ID NO: 23452 - DNA, 201 bp, Homo sapiens
acaagtaaacaacagaaagttattgacagaatctaaataaaaatgcctgctataattctgcagccaagacagcggctttcaactcaattccttcaactcartgttttcagaacacatcatcaacatcaagtattacgcacttatttcaaaagtttaagccaggcgtggtggttcacgcctgtaatcccagcactttgggag

SEQ ID NO: 23453 - DNA, 201 bp, Homo sapiens
tcacagcacttgctaatggatttatctgtggtgtgagaaagaagaatcaaggacacccacagtattggactgagtgagcagaagggtggagctgctgtcartggagatggggagactctggcaggagcatacagaggagagggcattgcaggcatccagtggaggtgacatctacgaggaatgaaggtgaggggcccagat

SEQ ID NO: 23454 - DNA, 201 bp, Homo sapiens
tcccctgaagaaatcacaggcacagaggagggacaggtggatttcagggctgtgcttgatctgggaaaggaagagtgcagaccgccaggtggcgccgctgmactgcttctgcgcccaggaggtgcctgctggggctgagattgaaggtggggagaaggatgtcacagctcatcgcacaggttcccggtaaaaatcctcctg

SEQ ID NO: 23455 - DNA, 201 bp, Homo sapiens
gctgtctgcacaggtaggtgaaagtcagggaagttatggtctgctgttggttataataagtcacagattattgtgctttctcagataattaaagaaataayaagagaatttgtaactagaacacttactgagaagaccacaataatgcaaagttttttattcatctaaagaaggcaacagaagaaaaatagttgagcaaga

SEQ ID NO: 23456 - DNA, 201 bp, Homo sapiens
aaaatgtggtgcatatacacatggaatattaatcagccttaaaagtgaagaatatttggattggatggaaccttgaaaacacgctaaataaaataagccaraaaaaaggcaaatatgatatttcacttatatgaggcacctagaataagcaaattcacaaaaacagaaagtagaatacaggttaccaggggctgaaggcag

SEQ ID NO: 23457 - DNA, 201 bp, Homo sapiens
ataaaaatgcctgctataattctgcagccaagacagcggctttcaactcaattccttcaactcagtgttttcagaacacatcatcaacatcaagtattacrcacttatttcaaaagtttaagccaggcgtggtggttcacgcctgtaatcccagcactttgggaggctgaggtgggtggaccacctgaggtcaggagttca

SEQ ID NO: 23458 - DNA, 201 bp, Homo sapiens
tttttgacacaagaaagaggatgtgattgctagggtcatcatgtcattgtttattgtgttgccagtaaagtgaaatcaaaatacacaataaataataaaayaacccatgataagccaatgtttataatgtactaacaccactgagccagtgtttataatgtactgacacactccaagtgtgggcacagctgcagacatgcc

SEQ ID NO: 23459 - DNA, 201 bp, Homo sapiens
tctgcagccaagacagcggctttcaactcaattccttcaactcagtgttttcagaacacatcatcaacatcaagtattacgcacttatttcaaaagtttargccaggcgtggtggttcacgcctgtaatcccagcactttgggaggctgaggtgggtggaccacctgaggtcaggagttcaagaccagtctggctaacatg

SEQ ID NO: 23460 - DNA, 201 bp, Homo sapiens
aaataataaaataacccatgataagccaatgtttataatgtactaacaccactgagccagtgtttataatgtactgacacactccaagtgtgggcacagckgcagacatgccttgtctcttgggtcaggacacagggtagagtgaaatggaaagaaatcccagtcactgcagaaaagggcccccatggaagaggcctggca

SEQ ID NO: 23461 - DNA, 201 bp, Homo sapiens
atggagccattagaggcttttaagtgaagaaatgaaacaatctgactcacattagcaggattgctgacctttgtggggagaacagtcatgggcagcaggcragggacagagctagggacacaattcagtagtgacagagtagtagagactaaggggagaggagggcctgaaggatgacagggacagagagaagggctggag

SEQ ID NO: 23462 - DNA, 201 bp, Homo sapiens
tcaggatggagtctccttttgggggatgtgaatgggcagcagcccagggtagtttacaggttctgtgttttacaacagtgctggctaaagtccaaacaacatatcatccattcccttttaaaatggaacttttaaaataaatgtgtaatacttgatgttgatgatgtgttctgaaaacattgagttgaaagaattgactta

SEQ ID NO: 23463 - DNA, 201 bp, Homo sapiens
caggatggagtctccttttgggggatgtgaatgggcagcagcccagggtagtttacaggttctgtgttttacaacagtgctggctaaagtccaaacaacatatcatccattcccttttaaaatggaacttttaaaataaatgtgtaatacttgatgttgatgatgtgttctgaaaacattgagttgaaagaattgacttaa

SEQ ID NO: 23464 - DNA, 201 bp, Homo sapiens
ggtagagagagtagaatgacagttcccagaaactgggaagaatgtaggggtgggaaaatatagagatgcaggttaatggatgcaaatgtccaattatataragaaaataagttctaatgtttgatagcacagcagactgactaaagttaacaaaaatgtatatttcaaaatagctataagagtggatttggctgggcgtgg

SEQ ID NO: 23465 - DNA, 201 bp, Homo sapiens
taatgaatgccagggttaacacctaggtgatgggttgataggtacagccaaccaccatggcacacgattacctatgtaacaaacctgcacatcctgcacaygtaccctggaacttaaaattaaattaaattaaattaaattaaaagataagcttaaagcattaaagaaaaataattagataaaagaagtctttgatttaca

SEQ ID NO: 23466 - DNA, 201 bp, Homo sapiens
gagggcagtgatggggggatcattaggaaaaatagctaatgaatgccagggttaacacctaggtgatgggttgataggtacagccaaccaccatggcacaygattacctatgtaacaaacctgcacatcctgcacacgtaccctggaacttaaaattaaattaaattaaattaaattaaaagataagcttaaagcattaaa

SEQ ID NO: 23467 - DNA, 201 bp, Homo sapiens
ccacacataccactgaattaaacttttacagaattggaaatgcacatcattgatcaaaataaatgaaacaagaaaagagtagaaaggaataaccagtgacrgaatagcaatatgaatagaaaacacaataggactgcgaaaacaaagaaacaaacaaaaccacttcagaagcacctgatggcatgctatttagaatcatag

SEQ ID NO: 23468 - DNA, 201 bp, Homo sapiens; identical to SEQ ID NO: 4107

SEQ ID NO: 23469 - DNA, 201 bp, Homo sapiens
atctgatgtgcaaggtaattccatcttgcaaaggatttgatgttacattctaccacacataccactgaattaaacttttacagaattggaaatgcacatcwttgatcaaaataaatgaaacaagaaaagagtagaaaggaataaccagtgacggaatagcaatatgaatagaaaacacaataggactgcgaaaacaaagaa

SEQ ID NO: 23470 - DNA, 201 bp, Homo sapiens
gaataccaaagttcattgcaagcatccttaacaagaactacttacattggaacaaaaccacacagaattgtaaggagccatgtgacagagaggaccacgakgccatgaaaatggctttggctacaaataggtcatttgatccttggctcactggcatctctgtagattttcatgtatacaatcttcaatctgatgtgcaag

SEQ ID NO: 23471 - DNA, 201 bp, Homo sapiens
aagaataccaaagttcattgcaagcatccttaacaagaactacttacattggaacaaaaccacacagaattgtaaggagccatgtgacagagaggaccacsaggccatgaaaatggctttggctacaaataggtcatttgatccttggctcactggcatctctgtagattttcatgtatacaatcttcaatctgatgtgca

SEQ ID NO: 23472 - DNA, 201 bp, Homo sapiens
aaaatggaacttttaaaataaatgtgtaatacttgatgttgatgatgtgttctgaaaacattgagttgaaagaattgacttaaattcctaattccttaaayagattttttcaaagtaaaatatgcttggtttttataaaaatgaaagagaaaagaataccaaagttcattgcaagcatccttaacaagaactacttacatt

SEQ ID NO: 23473 - DNA, 201 bp, Homo sapiens
agtaactgacttcctggaggagtgtgagcttaagccagaatgaagtgatagaccgtgaaagacggatgaaggagtaggagcttctggaggcaaacatggtrtgtggttggctggattgggatatgtggagggactctgaacattctgctttaggtccagcactagagaaagaggactcatctttatttagcaccttccaca

SEQ ID NO: 23474 - DNA, 201 bp, Homo sapiens
ggctaaagtccaaacaacatatcatccattcccttttaaaatggaacttttaaaataaatgtgtaatacttgatgttgatgatgtgttctgaaaacattgwgttgaaagaattgacttaaattcctaattccttaaacagattttttcaaagtaaaatatgcttggtttttataaaaatgaaagagaaaagaataccaaag

SEQ ID NO: 23475 - DNA, 201 bp, Homo sapiens
tacactgtctgggaaagtgaaacttaagagctttgtgagtcctgttgtaatgcttttagatgcatttatataccaacaggccaaagtcacattttttacckattagattcctgatcattcaggggttaccaaggttatgctacccactatagttaataaacaaaaagcaaactggtctctattctatctcatgcactcagg

SEQ ID NO: 23476 - DNA, 201 bp, Homo sapiens
ctgagcatgttagtgaccttcacagtaactgacttcctggaggagtgtgagcttaagccagaatgaagtgatagaccgtgaaagacggatgaaggagtagsagcttctggaggcaaacatggtatgtggttggctggattgggatatgtggagggactctgaacattctgctttaggtccagcactagagaaagaggactc

SEQ ID NO: 23477 - DNA, 201 bp, Homo sapiens
attctatctcatgcactcaggcacaacttttccagatttaagggggaaaaaaaaccctgtctttacacctacaatcccagggcgagctcactctctggcamcaagctccctggggtgatttttcttctagaagagtacaggaggacaggcaaggagtgggaggcagggagtccagttcagggacagggattccgggatgaa

SEQ ID NO: 23478 - DNA, 201 bp, Homo sapiens
tttggagagttcagaagacaagaaaatgggggaaaatttgcaacttcctagagatttgttaagctgttgtgaccaaaatgctgatagtgatatggacaatrgagtccaggctgataaggtctcacatggagatgaggaacttattgggacctagaggaaaggtcacttttgttatgcattggcaaagaacttggaggcatt

SEQ ID NO: 23479 - DNA, 201 bp, Homo sapiens
ctcgcccccaggctcccactccatgaggtatttcagcgccgccgtgtcccggcccggccgcggggagccccgcttcatcgccatgggctacgtggacgacwcgcagttcgtgcggttcgacagcgactcggcgtgtccgaggatggagccgcgggcgccgtgggtggagcaggaggggccggagtattgggaagaggagac

SEQ ID NO: 23480 - DNA, 201 bp, Homo sapiens
gcaacttcctagagatttgttaagctgttgtgaccaaaatgctgatagtgatatggacaatagagtccaggctgataaggtctcacatggagatgaggaayttattgggacctagaggaaaggtcacttttgttatgcattggcaaagaacttggaggcattgttccccctccctagggatctgtagaactttgaacttga

SEQ ID NO: 23481 - DNA, 201 bp, Homo sapiens
gagtcaatgaattgttgccctattagtttccaaaagagctagttgttaaaagagtctcgcaccttcctactccctctgttcctctcttaccacgtgacttytgcacataccagctcccctttgccttctgccatgagtggaagcagcctgaggccctcgctaaatgctcaaacatttccagacatcagaatcctgagccaa

SEQ ID NO: 23482 - DNA, 201 bp, Homo sapiens
ttccctggttaagtcagggacccaggagcccaccacaaacaatcccagctgcgcggtgccttcatggtctgtggcgccccctggtgttgacactgggcctrtggccaaatgaggcttgagggaaaaggaaaacgggtttaggtagcgggatctccttcaggctctccagatttcaagccatgacttacactcagaaaaaat

SEQ ID NO: 23483 - DNA, 201 bp, Homo sapiens
accacacataccactgaattaaacttttacagaattggaaatgcacatcattgatcaaaataaatgaaacaagaaaagagtagaaaggaataaccagtgayggaatagcaatatgaatagaaaacacaataggactgcgaaaacaaagaaacaaacaaaaccacttcagaagcacctgatggcatgctatttagaatcata

SEQ ID NO: 23484 - DNA, 201 bp, Homo sapiens
cgagtctccgggtctgggatccaccccgaggccgcgggacccgcccagaccctctacctgggagaaccccaaggcgcctttaccaaaatccccgcgggtgkgtccgggcgagggcgaggctcggtgggcggggctgaccgagggggtggggccaggttctcacaccctccagtggatgattggctgcgacctggggtccga

SEQ ID NO: 23485 - DNA, 201 bp, Homo sapiens
agccaaaaaaaaggcaaatatgatatttcacttatatgaggcacctagaataagcaaattcacaaaaacagaaagtagaatacaggttaccaggggctgarggcaggaacaatgggcagctgtcatttaatgggtacagtctctgttgggatgatgaaaatgttctgaaaatgcatgttggtgtttgtgtaaccaccatca

SEQ ID NO: 23486 - DNA, 201 bp, Homo sapiens
gcaccatccagaggctgccagccacaaggaatgctggacaggtcttctacaggcaaaactcagtgccagcctggaggaagcactctgagaggtgggtgccrtcttttaggacacggtgcattgtttgaatcagagatgtctctagagtgctgtgttctcaataggaagaacatgtgtgtccagggatcaaaagatggaagc

SEQ ID NO: 23487 - DNA, 201 bp, Homo sapiens
ctgccagccacaaggaatgctggacaggtcttctacaggcaaaactcagtgccagcctggaggaagcactctgagaggtgggtgccatcttttaggacacsgtgcattgtttgaatcagagatgtctctagagtgctgtgttctcaataggaagaacatgtgtgtccagggatcaaaagatggaagcaggtttggctccac

SEQ ID NO: 23488 - DNA, 201 bp, Homo sapiens
atgaatatttcacaaaaatgggctcataagttacgtagcctcctgtgactggcttccttcacttgtcttgttttcaagattcagcaatgttttagcatatrccagtgctttattcattttatgaccaaataatattctattgtaggaaaaaactatatgttgtttctccattcattggtcgatggacattttcttttaaat

SEQ ID NO: 23489 - DNA, 201 bp, Homo sapiens
ccatttccacctgccagcagaccctgtcgccacaaatccacttctttctctatcgacttgcctcttatgaatatttcacaaaaatgggctcataagttacktagcctcctgtgactggcttccttcacttgtcttgttttcaagattcagcaatgttttagcatatgccagtgctttattcattttatgaccaaataatat

SEQ ID NO: 23490 - DNA, 201 bp, Homo sapiens
actgagccagtgtttataatgtactgacacactccaagtgtgggcacagctgcagacatgccttgtctcttgggtcaggacacagggtagagtgaaatggraagaaatcccagtcactgcagaaaagggcccccatggaagaggcctggcagggaggccagctgtcccagggccgccatatttagggatgactcccccttt

SEQ ID NO: 23491 - DNA, 201 bp, Homo sapiens
gacccggaccggagcctcttcgcgcggggatgaacataccctacgatggcgccagttacctcgtcctaaaccaggaactgctctcttggaccgcagcggahaaggcggctcagatgttttggaggaggaacatgcagagctgctcaaaacctacctgccgggaaggtgggcggagtggctcagcaaaggccttaagaatga

SEQ ID NO: 23492 - DNA, 201 bp, Homo sapiens
tgactttaccacaaccaatatagcaatgtagcaaaattgcacttgtgcctcatgaatatatatgaatttaagaaataaaaaataaaataacataacatgtytctttatagatacaggtagacatgtttgtatagcatgtgtgtgaatgtgtgtgtgtgcctgtgtgtgtgtccgcctgtgtgtgtgtgtccgtgtagagag

SEQ ID NO: 23493 - DNA, 201 bp, Homo sapiens; identical to SEQ ID NO: 15425

SEQ ID NO: 23494 - DNA, 201 bp, Homo sapiens
gtccaggctggtgtctgggttctgtgctcccttccccaccccaggtatctggttcattcttaggatggtcacatccaggtgctgctggagtgtcccatgasagatgcaaagtgcttgagttttctgactcttcctttcagacccccccaagacacacgtgacccaccaccctgtctttgactatgaggccaccctgaggtg

SEQ ID NO: 23495 - DNA, 201 bp, Homo sapiens
aaggaatataaatcattctattataaaggtatatgcatgtgtatgttcattgcagcactattcacaatagcaaagacatggaatcaacccaaatgcccacmaatgaggaactggataaagaaaatatggtacatatacaccacggaatattatgcaaccataaaaaggaatgagatcaagtcctttgcagagatacgaatg

SEQ ID NO: 23496 - DNA, 201 bp, Homo sapiens
ggtatatgcatgtgtatgttcattgcagcactattcacaatagcaaagacatggaatcaacccaaatgcccacaaatgaggaactggataaagaaaatatrgtacatatacaccacggaatattatgcaaccataaaaaggaatgagatcaagtcctttgcagagatacgaatgaagctggaagccattatcctcagcaaa

SEQ ID NO: 23497 - DNA, 201 bp, Homo sapiens
aataaaaaataaaataacataacatgtctctttatagatacaggtagacatgtttgtatagcatgtgtgtgaatgtgtgtgtgtgcctgtgtgtgtgtccrcctgtgtgtgtgtgtccgtgtagagaggcagcacaaattaagagattaagattttgtgactgagctattccaaagtaacttaaacataaaacacacatgg

SEQ ID NO: 23498 - DNA, 201 bp, Homo sapiens
ttggaataccttcctcagcctctttttcattgtggtaaaatacacataaacacaaaggataccaccgtaaccatttaaagtgcacaatgcagtgacaattygtatgttcacaatgttatgtaaccatcatcactctctagttccagagtgtttttatcacctcagggggaactctgcacccattaagcagtcaccctccat

SEQ ID NO: 23499 - DNA, 201 bp, Homo sapiens
taacataacatgtctctttatagatacaggtagacatgtttgtatagcatgtgtgtgaatgtgtgtgtgtgcctgtgtgtgtgtccgcctgtgtgtgtgtktccgtgtagagaggcagcacaaattaagagattaagattttgtgactgagctattccaaagtaacttaaacataaaacacacatggataaatgtgtctgt

SEQ ID NO: 23500 - DNA, 201 bp, Homo sapiens; identical to SEQ ID NO: 3174

SEQ ID NO: 23501 - DNA, 201 bp, Homo sapiens
aaaatgtatatttcaaaatagctataagagtggatttggctgggcgtggtggctcatgcctgtgatcccagcactttgggaggccgaggagggtggatcaygaggtcaggagatcgagaccatcctggctaacatggtgaaaccccgtctctactaaaaatacaaaaaaaaaaaaaaaaattagccgggcgtggtggtggg

SEQ ID NO: 23502 - DNA, 201 bp, Homo sapiens
gaacagaacagagaactcagaaataagaccacacatctaaataaaggaataataatcacaagactcaggatggagtctccttttgggggatgtgaatgggmagcagcccagggtagtttacaggttctgtgttttacaacagtgctggctaaagtccaaacaacatatcatccattcccttttaaaatggaacttttaaaa

SEQ ID NO: 23503 - DNA, 201 bp, Homo sapiens
ccactcatgggtatttatataaaggaaaagaaatcaatatatcaaaagactacctgcacccccaggtttattgaagcactattcacagtagcgaagttatkaaatcaatgggtgaattcatcaatgggtgaatgaataaatggtggtatatatatacacaatggaatgcaattcagccataaaaaagaatgaaatcctgtc

SEQ ID NO: 23504 - DNA, 201 bp, Homo sapiens; identical to SEQ ID NO: 4110

SEQ ID NO: 23505 - DNA, 201 bp, Homo sapiens
ccccaggctcccactccatgaggtatttcagcgccgccgtgtcccggcccggccgcggggagccccgcttcatcgccatgggctacgtggacgacacgcarttcgtgcggttcgacagcgactcggcgtgtccgaggatggagccgcgggcgccgtgggtggagcaggaggggccggagtattgggaagaggagacacgga

SEQ ID NO: 23506 - DNA, 201 bp, Homo sapiens
cctgcagcaggaggaggccacagctggatgttcgagggccttggcccagccctggcttgggcaggacttaagggtgtaaaaaataacctacatgtgatggytcattttcaattctatgtgccttagtataggtttaagcaggccacatggtcataaagagataaagaaggaaaatgtactaagccaccatcccccctactt

SEQ ID NO: 23507 - DNA, 201 bp, Homo sapiens
accactaagcaaccattagaatggctaaaattaaaatgattaataactataaatgctagcaaggatgtggaacaatctgtactctcctccattgcctatargaatataaaacatccattttgaaaatcaatttcatatcatctaataaagttaaacaagctagtcctctacagctaccatttccactcctaggtatatact

SEQ ID NO: 23508 - DNA, 201 bp, Homo sapiens
agaccgggatggggacaaagcaggcaccacggccctccctgctgcccactcctcacctgcagcaggaggaggccacagctggatgttcgagggccttggcycagccctggcttgggcaggacttaagggtgtaaaaaataacctacatgtgatggttcattttcaattctatgtgccttagtataggtttaagcaggccac

SEQ ID NO: 23509 - DNA, 201 bp, Homo sapiens
acatgctcaactgacttttacaaaagcacaaaagcaattcaatgaaggaaggagagctttcccatcaaatggtgatggaacaactggacaaccacagtggaaaaaaaataacctgagccaaaacctcatgcttcatacaaaaataactcaaaatgagtcacaagctttcatgtaaagcacagagttaaaatggcaaacatt

SEQ ID NO: 23510 - DNA, 201 bp, Homo sapiens
cagggtcagggctgaggcctgggggtcaggacccctcacgttcccctcctttcttagggccatcttcccagcccacattcctcatcatgggcatcgttacygtcctggttgttctaggtgctgtggtcactgctgtgatgtggaagaataagaccccaggtaggaaaggggtgagttccaagatttcttcttccattcgtg

SEQ ID NO: 23511 - DNA, 201 bp, Homo sapiens
cttcagcagggtcagggctgaggcctgggggtcaggacccctcacgttcccctcctttcttagggccatcttcccagcccacattcctcatcatgggcatygttaccgtcctggttgttctaggtgctgtggtcactgctgtgatgtggaagaataagaccccaggtaggaaaggggtgagttccaagatttcttcttcca

SEQ ID NO: 23512 - DNA, 201 bp, Homo sapiens
atgaaaagttctagagatctgttgcataacaatgtgctacagttcatattatagtactctatacttaaaaattgttacgataccaaattttatataatatrgattttggcgcaatgaaaaaaataattagctctgataccaacttaggaaaagagcacatgaatttattgaaaatatattagcatgtgcttactatgaaaa

SEQ ID NO: 23513 - DNA, 201 bp, Homo sapiens
ctggaggccttcagcagggtcagggctgaggcctgggggtcaggacccctcacgttcccctcctttcttagggccatcttcccagcccacattcctcatcrtgggcatcgttaccgtcctggttgttctaggtgctgtggtcactgctgtgatgtggaagaataagaccccaggtaggaaaggggtgagttccaagatttc

SEQ ID NO: 23514 - DNA, 201 bp, Homo sapiens
aaggaaattccaatactgcgcaattcgttatatgcggcgtctaaactcttagaacctgaaagtagaatggcggctgccagtggttaggctggggggattcwtgaggagattttcagcgtagagtttcagttttgcaagatgaaaagttctagagatctgttgcataacaatgtgctacagttcatattatagtactctata

SEQ ID NO: 23515 - DNA, 201 bp, Homo sapiens; identical to SEQ ID NO: 4108

SEQ ID NO: 23516 - DNA, 201 bp, Homo sapiens
tggctgcaaatgtccccccatcccttcccagccctttcggtgttgctgtgaatctgtccctcactgagaactggtggggagatgtgggggaggaggggagrtttctttatgctgtgtcaaagcatggagacagacctctccttctctcctgaacctcacactatcccttcccagacacttgaaataaaacgcagaccagaa

SEQ ID NO: 23517 - DNA, 201 bp, Homo sapiens
cccttctggaggccttcagcagggtcagggctgaggcctgggggtcaggacccctcacgttcccctcctttcttagggccatcttcccagcccacattccycatcatgggcatcgttaccgtcctggttgttctaggtgctgtggtcactgctgtgatgtggaagaataagaccccaggtaggaaaggggtgagttccaag

SEQ ID NO: 23518 - DNA, 201 bp, Homo sapiens
atgccatgtgcagcaggaggcactgccagagcccctcacactgagatgggctaaggagatgaatgaggggccatgtctcttctcagggaaagcaggagccyttctggaggccttcagcagggtcagggctgaggcctgggggtcaggacccctcacgttcccctcctttcttagggccatcttcccagcccacattcctca

SEQ ID NO: 23519 - DNA, 201 bp, Homo sapiens
atttctttcttctctgcatttttttttctttaaaattcaaccaggtgttgatgtgtgcattttaaattcttctgtaatcaaatacattttcatatttctartgtagaaacatgtatttttaacattcaaaataaaacatttgaagtaaaataacaatgaaaagtggctgaacactgtggtgggcacctgtagtcccagcta

SEQ ID NO: 23520 - DNA, 201 bp, Homo sapiens; identical to SEQ ID NO: 4087

SEQ ID NO: 23521 - DNA, 201 bp, Homo sapiens
atagagaaaataagttctaatgtttgatagcacagcagactgactaaagttaacaaaaatgtatatttcaaaatagctataagagtggatttggctgggcrtggtggctcatgcctgtgatcccagcactttgggaggccgaggagggtggatcatgaggtcaggagatcgagaccatcctggctaacatggtgaaacccc

SEQ ID NO: 23522 - DNA, 201 bp, Homo sapiens
cactggctgcaaatgtccccccatcccttcccagccctttcggtgttgctgtgaatctgtccctcactgagaactggtggggagatgtgggggaggagggraggtttctttatgctgtgtcaaagcatggagacagacctctccttctctcctgaacctcacactatcccttcccagacacttgaaataaaacgcagacca

SEQ ID NO: 23523 - DNA, 201 bp, Homo sapiens
tgaattgtacactgaaaaaaattgttagaaggtaaatcgtatagtatgtgtgttttaccacaattttaaaaatatatatcaacaccaaatccaatcacttytcactcctctgccacctccaccccagaaccatcctcactaggatagaaaaccggaagggccttccagctgggctgcctgctgactctcatgcccactgtc

SEQ ID NO: 23524 - DNA, 201 bp, Homo sapiens; identical to SEQ ID NO: 3194

SEQ ID NO: 23525 - DNA, 201 bp, Homo sapiens
tgacaggttttatttgtttattgtctgttgatttattaaggttaccaagaaagaaagaaccaatagcataggtacatagatgatagatagataatagatagatagatgatagatgatagatagatgttagatgatgatagatagatagatagatagatagatagatagatagacagacagatagatagataggtgatttat

SEQ ID NO: 23526 - DNA, 201 bp, Homo sapiens
tggttctttggaggggaagcctgggtgatatttctttcttctctgcatttttttttctttaaaattcaaccaggtgttgatgtgtgcattttaaattcttstgtaatcaaatacattttcatatttctaatgtagaaacatgtatttttaacattcaaaataaaacatttgaagtaaaataacaatgaaaagtggctgaac

SEQ ID NO: 23527 - DNA, 201 bp, Homo sapiens
tttgtttattgtctgttgatttattaaggttaccaagaaagaaagaaccaatagcataggtacatagatgatagatagataatagatagatagatgatagwtgatagatagatgttagatgatgatagatagatagatagatagatagatagatagatagacagacagatagatagataggtgatttattgggctaattgg

SEQ ID NO: 23528 - DNA, 201 bp, Homo sapiens
ccctgcaggaaggtccatgtggctaagaactgaggccccctgggaccagacagcaaggaactaggcttttccaacagccatgtgactaagccatgtttcaygtgaatccctagccccagtgaagccctcagacgatgcagccctaggctgacaactggactgcaaccttgtgagaggccctgagccagaagcactcaggaa

SEQ ID NO: 23529 - DNA, 201 bp, Homo sapiens
ctctatgttgcctaggctggtcacaaactcaggggctcaagcaatctgccagcctgagcctcccaaagtgctggaagtacaggcatgagccaccatgtccrtcctgagtgttctatgaatttttaaaatcacaaccatagaagaatcttcatgtacaaacatgcttgtcaaaatattctttaccaaaagacaagatgaaag

SEQ ID NO: 23530 - DNA, 201 bp, Homo sapiens
ctgttgatttattaaggttaccaagaaagaaagaaccaatagcataggtacatagatgatagatagataatagatagatagatgatagatgatagatagakgttagatgatgatagatagatagatagatagatagatagatagatagacagacagatagatagataggtgatttattgggctaattggctcacacaatta

SEQ ID NO: 23531 - DNA, 201 bp, Homo sapiens; identical to SEQ ID NO: 3196

SEQ ID NO: 23532 - DNA, 201 bp, Homo sapiens
ctggactgcaaccttgtgagaggccctgagccagaagcactcaggaaaaccgctcctggattcctgaccattagaaactgtgggagatgatgaatatttgytgttttgagctgctaagttttacataatttgttacacaatagtaaataactaatacattttcacaagagaggatgtattattacacgttaatttgcattt

SEQ ID NO: 23533 - DNA, 201 bp, Homo sapiens
ttaggtgaaataagccaagcaaggaaagacaaataccacatgttgtcactaatatgtgcgagccaaaaaggttaatcttagggaggtagagagagtagaawgacagttcccagaaactgggaagaatgtaggggtgggaaaatatagagatgcaggttaatggatgcaaatgtccaattatatagagaaaataagttctaa

SEQ ID NO: 23534 - DNA, 201 bp, Homo sapiens
gttcttttgcataccccagttatgggcctgttgccactctgtactcctctccccaggccagccgctcagcccgctcctttcaccctctgcaggagagcctsgtggcaggccagtggagggacatgatggactacatgctccaaggggtggcgcagccgagcatggaagagggctctggacagctcctggaagggcacgtgc

SEQ ID NO: 23535 - DNA, 201 bp, Homo sapiens
agccgctcagcccgctcctttcaccctctgcaggagagcctcgtggcaggccagtggagggacatgatggactacatgctccaaggggtggcgcagccgascatggaagagggctctggacagctcctggaagggcacgtgcacatggctgcagtggacctcctgatcggtggcactgagaccacagcaaacaccctctcc

SEQ ID NO: 23536 - DNA, 201 bp, Homo sapiens
cctcgtggcaggccagtggagggacatgatggactacatgctccaaggggtggcgcagccgagcatggaagagggctctggacagctcctggaagggcacktgcacatggctgcagtggacctcctgatcggtggcactgagaccacagcaaacaccctctcctgggccgtggtttttttgcttcaccaccctgaggtgcg

SEQ ID NO: 23537 - DNA, 201 bp, Homo sapiens
caggaggtgttaaaaacctggagccactggtccatccaaattgtggacgtgattccctttctcagggtgaggacctggagcctagacacccctgggttgtrggggagaggctggggtggagggagaggctccttcccacagctgcattctcatgcttcctgccgcagttcttccccaatccaggtctccggaggctgaagc

SEQ ID NO: 23538 - DNA, 201 bp, Homo sapiens
gatgggtgattaattttttttgaaatacggacgtcccaaggccaatgagactggtgtcattccagaaaagggccactctgtgggtgggtcggtgggaaggyacctgagggtggggtcaagggaggccccaaaacagtctacacagcaggagggatggctggggctcttgagctataagtggcacctcagggccctgacggg

SEQ ID NO: 23539 - DNA, 201 bp, Homo sapiens
aggatgtcaaggccgctgctaatcagatgcgcaacttcctggttcgagcctcctgccgccttcgcttggaacctgggaaagaatatttgatcatgggtctrgatggggccacctatgacctcgagggacagtgagtcatctggtcccctcagtctcttgtcctccccatgcctcgccacctaggccttgcccctcagaagc

SEQ ID NO: 23540 - DNA, 201 bp, Homo sapiens
  misc_feature (1)...(201): n = A,T,C or G, or insertion/deletion polymorphism (see Tables 1-2)
ccacgaactgggccctggtgcctccagctcccgggtcccctacaaggaccgtgcacggctgcccttgctcaatgccaccatcgccgaggtgctgcgcctgnggcccgttgtgcccttagccttgccccaccgcaccacacggcccagcaggtgactcccgagggttggggatgagtgaggaaagcccgagcccagggaggt

SEQ ID NO: 23541 - DNA, 201 bp, Homo sapiens
cctccttttctggcaggacgacaacttaatgcctgcctattacaaatgtatccaggaggtgttaaaaacctggagccactggtccatccaaattgtggacrtgattccctttctcagggtgaggacctggagcctagacacccctgggttgtaggggagaggctggggtggagggagaggctccttcccacagctgcattc

SEQ ID NO: 23542 - DNA, 201 bp, Homo sapiens
gccagccgctcagcccgctcctttcaccctctgcaggagagcctcgtggcaggccagtggagggacatgatggactacatgctccaaggggtggcgcagcygagcatggaagagggctctggacagctcctggaagggcacgtgcacatggctgcagtggacctcctgatcggtggcactgagaccacagcaaacaccctc

SEQ ID NO: 23543 - DNA, 201 bp, Homo sapiens
cttgggggggcatatctggtggggagaaagcaggggttggggaggccgaagaaggtcaggccctcagctgccttcatcagttcccaccctccagcccccamctcctcctgcagacaagctggtgtctaggaactacccggacctgtccttgggagactactccctgctctggaaagcccacaagaagctcacccgctcagc

SEQ ID NO: 23544 - DNA, 201 bp, Homo sapiens
cagtcatcattccgaacctccaaggcgcccacctggatgagacggtctgggagaggccacatgagttctggcctggtatgtggggggccgggggcctgccrtgaaaatgtggtggaggctggtccccgctgccgctgaacgcctccccacccacctgtccacccgcccgcagatcgcttcctggagccaggcaagaactcc

SEQ ID NO: 23545 - DNA, 201 bp, Homo sapiens
agaggccacatgagttctggcctggtatgtggggggccgggggcctgccgtgaaaatgtggtggaggctggtccccgctgccgctgaacgcctccccaccyacctgtccacccgcccgcagatcgcttcctggagccaggcaagaactccagagctctggccttcggctgcggtgcccgcgtgtgcctgggcgagccgctg

SEQ ID NO: 23546 - DNA, 201 bp, Homo sapiens; identical to SEQ ID NO: 4215

SEQ ID NO: 23547 - DNA, 201 bp, Homo sapiens; identical to SEQ ID NO: 4217

SEQ ID NO: 23548 - DNA, 201 bp, Homo sapiens
agcaggggttggggaggccgaagaaggtcaggccctcagctgccttcatcagttcccaccctccagcccccaactcctcctgcagacaagctggtgtctargaactacccggacctgtccttgggagactactccctgctctggaaagcccacaagaagctcacccgctcagccctgctgctgggcatccgtgactccatg

SEQ ID NO: 23549 - DNA, 201 bp, Homo sapiens
  misc_feature (1)...(201): n = A,T,C or G, or insertion/deletion polymorphism (see Tables 1-2)
ctgctgggcatccgtgactccatggagccagtggtggagcagctgacccaggagttctgtgaggtaaggctgggctcctgaggccacctcgggtcagcctngcctctcacagtagcccccgccctgcccgctgcacagcggcctgctgaactcacactgtttctccacagcgcatgagagcccagcccggcacccctgtgg

SEQ ID NO: 23550 - DNA, 201 bp, Homo sapiens; identical to SEQ ID NO: 4218

SEQ ID NO: 23551 - DNA, 201 bp, Homo sapiens
tacctcaccttcggagacaagatcaaggtgcctcacagcccctcaggcccacccccagcccctccctgagcctctccttgtcctgaactgaaagtactccmtccttttctggcaggacgacaacttaatgcctgcctattacaaatgtatccaggaggtgttaaaaacctggagccactggtccatccaaattgtggacgt

SEQ ID NO: 23552 - DNA, 201 bp, Homo sapiens; identical to SEQ ID NO: 4219

SEQ ID NO: 23553 - DNA, 201 bp, Homo sapiens
ggggaggccgaagaaggtcaggccctcagctgccttcatcagttcccaccctccagcccccaactcctcctgcagacaagctggtgtctaggaactacccsgacctgtccttgggagactactccctgctctggaaagcccacaagaagctcacccgctcagccctgctgctgggcatccgtgactccatggagccagtgg

SEQ ID NO: 23554 - DNA, 201 bp, Homo sapiens
ctgactcagaaattcgggcccatctacaggctccaccttgggctgcaaggtgagaggctgatctcgctctggccctcaccataggagggggcggaggtgayggagagggtcctctctccgctgacgctgctttggctgtctcccagatgtggtggtgctgaactccaagaggaccattgaggaagccatggtcaaaaagtg

SEQ ID NO: 23555 - DNA, 201 bp, Homo sapiens
ctgctcctgggcctgctgctgctgctgcccctgctggctggcgcccgcctgctgtggaactggtggaagctccggagcctccacctcccgcctcttgcccygggcttcttgcacctgctgcagcccgacctccccatctatctgcttggcctgactcagaaattcgggcccatctacaggctccaccttgggctgcaaggt

SEQ ID NO: 23556 - DNA, 201 bp, Homo sapiens
gccgaagaaggtcaggccctcagctgccttcatcagttcccaccctccagcccccaactcctcctgcagacaagctggtgtctaggaactacccggacctktccttgggagactactccctgctctggaaagcccacaagaagctcacccgctcagccctgctgctgggcatccgtgactccatggagccagtggtggagc

SEQ ID NO: 23557 - DNA, 201 bp, Homo sapiens
  misc_feature (1)...(201): n = A,T,C or G, or insertion/deletion polymorphism (see Tables 1-2)
agatgtggtggtgctgaactccaagaggaccattgaggaagccatggtcaaaaagtgggcagactttgctggcagacctgagccacttacctgtaagggcngggggcattttttctttcttaaaaaaatttttttttaagagatgggttcttgctatgctgcccaggctggtcttaaattcctagtctcaaatgatcctcc

SEQ ID NO: 23558 - DNA, 201 bp, Homo sapiens
gcggcccgttgtgcccttagccttgccccaccgcaccacacggcccagcaggtgactcccgagggttggggatgagtgaggaaagcccgagcccagggagrtcctggccagcctctaactccagcccccttcagcatctccggctacgacatccctgagggcacagtcatcattccgaacctccaaggcgcccacctggat

SEQ ID NO: 23559 - DNA, 201 bp, Homo sapiens
ctcccgcctcttgccccgggcttcttgcacctgctgcagcccgacctccccatctatctgcttggcctgactcagaaattcgggcccatctacaggctccwccttgggctgcaaggtgagaggctgatctcgctctggccctcaccataggagggggcggaggtgacggagagggtcctctctccgctgacgctgctttgg

SEQ ID NO: 23560 - DNA, 201 bp, Homo sapiens
ggttgtaggggagaggctggggtggagggagaggctccttcccacagctgcattctcatgcttcctgccgcagttcttccccaatccaggtctccggaggytgaagcaggccatagagaagagggatcacatcgtggagatgcagctgaggcagcacaaggtggggactgtgtgtggacggcctcccctcggcccacagcc

SEQ ID NO: 23561 - DNA, 201 bp, Homo sapiens; identical to SEQ ID NO: 4225

SEQ ID NO: 23562 - DNA, 201 bp, Homo sapiens
  misc_feature (1)...(201): n = A,T,C or G, or insertion/deletion polymorphism (see Tables 1-2)
tgctgggcatccgtgactccatggagccagtggtggagcagctgacccaggagttctgtgaggtaaggctgggctcctgaggccacctcgggtcagcctcncctctcacagtagcccccgccctgcccgctgcacagcggcctgctgaactcacactgtttctccacagcgcatgagagcccagcccggcacccctgtggc

SEQ ID NO: 23563 - DNA, 201 bp, Homo sapiens; identical to SEQ ID NO: 4226

SEQ ID NO: 23564 - DNA, 201 bp, Homo sapiens
gcctgctgaactcacactgtttctccacagcgcatgagagcccagcccggcacccctgtggccattgaggaggaattctctctcctcacctgcagcatcawctgttacctcaccttcggagacaagatcaaggtgcctcacagcccctcaggcccacccccagcccctccctgagcctctccttgtcctgaactgaaagta

SEQ ID NO: 23565 - DNA, 201 bp, Homo sapiens
gtatccaggaggtgttaaaaacctggagccactggtccatccaaattgtggacgtgattccctttctcagggtgaggacctggagcctagacacccctggrttgtaggggagaggctggggtggagggagaggctccttcccacagctgcattctcatgcttcctgccgcagttcttccccaatccaggtctccggaggct

SEQ ID NO: 23566 - DNA, 201 bp, Homo sapiens; identical to SEQ ID NO: 4228

SEQ ID NO: 23567 - DNA, 201 bp, Homo sapiens
aaatttttttttaagagatgggttcttgctatgctgcccaggctggtcttaaattcctagtctcaaatgatcctcccacctcagcctcaagtgtgagccayctttggggcatccccaatccaggtccctggaagctcttgggggggcatatctggtggggagaaagcaggggttggggaggccgaagaaggtcaggccctc

SEQ ID NO: 23568 - DNA, 201 bp, Homo sapiens
ctttggggcatccccaatccaggtccctggaagctcttgggggggcatatctggtggggagaaagcaggggttggggaggccgaagaaggtcaggccctcrgctgccttcatcagttcccaccctccagcccccaactcctcctgcagacaagctggtgtctaggaactacccggacctgtccttgggagactactccctg

SEQ ID NO: 23569 - DNA, 201 bp, Homo sapiens
atccccaatccaggtccctggaagctcttgggggggcatatctggtggggagaaagcaggggttggggaggccgaagaaggtcaggccctcagctgccttsatcagttcccaccctccagcccccaactcctcctgcagacaagctggtgtctaggaactacccggacctgtccttgggagactactccctgctctggaaa

SEQ ID NO: 23570 - DNA, 201 bp, Homo sapiens
tccccaatccaggtccctggaagctcttgggggggcatatctggtggggagaaagcaggggttggggaggccgaagaaggtcaggccctcagctgccttcrtcagttcccaccctccagcccccaactcctcctgcagacaagctggtgtctaggaactacccggacctgtccttgggagactactccctgctctggaaag

SEQ ID NO: 23571 - DNA, 201 bp, Homo sapiens
cagtggtggagcagctgacccaggagttctgtgaggtaaggctgggctcctgaggccacctcgggtcagcctcgcctctcacagtagcccccgccctgccbgctgcacagcggcctgctgaactcacactgtttctccacagcgcatgagagcccagcccggcacccctgtggccattgaggaggaattctctctcctcac

SEQ ID NO: 23572 - DNA, 201 bp, Homo sapiens
gggagaggctccttcccacagctgcattctcatgcttcctgccgcagttcttccccaatccaggtctccggaggctgaagcaggccatagagaagagggaycacatcgtggagatgcagctgaggcagcacaaggtggggactgtgtgtggacggcctcccctcggcccacagccagtgatgctaccggcctcagcattgc

SEQ ID NO: 23573 - DNA, 201 bp, Homo sapiens
cctttcaccctctgcaggagagcctcgtggcaggccagtggagggacatgatggactacatgctccaaggggtggcgcagccgagcatggaagagggctcyggacagctcctggaagggcacgtgcacatggctgcagtggacctcctgatcggtggcactgagaccacagcaaacaccctctcctgggccgtggtttttt

SEQ ID NO: 23574 - DNA, 201 bp, Homo sapiens
caggctcactgggttgctgagggagcggctggaggctgggcagctgtgggctgctggggcaggactccacccgatcattccccagattcagcagcgactgraggaggagctagaccacgaactgggccctggtgcctccagctcccgggtcccctacaaggaccgtgcacggctgcccttgctcaatgccaccatcgccga

SEQ ID NO: 23575 - DNA, 201 bp, Homo sapiens; identical to SEQ ID NO: 4232

SEQ ID NO: 23576 - DNA, 201 bp, Homo sapiens
ataggaagcaaacaaaaacaggccaaggaaacccagtacagggggctgcagggcccagggagtgggtccctcatctctcctccccacgcttggccaggtcyccacctcccgggagtgcgtgggctttgaggctgtgcaggaagtgccggtggggctggtgcagccggccagcgcaaccctgtacgactactacaaccccgg

SEQ ID NO: 23577 - DNA, 201 bp, Homo sapiens
cccacagctgcattctcatgcttcctgccgcagttcttccccaatccaggtctccggaggctgaagcaggccatagagaagagggatcacatcgtggagawgcagctgaggcagcacaaggtggggactgtgtgtggacggcctcccctcggcccacagccagtgatgctaccggcctcagcattgctatgaggcgggttc

SEQ ID NO: 23578 - DNA, 201 bp, Homo sapiens
ctccttcccacagctgcattctcatgcttcctgccgcagttcttccccaatccaggtctccggaggctgaagcaggccatagagaagagggatcacatcgwggagatgcagctgaggcagcacaaggtggggactgtgtgtggacggcctcccctcggcccacagccagtgatgctaccggcctcagcattgctatgaggc

SEQ ID NO: 23579 - DNA, 201 bp, Homo sapiens
ctccatgggggtggcgaaggtggaatgagaggatctacacagagtccccagcctgggctcaccctgcaccttctcttcccctctgaccacttttgcgcacrtcatccccgcagccaaggatgtcaaggccgctgctaatcagatgcgcaacttcctggttcgagcctcctgccgccttcgcttggaacctgggaaagaata

SEQ ID NO: 23580 - DNA, 201 bp, Homo sapiens
  misc_feature (1)...(201): n = A,T,C or G, or insertion/deletion polymorphism (see Tables 1-2)
ccttcggagacaagatcaaggtgcctcacagcccctcaggcccacccccagcccctccctgagcctctccttgtcctgaactgaaagtactccctcctttnctggcaggacgacaacttaatgcctgcctattacaaatgtatccaggaggtgttaaaaacctggagccactggtccatccaaattgtggacgtgattccc

SEQ ID NO: 23581 - DNA, 201 bp, Homo sapiens
  misc_feature (1)...(201): n = A,T,C or G, or insertion/deletion polymorphism (see Tables 1-2)
ttccccttaaggaggtagctcccagcactcaaccaacctccccgcagagctcccttcctgaccctccgctgcagaggattgaggcttaattctgagctggncctttccagccaataaatcaactccagctccctctgcgaggctggcatgattgttccatttcacccagccactcagtcccttgcctgttacactgtgggg

SEQ ID NO: 23582 - DNA, 201 bp, Homo sapiens
caagatcaaggtgcctcacagcccctcaggcccacccccagcccctccctgagcctctccttgtcctgaactgaaagtactccctccttttctggcaggasgacaacttaatgcctgcctattacaaatgtatccaggaggtgttaaaaacctggagccactggtccatccaaattgtggacgtgattccctttctcaggg

SEQ ID NO: 23583 - DNA, 201 bp, Homo sapiens
gctgctgctgctgcccctgctggctggcgcccgcctgctgtggaactggtggaagctccggagcctccacctcccgcctcttgccccgggcttcttgcacytgctgcagcccgacctccccatctatctgcttggcctgactcagaaattcgggcccatctacaggctccaccttgggctgcaaggtgagaggctgatctc

SEQ ID NO: 23584 - DNA, 201 bp, Homo sapiens
cggcccagcaggtgactcccgagggttggggatgagtgaggaaagcccgagcccagggaggtcctggccagcctctaactccagcccccttcagcatctcyggctacgacatccctgagggcacagtcatcattccgaacctccaaggcgcccacctggatgagacggtctgggagaggccacatgagttctggcctggta

SEQ ID NO: 23585 - DNA, 201 bp, Homo sapiens
tggctggcgcccgcctgctgtggaactggtggaagctccggagcctccacctcccgcctcttgccccgggcttcttgcacctgctgcagcccgacctcccmatctatctgcttggcctgactcagaaattcgggcccatctacaggctccaccttgggctgcaaggtgagaggctgatctcgctctggccctcaccatagg

SEQ ID NO: 23586 - DNA, 201 bp, Homo sapiens
agttcttccccaatccaggtctccggaggctgaagcaggccatagagaagagggatcacatcgtggagatgcagctgaggcagcacaaggtggggactgtrtgtggacggcctcccctcggcccacagccagtgatgctaccggcctcagcattgctatgaggcgggttcttttgcataccccagttatgggcctgttgcc

SEQ ID NO: 23587 - DNA, 201 bp, Homo sapiens
ggggcatccccaatccaggtccctggaagctcttgggggggcatatctggtggggagaaagcaggggttggggaggccgaagaaggtcaggccctcagctkccttcatcagttcccaccctccagcccccaactcctcctgcagacaagctggtgtctaggaactacccggacctgtccttgggagactactccctgctct

SEQ ID NO: 23588 - DNA, 201 bp, Homo sapiens
gttcttccccaatccaggtctccggaggctgaagcaggccatagagaagagggatcacatcgtggagatgcagctgaggcagcacaaggtggggactgtgygtggacggcctcccctcggcccacagccagtgatgctaccggcctcagcattgctatgaggcgggttcttttgcataccccagttatgggcctgttgcca

SEQ ID NO: 23589 - DNA, 201 bp, Homo sapiens; identical to SEQ ID NO: 4240

SEQ ID NO: 23590 - DNA, 201 bp, Homo sapiens
  misc_feature (1)...(201): n = A,T,C or G, or insertion/deletion polymorphism (see Tables 1-2)
ctaccggcctcagcattgctatgaggcgggttcttttgcataccccagttatgggcctgttgccactctgtactcctctccccaggccagccgctcagccngctcctttcaccctctgcaggagagcctcgtggcaggccagtggagggacatgatggactacatgctccaaggggtggcgcagccgagcatggaagaggg

SEQ ID NO: 23591 - DNA, 201 bp, Homo sapiens
aacgcctccccacccacctgtccacccgcccgcagatcgcttcctggagccaggcaagaactccagagctctggccttcggctgcggtgcccgcgtgtgcytgggcgagccgctggcgcgcctggagctcttcgtggtgctgacccgactgctgcaggccttcacgctgctgccctccggggacgccctgccctccctgca

SEQ ID NO: 23592 - DNA, 201 bp, Homo sapiens
ataatcccagcactttgggaagccgaggcgggtggatcacctgaggtcaggagttcgagaacagctggctaacattgagaaaccccatctctactaaaaayacaaaaattagtgggcctggtggcgcacgcctgtagttccagctactcaggaggctgaggcaggagaacttgaaaccaggaggcggaggttgcaatgagc

SEQ ID NO: 23593 - DNA, 201 bp, Homo sapiens
tgaggtacgagaattgcttgagcctaggaggccaaggctgcagtgagccgagatctcaccattgcactcctgcctgggtgacagagtaagaccctgtctcaaaaaaaaaaaaaaaagttaccaaaatagcaaaaagcagtcatttatactcctcacctagatttcgcaaatgttaacattttgtcatgtttacattaatat

SEQ ID NO: 23594 - DNA, 201 bp, Homo sapiens
caggccaccctgccactcacccagcacacggcaaaatgcagaggactacctttccctggtccgccccctggccgccccttggggaatgcaaacttcgtgtyctgctgcggagccagacgcctgtattgggaagtggggagaatcaaggcggggaaatcggacttttgggtcgctgggggcaacgaagcctggagaggcctt

SEQ ID NO: 23595 - DNA, 201 bp, Homo sapiens
ctggagtgcagtggcgccatcccggctcactgcaacctttgcgtcccagaatcaagcaattctcctgcctctgcctcctgagtagctgggattacaggcgyccaccacgcccagctaattttgtatttttagtagagacagggtttctccgtgttggccaggctggtctcgaattcctgacctcagatgatccaccctcct

SEQ ID NO: 23596 - DNA, 201 bp, Homo sapiens
tgagtgggcaggagtacgggccacccgagggactcgggacgggcgtccgggctcgggtagtggtcacactcttggtctcctttgtccctagttcgggaggmggaaaaagatgagcgcgctctgaagcaggagattcacgagctgcgagggcgcctggagcggctggagcaggtgagccaagcctgctgggtggggcgaggc

SEQ ID NO: 23597 - DNA, 201 bp, Homo sapiens
aggcctgaccagtgcgagtgcgcccccggctggggagggaagcactgtcatgtgggtgagtcagcttgtcctccccacctacccaggtgcttgcccccgcyccctctctcagccccttccttttttcggtaactagacgtggatgaatgtaggaccagcatcaccctctgctcgcaccattgttttaatacggcaggcagc

SEQ ID NO: 23598 - DNA, 201 bp, Homo sapiens
gttaggcctgaccagtgcgagtgcgcccccggctggggagggaagcactgtcatgtgggtgagtcagcttgtcctccccacctacccaggtgcttgccccygccccctctctcagccccttccttttttcggtaactagacgtggatgaatgtaggaccagcatcaccctctgctcgcaccattgttttaatacggcaggc

SEQ ID NO: 23599 - DNA, 201 bp, Homo sapiens
aggagattcacgagctgcgagggcgcctggagcggctggagcaggtgagccaagcctgctgggtggggcgaggccagacgtcactgtcaataccctgaggsatctcttcctttctagtgggccggtcaggctggggcctgggtcagagcggtgctgcccgtgccgcctgaagagctgcagccagaacaggtggctgagctg

SEQ ID NO: 23600 - DNA, 201 bp, Homo sapiens; identical to SEQ ID NO: 4291

SEQ ID NO: 23601 - DNA, 201 bp, Homo sapiens
ccaggtgcttggtttgtgtgtacggtgtgaaggtatatagctaggggttttttttgtttgtttgttttgtttgtttttttgagacggagtcttgctctgtygcccaggctagagtgcagtggcatgatcttggttcactgcaacctctgcctccagggttcaagggattctcctgcctcagcttcccgagtagctgggatt

SEQ ID NO: 23602 - DNA, 201 bp, Homo sapiens; identical to SEQ ID NO: 4278

SEQ ID NO: 23603 - DNA, 201 bp, Homo sapiens; identical to SEQ ID NO: 4280

SEQ ID NO: 23604 - DNA, 201 bp, Homo sapiens
tcaggtgatttgccctccttggcctcccaaagtgctgcaattacaggcgtgtgccactgcgcccggccagattttctccagctcttctgataacctccccscaaatctctttgtagcttctttggtttctatgatgcaaatgagaccgtcctggagatggaggagcaactggtgagccccctgggattacttccccttcta

SEQ ID NO: 23605 - DNA, 201 bp, Homo sapiens; identical to SEQ ID NO: 4285

SEQ ID NO: 23606 - DNA, 201 bp, Homo sapiens
gaagcggcacccgggggcgctcacctgtgaaggtgaggctgggtcttccgggccttgcgggaggcgcgccccacggagctggggagctgggtcgtcggttygagtctgaaccccacttcctctgtcctcagccatctgcgccaagccttgcctgaacggaggcgtctgcgttaggcctgaccagtgcgagtgcgcccccgg

SEQ ID NO: 23607 - DNA, 201 bp, Homo sapiens; identical to SEQ ID NO: 4276

SEQ ID NO: 23608 - DNA, 201 bp, Homo sapiens
gagatgggaccccaagaaccccaactaggacccgtactcagggtcctgagccgggcgctgtgttccaggaccatgtaccgcgttatgtggcgggaggtgargcgggaggttcagcagacccatgcagtgtgctgccagggctggaagaagcggcacccgggggcgctcacctgtgaaggtgaggctgggtcttccgggcct

SEQ ID NO: 23609 - DNA, 201 bp, Homo sapiens; identical to SEQ ID NO: 4286

SEQ ID NO: 23610 - DNA, 201 bp, Homo sapiens
atgctggggctctgggggcagcggctccccgcggcgtgggtcctgcttctgttgcctttcctgccgctgctgctgcttgcagcccccgcgccccaccgcgmgtcctacaagccggtcatcgtggtgcatgggctcttcgacagctcgtacagcttccgccacctgctggaatacatcaatgaggtctggcaggggacacct

SEQ ID NO: 23611 - DNA, 201 bp, Homo sapiens
gccaacctctagaccagaccatggggccagaatacttgggtttgaatcttgaccctattgggtgcctttgggcaagttacttaaccattctgttactcagwtttccttatctgtaaaatattatagcatgtacttcaccaggtggttgtaaggattaaataaataaatgaatgcaatgtactttgaatagtacctggctca

SEQ ID NO: 23612 - DNA, 201 bp, Homo sapiens
gagtgggcaggagtacgggccacccgagggactcgggacgggcgtccgggctcgggtagtggtcacactcttggtctcctttgtccctagttcgggaggcrgaaaaagatgagcgcgctctgaagcaggagattcacgagctgcgagggcgcctggagcggctggagcaggtgagccaagcctgctgggtggggcgaggcc

SEQ ID NO: 23613 - DNA, 201 bp, Homo sapiens
tgttggccaggctggtcttgaactcctgacctcaggtgatccaccctccttggtctcccaaagtgctgggattacaggcatgagccaccacacctggcctyttttttttttttttttgagacaaagtctcactctgtcgccaggctggagtgcagtggcgccatcccggctcactgcaacctttgcgtcccagaatcaagc

SEQ ID NO: 23614 - DNA, 201 bp, Homo sapiens
ggtgttatccctgtatttatggaaataaagttccatttcctcagtgtgacttggctcatttccaggtggaggggacctggctccccaaggagggtgggggyggagcctgaggcctgggtgcccagatgcctggtctagggtggggacccccttggtgtttccgctctctctcaatgcccattctttgtgggttcctggttc

SEQ ID NO: 23615 - DNA, 201 bp, Homo sapiens
acccagcacacggcaaaatgcagaggactacctttccctggtccgccccctggccgccccttggggaatgcaaacttcgtgttctgctgcggagccagackcctgtattgggaagtggggagaatcaaggcggggaaatcggacttttgggtcgctgggggcaacgaagcctggagaggccttctttccattcccagaata

SEQ ID NO: 23616 - DNA, 201 bp, Homo sapiens; identical to SEQ ID NO: 4292

SEQ ID NO: 23617 - DNA, 201 bp, Homo sapiens
ccacagatgggacagtatggaggtgagtgggcactagactccatagaatgccctgagttttgggggaacagaggtttatggtcacttagcattgccattcrcttgccagacacggactacttgaagtggctgttccccacctccatgcggtctaacctctatcggatctgctatagcccctggggccaggaattctccatc

SEQ ID NO: 23618 - DNA, 201 bp, Homo sapiens
ccctctctgtgactcctgagctgaagggttcaccctgtggggaggaggtccaggatcccagcagtaactcactttgtctctccttgtgtctctcttccatrcttccacgccccttcgaccaccttgaaggtttatctgcgggattcttttgggttgaagactctattggcccggggggccatagtgaggtgtccaatggcc

SEQ ID NO: 23619 - DNA, 201 bp, Homo sapiens
atgtaccatatgtgaatgaatgtgcctgtgttccagtaaaacttcatttacaaaaacaagtagcaggctggatttggtcctttggtcacagtttgccaacytctagaccagaccatggggccagaatacttgggtttgaatcttgaccctattgggtgcctttgggcaagttacttaaccattctgttactcagttttcct

SEQ ID NO: 23620 - DNA, 201 bp, Homo sapiens; identical to SEQ ID NO: 4279

SEQ ID NO: 23621 - DNA, 201 bp, Homo sapiens
agtacagcgttattagtctttttatttgcttattgcatcttgggagcgcgtgggtgggtgaagggagcgaggataggaagtctatggagatttacaccagtttttttttttttttaaacaaaaacacagccagataatcattattcttcccttacgtccccccagcccccacctggggcagtcgctctcccggctgcgtcc

SEQ ID NO: 23622 - DNA, 201 bp, Homo sapiens
gcctgaagagctgcagccagaacaggtggctgagctgtggggccggggtgaccggatcgaatctctcagcgaccaggtgctgctgctggaggagaggctakgtgcctgtgagtcctcacactcctcccgccttgacttctattccccaactttccccaagacccctctccattcaggcattccctctttcctccaagcccc

SEQ ID NO: 23623 - DNA, 201 bp, Homo sapiens
gaagaggtggaacaagagaaggttaaaccctcacaggattggcccacccccgtcccgccgcgtgctgcgcaggcgcgttttacctaaccaccattttccgkcaagttttagccaatgagttgatttggagccatacgctccaaagtccaatagcaatccggacattctctaaaagaggaagcgaaggaaagaaaggggctt

SEQ ID NO: 23624 - DNA, 201 bp, Homo sapiens
ggcgcgttttacctaaccaccattttccgtcaagttttagccaatgagttgatttggagccatacgctccaaagtccaatagcaatccggacattctctaraagaggaagcgaaggaaagaaaggggcttatagtgggcgaggtctataggtagtcccgagcaaattgcttatggctttggttatgactgacaactactca

SEQ ID NO: 23625 - DNA, 201 bp, Homo sapiens
actccaccccgcccccagggccagagaccagctccggagagcagaggggtgagtcttcttgtccagttgtgtcccttccttgacagatttgccggcttccygtctgactttttctgcctccctagggattccagccatttggtgataccgggggcttccacttctcatttggtgttggtgcttttccctttggctttttca

SEQ ID NO: 23626 - DNA, 201 bp, Homo sapiens
gggaagctgtggtcagtgtgtgtggccacctgtactggtgagaatcgaggaggggggcgggaggtggtgggtctcgcttatatactggagaggctaggagmgaataatcatacagtcatacagataatcggagggcacgttcccataggtgaagcccgacaggagacataagactttgctggtatgtgtgggtgggagtat

SEQ ID NO: 23627 - DNA, 201 bp, Homo sapiens
gatggggttggggttgaaaagaggagacccagaaagaggtggctgaaggaaattagaaattaacttgaaaggcagaaaagagagggcacgaaaatttgtaygtgtttgttggggagaggagaaaggagagggttgagtgtgttgaggatggacagagctttaggtgttggaagatcagacaagcaggaaggctaactaagt

SEQ ID NO: 23628 - DNA, 201 bp, Homo sapiens
ggagctgtaagaccctcttgtatactggaaaccaccttttttctccccagtggctggagacacggccagaacggcaagagtgtccagtatgtaaagctggkatcagcagagagaaggttgtcccgctttatgggcgagggagccagaagccccaggatcccaggtgagagactggaggtgttgcttagggaagattgaagg

SEQ ID NO: 23629 - DNA, 201 bp, Homo sapiens
cggtgtggaagatgggaggagaaaaatccctgttaactttctctctccacttcctcagattaaaaactccaccccgcccccagggccagagaccagctccrgagagcagaggggtgagtcttcttgtccagttgtgtcccttccttgacagatttgccggcttcccgtctgactttttctgcctccctagggattccagcc

SEQ ID NO: 23630 - DNA, 201 bp, Homo sapiens
gttgcttagggaagattgaaggcttctgcccttggaaaacggtgtggaagatgggaggagaaaaatccctgttaactttctctctccacttcctcagattraaaactccaccccgcccccagggccagagaccagctccggagagcagaggggtgagtcttcttgtccagttgtgtcccttccttgacagatttgccggct

SEQ ID NO: 23631 - DNA, 201 bp, Homo sapiens; identical to SEQ ID NO: 4369

SEQ ID NO: 23632 - DNA, 201 bp, Homo sapiens
tttggtgttggtgcttttccctttggctttttcaccaccgtcttcaatgcccatgagcctttccgccggggtacaggtaagagtcacactcagctcccatsagggagccctgtgaatcccctcaggccccctcccagcctaggagcatatgcttccacagctttcctctctcccacaggtgtggatctgggacagggtcac

SEQ ID NO: 23633 - DNA, 201 bp, Homo sapiens
ggagccctgtgaatcccctcaggccccctcccagcctaggagcatatgcttccacagctttcctctctcccacaggtgtggatctgggacagggtcacccrgcctccagctggcaggattccctcttcctgtttctcgccatcttcttctttttttggctgctcagtatttgagctatgtctgcttcctgcccacctccag

SEQ ID NO: 23634 - DNA, 201 bp, Homo sapiens
tgtgggtgggagtataacggtcgagatctgtggaaagaaaggtcttaggaaccaggagctgaggcacgtgatgtgctgagaagagaaggtggggcggggartggcaggacaatgtgagacccgagccaccttaccccagagaagtgaggggtcttagctgtgcaggtggaaacaagtgagacacaaaggttaagggaggca

SEQ ID NO: 23635 - DNA, 201 bp, Homo sapiens; identical to SEQ ID NO: 4363

SEQ ID NO: 23636 - DNA, 201 bp, Homo sapiens; identical to SEQ ID NO: 4364

SEQ ID NO: 23637 - DNA, 201 bp, Homo sapiens
gatagggacattattgagcttgaaagtgagtaatgggggaatgtgctagtaaaggggtttggtttggagtgatggggttggggttgaaaagaggagacccrgaaagaggtggctgaaggaaattagaaattaacttgaaaggcagaaaagagagggcacgaaaatttgtatgtgtttgttggggagaggagaaaggagagg

SEQ ID NO: 23638 - DNA, 201 bp, Homo sapiens
aaaacagagaccttagaagaattgtttatttgttataaatgtataatgttgctattcttgtaatagtctttctcgtaccctataattgttagaagaaattmttttaagttaatacgttcctacatgcttttctttggtttaaaaaaaaaagaataaaggaaactctgtgtagaaagtgtcctgttctgatctagtcctgac

SEQ ID NO: 23639 - DNA, 201 bp, Homo sapiens
ctgcccattagaggaaaaagggtttaatttacctgagtcctcgagtgaatgtaattgttgaatcagaacactatagacatttagtaacctccttcagaggaaaaaaaaaaaaagtgggggcaatgacagaaattaaaaaaccagtcgagcttccacttttcatttcagaagaaatcaggtgctctcctctaaggaccacta

SEQ ID NO: 23640 - DNA, 201 bp, Homo sapiens; identical to SEQ ID NO: 3709

SEQ ID NO: 23641 - DNA, 201 bp, Homo sapiens
  misc_feature (1)...(201): n = A,T,C or G, or insertion/deletion polymorphism (see Tables 1-2)
cttgggaagaagatgatcctaaacaaagctctgctgctgggggccctcgccctgactgccgtgatgagcccctgtggaggtgaagacattgtgggtgagtncatgagtgaggaatgttctctggagctgaaaaacagtaaattaaaggaaaagaaagagtgcaatttgctaagaaatagtagaaatttcccaagggtcttt

SEQ ID NO: 23642 - DNA, 201 bp, Homo sapiens
cacctggctgagcaatgggcactcagtcacagaaggtgtttctgagaccagcttcctctccaagagtgatcattccttcttcaagatcagttacctcaccytcctcccttctgctgatgagatttatgactgcaaggtggagcactggggcctggacgagcctcttctgaaacactggggtaaggatgagttccaccactt

SEQ ID NO: 23643 - DNA, 201 bp, Homo sapiens
caatgggcactcagtcacagaaggtgtttctgagaccagcttcctctccaagagtgatcattccttcttcaagatcagttacctcaccttcctcccttctkctgatgagatttatgactgcaaggtggagcactggggcctggacgagcctcttctgaaacactggggtaaggatgagttccaccacttcatgggtttcta

SEQ ID NO: 23644 - DNA, 201 bp, Homo sapiens
tggtaaagggctcacacatgtcttaacaaaaatgtccagttcggctcatttggctatacttcatggctgctgctctgcccttgcatcctcggataagctcrctgcccattagaggaaaaagggtttaatttacctgagtcctcgagtgaatgtaattgttgaatcagaacactatagacatttagtaacctccttcagagg

SEQ ID NO: 23645 - DNA, 201 bp, Homo sapiens
gaaggaaggaaagataaaatggtaaagggctcacacatgtcttaacaaaaatgtccagttcggctcatttggctatacttcatggctgctgctctgccctkgcatcctcggataagctcactgcccattagaggaaaaagggtttaatttacctgagtcctcgagtgaatgtaattgttgaatcagaacactatagacatt

SEQ ID NO: 23646 - DNA, 201 bp, Homo sapiens
ggcactcagtcacagaaggtgtttctgagaccagcttcctctccaagagtgatcattccttcttcaagatcagttacctcaccttcctcccttctgctgakgagatttatgactgcaaggtggagcactggggcctggacgagcctcttctgaaacactggggtaaggatgagttccaccacttcatgggtttctaataac

SEQ ID NO: 23647 - DNA, 201 bp, Homo sapiens
  misc_feature (1)...(201): n = A,T,C or G, or insertion/deletion polymorphism (see Tables 1-2)
tgggggccctcgccctgactgccgtgatgagcccctgtggaggtgaagacattgtgggtgagtgcatgagtgaggaatgttctctggagctgaaaaacagnaaattaaaggaaaagaaagagtgcaatttgctaagaaatagtagaaatttcccaagggtcttttcaatattaagaaattttaaaattatggcagttcctc

SEQ ID NO: 23648 - DNA, 201 bp, Homo sapiens
gacccttgcaaagacatgaaaggaaatgtagtttggtttgattggcagatagttgtgaagaatgtcggactgtaaggctgtcgatatcctcctcacagaaytccccaaagtacattgtatttgctcccttaccgacctgattctcccactattcagttcattccttgatgctgttttaagcaacccctgctctgtctgaca

SEQ ID NO: 23649 - DNA, 201 bp, Homo sapiens
ttagtgatttaggagattcaagcgtagacgtaaaagtgagtttcttttcatatgttaactggaggatttttttctttcttgagaggctgagattgggttgmtaagagaactcttaggacaagaagttgtaatatttgacttcggtttttaactctctaaggggtatattccctccttatggcccataaattttaagtcaag

SEQ ID NO: 23650 - DNA, 201 bp, Homo sapiens
  misc_feature (1)...(201): n = A,T,C or G, or insertion/deletion polymorphism (see Tables 1-2)
actgccgtgatgagcccctgtggaggtgaagacattgtgggtgagtgcatgagtgaggaatgttctctggagctgaaaaacagtaaattaaaggaaaaganagagtgcaatttgctaagaaatagtagaaatttcccaagggtcttttcaatattaagaaattttaaaattatggcagttcctcctttaggaaaccagagc

SEQ ID NO: 23651 - DNA, 201 bp, Homo sapiens
caccttcctcccttctgctgatgagatttatgactgcaaggtggagcactggggcctggacgagcctcttctgaaacactggggtaaggatgagttccacyacttcatgggtttctaataacagacttcactcttctccctaagcctggggccttgagtcttgcagagccagccctccaccccatcccatcccacacacat

SEQ ID NO: 23652 - DNA, 201 bp, Homo sapiens
gagggctctaaacagctatgaaatctgccaggatatttctgtccatgctatctgcatcagtgagtttaaaatgtaataggagaaaaaaaagagacaaaacrttaacataataattgatacagcatagttttgtacaaagaaacctaaatccaaatacttgactcagtattttgaagctaatattttaaactttactgggta

SEQ ID NO: 23653 - DNA, 201 bp, Homo sapiens
tcagtcacagaaggtgtttctgagaccagcttcctctccaagagtgatcattccttcttcaagatcagttacctcaccttcctcccttctgctgatgagakttatgactgcaaggtggagcactggggcctggacgagcctcttctgaaacactggggtaaggatgagttccaccacttcatgggtttctaataacagact

SEQ ID NO: 23654 - DNA, 201 bp, Homo sapiens
  misc_feature (1)...(201): n = A,T,C or G, or insertion/deletion polymorphism (see Tables 1-2)
tgatgagcccctgtggaggtgaagacattgtgggtgagtgcatgagtgaggaatgttctctggagctgaaaaacagtaaattaaaggaaaagaaagagtgnaatttgctaagaaatagtagaaatttcccaagggtcttttcaatattaagaaattttaaaattatggcagttcctcctttaggaaaccagagctccaacc

SEQ ID NO: 23655 - DNA, 201 bp, Homo sapiens
gaaggtgagctggaggaggaaaagacaaacttggagagccagacattgagattccattgaggcgttggaggtcacaacgcggtcaaaaacatgttgagagsacttagctgcaaagttgttaactaagtagaaacctcaaggatgaattttaggatttctccaggaaatcctaaaagataacttctttcagggagaaaaaac

SEQ ID NO: 23656 - DNA, 201 bp, Homo sapiens
tgaatgtaattgttgaatcagaacactatagacatttagtaacctccttcagaggaaaaaaaaaaaaagtgggggcaatgacagaaattaaaaaaccagtygagcttccacttttcatttcagaagaaatcaggtgctctcctctaaggaccactactattaacaaaacagagaccttagaagaattgtttatttgttata

SEQ ID NO: 23657 - DNA, 201 bp, Homo sapiens
agatcagttacctcaccttcctcccttctgctgatgagatttatgactgcaaggtggagcactggggcctggacgagcctcttctgaaacactggggtaargatgagttccaccacttcatgggtttctaataacagacttcactcttctccctaagcctggggccttgagtcttgcagagccagccctccaccccatccc

SEQ ID NO: 23658 - DNA, 201 bp, Homo sapiens
tgacctcaacagctccactttcacagagcctgagattccagcccctatgtcagagctcacagagactttggtctgcgccctggggttgtctgtgggcctcrtgggcattgtggtgggcactgtcttcatcatccaaggcctgcgttcagttggtgcttccagacaccaagggctcttatgaatctcatcctgaaaggaagg

SEQ ID NO: 23659 - DNA, 201 bp, Homo sapiens
ccttgcatcctcggataagctcactgcccattagaggaaaaagggtttaatttacctgagtcctcgagtgaatgtaattgttgaatcagaacactatagayatttagtaacctccttcagaggaaaaaaaaaaaaagtgggggcaatgacagaaattaaaaaaccagtcgagcttccacttttcatttcagaagaaatcag

SEQ ID NO: 23660 - DNA, 201 bp, Homo sapiens
caaggctgcagtgagctaggactgactgcaccactgcactcgctccagcctgggcaacacagcgagaccccgtctctaaaaataaataaataaatgaatgaatgaataaataaaaattacaaaacgtaaaaatcacgtaaaatatttcaggtttgtacttaccacatacaaactagagatatgaagaattaaacattacaa

SEQ ID NO: 23661 - DNA, 201 bp, Homo sapiens
aatcctaatgtacatattgtgaacgttctttgaatagatcttttcatttatttatttttagagacggggtcttgctactgagacagccaggtgggaagggrtccccagataaattccagccagcctgagcactgggaggagtgcaaactgggatggagccacagaagtttgcaccatttgcggcagggaggagagtgaccc

SEQ ID NO: 23662 - DNA, 201 bp, Homo sapiens
aggctgcagtgagctaggactgactgcaccactgcactcgctccagcctgggcaacacagcgagaccccgtctctaaaaataaataaataaatgaatgaatgaataaataaaaattacaaaacgtaaaaatcacgtaaaatatttcaggtttgtacttaccacatacaaactagagatatgaagaattaaacattacaaat

SEQ ID NO: 23663 - DNA, 201 bp, Homo sapiens
ggctgcagtgagctaggactgactgcaccactgcactcgctccagcctgggcaacacagcgagaccccgtctctaaaaataaataaataaatgaatgaatgaataaataaaaattacaaaacgtaaaaatcacgtaaaatatttcaggtttgtacttaccacatacaaactagagatatgaagaattaaacattacaaata

SEQ ID NO: 23664 - DNA, 201 bp, Homo sapiens; identical to SEQ ID NO: 4398

SEQ ID NO: 23665 - DNA, 201 bp, Homo sapiens
gaggcccctcagacccatcgatctcatgtctgtcctgttgcaggtgcatcaccatctacaggagaagaagaatggacttgctaaatgacctagcactattytctggcctgatttatcatatcccttttctcctccaaatgtttcttctctcacctcttctctgggacttaaggtgctatattccctcagagctcacaaatg

SEQ ID NO: 23666 - DNA, 201 bp, Homo sapiens
gagctcacagagactttggtctgcgccctggggttgtctgtgggcctcatgggcattgtggtgggcactgtcttcatcatccaaggcctgcgttcagttgrtgcttccagacaccaagggctcttatgaatctcatcctgaaaggaaggtaagattgagatttgttggagctgaaacctcagtatgagagggaggaaagtg

SEQ ID NO: 23667 - DNA, 201 bp, Homo sapiens
gccaaaacctgacctggcagggtttggtttgggtgtcttcagatttgcttgtctcgaggtcctcacaattgctctacagctcagagcagcaactgctgagsctgccttgggaagaagatgatcctaaacaaagctctgctgctgggggccctcgccctgactgccgtgatgagcccctgtggaggtgaagacattgtgggt

SEQ ID NO: 23668 - DNA, 201 bp, Homo sapiens
tgggcctcatgggcattgtggtgggcactgtcttcatcatccaaggcctgcgttcagttggtgcttccagacaccaagggctcttatgaatctcatcctgaaaggaaggtaagattgagatttgttggagctgaaacctcagtatgagagggaggaaagtgggagggggttgtggacatgaatgtggttgaaagttgtagg

SEQ ID NO: 23669 - DNA, 201 bp, Homo sapiens
gaaggccctgctgagcaggacactggcccagcagaggctgaaactataaaaatgacttggttccagctgggccagtagagtgatgtcctccagcaacactragcacccaggacaagtaccagatgaaaagaaggattgcatgtattccacatatattcatgtttgaacaaggagtcaaagtttattgtaaggataaggagt

SEQ ID NO: 23670 - DNA, 201 bp, Homo sapiens
aaagtttattgtaaggataaggagtctttgttggtggcctgttaagtaaccaaccagggcagtcatgctgggtagggaagaaggtgagctggaggaggaakagacaaacttggagagccagacattgagattccattgaggcgttggaggtcacaacgcggtcaaaaacatgttgagaggacttagctgcaaagttgttaa

SEQ ID NO: 23671 - DNA, 201 bp, Homo sapiens
tagaaacctcaaggatgaattttaggatttctccaggaaatcctaaaagataacttctttcagggagaaaaaacagacccttgcaaagacatgaaaggaartgtagtttggtttgattggcagatagttgtgaagaatgtcggactgtaaggctgtcgatatcctcctcacagaactccccaaagtacattgtatttgctc

SEQ ID NO: 23672 - DNA, 201 bp, Homo sapiens
gctattcttgtaatagtctttctcgtaccctataattgttagaagaaattcttttaagttaatacgttcctacatgcttttctttggtttaaaaaaaaaaraataaaggaaactctgtgtagaaagtgtcctgttctgatctagtcctgacaggaaacgaagtataatcaacttgttattaactgagagagaaaacttagg

SEQ ID NO: 23673 - DNA, 201 bp, Homo sapiens
attcttgtaatagtctttctcgtaccctataattgttagaagaaattcttttaagttaatacgttcctacatgcttttctttggtttaaaaaaaaaagaataaaggaaactctgtgtagaaagtgtcctgttctgatctagtcctgacaggaaacgaagtataatcaacttgttattaactgagagagaaaacttaggaag

SEQ ID NO: 23674 - DNA, 201 bp, Homo sapiens
ctccaagagtgatcattccttcttcaagatcagttacctcaccttcctcccttctgctgatgagatttatgactgcaaggtggagcactggggcctggacsagcctcttctgaaacactggggtaaggatgagttccaccacttcatgggtttctaataacagacttcactcttctccctaagcctggggccttgagtctt

SEQ ID NO: 23675 - DNA, 201 bp, Homo sapiens
ccttcactcgtcagctgaccatgttgcctcctatggtgtgaacttctaccagtctcacggtccctctggccagtacacccatgaatttgatggagacgagsagttctacgtggacctggagacgaaagagactgtctggcagttgcctatgtttagcaaatttataagttttgacccgcagagtgcactgagaaatatggc

SEQ ID NO: 23676 - DNA, 201 bp, Homo sapiens
acaggagcaaccaagtacagtgtatcctgataatttgttgatttcttaactggtgttaatatttctttcttccttttgttcctacccttggccactgccasccacccctcaattcaggtaccaacgaaccctctgcccttggctcagaatggttatagcagaaatacaaaaaaaaaaaaaaaagtctgtactaatttcaat

SEQ ID NO: 23677 - DNA, 201 bp, Homo sapiens
agagctattcacacttcacatcagtgctgtttcctcaccacagaggttcctgaggtcacagtgttttccaagtttcctgtgacgctgggtcagcccaacaycctcatctgtcttgtggacaacatctttcctcctgtggtcaacatcacctggctgagcaatgggcactcagtcacagaaggtgtttctgagaccagcttc

SEQ ID NO: 23678 - DNA, 201 bp, Homo sapiens; identical to SEQ ID NO: 4431

SEQ ID NO: 23679 - DNA, 201 bp, Homo sapiens
ttcacacttcacatcagtgctgtttcctcaccacagaggttcctgaggtcacagtgttttccaagtttcctgtgacgctgggtcagcccaacaccctcatytgtcttgtggacaacatctttcctcctgtggtcaacatcacctggctgagcaatgggcactcagtcacagaaggtgtttctgagaccagcttcctctcca

SEQ ID NO: 23680 - DNA, 201 bp, Homo sapiens; identical to SEQ ID NO: 4433

SEQ ID NO: 23681 - DNA, 201 bp, Homo sapiens; identical to SEQ ID NO: 4434

SEQ ID NO: 23682 - DNA, 201 bp, Homo sapiens; identical to SEQ ID NO: 3710

SEQ ID NO: 23683 - DNA, 201 bp, Homo sapiens
gtcaccttcactcgtcagctgaccatgttgcctcctatggtgtgaacttctaccagtctcacggtccctctggccagtacacccatgaatttgatggagaygaggagttctacgtggacctggagacgaaagagactgtctggcagttgcctatgtttagcaaatttataagttttgacccgcagagtgcactgagaaata

SEQ ID NO: 23684 - DNA, 201 bp, Homo sapiens; identical to SEQ ID NO: 4438

SEQ ID NO: 23685 - DNA, 201 bp, Homo sapiens
ctgctcctcccccttcctggctaaggaaagcatgagcctatgagagagaaatcctaggaagaacaagacagttgagacaatgtagcagcagtagtgggtgytgtgtcctacactggattcgtggtctcctaatagaaaatctctcagaggaaatgggtccacagagacctgagggctctaaacagctatgaaatctgccag

SEQ ID NO: 23686 - DNA, 201 bp, Homo sapiens
gttgtctgtgggcctcatgggcattgtggtgggcactgtcttcatcatccaaggcctgcgttcagttggtgcttccagacaccaagggctcttatgaatcycatcctgaaaggaaggtaagattgagatttgttggagctgaaacctcagtatgagagggaggaaagtgggagggggttgtggacatgaatgtggttgaaa

SEQ ID NO: 23687 - DNA, 201 bp, Homo sapiens
cacaggaggcccctcagacccatcgatctcatgtctgtcctgttgcaggtgcatcaccatctacaggagaagaagaatggacttgctaaatgacctagcaytattctctggcctgatttatcatatcccttttctcctccaaatgtttcttctctcacctcttctctgggacttaaggtgctatattccctcagagctcac

SEQ ID NO: 23688 - DNA, 201 bp, Homo sapiens
tgagatttatgactgcaaggtggagcactggggcctggacgagcctcttctgaaacactggggtaaggatgagttccaccacttcatgggtttctaataayagacttcactcttctccctaagcctggggccttgagtcttgcagagccagccctccaccccatcccatcccacacacatgcacatgagcacactgcacat

SEQ ID NO: 23689 - DNA, 201 bp, Homo sapiens
tttgtggagcatatgttatagtgagaaagacagaatcagttctaacctgatgactaccaacgttaggcaaggaggaagcaggtgttaggaagattgttcarggactgtgccaaagatgaagcccataatatttgaaagtgagtttcttcaatcactttctgtattaaggttctttctccctgtgttccaccctcctgcttg

SEQ ID NO: 23690 - DNA, 201 bp, Homo sapiens
tctcctctaaggaccactactattaacaaaacagagaccttagaagaattgtttatttgttataaatgtataatgttgctattcttgtaatagtctttctygtaccctataattgttagaagaaattcttttaagttaatacgttcctacatgcttttctttggtttaaaaaaaaaagaataaaggaaactctgtgtagaa

SEQ ID NO: 23691 - DNA, 201 bp, Homo sapiens
  misc_feature (1)...(201): n = A,T,C or G, or insertion/deletion polymorphism (see Tables 1-2)
agttttgacccgcagagtgcactgagaaatatggctgtgggaaaacacaccttggaattcatgatgagacagtccaactctaccgctgccaccaatggtangtgtccaccattccgcctctctttactgaaactaatctttcataccaagttttactcccttcttctcaagagatttccagatcttctcatggtaattgct

SEQ ID NO: 23692 - DNA, 201 bp, Homo sapiens
ctaccgctgccaccaatggtatgtgtccaccattccgcctctctttactgaaactaatctttcataccaagttttactcccttcttctcaagagatttccygatcttctcatggtaattgctgaaattttatcatctcccatctctaaaatcacatattcccatgtaatacaagggtctttccattatgtattaattccta

SEQ ID NO: 23693 - DNA, 201 bp, Homo sapiens
agagagaagggcacaggaataaagcagaggcaatgtgtcgttgctcccaagcagaaggtaaataagacctctttgactatcaggtggtgaaatgctggtargagggctcttccaggatgtaatgcagaagctcatggcagagctattcacacttcacatcagtgctgtttcctcaccacagaggttcctgaggtcacagtg

SEQ ID NO: 23694 - DNA, 201 bp, Homo sapiens
cgtcagctgaccatgttgcctcctatggtgtgaacttctaccagtctcacggtccctctggccagtacacccatgaatttgatggagacgaggagttctaygtggacctggagacgaaagagactgtctggcagttgcctatgtttagcaaatttataagttttgacccgcagagtgcactgagaaatatggctgtgggaa

SEQ ID NO: 23695 - DNA, 201 bp, Homo sapiens
gtgtgtgtgtgtgtgtgtgtgtgtgtgtgtgtgtgataatagccaccctgattggtttgaagtggtatctcattgtggtttggatttgcattttcctaatragtactgatattgagcatcttttcatgtgtttattgatcatttgtatattttctttgaagaattggccattgaagtcttgcccatttttctcccccacat

SEQ ID NO: 23696 - DNA, 201 bp, Homo sapiens
tggctgccacaaataagtgagaacatgcgaagtttgtctctctgggcctggggcttatttcacttcacatgatgacctccagttctttgcaaatgacatgrtggctgaatagtactccacatacacgtgtgcaccacattttctttctccattcgtctgttgatggacacttaggtcgcttgcagatcttggctattttga

SEQ ID NO: 23697 - DNA, 201 bp, Homo sapiens
tgttggtgacaaggcttccgtaacaggggatgaaagttggggaatttgggaagggaatgggggcagcatctccatctacacccataagtgctgcccaagcragggtcaaacgcccagctgtggcatcctcctgctgcaggtgaggagtgggcagcagggagggctgcggcgcctgctctgtccccatcccggtctctgtgt

SEQ ID NO: 23698 - DNA, 201 bp, Homo sapiens
ataagttgctgcatttggctcctcctacaaccaagaaagaggcacaatgcctagtgggccgatttggattttggaggcaacacattcctcatttgggtatrttactccggcccatttatcaagtgacctgaaaggctgccagttttgggtagggtacagaacaggagaaggctctgcaacatgtccaggctgctgtgcaag

SEQ ID NO: 23699 - DNA, 201 bp, Homo sapiens
caaagggtaatgatcaaagagaaaaaaaggtatgaactgatgaactgatacctttaagtagatgagaaggatgatgtttgggacaccagtagagggactgsctctggctgggagcgggaaggttaacccacaacaaccatccatgtggtagaagacccagcatgcagtgcagctgcaaatgcatgagcagatggaatctgt

SEQ ID NO: 23700 - DNA, 201 bp, Homo sapiens
tggttatccattcctcagacaatggacacttgggttacttctaccttttggatattggcaaatatttcatttctcttgggtatatatttatttcttttgartatttcttttgggtatatatccagaaatagaattgttggatcatacggtatttcattttttaatttttagaggaatcaccatagtgttttccattgcagg

SEQ ID NO: 23701 - DNA, 201 bp, Homo sapiens
ctcttctctcaattattgaatcgaagaagccaatggcaagtatggtctgagagcaaacgtagcaatagatttcaggcggcaacagctggagcatcatcagytgtgcttcctctagctgaggggctgggatgtgcattctcaagactgccacaacaatccagtggggagaaaggacaaagggtaatgatcaaagagaaaaaa

SEQ ID NO: 23702 - DNA, 201 bp, Homo sapiens
tcagaccacatgatgtgcaaacaaggataatttgacttcttcttttccaattttgatgccctttatttccttctcctgtcagattgctctagctaggactkgcagtattgtgttgcataactgtagtgaaagtagtcatccttgtcttgttccagatcttaaagaaaaggctttcagttttcccccattcagtatgttact

SEQ ID NO: 23703 - DNA, 201 bp, Homo sapiens
caggaattgctgattaggtaatttagaccattccttccactgagtacaatgggaaaaggaggaaaacatacatatttgaaaaatctggttgagcaaatggwtgggctaacaaagcagtgaagatttgcctggccaggaaccaggagaggggagaaatccagaagagcaacttgagctgtggggctgcttttgtggatcaga

SEQ ID NO: 23704 - DNA, 201 bp, Homo sapiens
cacatccaatgtcatttgtgagattgctttgattcgctcatgtagaatgttactctgctgctttgcagagaggcttgccacacatttcaaatctctgctcytcatttcacaccatctggctcatgaggtgaaggtgatgagaagtgtcttcagacaatactccgaggtttgtctatcagagtcatagtcatatattacata

SEQ ID NO: 23705 - DNA, 201 bp, Homo sapiens
ggaagtgaagcccaggacccaggagaggaggaggaggagataacacaggaccctgtgatcactctcctggccatctgtgtacagtgagacgcttcccttcrgggttgggagcacccagtgtcatggtcctgagtgttgctaccctgctgttctcatctgtgaatgcagccagaccactttcttcctctgatataaataact

SEQ ID NO: 23706 - DNA, 201 bp, Homo sapiens
ctcataaacatcccttgtgagaaggatcagatcaacatataaaaatatgccaaataaagtgaaactcaaggcaggagtgggactggccattctcagcccgygacctccatggacttggagaaaggctcagcctggagatgtgtgaggcctccgacctggagcagcacccgcccctaaagaccaggcacaaatcccagcaca

SEQ ID NO: 23707 - DNA, 201 bp, Homo sapiens
gctagtcaagtgaaacagtgggagtgaagatgaaacaaaaacatctataactggttgtgatcaattagttgtaaacaccactgcactcagaccagcctaaytgggaagattttgaggatatgctgtggtctgatgggttccaaggcagaggtgacagtaacctggaagagggagactgcttaggcagtggcatcctggtgg

SEQ ID NO: 23708 - DNA, 201 bp, Homo sapiens; identical to SEQ ID NO: 1923

SEQ ID NO: 23709 - DNA, 201 bp, Homo sapiens
tgagaagccccacgtgcagaggctgtcccgggactttaggggagaacaaaaacaaagcacccaggatcctggtgtcagggacagagcatggccacggcggratggtagtggctctcctatgaaataatgctcataaacatcccttgtgagaaggatcagatcaacatataaaaatatgccaaataaagtgaaactcaaggc

SEQ ID NO: 23710 - DNA, 201 bp, Homo sapiens
agggagactgcttaggcagtggcatcctggtgggatagggtgaggagatcccagagcccacgtttactgcaaccctggggaaatgtcaccagagaaatggrggtggtgccagacaatagattgtgggagctatggtttccatggtagagtagaagcatccaccatgtgtgacattcagcagatggggcgctgtgggtggct

SEQ ID NO: 23711 - DNA, 201 bp, Homo sapiens
tcctcacttgggtggaaaggtgatgggttcgggaatggagaagtcactgctgggtgggggcaggcttgcattccctccaggagattagggtctgtgagatscatgaagacagcagcaccaggggctcccggcatttctactacaatggggagctcttcctctcccaaaacctggagactcaagaatcgacagtgccccagt

SEQ ID NO: 23712 - DNA, 201 bp, Homo sapiens
attcatggtgttaattcgatttgtttcatagagacagggtcttgctatgttgcccaggctggtcttccactcctggcctcaagcaatccccctgacttggmcttccaaagtgctagcattacaggtgtgagccattgtgcccagcccttaacttgaaaatctgacagtataataaaagaaaaaaatagaagtattctggaa

SEQ ID NO: 23713 - DNA, 201 bp, Homo sapiens
actgcaaccctggggaaatgtcaccagagaaatgggggtggtgccagacaatagattgtgggagctatggtttccatggtagagtagaagcatccaccatstgtgacattcagcagatggggcgctgtgggtggcttggagcactctggttgtaactgaggcaggcacagtgtttaggaagcctgtgcagtaatccagact

SEQ ID NO: 23714 - DNA, 201 bp, Homo sapiens
gggtggcttggagcactctggttgtaactgaggcaggcacagtgtttaggaagcctgtgcagtaatccagactgaagggaggggaaagcctagactaagaytatggctgtgggattgaaatagcgttgaaggagctgactttgactcccggagatgaaggggaaagaggaaatcagaagggaccaaggatggtgaagttct

SEQ ID NO: 23715 - DNA, 201 bp, Homo sapiens
tttttcagggaaagtgctggtgcttcagagtcattggcagacattccatgtttctgctgttgctgctggctgctgctatttttgttattattattttctaygtccgttgttgtaagaagaaaacatcagctgcagagggtccaggtgagaaaagcgggcagtttctggagatggtaaggcccctgtctgggcagtagggtc

SEQ ID NO: 23716 - DNA, 201 bp, Homo sapiens
gtggcttggagcactctggttgtaactgaggcaggcacagtgtttaggaagcctgtgcagtaatccagactgaagggaggggaaagcctagactaagactrtggctgtgggattgaaatagcgttgaaggagctgactttgactcccggagatgaaggggaaagaggaaatcagaagggaccaaggatggtgaagttctta

SEQ ID NO: 23717 - DNA, 201 bp, Homo sapiens
ttgtatttttagtagagatagggtttcaccatgttagccaggatggtctcaatctcctgacctggtgatacacccgcctcggcctcccaaagtgctggaaytacaggcttgagccaccacgcctggccttctggaaactaatctcttatcagatatatgacttgcaatatttatttcatttcaggggttgattgctttctc

SEQ ID NO: 23718 - DNA, 201 bp, Homo sapiens
actggcaatggaatctttcagttagttgttaattaactggaaacatctcaatttctccttcatttattttaatttattaattgtgataaaatgcacataasataaaatttaccatcttaaccatttgtagtggtagtgttcagtagtgctaagaacactcacactgttttgcaaaccaatctccagaactcctttcatatt

SEQ ID NO: 23719 - DNA, 201 bp, Homo sapiens
attcctaggtattttattttatttgtagctaatgaaaatgggattcgtttcttgatttctttttcagattatttgctgttagcacatagaaatgctattgwtttttgcatgttgattttgtatcctgcaactttactgaatttgttcttcagttctaatagttttttggtggagtctttaggttttccaaatatcagacca

SEQ ID NO: 23720 - DNA, 201 bp, Homo sapiens
cctcaacttgcttttctcatacctgatgcagtggtctcaggactagggatgcaaataaaagtccaggcacaggaattattcctgagcaagaaaccgttaayatatttaaaaaccattatgcaagactgcctaagggcctggagtagatgtgccttcactgcatctggcaaagttggagctaacattgaatgcagctgtatt

SEQ ID NO: 23721 - DNA, 201 bp, Homo sapiens
tatcctagacccagtgcaggttaagagaagttcagtaagggtgagccctggagcctcagtgggcctttaaaggagggacaatcctgtctttgtttctcctsttctctcaattattgaatcgaagaagccaatggcaagtatggtctgagagcaaacgtagcaatagatttcaggcggcaacagctggagcatcatcagttg

SEQ ID NO: 23722 - DNA, 201 bp, Homo sapiens
ttacctcaacttgcttttctcatacctgatgcagtggtctcaggactagggatgcaaataaaagtccaggcacaggaattattcctgagcaagaaaccgtwaacatatttaaaaaccattatgcaagactgcctaagggcctggagtagatgtgccttcactgcatctggcaaagttggagctaacattgaatgcagctgt

SEQ ID NO: 23723 - DNA, 201 bp, Homo sapiens
gattacatgcatgcaccaccaaacctggcaaatttttgtctttgtagtagaggcgggttttcaccatgttagctaggccggtctcaaactcctgacctcaygtgatctgcccaccttggcctcccaaagtgctgggattacaggcgtgagccactgtgcccaaccagactgcaatgcaagtttaaaccccagtgaaggaga

SEQ ID NO: 23724 - DNA, 201 bp, Homo sapiens; identical to SEQ ID NO: 12726

SEQ ID NO: 23725 - DNA, 201 bp, Homo sapiens
caaggcaggggaattacaatagagaaagagtaattcatgcagagccggccgtgcgggagaccagagttttattactcaaatcagtctccccgaaaactctratcagtttttaaggataatttggtggatagggggggccagtgaatcaggagtgctgattggttggctccggtatgaaatcatagtgagtggaggctgttc

SEQ ID NO: 23726 - DNA, 201 bp, Homo sapiens
ctgatgttgatggagtgatgggagagaactgacaggggctgggaaaagcaaggagggaggaagaaaaaagtgggggcctcatcttctctcagagaaagggygaatctgattttggggcaactgaagagagaaaagtccttagggaataaacacaacactgcacccagtggagcatttacccgtttccctcttctccagagc

SEQ ID NO: 23727 - DNA, 201 bp, Homo sapiens; identical to SEQ ID NO: 12730

SEQ ID NO: 23728 - DNA, 201 bp, Homo sapiens
agaatttatttatgacatgacaataacacatgtattcatggtgttaattcgatttgtttcatagagacagggtcttgctatgttgcccaggctggtcttcmactcctggcctcaagcaatccccctgacttggacttccaaagtgctagcattacaggtgtgagccattgtgcccagcccttaacttgaaaatctgacagt

SEQ ID NO: 23729 - DNA, 201 bp, Homo sapiens
gaccctgactgtcccacagaagaagtgacaagaatttatttatgacatgacaataacacatgtattcatggtgttaattcgatttgtttcatagagacagsgtcttgctatgttgcccaggctggtcttccactcctggcctcaagcaatccccctgacttggacttccaaagtgctagcattacaggtgtgagccattgt

SEQ ID NO: 23730 - DNA, 201 bp, Homo sapiens
gttgtttgatgggggatgaaaagagacagcaggaagttttgtgtttctgcaaagacagaagcagttcaggcgacagtaagaggctggggtgtccaggaggrtgtgtctggcagtagggtcgctggtttctcatccttgaacctaattgcactgtcaatcggcccctcaggcctgagcagatgggaaggtttgtcccctgcc

SEQ ID NO: 23731 - DNA, 201 bp, Homo sapiens
actccatggtctagtccaacgagactggtcagggcttgccgcctgctcctcggtgctgtcctggtactttgaaagtatctgtgattctgtgaactgcaccsccagctgcccaacaacttccctttgctgatctgagccagactctgcttttatggcttacacccaaataattcaagttattttaaaaaaataataataaat

SEQ ID NO: 23732 - DNA, 201 bp, Homo sapiens
agaagcagttcaggcgacagtaagaggctggggtgtccaggaggatgtgtctggcagtagggtcgctggtttctcatccttgaacctaattgcactgtcartcggcccctcaggcctgagcagatgggaaggtttgtcccctgccctgcagcaagagggccctgtccaggaggcacccacaacaggggcagtgcaggtctg

SEQ ID NO: 23733 - DNA, 201 bp, Homo sapiens
gatattgactctatccctgaaattaaatcacaagaaaataagaaatgcatgagatctaaactaagccatttgggtaaactgtctcagaatttaaagcatcwgcagtcacaagctatcagtatcagtgacgattctttcactccatggtctagtccaacgagactggtcagggcttgccgcctgctcctcggtgctgtcctg

SEQ ID NO: 23734 - DNA, 201 bp, Homo sapiens
tgaaaaagtcttccccttccacctagtttaacaagataaacaggaaaggaacttcccttaagggaagatattgactctatccctgaaattaaatcacaagraaataagaaatgcatgagatctaaactaagccatttgggtaaactgtctcagaatttaaagcatcagcagtcacaagctatcagtatcagtgacgattct

SEQ ID NO: 23735 - DNA, 201 bp, Homo sapiens
tatgtatctgttggccatttatattcttcttctgaaaaatatttattcatgccctttgcccactttttaataagattgtttggttttttaattcttgagtwgtttgagtttcttatagtattctggatattagtcccttgtcagataaattgtttgaaaatgttttctcctgttcagcagattgtctcttcactctgtcaa

SEQ ID NO: 23736 - DNA, 201 bp, Homo sapiens
gggagataccattcaagttgagattcgaatggggacacagccaaaccgtatcactggatgagagcaattagattgatgtcatgatgtatatgggtccatgrgaacttgaaaaagtcttccccttccacctagtttaacaagataaacaggaaaggaacttcccttaagggaagatattgactctatccctgaaattaaatc

SEQ ID NO: 23737 - DNA, 201 bp, Homo sapiens
gattcctgtagtgtagggaagggaaatgcctagcccagctctctgattccccttttaatgggtttgagctgcaatatgggtgcagaagagcctcccacagygccactggtggtggaggaaatagcccctctcattggcccattttcacgctgctgataaagacatactgggaagaaaaagaggtttaattggacttacaat

SEQ ID NO: 23738 - DNA, 201 bp, Homo sapiens
agggttctgatgcagggaaggagctgtgtgctctgtgtgggaggatgccttctgcctttctagctgggcctcaggtcagggctttgagcctgagcagggaraggagatggaagggagatggccttggagcaaacgtctgcccctgccagtgcatcccgtaggtatcatcccatccaccagtgccttggcaggaccccactc

SEQ ID NO: 23739 - DNA, 201 bp, Homo sapiens
ccatgtgccagagagggtggcgcatcccaaccccatgggacagaagctcctgcactggaaacccttctcaccttgccctatgtgtctgttcatggggctcwttgtgtcttttaaaatatctttttaaataaactggtaaatatatgtaagtgttttcctgagttctgtgagccattctagcaaattaatcaaacctgagaa

SEQ ID NO: 23740 - DNA, 201 bp, Homo sapiens
acatagactttcactcaccaaggctgacctggctatggccacttctgagtgcccaatttgccagcagcagagaccaacactgagctctcaatatgacaccwttccttgggcgatcagccagctacctggtgacaggttgattattggacctcttccattatggaaagggcagaagtttgtcttcactggaatagacactta

SEQ ID NO: 23741 - DNA, 201 bp, Homo sapiens
ggttgtggtgagctgagattgcaccattgcactccagcctgggcaacaggagcaaaactccatctcagaaaataaaaataaacattgattcttccagtccrtgaacatggaatgccttttccattttttgtgtcctcttcaatgttttgcatcagtgctttatagtttttattggagagatctttcacttcttcagttaag

SEQ ID NO: 23742 - DNA, 201 bp, Homo sapiens
gaaaatacagttcattttcagatactcaatgggattgaaaagttgaattgtgtgctttcttgcagtgagcacagaggaatttgctgtcccatgccactggracatttttaggagcaccattctcttccagagggcttgagtaaggtcagtgaggaattaacatgtagcatattggcaactccagggttgagcagggagaca

SEQ ID NO: 23743 - DNA, 201 bp, Homo sapiens; identical to SEQ ID NO: 1921

SEQ ID NO: 23744 - DNA, 201 bp, Homo sapiens
actttacctcaacttgcttttctcatacctgatgcagtggtctcaggactagggatgcaaataaaagtccaggcacaggaattattcctgagcaagaaacygttaacatatttaaaaaccattatgcaagactgcctaagggcctggagtagatgtgccttcactgcatctggcaaagttggagctaacattgaatgcagc

SEQ ID NO: 23745 - DNA, 201 bp, Homo sapiens
ccccacatcctccagctctctaatggtggtgctacccccacagcacttgcagtgccttccacaagattcaccctgggacatacgatcatttttgatttggscagaatggaggcagtttcagaggtttccctttggccttcagcacaatgagagcccttactccacagactagggatgcagtgtgggggtgactccagctgc

SEQ ID NO: 23746 - DNA, 201 bp, Homo sapiens
tctccagtgccccccatggtgaatgtcacccgcagcgaggcctcagagggcaacatcaccgtgacatgcagggcttccagcttctatccccggaatatcayactgacctggcgtcaggatggggtatctttgagccacgacacccagcagtggggggatgtcctgcctgatgggaatggaacctaccagacctgggtggcc

SEQ ID NO: 23747 - DNA, 201 bp, Homo sapiens
ttttgcatctatgtttattagggatattggtgtgtagtttacttttttggttatgtcttttcctgcttttggcttcatagaatgatttagggaggatgccstctttaccttttgaaatagtttcagtaagattgagaccaattcttctttgaatgtctgatggaattcagctgtgaattcatctggtcctggacttttttt

SEQ ID NO: 23748 - DNA, 201 bp, Homo sapiens
tattctctgcttcccctccacagagctgtggttcactctcctccatcctgccccctgcactgggggcaccacagagacagcacggcctgtgctcctgcacmacctgcttctgcttgggtgtggatgataacaggcacctgcaggagatgggagcgtggggggagaagtaactcagggttttcacttccctcactccctttg

SEQ ID NO: 23749 - DNA, 201 bp, Homo sapiens
gactctgcttttatggcttacacccaaataattcaagttattttaaaaaaataataataaatcaagttattcatttatgagttatacagtcccatgtgggkaaagggaaggagagtgaggtaatactcaattttactacctgctatgcatttataagtgagatacttctttttaaagtcatatttttggattagaacaaac

SEQ ID NO: 23750 - DNA, 201 bp, Homo sapiens
tgatgaggcacatgaggaatggggagagtggcaggatctcctattgccagaaaatcgtacttgtacccactgcattcccagccctggtgtatgcatctctrggaaatcagaatgaatttggctattatggtgtcagaaagagccctgaagagcctcgtgtgcctgtcaatgtaatgaaagtgcaggtgacagcccctcctg

SEQ ID NO: 23751 - DNA, 201 bp, Homo sapiens
acttgatggtgccaccgagggttctgatgcagggaaggagctgtgtgctctgtgtgggaggatgccttctgcctttctagctgggcctcaggtcagggctwtgagcctgagcagggagaggagatggaagggagatggccttggagcaaacgtctgcccctgccagtgcatcccgtaggtatcatcccatccaccagtgcc

SEQ ID NO: 23752 - DNA, 201 bp, Homo sapiens
caggaatgtcctgatgtcagcggagatgaaggaaaaccagagattcaaaagtcaaaggaaagggccatttaccataattcatatcatacatatttcctggaaaaaaaagaaaaattccttggggaaaaagcatcaaaatcatcaggaagtcttccacacagaaatgacttcattaatttgatctctgtcattctttctttt

SEQ ID NO: 23753 - DNA, 201 bp, Homo sapiens
atgtctcttcatgtccattacccatttttgaatggcgttgtttttttaatggatgagttgtagttttttatgtattttgaatattaattcttcatcagatrtatgattggcaaatagctcctcccattctgtgcattttctttccactcttttaataatgtcacttgttgcaaaaaagtttttaaatctgataaagtctaa

SEQ ID NO: 23754 - DNA, 201 bp, Homo sapiens
tctagaggagcagaactaataggatgtatgtacatatgtaagggagtttattaaggagaattgactcacacgatcacaaggtgaagtcccacgacagaccrtctgcaagttgaggtgcaagaaagccagtgatggatcagtccaagtcccaaaacctcaaaagtagggaagctgacagtgcagccttcagtctgtggccaa

SEQ ID NO: 23755 - DNA, 201 bp, Homo sapiens
agcagtgacaagaggctggtgtgagtggagacaagtgagctgggctgagaggagtgggatgagcccagagttgacagaggggccctgtgttgaggggcttstaggaaatggtgagacattggggtttcattgcactaagaggggaagaagctagagtggctttgggatgtggtggtgatgatgtgctctaattcccgtttg

SEQ ID NO: 23756 - DNA, 201 bp, Homo sapiens
gaagaataagtgagaaaagacacagtgccaagagaaacagacacaagacctgtggcgggctggacaccagggctctaaagcaagttctgcctaaactggcragaacatttttcaggtcaggaacaggagttgttctggattctgtctggggtcaggctgggagggagctgggggtggcagagtaggatgggggcaagggct

SEQ ID NO: 23757 - DNA, 201 bp, Homo sapiens
ggggagcaggtacatgtgggagtcagagcatgggtaggtggcagaaatagggcagagcagtgacaagaggctggtgtgagtggagacaagtgagctgggckgagaggagtgggatgagcccagagttgacagaggggccctgtgttgaggggcttgtaggaaatggtgagacattggggtttcattgcactaagaggggaa

SEQ ID NO: 23758 - DNA, 201 bp, Homo sapiens
caaaggggaaatcagcactgaagcaaagtcaggaaaagctttcaagtcagatgggcctggacctgggcatgaaccctccaggtcctcccaccagccagctraagaggcctgagcacatctgacccagagctggccccgacagacacttgcccagtgagtgagtgctgaatgaaaccatctgagccagtttcctcatctgca

SEQ ID NO: 23759 - DNA, 201 bp, Homo sapiens
catcacagggatctgttcctgtttagactccaatgctcagtacccagtgcagaacatggcaagacttcagcaaatacatcagtcagctggatgaaggaggmaggtgtgagccagcaaaaaaaagcttgtgattttattggagcatgaatttaaaagtgttgatgtggctgggcgcggtggctcatgcctgtaatcccagca

SEQ ID NO: 23760 - DNA, 201 bp, Homo sapiens
agagacctgaatcgtgtgaggagtgagtcatgtgaatccctggggagcaggtacatgtgggagtcagagcatgggtaggtggcagaaatagggcagagcastgacaagaggctggtgtgagtggagacaagtgagctgggctgagaggagtgggatgagcccagagttgacagaggggccctgtgttgaggggcttgtagg

SEQ ID NO: 23761 - DNA, 201 bp, Homo sapiens
ttgtctgtatataatcatattttcttgatctattcatctgttggtaaacatataggttgcttccatatcttgcctgttgtgaataacaccattatgaatayggatatgcaatctttcttttcacttttgtatcccccctcattttggtgcaactaatcttctagtagcttttcctgaaagcacgtgcttaaagtacatttg

SEQ ID NO: 23762 - DNA, 201 bp, Homo sapiens
ggagaccccttgtaacagggagggtcctgagcacacatggccatctctgtccactttgcagctccccatgcacctcctccaggagctttcttggggttgtygtgtcctctgcaccattcgaggccctactctttccaggttcccacggcctggcctccctgagtttcttgcagatgacatggatgagtagataagcagatg

SEQ ID NO: 23763 - DNA, 201 bp, Homo sapiens
gggaagctaacaggaggtgaacaagaactcagccatgtgccagagagggtggcgcatcccaaccccatgggacagaagctcctgcactggaaacccttctsaccttgccctatgtgtctgttcatggggctctttgtgtcttttaaaatatctttttaaataaactggtaaatatatgtaagtgttttcctgagttctgtg

SEQ ID NO: 23764 - DNA, 201 bp, Homo sapiens
gttgacagcagcatcaccacaaacacatgattaatgcatcatactatgaggttatgatggcttcaatgtcactaggtgataggaatttttcaggtccattmaactctcatgggacgacagtcatatatgcaattcatcattgacccaaacatcattatacaatgcatgactctataacacagtggggtgtgtgtgtgtgtg

SEQ ID NO: 23765 - DNA, 201 bp, Homo sapiens
actaccttcaggtatgttccttgtatgccaactttgttgaagcttttaatcataaagcaatgctggattttgtaaaatgtttgtcaaatgttttttgtgcrtggttaatactaagtgtcaacttgatttggattgaaggatacaaagtattgatcctcggtgtgtctatgagggtgttgccaaaagagattaacatttgag

SEQ ID NO: 23766 - DNA, 201 bp, Homo sapiens
acgtggagaaaagtccttgtaggttgcaagggcagtggcctgggtggaatccctgctagggacagagcaggaaggcctcgcagcctcaccaagcagcagcyctggggtgaagtaagtggaccaggagtaagtggaccaggcaggagcagtagtgactcaacagcaggtcacaggcctaggtgggtgctgaaggtcatggga

SEQ ID NO: 23767 - DNA, 201 bp, Homo sapiens
aattaccccatgcagaatttgaaatgcaaacgaccattggaggcttagaggtcttcgggttcaaaccgtcagagaatagctcattttaaactcatcctccmacagtaaacaagtataaaagtcacaaaaaacatacaatgcagttgtgcagccacaaaacagcaaccagcacaggactatcaccttttggagaatggaagt

SEQ ID NO: 23768 - DNA, 201 bp, Homo sapiens
gggatttatttggtgctcctggtgtgggtgactatctccctgagtcccaaaagacagcacattctgccgggtacccagaggtggggacagatgctaacagstccatcttataagtgcaacatgaaatttaaggtcagggaatctcttaacttttcttgaaggacctcatatttagcttcttgactcaaaatcatttgtgga

SEQ ID NO: 23769 - DNA, 201 bp, Homo sapiens
gacggctccgtctccagatccttctctctatgtccttcagtcttggctctctaggtacaatttactgctatgaaaagggatttgagaattcccagaggagsctttcagcctctttgcatggctctttctggcctttcaaaagcgccagagacatcagaaatgaaatcgtacacacttattcggagttttccacaatcattg

SEQ ID NO: 23770 - DNA, 201 bp, Homo sapiens
atgcccaactaattttttaaaaaatttttttgtagagatgaggtatcactatgttgccgaggctggtctcaaactcctgggttcaaacaattcacccaccytggctccccagaatgctgggattacaggcctgagccacgtacccagcctctatcccatgttttgattcatcatcatctcctaagccctttcccagcatcg

SEQ ID NO: 23771 - DNA, 201 bp, Homo sapiens
attgctggataatatagtggttctatttttagattttttaaaactctccatactgtcttctatagtggctgtactaatttaaattcctatcaacagcgtayaagagttcccttttctccacatcaccagcatctgttattttattttattttatttattttatttttgtcttttcagttgtggctattctatctggggtaa

SEQ ID NO: 23772 - DNA, 201 bp, Homo sapiens
cagctgacagccaggacccttgtgtggggcgcgtgacgcccctttgcaaccagggcgttttctgcaccccaccagccatccctcctgggaccacgctggtyctctccaaccctaacagggagagaaggaaggagaggtctggaggctttgggtcctccctcgtgctccttcttcctctgccatttattccctgagtgtcct

SEQ ID NO: 23773 - DNA, 201 bp, Homo sapiens
ccaggccctgctctctgccaaccctgatccctgaactccagcactttccaaacccacccccgaattgctggataatatagtggttctatttttagattttytaaaactctccatactgtcttctatagtggctgtactaatttaaattcctatcaacagcgtacaagagttcccttttctccacatcaccagcatctgtta

SEQ ID NO: 23774 - DNA, 201 bp, Homo sapiens
gctgacagccaggacccttgtgtggggcgcgtgacgcccctttgcaaccagggcgttttctgcaccccaccagccatccctcctgggaccacgctggtccyctccaaccctaacagggagagaaggaaggagaggtctggaggctttgggtcctccctcgtgctccttcttcctctgccatttattccctgagtgtccttg

SEQ ID NO: 23775 - DNA, 201 bp, Homo sapiens
attctgtgaactgcacccccagctgcccaacaacttccctttgctgatctgagccagactctgcttttatggcttacacccaaataattcaagttattttwaaaaaataataataaatcaagttattcatttatgagttatacagtcccatgtggggaaagggaaggagagtgaggtaatactcaattttactacctgcta

SEQ ID NO: 23776 - DNA, 201 bp, Homo sapiens
caggatggggtatctttgagccacgacacccagcagtggggggatgtcctgcctgatgggaatggaacctaccagacctgggtggccaccaggatttgccraggagaggagcagaggttcacctgctacatggaacacagcgggaatcacagcactcaccctgtgccctctggtgagcctagggtgaccctggagagggtc

SEQ ID NO: 23777 - DNA, 201 bp, Homo sapiens
taggcaaccccaacaccaccccacatcctccagctctctaatggtggtgctacccccacagcacttgcagtgccttccacaagattcaccctgggacataygatcatttttgatttggccagaatggaggcagtttcagaggtttccctttggccttcagcacaatgagagcccttactccacagactagggatgcagtgt

SEQ ID NO: 23778 - DNA, 201 bp, Homo sapiens
taattcatgcagagccggccgtgcgggagaccagagttttattactcaaatcagtctccccgaaaactctgatcagtttttaaggataatttggtggatarggggggccagtgaatcaggagtgctgattggttggctccggtatgaaatcatagtgagtggaggctgttctcttaggctgagtcagttcctgagtggggg

SEQ ID NO: 23779 - DNA, 201 bp, Homo sapiens; identical to SEQ ID NO: 1924

SEQ ID NO: 23780 - DNA, 201 bp, Homo sapiens
aggaaaatccaatataacatgatctcctcaaaagaggtataaacgaatgatgatattgtcttttatctcatttttaccagatgtctgaaaggttgaagccrtatgttgctgagaccattgctatttttggactgcaatgggcgaattgataatgactaaacaggactctggtaatgggccagtatctttttactgctatga

SEQ ID NO: 23781 - DNA, 201 bp, Homo sapiens
agaaaagcgggcagtttctggagatggtaaggcccctgtctgggcagtagggtcccctcattgctcctgcaaagataggcatgttggtgacaaggcttccrtaacaggggatgaaagttggggaatttgggaagggaatgggggcagcatctccatctacacccataagtgctgcccaagcaagggtcaaacgcccagctg

SEQ ID NO: 23782 - DNA, 201 bp, Homo sapiens
agaagaggaagaatagtagctgaggtgaaatgaatgaataaatggggtatgtaatgaggaaaatccaatataacatgatctcctcaaaagaggtataaacraatgatgatattgtcttttatctcatttttaccagatgtctgaaaggttgaagccatatgttgctgagaccattgctatttttggactgcaatgggcgaa

SEQ ID NO: 23783 - DNA, 201 bp, Homo sapiens
atgtatgtaccacatcttggttatccatccctcagacaatggacacttgggttacttctaccttttggatattggcaaatatttcatttcctttgggtatrtatttatttcctttgggtatttcttttgggtatatatccagaaatagaagcagtacacaggggcttcattttctctgtctctttgccaaccttgctctgt

SEQ ID NO: 23784 - DNA, 201 bp, Homo sapiens
tgaataaccctaacctctatgaactggaatggactgatgggagacactcgctgttactagcatggtatagctccctgcataggccagcacagcaggaaaayctaatgtcccttccaaaatgagaaatatttggtataaatgcagaagaggaagaatagtagctgaggtgaaatgaatgaataaatggggtatgtaatgagg

SEQ ID NO: 23785 - DNA, 201 bp, Homo sapiens
cttgaatccgggaagtggaggttgcagtgagctgagatcaggccactgcactccagcctgggcaacaagagtgaaattccatctccaaaaaaaaaaataaracaataataataataatatttttgaggttcatccaagttgtagtatgggtcagaatttcattccttttaaggatggataatactcattatatgtatgtac

SEQ ID NO: 23786 - DNA, 201 bp, Homo sapiens
taaccctcacaatgatatcttcagctaccattccacactatctaccctttcgctacaggaaataagggcctctccatgagacactgcagaggcctcacacrtagccagtgacagctgttagaatccctcagattctcattctccttttatagggcatcaacacagctgagcagtaaccagccagcttccctgttgtaggtt

SEQ ID NO: 23787 - DNA, 201 bp, Homo sapiens
cgggccaggtgactaagtttccgcggcgccttctccccggccactgcttgagccgctgagagggtggcgacgtcggggccatggggctgggcccggtcttyctgcttctggctggcatcttcccttttgcacctccgggagctgctgctggtgagtggcgttcctggcggtcctcggcggagcgggagcagtgggacgttt

SEQ ID NO: 23788 - DNA, 201 bp, Homo sapiens
cctgccttggctgaatgtcaaacatctctggaggtctgtaaccctcacaatgatatcttcagctaccattccacactatctaccctttcgctacaggaaayaagggcctctccatgagacactgcagaggcctcacacgtagccagtgacagctgttagaatccctcagattctcattctccttttatagggcatcaacac

SEQ ID NO: 23789 - DNA, 201 bp, Homo sapiens
tggacatgccagctagttcctgcaaagctcctgagtggaattcccgctgcattataagggtgaggcttctgcagcatcttccagcgtaggaagtgggaacyattactggaaaaggcgagccttctctgcatgcccagagggtactggagggcacccatctgataatgctgtcctagtttgcagaatctcatgtttccccac

SEQ ID NO: 23790 - DNA, 201 bp, Homo sapiens
aatgtgtccaaaaatagacctgcattcctgaaaaatgactgtattcagaattatatgttgcaaccctgtttgtaaaatcaaaaaggaaagaagaaagaaamtgaaagataaaagaaaaaataatccaaatgtctgtcactagcggactagttaaaaaagcattgcaagctgggcacagtagcattcacctgtgaatacact

SEQ ID NO: 23791 - DNA, 201 bp, Homo sapiens
tgctcagggctgggaggggaggagtgctgagctgcagatagagggcagggcccacagtgggcagggcctgccctggtgtgcaggtgcctctgcaggagagragggcctggggactgagagcaagggtcagggcctctctttggggaggcctctcactgtaacaggactggtcaggcctgagaggagggcactgggttccct

SEQ ID NO: 23792 - DNA, 201 bp, Homo sapiens
ctagactttttataggactggcagtgcagtaggtttgttgacagcagcatcaccacaaacacatgattaatgcatcatactatgaggttatgatggcttcaatgtcactaggtgataggaatttttcaggtccattaaactctcatgggacgacagtcatatatgcaattcatcattgacccaaacatcattatacaatgc

SEQ ID NO: 23793 - DNA, 201 bp, Homo sapiens
ggccccctgggtcctcttataaagcacggttccggtgggctttccggcctcacgtaatgtctccatcccacaggccaaattcccccagcctcattattccmtcttctacatgttccggggcaactaagtcaggtctagcttgtgagataccggcatcattttttcccagtctacatggatcaccccagcagtgggtttgcc

SEQ ID NO: 23794 - DNA, 201 bp, Homo sapiens
ctctttggggaggcctctcactgtaacaggactggtcaggcctgagaggagggcactgggttccctcttgggtcttgtccttttgtcttggggccctttcmctccctgcacggtgagtggtgggcacaggacaggggctgatgttgatggagtgatgggagagaactgacaggggctgggaaaagcaaggagggaggaaga

SEQ ID NO: 23795 - DNA, 201 bp, Homo sapiens
tttcaggtccattaaactctcatgggacgacagtcatatatgcaattcatcattgacccaaacatcattatacaatgcatgactctataacacagtggggkgtgtgtgtgtgtgtttgtattttgtgtgtaagattaacactgaaattgaggtatcaactaggcaccaaggtaaaaacatattaacttttcctgtgaggtg

SEQ ID NO: 23796 - DNA, 201 bp, Homo sapiens
cacgttcctgaggctctggtggaaggtgggccccctgggtcctcttataaagcacggttccggtgggctttccggcctcacgtaatgtctccatcccacakgccaaattcccccagcctcattattccctcttctacatgttccggggcaactaagtcaggtctagcttgtgagataccggcatcattttttcccagtcta

SEQ ID NO: 23797 - DNA, 201 bp, Homo sapiens; identical to SEQ ID NO: 4638

SEQ ID NO: 23798 - DNA, 201 bp, Homo sapiens
atgtcaaattgttctctgaagaggttgtatcaactcccccctttaaaatcttctttgacattttacaggtcaagttatcttcctccccaactagctgctcmgcctcagtcccccttcattggctccttttgctgtagatgctggagcactgtggggttttactgcctcccaatcactctagtgtcctccactcccaggatt

SEQ ID NO: 23799 - DNA, 201 bp, Homo sapiens
gatatatccagccagcatgctagctgcaatcaggactcctacttggtcacatctggagtaatcccattcattccttagtaatcccattcattccttaggcyccatcaggcttatttgctaaattacatggagataataggcaaccccaacaccaccccacatcctccagctctctaatggtggtgctacccccacagcact

SEQ ID NO: 23800 - DNA, 201 bp, Homo sapiens
gcaaacgaccattggaggcttagaggtcttcgggttcaaaccgtcagagaatagctcattttaaactcatcctcccacagtaaacaagtataaaagtcacaaaaaacatacaatgcagttgtgcagccacaaaacagcaaccagcacaggactatcaccttttggagaatggaagttcctgaaagggagattcacatcctt

SEQ ID NO: 23801 - DNA, 201 bp, Homo sapiens; identical to SEQ ID NO: 1919

SEQ ID NO: 23802 - DNA, 201 bp, Homo sapiens; identical to SEQ ID NO: 4449

SEQ ID NO: 23803 - DNA, 201 bp, Homo sapiens; identical to SEQ ID NO: 1922

SEQ ID NO: 23804 - DNA, 201 bp, Homo sapiens; identical to SEQ ID NO: 4644

SEQ ID NO: 23805 - DNA, 201 bp, Homo sapiens; identical to SEQ ID NO: 4486

SEQ ID NO: 23806 - DNA, 201 bp, Homo sapiens
ctattcccaacaggtctcaagaattcttctgttagtctcctgccctcttgggacagccccgcacttccctcactttgataccctggtacccaggcatctgyctccttcattctcctccagctacccaagcacccccaggccctgctctctgccaaccctgatccctgaactccagcactttccaaacccacccccgaattg

SEQ ID NO: 23807 - DNA, 201 bp, Homo sapiens
tccccttttcttcctatctcttccctcctttcttaacacgtccccctatccttccctcctttcaccactctctgcacttgatccccggtgtattccagccyccaggccaacacacttcaccgcgtccgcctggggcaggtcagagaagggacgcgaggcggcgctgtcacagcattctatgcgccccagcgccctgggccg

SEQ ID NO: 23808 - DNA, 201 bp, Homo sapiens
agctgggagtctgaagatggtggtgggttacaaagagctcagcgatgagcctggcccaagattctgaccccttgccctggatcctgagggttccacccttycctattcccaacaggtctcaagaattcttctgttagtctcctgccctcttgggacagccccgcacttccctcactttgataccctggtacccaggcatct

SEQ ID NO: 23809 - DNA, 201 bp, Homo sapiens; identical to SEQ ID NO: 12744

SEQ ID NO: 23810 - DNA, 201 bp, Homo sapiens
gtccctctgctggcagccaaggagatgctcttggaggatacgtgcacaacttagctgggagtctgaagatggtggtgggttacaaagagctcagcgatgarcctggcccaagattctgaccccttgccctggatcctgagggttccacccttccctattcccaacaggtctcaagaattcttctgttagtctcctgccctc

SEQ ID NO: 23811 - DNA, 201 bp, Homo sapiens
tctctgctctatgggtgtttattgctgccataaaaattaacacaaaacaagtggctttaaacagcatctctttatcatgtcacagtcatgtgtgttacaayttcaacagtctcatggggctaaaatcaaggtaaggggaggtctgtgttccttctgactctgaggaaaaatctactgtcaagctcattcaggttcttgtct

SEQ ID NO: 23812 - DNA, 201 bp, Homo sapiens
gaggagaggagtcccagcatctgagaagccagagggcgatgcatcctctctgctctatgggtgtttattgctgccataaaaattaacacaaaacaagtggstttaaacagcatctctttatcatgtcacagtcatgtgtgttacaatttcaacagtctcatggggctaaaatcaaggtaaggggaggtctgtgttccttct

SEQ ID NO: 23813 - DNA, 201 bp, Homo sapiens
aggatcctggtgtcagggacagaccatggccatggcgggatgatagcagctctcctacgaaataatgcttatatgacaagggcatgagattcaggcagagrgaggagaaggtcatggaggagaggagtcccagcatctgagaagccagagggcgatgcatcctctctgctctatgggtgtttattgctgccataaaaatta

SEQ ID NO: 23814 - DNA, 201 bp, Homo sapiens
ttggttcaaacaccctcagcctcctgctcctcaattcttgctttcttatcatagataccaagcagtgctcttgctggctgcccttctgttctgaccctggracaccaccctctattaaccttacccacaactgcaggcaggtcaagccccctcggctgctcctctggggttgccatggtaaccgtgtcctctggcttttgc

SEQ ID NO: 23815 - DNA, 201 bp, Homo sapiens; identical to SEQ ID NO: 1925

SEQ ID NO: 23816 - DNA, 201 bp, Homo sapiens; identical to SEQ ID NO: 1914

SEQ ID NO: 23817 - DNA, 201 bp, Homo sapiens; identical to SEQ ID NO: 1915

SEQ ID NO: 23818 - DNA, 201 bp, Homo sapiens
atatataaaatagcctagtatttgcctattagctatgcacatcctcccatatactttaaatcatctctagattacttataattcctaatgcaatgtaaatkatttgtaaatagttgttacactgtattgcttaggaaataatgacaagaaaaatgtctatacatcttcagtacagacataaccactgtaggtactcctaac

SEQ ID NO: 23819 - DNA, 201 bp, Homo sapiens; identical to SEQ ID NO: 12739

SEQ ID NO: 23820 - DNA, 201 bp, Homo sapiens
caagactgctgcaggggtcaaaggggactgctgatcagtgttccagggatttgctccagattaatctgagtcatggaaaaactgcctttcttttgtttctraacaaatacctgcaaagacaaaagaccacataaatccccaggtgcacaactttttcagatttaaagaaaaaacaacccccgtctttccctccattcccag

SEQ ID NO: 23821 - DNA, 201 bp, Homo sapiens
ggcacacctcatctccatagagacagaggcttctgcgcttatatctttctgtaaggcagacacccttgtttctaggagggacctagggtggactgtggatyctttctctggggcaaataaaaatgtagaatcagaaaattcaggcactttgcactcctcatgggacactccagcagcactcacgtgaccatcctgagaatg

SEQ ID NO: 23822 - DNA, 201 bp, Homo sapiens
acccatcagaataactcccttccaggtttggaaggtgattgaaatcaacaagcatttatctctaagtgcttgccaggtgcacctgtagtcccagctatgasagtgtctgaggcagaaggatatcttgagtacaggcatttgggtttagcctgagaaatatttgagtctagcctgggaaacatatcaagaccacatctcaaa

SEQ ID NO: 23823 - DNA, 201 bp, Homo sapiens
tgagacatcaggatggggaagccgtgtaagtgaggaccgtgaccttggagtaagaaccacactgaaatagactcaccctagcaaaggctaaaatcaagagkaagcagaatcaaagtgggtctgatttttactaaaggtgattctttgataattacctaactgtcaaactattaccagtctttggaggaagataacaaaacc

SEQ ID NO: 23824 - DNA, 201 bp, Homo sapiens
ttggaagtctacccctttgatcaaagaagataaaaacagaacagctcttgtgggctgaattgcagggtgttttcttagcagtgatggaagaattgaacaaygataaaagctcctatgttttagttttactgacttatgggcagtgactgatggcctggccatataattaattaagaaagcagtggaaaactggcctatgaa

SEQ ID NO: 23825 - DNA, 201 bp, Homo sapiens
gttggaatttcagccctgcaaaacctgtgttgagacatcaggatggggaagccgtgtaagtgaggaccgtgaccttggagtaagaaccacactgaaatagrctcaccctagcaaaggctaaaatcaagaggaagcagaatcaaagtgggtctgatttttactaaaggtgattctttgataattacctaactgtcaaactat

SEQ ID NO: 23826 - DNA, 201 bp, Homo sapiens; identical to SEQ ID NO: 4464

SEQ ID NO: 23827 - DNA, 201 bp, Homo sapiens; identical to SEQ ID NO: 4466

SEQ ID NO: 23828 - DNA, 201 bp, Homo sapiens
ctgggcacggtggctcactcctgtaatcccagcactttgggaggccgagtcaggtggatcacttgagatcaggagttcaagaccagcctgatcaacatggrgaaaccccgcctctactaaaaatacaaaattagccaggcgtggtggcatatgcctgtaatcccagctactcaggaaagctgaggcaggagaatcgcttga

SEQ ID NO: 23829 - DNA, 201 bp, Homo sapiens
cacagggtcaagaccaacaatatcaaccatcttcagccttcacatcttgtcccactggaagattttcaggtgtaataacacgcatggagctgcatctcctrtgataacaatgccttcttctggaatacctcctaaaggacctggctgaggctgttttaatttttttatatatatagaaggagcacactctaaaataacaat

SEQ ID NO: 23830 - DNA, 201 bp, Homo sapiens
tgcctgatgggaatggaacctaccagacctgggtggccaccaggattcgccaaggagaggagcagaggttcacctgctacatggaacacagcgggaatcayggcactcaccctgtgccctctggtgagcctggggtgaccctggagagggtcaggccagggtaggaacagcagggacggctgtggctctctgcccagtgta

SEQ ID NO: 23831 - DNA, 201 bp, Homo sapiens
gcctgatgggaatggaacctaccagacctgggtggccaccaggattcgccaaggagaggagcagaggttcacctgctacatggaacacagcgggaatcacrgcactcaccctgtgccctctggtgagcctggggtgaccctggagagggtcaggccagggtaggaacagcagggacggctgtggctctctgcccagtgtat

SEQ ID NO: 23832 - DNA, 201 bp, Homo sapiens
agaatcaaagtgggtctgatttttactaaaggtgattctttgataattacctaactgtcaaactattaccagtctttggaggaagataacaaaacccagakcctctaaaatccatcatgtagaatatgtgccatgccaagcagcagagagaatgcagcaactaaagaagaaataatcaacagaagccaactcaaagatgat

SEQ ID NO: 23833 - DNA, 201 bp, Homo sapiens
tgagacctaggactctttaggggagaacaacaacaaagcaacaggatcctggtgtcagggacagaccatggccatggcgggatgatagcagctctcctacraaataatgcttatatgacaagggcatgagattcaggcagagagaggagaaggtcatggaggagaggagtcccagcatctgagaagccagagggcgatgca

SEQ ID NO: 23834 - DNA, 201 bp, Homo sapiens
gccctgaattttgtgagcgaccgcgctgggccgtttctctttcttttccggaccctgcagtggcgcctaaagtctgcgaggaggaagtcgcctctgtgctygtgagtccagggatctaaggcaagtgctgagggagaaaacatagttgatggggcagagcagagggggctggaggtggggtggagggggagggctttgaac

SEQ ID NO: 23835 - DNA, 201 bp, Homo sapiens
tgatattacgtcacagcatatgataaaatgatagtataagtatcctcagagcctgtggcctccgtgcaaggggatgagtggaaagatggtcagagaatggraagtgtgagatagagagtatggaagggctggggttcttggccatgatgagacctaggactctttaggggagaacaacaacaaagcaacaggatcctggtg

SEQ ID NO: 23836 - DNA, 201 bp, Homo sapiens
agagggaaggaagtttggctgaaagtatcctagacccagtgcaggttaagagaagttcagtaagggtgagccctggagcctcagtgggcctttaaaggagrgacaatcctgtctttgtttctcctcttctctcaattattgaatcgaagaagccaatggcaagtatggtctgagagcaaacgtagcaatagatttcaggcg

SEQ ID NO: 23837 - DNA, 201 bp, Homo sapiens
catccaagttgtagtatgggtcagaatttcattccttttaaggatggataatactcattatatgtatgtaccacatcttggttatccatccctcagacaayggacacttgggttacttctaccttttggatattggcaaatatttcatttcctttgggtatatatttatttcctttgggtatttcttttgggtatatatcc

SEQ ID NO: 23838 - DNA, 201 bp, Homo sapiens
tttccttagaatattattgtattgaagaatgtcataaataattttatttgtcacctggacctggtgccaagatacgtggtcaagcattattctggatgatytttttaggatgtttcttggatatgattaacatataaattgctatactttgagtaaagtagattgacctctataatgtggacaggcttcattcaattcatt

SEQ ID NO: 23839 - DNA, 201 bp, Homo sapiens
aaaaatcttatgtatctacccatgtgcttaccatttctggtgctcttcattacatatttgcttttggtataattttctttttgcctgaaggactgaaacayttattacagttcgtgtctgctggttatgtattttttcactccctataagtctaaaatccctttttttatagatatctttagagtctgttaagtagcttga

SEQ ID NO: 23840 - DNA, 201 bp, Homo sapiens
atacaaaaatgtgaggagcttaaaatagccagaacaatattggaagagaacacaattggaggacttaaactatcagatatcaacagatatttgaaagccayagtgattagaaaagtgaagtatttgttcagggataaacaaacaggaaaaaattattaaaatagagccctctctattttcttctatgagttttataattta

SEQ ID NO: 23841 - DNA, 201 bp, Homo sapiens
acaatattgctaagataccgtttatccacaaagtgatccatggagtcaatgcaattgtaataaaactcccaacagttttttttgtgggaattgacatgctycttctaaaatgtatacaaaaatgtgaggagcttaaaatagccagaacaatattggaagagaacacaattggaggacttaaactatcagatatcaacagat

SEQ ID NO: 23842 - DNA, 201 bp, Homo sapiens; identical to SEQ ID NO: 4639

SEQ ID NO: 23843 - DNA, 201 bp, Homo sapiens
ggatagttatttcatatatatgaagaagacaatattgctaagataccgtttatccacaaagtgatccatggagtcaatgcaattgtaataaaactcccaasagttttttttgtgggaattgacatgctccttctaaaatgtatacaaaaatgtgaggagcttaaaatagccagaacaatattggaagagaacacaattgga

SEQ ID NO: 23844 - DNA, 201 bp, Homo sapiens
tgatccattttgtgttgatttatacatatgctgtgaggtagggtttcaacttctttgttttttttcttttgcagagacagtgtctgtgtcacccaggctabagtgcagtggtgcaatcagagctcatggtaaccttgaactcctgggtccaagcaattctcctgtctcagcccctcaaaatgctgagattgcaggtggagt

SEQ ID NO: 23845 - DNA, 201 bp, Homo sapiens; identical to SEQ ID NO: 4640

SEQ ID NO: 23846 - DNA, 201 bp, Homo sapiens
aattgtagaaataaatataaaagttatacaaaatctcatcattcagaattacaaaacattgctgagacaaattaagtggatagttatttcatatatatgargaagacaatattgctaagataccgtttatccacaaagtgatccatggagtcaatgcaattgtaataaaactcccaacagttttttttgtgggaattgaca

SEQ ID NO: 23847 - DNA, 201 bp, Homo sapiens
ttagatgaagagtgtatactttaacacattgagttgtcttaacacctttactgaggttctttgcatatatctctttatgtgtctctgagctgttgtctagkgccctttcattttaatctgaatgactcacattagtatttcttataggaaaaatctactggcaatggaatctttcagttagttgttaattaactggaaaca

SEQ ID NO: 23848 - DNA, 201 bp, Homo sapiens; identical to SEQ ID NO: 4641

SEQ ID NO: 23849 - DNA, 201 bp, Homo sapiens
aactaaataaactagacataaaagggaacttccctaacagaatacagttatttacaacaaagaaatacaaagaaatacctaaatctaaagtcataattaaygaagaaatattaaacactcctctgaggtggggacaagagaaggatgtccactatcatcacttttatttaacattgtactgtgtgtccaacagcaaaaata

SEQ ID NO: 23850 - DNA, 201 bp, Homo sapiens
ctttatgtgtctctgagctgttgtctagtgccctttcattttaatctgaatgactcacattagtatttcttataggaaaaatctactggcaatggaatctktcagttagttgttaattaactggaaacatctcaatttctccttcatttattttaatttattaattgtgataaaatgcacataacataaaatttaccatct

SEQ ID NO: 23851 - DNA, 201 bp, Homo sapiens; identical to SEQ ID NO: 4482

SEQ ID NO: 23852 - DNA, 201 bp, Homo sapiens
aaataatatatgaaatggataacacataatgaccaaatgggatttataagagaaatacatggtagatttaacttcaaaatgtcagaataatctaccccaaraatagagaaaagtaggacaacatgtggttatatcaatagatgcaggaaaaccatttgataaagttcagtaggcattcataataaaaactaaataaactag

SEQ ID NO: 23853 - DNA, 201 bp, Homo sapiens
cgtcaggaatttcttgaaggaagatgccatgaagaccaagacacactatcacgctatgcatgcagactgcctgcaggaactacggcgatatctagaatccrgcgtagtcctgaggagaacaggtaccgacgctggccaggggctctcctctccctccaattctgctagagttgcctcacctcccagatgtgtccagggaaa

SEQ ID NO: 23854 - DNA, 201 bp, Homo sapiens
taattttatgaggcaacataagtcagacaaggacctaaacatgacaattatattacaagaaaaataaactcatcatcaaaatgatctgatgaacatagccwccaaaattccaattaaaatattagtaaatagaaccaaataatatatgaaatggataacacataatgaccaaatgggatttataagagaaatacatggtag

SEQ ID NO: 23855 - DNA, 201 bp, Homo sapiens
gaagatgccatgaagaccaagacacactatcacgctatgcatgcagactgcctgcaggaactacggcgatatctagaatccggcgtagtcctgaggagaasaggtaccgacgctggccaggggctctcctctccctccaattctgctagagttgcctcacctcccagatgtgtccagggaaaccctccctgtgctatggat

SEQ ID NO: 23856 - DNA, 201 bp, Homo sapiens
ataaagagtaaacaccttccaactaattttatgaggcaacataagtcagacaaggacctaaacatgacaattatattacaagaaaaataaactcatcatcraaatgatctgatgaacatagccaccaaaattccaattaaaatattagtaaatagaaccaaataatatatgaaatggataacacataatgaccaaatggga

SEQ ID NO: 23857 - DNA, 201 bp, Homo sapiens
gtctagtgccctttcattttaatctgaatgactcacattagtatttcttataggaaaaatctactggcaatggaatctttcagttagttgttaattaactrgaaacatctcaatttctccttcatttattttaatttattaattgtgataaaatgcacataacataaaatttaccatcttaaccatttgtagtggtagtgt

SEQ ID NO: 23858 - DNA, 201 bp, Homo sapiens
tgttcagtagtgctaagaacactcacactgttttgcaaaccaatctccagaactcctttcatattgcaaaactgcatattttcatttttgaagaataagtyttctagatatagaacttttggttgacagctttatttttgtagcactttaaacatgtcataccactctgactttcctcagtgttttctggtatgaaattgg

SEQ ID NO: 23859 - DNA, 201 bp, Homo sapiens; identical to SEQ ID NO: 4647

SEQ ID NO: 23860 - DNA, 201 bp, Homo sapiens
acctggaagttttacctggcagccaccattctaccttcacattcatcaagtttgactgttttagacacctcatgtaaatggaattatgcagtacttggagttttttttttttttttgattggcatatttcacttagcaatgactttaaggttcatatacgttgtagcatatagcaagattttcttcttttaaatgttgaat

SEQ ID NO: 23861 - DNA, 201 bp, Homo sapiens; identical to SEQ ID NO: 4609

SEQ ID NO: 23862 - DNA, 201 bp, Homo sapiens
attaactggaaacatctcaatttctccttcatttattttaatttattaattgtgataaaatgcacataacataaaatttaccatcttaaccatttgtagtrgtagtgttcagtagtgctaagaacactcacactgttttgcaaaccaatctccagaactcctttcatattgcaaaactgcatattttcatttttgaagaat

SEQ ID NO: 23863 - DNA, 201 bp, Homo sapiens
ccagactgcaatgcaagtttaaaccccagtgaaggagagagggaaggaagtttggctgaaagtatcctagacccagtgcaggttaagagaagttcagtaakggtgagccctggagcctcagtgggcctttaaaggagggacaatcctgtctttgtttctcctcttctctcaattattgaatcgaagaagccaatggcaagt

SEQ ID NO: 23864 - DNA, 201 bp, Homo sapiens
catgaacgtcaggaatttcttgaaggaagatgccatgaagaccaagacacactatcacgctatgcatgcagactgcctgcaggaactacggcgatatctaraatccggcgtagtcctgaggagaacaggtaccgacgctggccaggggctctcctctccctccaattctgctagagttgcctcacctcccagatgtgtcca

SEQ ID NO: 23865 - DNA, 201 bp, Homo sapiens
ccatgaagaccaagacacactatcacgctatgcatgcagactgcctgcaggaactacggcgatatctagaatccggcgtagtcctgaggagaacaggtacsgacgctggccaggggctctcctctccctccaattctgctagagttgcctcacctcccagatgtgtccagggaaaccctccctgtgctatggatgaaggca

SEQ ID NO: 23866 - DNA, 201 bp, Homo sapiens; identical to SEQ ID NO: 4612

SEQ ID NO: 23867 - DNA, 201 bp, Homo sapiens
gcaggatgctctcgatctcctgacctcgtgatctgcccacctcgacctcccaaagtgctgggattacaggcgtgagccaccgtgcccggaccctttttccttttttttttttttaaaggctagtcaagtgaaacagtgggagtgaagatgaaacaaaaacatctataactggttgtgatcaattagttgtaaacaccactg

SEQ ID NO: 23868 - DNA, 201 bp, Homo sapiens
ctatgcatgcagactgcctgcaggaactacggcgatatctagaatccggcgtagtcctgaggagaacaggtaccgacgctggccaggggctctcctctccytccaattctgctagagttgcctcacctcccagatgtgtccagggaaaccctccctgtgctatggatgaaggcatttcctgttggcacatcgtgtcctgat

SEQ ID NO: 23869 - DNA, 201 bp, Homo sapiens; identical to SEQ ID NO: 4613

SEQ ID NO: 23870 - DNA, 201 bp, Homo sapiens; identical to SEQ ID NO: 4614

SEQ ID NO: 23871 - DNA, 201 bp, Homo sapiens
agtaatccagactgaagggaggggaaagcctagactaagactatggctgtgggattgaaatagcgttgaaggagctgactttgactcccggagatgaaggrgaaagaggaaatcagaagggaccaaggatggtgaagttcttaagagaaactgaggaggaagagaggatgatgtggtgggagacgtgtagagagtccttgt

SEQ ID NO: 23872 - DNA, 201 bp, Homo sapiens
ttttataaggggctttttctgcttcggtttggcacttctccttgttgctgccatgtgaggaaggatgtgtttgcttcctcttctgccatgattataagttwcctgaggcctccccagtcatgctgaactctgagtcaattaaacctctttccttttaaattgcccagtcttgagtatgtctttattagcagtatgataaca

SEQ ID NO: 23873 - DNA, 201 bp, Homo sapiens; identical to SEQ ID NO: 4616

SEQ ID NO: 23874 - DNA, 201 bp, Homo sapiens
ggcgatatctagaatccggcgtagtcctgaggagaacaggtaccgacgctggccaggggctctcctctccctccaattctgctagagttgcctcacctccmagatgtgtccagggaaaccctccctgtgctatggatgaaggcatttcctgttggcacatcgtgtcctgattttcctctattgttagagccactggataaa

SEQ ID NO: 23875 - DNA, 201 bp, Homo sapiens
atcataatccccacgcgttgttggagggactcgatgggagacaatttaatcatgggggtggttcccctcatgctgttctcatgatagtgtgttctcacaakacttcatggttttataaggggctttttctgcttcggtttggcacttctccttgttgctgccatgtgaggaaggatgtgtttgcttcctcttctgccatga

SEQ ID NO: 23876 - DNA, 201 bp, Homo sapiens
gtatacatcagcaacaacataacattttcaatcctaaggttgttgaattcacagatgtggaactcacagacatgaaaggcagactgtgtgctatggtttgkctgtttgcccacccaaatctcatcttgaattgtagttatcataatccccacgcgttgttggagggactcgatgggagacaatttaatcatgggggtggtt

SEQ ID NO: 23877 - DNA, 201 bp, Homo sapiens
ataattcctaatgcaatgtaaatgatttgtaaatagttgttacactgtattgcttaggaaataatgacaagaaaaatgtctatacatcttcagtacagacmtaaccactgtaggtactcctaactacagagtatacatcagcaacaacataacattttcaatcctaaggttgttgaattcacagatgtggaactcacagac

SEQ ID NO: 23878 - DNA, 201 bp, Homo sapiens; identical to SEQ ID NO: 4617

SEQ ID NO: 23879 - DNA, 201 bp, Homo sapiens
aatcatctctagattacttataattcctaatgcaatgtaaatgatttgtaaatagttgttacactgtattgcttaggaaataatgacaagaaaaatgtctrtacatcttcagtacagacataaccactgtaggtactcctaactacagagtatacatcagcaacaacataacattttcaatcctaaggttgttgaattcac

SEQ ID NO: 23880 - DNA, 201 bp, Homo sapiens; identical to SEQ ID NO: 4619

SEQ ID NO: 23881 - DNA, 201 bp, Homo sapiens; identical to SEQ ID NO: 4463

SEQ ID NO: 23882 - DNA, 201 bp, Homo sapiens
acattcttcaaaatatttatgattaatatgttaaggaaaatagaggaaaagatgggcaaactatttcaaaattcccagaaagattaatcataagaagagaraaaacacaaatgaacactatgagaagggacattataaaactgtagattttattaaaacaaaaataagagaaagttagacacaacttcatggaaagagctt

SEQ ID NO: 23883 - DNA, 201 bp, Homo sapiens
agagcctctaaaatccatcatgtagaatatgtgccatgccaagcagcagagagaatgcagcaactaaagaagaaataatcaacagaagccaactcaaagaygatctgaatattgaagtcagcaaacaaggacattcttcaaaatatttatgattaatatgttaaggaaaatagaggaaaagatgggcaaactatttcaaaa

SEQ ID NO: 23884 - DNA, 201 bp, Homo sapiens
actctacctgttgtgtgggtgatggacagcggcgtgaatgtctcttcatgtccattacccatttttgaatggcgttgtttttttaatggatgagttgtagttttttatgtattttgaatattaattcttcatcagatgtatgattggcaaatagctcctcccattctgtgcattttctttccactcttttaataatgtcac

SEQ ID NO: 23885 - DNA, 201 bp, Homo sapiens
tcctgaaagggagattcacatccttatcagctttctttccagaagcatttgccaaaatacaatgaagagaaatggaacccaagcagagaaaatcagtctcrtcggcaaaggaaacagagatcagagttcaggcttggcacattgactgggatttaggggtagggtgctgagggagggagttacagacaagaaacccccaaa

SEQ ID NO: 23886 - DNA, 201 bp, Homo sapiens
cactgctccccctccagcattactccttttggcaggtccttcctcaggctgagaatctccccctctaccttggttttctctctctggccagcacccccacyccttgctttgtttttaatttttaacttttgtttgggtacgtagtagatatgtatgtatatatttatggggtacatgggatattttgacacaggcctacaa

SEQ ID NO: 23887 - DNA, 201 bp, Homo sapiens
accacattttcttttttttaattacactttttattttgaggtaatcatagatccacatgtaactgtaagaaatagtaaagagggcaggcatggtggctcasgcctgtaatcccagcactttgggaggtggagagagcaggatcacttgagaccaggagctcaagaccaacctgggcaacacagcaagaccctgtgtcttac

SEQ ID NO: 23888 - DNA, 201 bp, Homo sapiens; identical to SEQ ID NO: 4625

SEQ ID NO: 23889 - DNA, 201 bp, Homo sapiens
tgccctttcttctccagtgccccccatggtgaatgtcacccgcagcgaggcctcagagggcaacatcaccgtgacatgcagggcttccagcttctatcccyggaatatcatactgacctggcgtcaggatggggtatctttgagccacgacacccagcagtggggggatgtcctgcctgatgggaatggaacctaccagac

SEQ ID NO: 23890 - DNA, 201 bp, Homo sapiens; identical to SEQ ID NO: 4470

SEQ ID NO: 23891 - DNA, 201 bp, Homo sapiens
cacattttcttttttttaattacactttttattttgaggtaatcatagatccacatgtaactgtaagaaatagtaaagagggcaggcatggtggctcacgyctgtaatcccagcactttgggaggtggagagagcaggatcacttgagaccaggagctcaagaccaacctgggcaacacagcaagaccctgtgtcttacca

SEQ ID NO: 23892 - DNA, 201 bp, Homo sapiens; identical to SEQ ID NO: 4627

SEQ ID NO: 23893 - DNA, 201 bp, Homo sapiens
gccagcacccccactccttgctttgtttttaatttttaacttttgtttgggtacgtagtagatatgtatgtatatatttatggggtacatgggatattttsacacaggcctacaatatgtcataatcacatcagggtaaatgggttatctatcacaacaagcatttatcctttctttgtgctacaaacaatcccattatgc

SEQ ID NO: 23894 - DNA, 201 bp, Homo sapiens; identical to SEQ ID NO: 4476

SEQ ID NO: 23895 - DNA, 201 bp, Homo sapiens
tcagggaaagtgctggtgcttcagagtcattggcagacattccatgtttctgctgttgctgctggctgctgctatttttgttattattattttctatgtcygttgttgtaagaagaaaacatcagctgcagagggtccaggtgagaaaagcgggcagtttctggagatggtaaggcccctgtctgggcagtagggtcccct

SEQ ID NO: 23896 - DNA, 201 bp, Homo sapiens
tttttcttcctgctcttcagattgcataatcgtaattggcctatcttcaatttgctggttcttctgcctgctaaactctgcatatattagtcagcatggcrgtgtcccacaagtcccttaggctctgttcactattttttgttccttttttcatttctattcctcaaagtctatgatttaagatgacttggcttcgagttt

SEQ ID NO: 23897 - DNA, 201 bp, Homo sapiens
tggttgacagctttatttttgtagcactttaaacatgtcataccactctgactttcctcagtgttttctggtatgaaattggctgttaatctcaatgaggwtcccttgtacatgatgcattatttgtttcttgctgctgtccaagttctctctgcttctatttcaacagtttggttataatgtttcttggtttggatgtct

SEQ ID NO: 23898 - DNA, 201 bp, Homo sapiens
aaacgcccagctgtggcatcctcctgctgcaggtgaggagtgggcagcagggagggctgcggcgcctgctctgtccccatcccggtctctgtgtctcttgractcactagggcgcatccaggtggggtgagctgggaatcacgtgctgaatgctaagggcctggatgatcacggcctcagagggagcaaatagtaaaggca

SEQ ID NO: 23899 - DNA, 201 bp, Homo sapiens
gctttttcagtatcaattgaaatggtgatatggcttttgtcctttattctgttgatacgatgtattacattgattgatttgtgtatgcatacctggaatayattccacttggtcatgaagaatgatctttttaatatactgttgaatgtggtttgctagtatttcattgatgatatttgcctcaatgttcatcagggatat

SEQ ID NO: 23900 - DNA, 201 bp, Homo sapiens
aaagtagtcatccttgtcttgttccagatcttaaagaaaaggctttcagttttcccccattcagtatgttactagctgtgagttgtcatatatggcttttrttatattgaggtctgttccttgtatactcagtttttttagagtttttatcatgaagggatgttaaacttatcaaatgctttttcagtatcaattgaaatg

SEQ ID NO: 23901 - DNA, 201 bp, Homo sapiens
ttttagtttttggaagaacctccacattatttcccacagtggttatactagtttacgttcccaccaacagtgtacaagggttctcttttgctacatcctcrccaggattccttattgcctgtcttctggataaaagccagtttatctggggtgggatgatatctcgtaggagttttgatttgccttcatctgatgacgaat

SEQ ID NO: 23902 - DNA, 201 bp, Homo sapiens
gcccctaaagaccaggcacaaatcccagcacatggagggatccagacaaatacacaagagatgaccacagcaggagctttactgggcacagagcgaggccrcacaccactcagctcctgcccctccacctgcccttctctccccacctgcccctgccccagcacagcagatcctcagaatccaaaaagagaacctaacttc

SEQ ID NO: 23903 - DNA, 201 bp, Homo sapiens
aggcctcctcgagcaaggtgggggtcccagggtcaggtcaggtgcagatcctgtggcagccacgtctttccatgctgggcctgctgggccccccaggcttyctgatggggtccccagttaggagctgcctgctcagggctgggaggggaggagcactgagctgcagatagagggcagagcccacagtgggcagggcctgcc

SEQ ID NO: 23904 - DNA, 201 bp, Homo sapiens
gaccttggccatgaacgtcaggaatttcttgaaggaagatgccatgaagaccaagacacactatcacgctatgcatgcagactgcctgcaggaactacggygatatctagaatccggcgtagtcctgaggagaacaggtaccgacgctggccaggggctctcctctccctccaattctgctagagttgcctcacctcccag

SEQ ID NO: 23905 - DNA, 201 bp, Homo sapiens
taccccatgcagaatttgaaatgcaaacgaccattggaggcttagaggtcttcgggttcaaaccgtcagagaatagctcattttaaactcatcctcccacrgtaaacaagtataaaagtcacaaaaaacatacaatgcagttgtgcagccacaaaacagcaaccagcacaggactatcaccttttggagaatggaagttcc

SEQ ID NO: 23906 - DNA, 201 bp, Homo sapiens
tgtccagggaaaccctccctgtgctatggatgaaggcatttcctgttggcacatcgtgtcctgattttcctctattgttagagccactggataaagacagwgggtcagggactggaccatccagtgttgtaatcagggcaagtagaggaccctccgacagaatcctgagcctgtggtgggtgtcaggcaggagaggaagcc

SEQ ID NO: 23907 - DNA, 201 bp, Homo sapiens
tcccagcagcctcctctctcacccttcacctcttctgactgggtgcgaatggtaactagaccaggcagtgccctccttgtcagtctgcctgtctgcctggytccctctcagagtttgtgtcttcactcggttcatcatccccagccccagcaggaacagggagaagtgacttggcaaatgccccactcaaaatgggatccc

SEQ ID NO: 23908 - DNA, 201 bp, Homo sapiens
taaaaacatattaacttttcctgtgaggtgtcaaattaccccatgcagaatttgaaatgcaaacgaccattggaggcttagaggtcttcgggttcaaaccrtcagagaatagctcattttaaactcatcctcccacagtaaacaagtataaaagtcacaaaaaacatacaatgcagttgtgcagccacaaaacagcaacca

SEQ ID NO: 23909 - DNA, 201 bp, Homo sapiens
gaggtggagagagcaggatcacttgagaccaggagctcaagaccaacctgggcaacacagcaagaccctgtgtcttaccaataaaataataataataatawagagaaatgtcatacattctttacccattattcttcaatgacatgttacaaactacagcataatatcacaagggacactgacattgatatggtcaagaca

SEQ ID NO: 23910 - DNA, 201 bp, Homo sapiens
aacatgccatgattaaattatatctctataccttgatataaacaaaaaattatatgagcagtaaagacaaatatgaaaaagtaaaattactgccaaagttrttaggaggataacctaaattatttgggtaggaaaatctttcttttttattttatttttttttccagccagggtctcattctgtcactcaggctaaattac

SEQ ID NO: 23911 - DNA, 201 bp, Homo sapiens
acacagaacagttctaccaccacaaggagccctcatgttacccttttataatcacactgacctttccccgcttccatgcctaacccctggcaaccactaayatattctctacttctattaaacttgtcatttcaagaaagtgatatgaatggaatcatgcagtatgtgttcttttgatattggctttttttttcactcagc

SEQ ID NO: 23912 - DNA, 201 bp, Homo sapiens
attttttaaaaaatttttttgtagagatgaggtatcactatgttgccgaggctggtctcaaactcctgggttcaaacaattcacccaccttggctccccaraatgctgggattacaggcctgagccacgtacccagcctctatcccatgttttgattcatcatcatctcctaagccctttcccagcatcgatagtctacta

SEQ ID NO: 23913 - DNA, 201 bp, Homo sapiens
cacagaactgattgcttgtttgttggagaaattccctacatttggtcagagaagtcttctgtgttgatagttgttgtggtgtgagagcagtggaaaacaaygtgagattttccacactcagagtggatctaaatgttgagttgcttttaaatttgacttagtcgtggcctgactaaacaggattagatgtgagaaattttt

SEQ ID NO: 23914 - DNA, 201 bp, Homo sapiens
agctggtgtccatcacagaactgattgcttgtttgttggagaaattccctacatttggtcagagaagtcttctgtgttgatagttgttgtggtgtgagagyagtggaaaacaacgtgagattttccacactcagagtggatctaaatgttgagttgcttttaaatttgacttagtcgtggcctgactaaacaggattagat

SEQ ID NO: 23915 - DNA, 201 bp, Homo sapiens
tgacctggcgtcaggatggggtatctttgagccacgacacccagcagtggggggatgtcctgcctgatgggaatggaacctaccagacctgggtggccacyaggatttgccgaggagaggagcagaggttcacctgctacatggaacacagcgggaatcacagcactcaccctgtgccctctggtgagcctagggtgaccc

SEQ ID NO: 23916 - DNA, 201 bp, Homo sapiens
cgtctgccccactcagcccgcagcctggtccccgaaagcgctcagtcagaatccgagagcagtgtggcggcgcccccgtgtggccacaggactgaagacaraggaccccgctcccctttctccccagccaggacgtcccaggctctccccctgttccccgcacctggacgggactctgcacagaagagagtctcccggtct

SEQ ID NO: 23917 - DNA, 201 bp, Homo sapiens
gaatggaacctaccagacctgggtggccaccaggatttgccgaggagaggagcagaggttcacctgctacatggaacacagcgggaatcacagcactcacsctgtgccctctggtgagcctagggtgaccctggagagggtcaggccagggtagggacagcagggatggctgtggctctctgcccagtgtataacaagtcc

SEQ ID NO: 23918 - DNA, 201 bp, Homo sapiens
agaaacagccctgttcctctcccctccttagaggggagcagggcttcactggctctgccctttcttctccagtgccccccatggtgaatgtcacccgcagygaggcctcagagggcaacatcaccgtgacatgcagggcttccagcttctatccccggaatatcatactgacctggcgtcaggatggggtatctttgagcc

SEQ ID NO: 23919 - DNA, 201 bp, Homo sapiens
atgagtgtggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttt

SEQ ID NO: 23920 - DNA, 201 bp, Homo sapiens
gtggggaagggagcacagaacccagacaccagcctggacacaggcacctgggataatctcctattccttggaaagttccagtatctgagggaggaacagtsacttctggtcctgacctgagtggagaccgagggactcagaagagctggaatcagacccccacacacactgagtatgagtcagagaacaaggcctgagaga

SEQ ID NO: 23921 - DNA, 201 bp, Homo sapiens
tggacaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcata

SEQ ID NO: 23922 - DNA, 201 bp, Homo sapiens; identical to SEQ ID NO: 12731

SEQ ID NO: 23923 - DNA, 201 bp, Homo sapiens
ccatgcgtctgttgatggacacttagattgcttgcagatcttggctactttgaatagtgctgcaataaacatggaaaagtagatagctctttaatataccratttcctttctttggagtatatgcctaacagtgggagtgctggagcatatgacagctctattgtatttttagtttttggaagaacctccacattgtttcc

SEQ ID NO: 23924 - DNA, 201 bp, Homo sapiens
acaaaggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacct

SEQ ID NO: 23925 - DNA, 201 bp, Homo sapiens
ggaatgtccccactagagagtgtcctctttttccctgctggatcagggaaaggtgctggtgtgattctacatacaattcttccctaaaaaataaataaataaataaataaataaataaataaaaacaatccttcccaaggccagaagacactagaattatgactatactttacctcaacttgcttttctcatacctgatgc

SEQ ID NO: 23926 - DNA, 201 bp, Homo sapiens
aaataaataaataaataaaaacaatccttcccaaggccagaagacactagaattatgactatactttacctcaacttgcttttctcatacctgatgcagtrgtctcaggactagggatgcaaataaaagtccaggcacaggaattattcctgagcaagaaaccgttaacatatttaaaaaccattatgcaagactgcctaa

SEQ ID NO: 23927 - DNA, 201 bp, Homo sapiens
gtctttgcccctagtccctgacaggcaggtcctaaaacgcttgcagtccctcagtgataagcatgattttaatatggcaatgagatgactatggggtgagrggctcctagatagtttcaggatggaggctgcttgccagaaacaccagctgtgattagaggattggaactttcactgccatccccatcctctggggaagaa

SEQ ID NO: 23928 - DNA, 201 bp, Homo sapiens
aaaaatgtagaatcagaaaattcaggcactttgcactcctcatgggacactccagcagcactcacgtgaccatcctgagaatggacaggacacctgaggtrgggaagggagcacagaacccagacaccagcctggacacaggcacctgggataatctcctattccttggaaagttccagtatctgagggaggaacagtgac

SEQ ID NO: 23929 - DNA, 201 bp, Homo sapiens; identical to SEQ ID NO: 1916

SEQ ID NO: 23930 - DNA, 201 bp, Homo sapiens
aatacatcagtcagctggatgaaggaggcaggtgtgagccagcaaaaaaaagcttgtgattttattggagcatgaatttaaaagtgttgatgtggctgggygcggtggctcatgcctgtaatcccagcactttgggaggccgaggtgggtggatcacgaggtcaggagtacgagaccagcttgaccaacatggtaaaaccc

SEQ ID NO: 23931 - DNA, 201 bp, Homo sapiens
agctggatgaaggaggcaggtgtgagccagcaaaaaaaagcttgtgattttattggagcatgaatttaaaagtgttgatgtggctgggcgcggtggctcaygcctgtaatcccagcactttgggaggccgaggtgggtggatcacgaggtcaggagtacgagaccagcttgaccaacatggtaaaaccccatctctactaa

SEQ ID NO: 23932 - DNA, 201 bp, Homo sapiens
cttgaccaacatggtaaaaccccatctctactaaaaatacaaaaattagccgggcatggtggcagacgcctgtaatcccagctacttgggaagctgaggcrgagaattgcttgaacccaggaggcggagattgcagtgagctgagatcatgccactgcactccagcctgggtgacagagcgagactccatctcaaaaaaaa

SEQ ID NO: 23933 - DNA, 201 bp, Homo sapiens
aaaattagccgggcatggtggcagacgcctgtaatcccagctacttgggaagctgaggcagagaattgcttgaacccaggaggcggagattgcagtgagcygagatcatgccactgcactccagcctgggtgacagagcgagactccatctcaaaaaaaaaaaagtgttgatgtacctaccttgcaaggaggtagataggt

SEQ ID NO: 23934 - DNA, 201 bp, Homo sapiens
tgccaaccttgctctgtgtgtgtgtgtatgtgtgtgtgtaggtgtgtgataacagccatcctgattggtttcaggtggcatctcattgtggtttggatttrcattttcctaatgagtgctgatattgagcatcttttcatgtgtttgttgatcatttgtaattttctttgaagaattggccatttaagtcttttgcccatt

SEQ ID NO: 23935 - DNA, 201 bp, Homo sapiens
ctgtaatcccagctacttgggaagctgaggcagagaattgcttgaacccaggaggcggagattgcagtgagctgagatcatgccactgcactccagcctgsgtgacagagcgagactccatctcaaaaaaaaaaaagtgttgatgtacctaccttgcaaggaggtagataggtagacagaagcatggatagatggatggat

SEQ ID NO: 23936 - DNA, 201 bp, Homo sapiens; identical to SEQ ID NO: 4462

SEQ ID NO: 23937 - DNA, 201 bp, Homo sapiens
aaatggcttgagactggcatcaggagtgggaggcttgagactggcatcaggagtgggagggggacagtcatggggactgagctctcaacccatgggatgcratgctatctccagggaaagagtggcagaattcagttagaggacacccagctggtgtccatcacagaactgattgcttgtttgttggagaaattccctaca

SEQ ID NO: 23938 - DNA, 201 bp, Homo sapiens
ctgaggcagagaattgcttgaacccaggaggcggagattgcagtgagctgagatcatgccactgcactccagcctgggtgacagagcgagactccatctcaaaaaaaaaaaagtgttgatgtacctaccttgcaaggaggtagataggtagacagaagcatggatagatggatggatattctttttctgtgtttttctatt

SEQ ID NO: 23939 - DNA, 201 bp, Homo sapiens
gtgtcttttaaaatatctttttaaataaactggtaaatatatgtaagtgttttcctgagttctgtgagccattctagcaaattaatcaaacctgagaaacrggttatgggaacactgatttaaagcaagttagttagaaacacgggcaaaatggcttgagactggcatcaggagtgggaggcttgagactggcatcaggag

SEQ ID NO: 23940 - DNA, 201 bp, Homo sapiens
ggatgaaagttggggaatttgggaagggaatgggggcagcatctccatctacacccataagtgctgcccaagcaagggtcaaacgcccagctgtggcatcytcctgctgcaggtgaggagtgggcagcagggagggctgcggcgcctgctctgtccccatcccggtctctgtgtctcttgaactcactagggcgcatccag

SEQ ID NO: 23941 - DNA, 201 bp, Homo sapiens
ccctccttagaggggagcagggcttcactggctctgccctttcttctccagtgccccccatggtgaatgtcacccgcagcgaggcctcagagggcaacatyaccgtgacatgcagggcttccagcttctatccccggaatatcatactgacctggcgtcaggatggggtatctttgagccacgacacccagcagtgggggg

SEQ ID NO: 23942 - DNA, 201 bp, Homo sapiens
tcagtctgtgagctccaaccttggggcctcggtccaggaaggagggaggctccagagagcagaagggagatgaaatggatcataagagaagaaggaatcayaccaaacactggaactgtaggtcaattaaacctttttctttataagggggggggaggaagaggaggaggaaaaaggaggagggtgaaaggagtcagggag

SEQ ID NO: 23943 - DNA, 201 bp, Homo sapiens
ggctgcggcgcctgctctgtccccatcccggtctctgtgtctcttgaactcactagggcgcatccaggtggggtgagctgggaatcacgtgctgaatgctragggcctggatgatcacggcctcagagggagcaaatagtaaaggcagctgtgatctggggagggccagaaactggagaggaatctgaggagaggcggtgc

SEQ ID NO: 23944 - DNA, 201 bp, Homo sapiens
cccacaactgattgactggacttttgtctcagggcagagggaggcctccagaccaaaacagcaggatcaggtctggagctgactcaaccccaaacccttgmtaatgcacgacccagtcccccagcctccaggatgggaccttggcctcctgtcccctcccttgttcctgccactgctcctgcaggtggaggctgctcatcc

SEQ ID NO: 23945 - DNA, 201 bp, Homo sapiens
ccccctcccctgtttctccagccatcggggcggacaccgagaaaaagacctatgaggcccagcctgggggccctgcctgtgtagccctttggagacccctwgtaacagggagggtcctgagcacacatggccatctctgtccactttgcagctccccatgcacctcctccaggagctttcttggggttgtcgtgtcctctg

SEQ ID NO: 23946 - DNA, 201 bp, Homo sapiens
agacctatgaggcccagcctgggggccctgcctgtgtagccctttggagaccccttgtaacagggagggtcctgagcacacatggccatctctgtccactktgcagctccccatgcacctcctccaggagctttcttggggttgtcgtgtcctctgcaccattcgaggccctactctttccaggttcccacggcctggcct

SEQ ID NO: 23947 - DNA, 201 bp, Homo sapiens; identical to SEQ ID NO: 4624

SEQ ID NO: 23948 - DNA, 201 bp, Homo sapiens
gtccaggctgaggtggcctcagatggagatgagaaacttgttgggagctggaataaaggtgattcttgctacgctttagcaatgagactggcagcattttkcccctgccctagagatatgtggaactttgaacttgagagagatgatttagtgtatctgccagaagaaatttctaagcagcaaagtgttcaagaggaagca

SEQ ID NO: 23949 - DNA, 201 bp, Homo sapiens
tactattttattcatcatgcaggttgttgccttaataccttgttttttccatttcatagtgttgttgaagagtgatggctaaatgtatccagcataattcrcctacacttagttttctagataattgagttgggtggccccattttaataatgacaaacatgaaattctaaatgcaatatcatcttggagagattatttga

SEQ ID NO: 23950 - DNA, 201 bp, Homo sapiens
ttggaacccctagtgttaggtgcatatatattaaggattgtgatactttcctgttagactaatccttttgtcattatatagtgttcctctttgtctttttytttttaaactgttgttgctttaaaggctgttttgtctgatataacaatagctactcctgctcacttttggcttccatttgcatgaaatatttccacccct

SEQ ID NO: 23951 - DNA, 201 bp, Homo sapiens
ttgctgtattccagggttttaataggttgtgtcactattatcattcagttcaaagaatttttaaatttccatcttgattttaatgttgactcaaagatcaytgaagagcaagttatttaatttccatgtattcacacagttttgagggttcctttggagttaatttccagtttcagtccactgtggtctgagagagtactt

SEQ ID NO: 23952 - DNA, 201 bp, Homo sapiens
gcttcactggctctgccctttcttctccagtgccccccatggtgaatgtcacccgcagcgaggcctcagagggcaacatcaccgtgacatgcagggcttcyagcttctatccccggaatatcatactgacctggcgtcaggatggggtatctttgagccacgacacccagcagtggggggatgtcctgcctgatgggaatg

SEQ ID NO: 23953 - DNA, 201 bp, Homo sapiens
cttcactggctctgccctttcttctccagtgccccccatggtgaatgtcacccgcagcgaggcctcagagggcaacatcaccgtgacatgcagggcttccrgcttctatccccggaatatcatactgacctggcgtcaggatggggtatctttgagccacgacacccagcagtggggggatgtcctgcctgatgggaatgg

SEQ ID NO: 23954 - DNA, 201 bp, Homo sapiens; identical to SEQ ID NO: 1926

SEQ ID NO: 23955 - DNA, 201 bp, Homo sapiens
gcccactggagaacagcttcttggagattgcatgctaagtagaaatgtcacaggctccatagtgtgaggagatgttggaatttcagccctgcaaaacctgygttgagacatcaggatggggaagccgtgtaagtgaggaccgtgaccttggagtaagaaccacactgaaatagactcaccctagcaaaggctaaaatcaag

SEQ ID NO: 23956 - DNA, 201 bp, Homo sapiens; identical to SEQ ID NO: 4636

SEQ ID NO: 23957 - DNA, 201 bp, Homo sapiens
ttgcatgctaagtagaaatgtcacaggctccatagtgtgaggagatgttggaatttcagccctgcaaaacctgtgttgagacatcaggatggggaagccgygtaagtgaggaccgtgaccttggagtaagaaccacactgaaatagactcaccctagcaaaggctaaaatcaagaggaagcagaatcaaagtgggtctgat

SEQ ID NO: 23958 - DNA, 201 bp, Homo sapiens
gaaagatggtcagagaatggaaagtgtgagatagagagtatggaagggctggggttcttggccatgatgagacctaggactctttaggggagaacaacaamaaagcaacaggatcctggtgtcagggacagaccatggccatggcgggatgatagcagctctcctacgaaataatgcttatatgacaagggcatgagattc

SEQ ID NO: 23959 - DNA, 201 bp, Homo sapiens
ccccaggatcctatgtggacatgccagctagttcctgcaaagctcctgagtggaattcccgctgcattataagggtgaggcttctgcagcatcttccagcrtaggaagtgggaaccattactggaaaaggcgagccttctctgcatgcccagagggtactggagggcacccatctgataatgctgtcctagtttgcagaat

SEQ ID NO: 23960 - DNA, 201 bp, Homo sapiens; identical to SEQ ID NO: 1917

SEQ ID NO: 23961 - DNA, 201 bp, Homo sapiens
ttttatttttattttttgagcaatctcagctcactgcaacctccacctcccaggtgcaagtgattctcatgcctcagcctcccaagtagctgggattacaygcatgcaccaccaaacctggcaaatttttgtctttgtagtagaggcgggttttcaccatgttagctaggccggtctcaaactcctgacctcatgtgatct

SEQ ID NO: 23962 - DNA, 201 bp, Homo sapiens
tgggattacaggcgtgagccactgtgcccaaccagactgcaatgcaagtttaaaccccagtgaaggagagagggaaggaagtttggctgaaagtatcctasacccagtgcaggttaagagaagttcagtaagggtgagccctggagcctcagtgggcctttaaaggagggacaatcctgtctttgtttctcctcttctctc

SEQ ID NO: 23963 - DNA, 201 bp, Homo sapiens
aggtactattttattcatcatgcaggttgttgccttaataccttgttttttccatttcatagtgttgttgaagagtgatggctaaatgtatccagcataaytcacctacacttagttttctagataattgagttgggtggccccattttaataatgacaaacatgaaattctaaatgcaatatcatcttggagagattatt

SEQ ID NO: 23964 - DNA, 201 bp, Homo sapiens
tgtcttctatagtggctgtactaatttaaattcctatcaacagcgtacaagagttcccttttctccacatcaccagcatctgttattttattttattttatttattttatttttgtcttttcagttgtggctattctatctggggtaagatgacatctcattgtggttttgatttgcatttccctaatgattagtgatgtt

SEQ ID NO: 23965 - DNA, 201 bp, Homo sapiens
ctgtttttatatcaataccattctgttttggatactatagccttgtaatgtattttaaagtcaagtagtgtgatggccctagctttgttctttttgctcargatttctttggctatttggactttttaaaaatgttttgggtccatagaaatattagaattattttttctaattctgtggaaaaataaccttggtattttt

SEQ ID NO: 23966 - DNA, 201 bp, Homo sapiens
gcctggcctccctgagtttcttgcagatgacatggatgagtagataagcagatgtccctgggccatttgaggagtggggcccagcccctcatcagggcagwtgtggtccctgttttcatcctacctccgagtgttttcttctccagtccctgagggacacagtcctcagggcccatgtttttggggatttaatctgtgctc

SEQ ID NO: 23967 - DNA, 201 bp, Homo sapiens
tcctacctccgagtgttttcttctccagtccctgagggacacagtcctcagggcccatgtttttggggatttaatctgtgctctgtggcctcaccttgccytccctgagccaatttccctttctaaaggtggtcactgcctggtaagtttggagtaagggacggtcagaatcatttcccctacagtcaggttgtttgatgg

SEQ ID NO: 23968 - DNA, 201 bp, Homo sapiens
tcgacctccctgtctgaagcaatcctccagcctcagcctcatgagtagctgaaactacaggaacatgccaccatgcccaactaattttttaaaaaattttkttgtagagatgaggtatcactatgttgccgaggctggtctcaaactcctgggttcaaacaattcacccaccttggctccccagaatgctgggattacagg

SEQ ID NO: 23969 - DNA, 201 bp, Homo sapiens
ctaattgcactgtcaatcggcccctcaggcctgagcagatgggaaggtttgtcccctgccctgcagcaagagggccctgtccaggaggcacccacaacagrggcagtgcaggtctgtggtcactcctgctctcacctgtggcgtctcccgtagagggattgtcagttctggttccctgtgggcaggaatggtttcctcata

SEQ ID NO: 23970 - DNA, 201 bp, Homo sapiens
tgagatagcttctgagaaatgagtccttaggtgattttgtcatgtgtggacatcatagagtgtccttacatgaacctagatggtataacctacttcacacytaggctacgtgataagcccattgcttctaggctacaaattatatagcatgttaccgtatggaacattgcagccaattctaacacaatggtaagtatttgt

SEQ ID NO: 23971 - DNA, 201 bp, Homo sapiens
aagcaatcctccagcctcagcctcatgagtagctgaaactacaggaacatgccaccatgcccaactaattttttaaaaaatttttttgtagagatgaggtrtcactatgttgccgaggctggtctcaaactcctgggttcaaacaattcacccaccttggctccccagaatgctgggattacaggcctgagccacgtaccc

SEQ ID NO: 23972 - DNA, 201 bp, Homo sapiens
ggcctgagcagatgggaaggtttgtcccctgccctgcagcaagagggccctgtccaggaggcacccacaacaggggcagtgcaggtctgtggtcactcctrctctcacctgtggcgtctcccgtagagggattgtcagttctggttccctgtgggcaggaatggtttcctcataggtcactggagttttggccaggaaaag

SEQ ID NO: 23973 - DNA, 201 bp, Homo sapiens
ttatatttttagtagagatggggttttgccatgttacccaggctggtctcaaacttctaggctcaaacgatccacccacctcagcctcccaaagtgctggkattacaggcatgaggcactgtgccagccttttttttttttcacatctgctggaatggaaaatatttcttaaatgagacacaaatgtatcaaattgaaaat

SEQ ID NO: 23974 - DNA, 201 bp, Homo sapiens
tcccgtagagggattgtcagttctggttccctgtgggcaggaatggtttcctcataggtcactggagttttggccaggaaaagagtatgaagttcatgtgscagtttctcaaaattcctgctttcaatgttgatgtccagtaaagatattcgtaatttcagctctataatcttaataggatttcctctaatattgtgaagc

SEQ ID NO: 23975 - DNA, 201 bp, Homo sapiens
tgttattattattttctatgtccgttgttgtaagaagaaaacatcagctgcagagggtccaggtgagaaaagcgggcagtttctggagatggtaaggcccytgtctgggcagtagggtcccctcattgctcctgcaaagataggcatgttggtgacaaggcttccgtaacaggggatgaaagttggggaatttgggaaggg

SEQ ID NO: 23976 - DNA, 201 bp, Homo sapiens
ctggcaggggctgggaaaagcaaggagggaggaagaaaaaagtgggggcctcatcttccctcagagaaagggcaaatctggttttggagcaactgaagagwgaaaagtccccagggaataaacacaacactgcacccagtggagcatttacccatttccctcttttctccagagctcgtgagcctgcaggtcctggatcaa

SEQ ID NO: 23977 - DNA, 201 bp, Homo sapiens
cccggtcttcctgcttctggctggcatcttcccttttgcacctccgggagctgctgctggtgagtggcgttcctggcggtcctcggcggagcgggagcagygggacgtttccgggggtcgggtgggtagcggcgagcgctgtgcggtcagggcggggctcctgtgccctgtcggtggcgcagggagctggacgcggcccgt

SEQ ID NO: 23978 - DNA, 201 bp, Homo sapiens
atagtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatctcattgtggtttggatttgcattttcct

SEQ ID NO: 23979 - DNA, 201 bp, Homo sapiens
agtgttttccattgcaggcgtgccattttgtatttctagaagcagtatacaggggcttcagtttctctacctccttgccaaacttgctgtttgtgtgtgtgtgtgtgtgtgtgtgtgtgtgtgtgtgtgtgtgtgtgataatagccaccctgattggtttgaagtggtatctcattgtggtttggatttgcattttcctaa

SEQ ID NO: 23980 - DNA, 201 bp, Homo sapiens
tcctcaggctgagaatctccccctctaccttggttttctctctctggccagcacccccactccttgctttgtttttaatttttaacttttgtttgggtacrtagtagatatgtatgtatatatttatggggtacatgggatattttgacacaggcctacaatatgtcataatcacatcagggtaaatgggttatctatcac

SEQ ID NO: 23981 - DNA, 201 bp, Homo sapiens; identical to SEQ ID NO: 4605

SEQ ID NO: 23982 - DNA, 201 bp, Homo sapiens
ccctatgcctccccgttcccaaatgtccctgactctaactttctggtgctgccttttatccgggggggtcttccctccatcccactcccctccagaccccyaaggggaaccctgatgctaatggcagttgggccttaggcagggcgcagggcagcgcagatgccccctcccctccagtgcagatgcctgctctggaccctg

SEQ ID NO: 23983 - DNA, 201 bp, Homo sapiens; identical to SEQ ID NO: 4607

SEQ ID NO: 23984 - DNA, 201 bp, Homo sapiens
cccctgtctgggcagtagggtcccctcattgctcctgcaaagataggcatgttggtgacaaggcttccgtaacaggggatgaaagttggggaatttgggamgggaatgggggcagcatctccatctacacccataagtgctgcccaagcaagggtcaaacgcccagctgtggcatcctcctgctgcaggtgaggagtgggc

SEQ ID NO: 23985 - DNA, 201 bp, Homo sapiens; identical to SEQ ID NO: 1920

SEQ ID NO: 23986 - DNA, 201 bp, Homo sapiens
ccgttgttgtaagaagaaaacatcagctgcagagggtccaggtgagaaaagcgggcagtttctggagatggtaaggcccctgtctgggcagtagggtcccytcattgctcctgcaaagataggcatgttggtgacaaggcttccgtaacaggggatgaaagttggggaatttgggaagggaatgggggcagcatctccatc

SEQ ID NO: 23987 - DNA, 201 bp, Homo sapiens
acagaaaggactgggaagggatggaggtgggacatctggcactgaccttcaggggctgaccctgtgggggaacatctgccctgaagagttggagccttcaygtgatgacacagagctgaagtgtgatattcgggaggggatagagagtgcttggaggttttctgattttgaagaatcccagtcagtcaggttctggcgtaa

SEQ ID NO: 23988 - DNA, 201 bp, Homo sapiens
gttggagcctttggcaggcccacatagttgaatcacagcagaggcctccaggattttggagcaaggccctgccatcttctgcagataactactctcctttygagagacagctcttagcctgttactgggctttggtagaaactgaacatttgactatgggtcatcaagtcaccatgcaacctgaactgcctatcatgaact

SEQ ID NO: 23989 - DNA, 201 bp, Homo sapiens
aagtgactgctggggaggtgtggactgaatgaatgaagaataaatgaaccaggaaagtggacatgcaagaggtgggttattcctcaccctatttcttgatrcctcctgactgctggtgttggggcacacagatgggtgatgcacttcttggtcaaggcaacctcagccccacccacgtaaggtggtcatggcagagagtgt

SEQ ID NO: 23990 - DNA, 201 bp, Homo sapiens; identical to SEQ ID NO: 4459

SEQ ID NO: 23991 - DNA, 201 bp, Homo sapiens
gaggacatcaagggtgagggacagtgagtagatggcaggatcactggattgggaatcccagagtgggtggaaggattgttggaattgatgtactacagggmagactccaagcctggaaagcaggcacataggcaatgagtggttcactgatattacgtcacagcatatgataaaatgatagtataagtatcctcagagcct

SEQ ID NO: 23992 - DNA, 201 bp, Homo sapiens
ctataaactattgggggttcgtccattttggagttataacctaaggcagaaactcagatggttcaaatgtcctcttcatgaagcaatgttatcagcgtatmatttagattgtcttgcaagagtctcatttgttgtttttctaaatgcctgccaatattgtttgaaaatctacaaatgtgataaatgtatcttcaaagttaa

SEQ ID NO: 23993 - DNA, 201 bp, Homo sapiens; identical to SEQ ID NO: 12738

SEQ ID NO: 23994 - DNA, 201 bp, Homo sapiens
gggtgagtgagtgagtggtgagtgaatgtgaaggctagggcattactgtacactacttagactttataaacttaggctacactaaattgattttaacattktctttctttaataataaattaacttattaataattaactaataattttattatttatttattaacaattaataactaattaataattagttaccatagct

SEQ ID NO: 23995 - DNA, 201 bp, Homo sapiens
tttaataataaattaacttattaataattaactaataattttattatttatttattaacaattaataactaattaataattagttaccatagctttctgtraccttttgaacttttttgttttattattatactttaagttttagggtacatatgcacattgtgcaggttagttacatatgtatacatgtgccatgctggt

SEQ ID NO: 23996 - DNA, 201 bp, Homo sapiens
tataaatagcactcattaacgttgatatttcttctatttgtattactcctttttttgggatggagtctcactctgttgtccaggctggagtgcagtggtgygatcttggctcaccacaacctccgcctcccaggttcaagcaattctcctgcctcagcttcccgagtagctgggattacaggcactcaccaccatgcccag

SEQ ID NO: 23997 - DNA, 201 bp, Homo sapiens
aatcaaagtgggtctgatttttactaaaggtgattctttgataattacctaactgtcaaactattaccagtctttggaggaagataacaaaacccagagcytctaaaatccatcatgtagaatatgtgccatgccaagcagcagagagaatgcagcaactaaagaagaaataatcaacagaagccaactcaaagatgatct

SEQ ID NO: 23998 - DNA, 201 bp, Homo sapiens
ctccagacccccaaggggaaccctgatgctaatggcagttgggccttaggcagggcgcagggcagcgcagatgccccctcccctccagtgcagatgcctgytctggaccctgcctcattgtggccccttccccactccttcatcctcagcctcaccctcttgaggaccccaccctccagcccacaggtgctggaccatccc

SEQ ID NO: 23999 - DNA, 201 bp, Homo sapiens
aaccctgatgctaatggcagttgggccttaggcagggcgcagggcagcgcagatgccccctcccctccagtgcagatgcctgctctggaccctgcctcatkgtggccccttccccactccttcatcctcagcctcaccctcttgaggaccccaccctccagcccacaggtgctggaccatccctccctggtccctccgccc

SEQ ID NO: 24000 - DNA, 201 bp, Homo sapiens
cttcaaaatatttatgattaatatgttaaggaaaatagaggaaaagatgggcaaactatttcaaaattcccagaaagattaatcataagaagagagaaaamacaaatgaacactatgagaagggacattataaaactgtagattttattaaaacaaaaataagagaaagttagacacaacttcatggaaagagcttttaaa

SEQ ID NO: 24001 - DNA, 201 bp, Homo sapiens
cagatgccccctcccctccagtgcagatgcctgctctggaccctgcctcattgtggccccttccccactccttcatcctcagcctcaccctcttgaggacsccaccctccagcccacaggtgctggaccatccctccctggtccctccgcccctctccaccttgggaccttgtgctgctcctatctcttgcccagctgcct

SEQ ID NO: 24002 - DNA, 201 bp, Homo sapiens
gcctgctctggaccctgcctcattgtggccccttccccactccttcatcctcagcctcaccctcttgaggaccccaccctccagcccacaggtgctggacyatccctccctggtccctccgcccctctccaccttgggaccttgtgctgctcctatctcttgcccagctgccttgggccctcagcacgttctcatctttca

SEQ ID NO: 24003 - DNA, 201 bp, Homo sapiens
gctgggattacagaggtaagccactgcacccagccgtattactcttttaagaaattacagactttggatattccactttaccttcttggaaatgtccctcytgggcccttctcgctgctcccatctggactggaggcttctccctgtggagcagagtcactgtcctaggatctccctccaccgccatctggggcagtgctt

SEQ ID NO: 24004 - DNA, 201 bp, Homo sapiens
cctcaccctcttgaggaccccaccctccagcccacaggtgctggaccatccctccctggtccctccgcccctctccaccttgggaccttgtgctgctcctrtctcttgcccagctgccttgggccctcagcacgttctcatctttcagtgggaaagtgggagtgctggagcatatgacagtgctgagcatctttcccaagc

SEQ ID NO: 24005 - DNA, 201 bp, Homo sapiens
ccagccgtattactcttttaagaaattacagactttggatattccactttaccttcttggaaatgtccctcctgggcccttctcgctgctcccatctggaytggaggcttctccctgtggagcagagtcactgtcctaggatctccctccaccgccatctggggcagtgctttacatgcagtggagccacctggggtccag

SEQ ID NO: 24006 - DNA, 201 bp, Homo sapiens
cttctcatggctattttgcccatttttgagtgggttgactgttttgttgtttttgtcaaacttttttgcatattctggaaactaatctctctctttttcttttttttttttttttttttttttgagatggagtcttgctctgttgcccaggctggagtgcagtggcacgatctcagctcactgcaagctccgcccgctagc

SEQ ID NO: 24007 - DNA, 201 bp, Homo sapiens
cctctcccaaaacctggagactgaggaatggacagtgccccagtcctccagagctcagaccttggccatgaacgtcaggaatttcttgaaggaagatgccrtgaagaccaagacacactatcacgctatgcatgcagactgcctgcaggaactacggcgatatctagaatccggcgtagtcctgaggagaacaggtaccga

SEQ ID NO: 24008 - DNA, 201 bp, Homo sapiens
tcctcaggctgagaatctccccctctaccttggttttctctctctggccagcacccccactccttgctttgtttttaatttttaacttttgtttgggtacrtagtagatatatatgtatatatttatggggtacatgggatattttgacacaggcctacaatatgtaataatcacatcagggtaaatgggttatatcacaa

SEQ ID NO: 24009 - DNA, 201 bp, Homo sapiens; identical to SEQ ID NO: 4630

SEQ ID NO: 24010 - DNA, 201 bp, Homo sapiens
gccagcacccccactccttgctttgtttttaatttttaacttttgtttgggtacgtagtagatatatatgtatatatttatggggtacatgggatattttsacacaggcctacaatatgtaataatcacatcagggtaaatgggttatatcacaacaagcatttatcctttctttgtgctacaaacaatcccattatgctc

SEQ ID NO: 24011 - DNA, 201 bp, Homo sapiens
gagaaaagcgggcagtttctggagatggtaaggcccctgtctgggcagtagggtcccctcattgctcctgcaaagataggcatgttggtgacaaggcttcygtaacaggggatgaaagttggggaatttgggaagggaatgggggcagcatctccatctacacccataagtgctgcccaagcaagggtcaaacgcccagct

SEQ ID NO: 24012 - DNA, 201 bp, Homo sapiens
atgtactgtgcatagctgtatatgctagactttttataggactggcagtgcagtaggtttgttgacagcagcatcaccacaaacacatgattaatgcatcrtactatgaggttatgatggcttcaatgtcactaggtgataggaatttttcaggtccattaaactctcatgggacgacagtcatatatgcaattcatcatt

SEQ ID NO: 24013 - DNA, 201 bp, Homo sapiens
ttttgttgccattgcttggtgttttagacatgaagtcctttataaactttttaaacttttctactcttttgtaatagcacttagcttaaaacgtcaacacrttatacagctctacaaaaatatttttctttatattcccattctagaagcttattcctatttaattatctttaccttttaatcttttttggtaaaaataaa

SEQ ID NO: 24014 - DNA, 201 bp, Homo sapiens
tattaaaacaaaaataagagaaagttagacacaacttcatggaaagagcttttaaaatttaggtatagtgacatgagttcttgaaaaagacggttgaacaragccaacagaaaactaagtagaaaatataaataatcctatatccattaagaaattgagttctaaatacattccttcccaccagagaaactccatgcccag

SEQ ID NO: 24015 - DNA, 201 bp, Homo sapiens
gccaacagaaaactaagtagaaaatataaataatcctatatccattaagaaattgagttctaaatacattccttcccaccagagaaactccatgcccagayttcttcacctgtcaattctttcaaaaactttttaaaaggcatgtcagccttatacagtcttcctctggtaccttttgggatgggttctagggcacctgtg

SEQ ID NO: 24016 - DNA, 201 bp, Homo sapiens
actgtattgcttaggaaataatgacaagaaaaatgtctatacatcttcagtacagacataaccactgtaggtactcctaactacagagtatacatcagcarcaacataacattttcaatcctaaggttgttgaattcacagatgtggaactcacagacatgaaaggcagactgtgtgctatggtttggctgtttgcccacc

SEQ ID NO: 24017 - DNA, 201 bp, Homo sapiens
ctatggtttggctgtttgcccacccaaatctcatcttgaattgtagttatcataatccccacgcgttgttggagggactcgatgggagacaatttaatcawgggggtggttcccctcatgctgttctcatgatagtgtgttctcacaatacttcatggttttataaggggctttttctgcttcggtttggcacttctcctt

SEQ ID NO: 24018 - DNA, 201 bp, Homo sapiens
cccctcctggaaatattgttgccaaatgtttaacccagatctgcctcggtctttaggaaacacagcagagagaagagcaaagtaaaaggcatcaggggaamtaatatgataaattcggtgtggagagcatgctaaagttatttggcctgcaataagtaatgctgttctaaaagaaaaaaggattagtggattgttgtagat

SEQ ID NO: 24019 - DNA, 201 bp, Homo sapiens
aaaatctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctt

SEQ ID NO: 24020 - DNA, 201 bp, Homo sapiens
aaggagtgagtttaggagtagaggtttaataggcaaaagaaaagaaagagaaagaagaatagctctctctcctgtgagagaaggggcacgcaagtgggaaytccagcccatggcagagtgcactggattttatacacaggctgaaagaggtgtctgatttgcacagggcccacagattggttggaccaggtgtgatgttta

SEQ ID NO: 24021 - DNA, 201 bp, Homo sapiens
aaatctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactccttt

SEQ ID NO: 24022 - DNA, 201 bp, Homo sapiens
gtagggtcccctcattgctcctgcaaagataggcatgttggtgacaaggcttccgtaacaggggatgaaagttggggaatttgggaagggaatgggggcarcatctccatctacacccataagtgctgcccaagcaagggtcaaacgcccagctgtggcatcctcctgctgcaggtgaggagtgggcagcagggagggctg

SEQ ID NO: 24023 - DNA, 201 bp, Homo sapiens
tggctttttttttcactcagcatgattccctaaagattcaaggattcatttacattcttggatgtatctatcaatagattgttggtttttttgtttttttkttgttgttttttttaattatactttaggctctagggtacatgtgcacaacgtgcaggtttgttacatatgtatacatgtgccatgttggtgttctgcacc

SEQ ID NO: 24024 - DNA, 201 bp, Homo sapiens
ccccactataaacttctctagggctacaaccttcctaccccttgtgcctcatgaccaccccctcccttgtccccaccatgcccatgatgagtcttttctcraggcagctcgccttgcctccatctcaccctcacctgtgcaccacagccacactggacatgggtccctctgagcctgagtcccttcccattcccactgtcc

SEQ ID NO: 24025 - DNA, 201 bp, Homo sapiens
tctcaaggcagctcgccttgcctccatctcaccctcacctgtgcaccacagccacactggacatgggtccctctgagcctgagtcccttcccattcccacygtcccctctggcaagaccttccttccaacactgccttcatgctcctcccttgcccctgcagggcagcctctccccttggcccctattcccttagggggct

SEQ ID NO: 24026 - DNA, 201 bp, Homo sapiens
gttgagattcgaatggggacacagccaaaccgtatcactggatgagagcaattagattgatgtcatgatgtatatgggtccatgggaacttgaaaaagtcttccccttccacctagtttaacaagataaacaggaaaggaacttcccttaagggaagatattgactctatccctgaaattaaatcacaagaaaataagaaa

SEQ ID NO: 24027 - DNA, 201 bp, Homo sapiens
cacacttgcccagaatgtccaacaatggtcagagaaatttgttcctcagaagaagagtttcagagagaattaaaatagtcatttgaaacattgagtgtatraatcaggagcggggagacataagcatgaagggcgggcctatacaccttcatgagtgtgctcgctcttgacatgagtgtggacaaaggaatgtccccacta

SEQ ID NO: 24028 - DNA, 201 bp, Homo sapiens
aaacagaagggaaacacaactaggattcctgtagtgtagggaagggaaatgcctagcccagctctctgattccccttttaatgggtttgagctgcaatatgggtgcagaagagcctcccacagcgccactggtggtggaggaaatagcccctctcattggcccattttcacgctgctgataaagacatactgggaagaaaa

SEQ ID NO: 24029 - DNA, 201 bp, Homo sapiens
atggcggcaggtgaaaggcacttcttacatggcagtggcaagagaaaatgaggaggaagcaaaagcggaaacccctgataaacccattagatctcgtgaghctatcacaagaataccacgggaaaaactggccccagtgattcagttacctccccctgggtccctcccacaacatgtgggaattctgggagataccattca

SEQ ID NO: 24030 - DNA, 201 bp, Homo sapiens
ttgacaaacattgctatggagacctctccaatcttaataaagttccaagaggagtgaagcaaagaccagcctctaagctgatctttttgggggctatcatrcatgtcaaaggacacaaacacaattctttgaaaagaaagttcattttgccttttctggcatcaggaaactacaccaggaatgtgggacaccgtccccatg

SEQ ID NO: 24031 - DNA, 201 bp, Homo sapiens
gcagtttagacgtccaccttaaccttcactggctgcttacttggaggctaaagatcacccagaggtaaaagcctaaggtcatctcaggtctttttaaagartgtgggcatccagggctaaatatccagtgtttagccctggccatgtatgtgacattctgatttcctcagtatatgcgggatattttgaaagccatattgc

SEQ ID NO: 24032 - DNA, 201 bp, Homo sapiens
atctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttca

SEQ ID NO: 24033 - DNA, 201 bp, Homo sapiens
accctgtgggggaacatctgccctgaagagttggagccttcatgtgatgacacagagctgaagtgtgatattcgggaggggatagagagtgcttggaggtyttctgattttgaagaatcccagtcagtcaggttctggcgtaaagtgactgctggggaggtgtggactgaatgaatgaagaataaatgaaccaggaaagtg

SEQ ID NO: 24034 - DNA, 201 bp, Homo sapiens
tctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttcat

SEQ ID NO: 24035 - DNA, 201 bp, Homo sapiens
gattaacatttgagacagtggaccagggaaggcagatccattcttaatctggtgggcacagtctaatcagctgccagcaaatataaagcaagaagaaaaayttgaaaaggagagagactggcctagcctcccagcctacatctttctcccatgctggatgcttcctgccctcgaacatcagattccaagttcttcagtttt

SEQ ID NO: 24036 - DNA, 201 bp, Homo sapiens
ctactggcaatggaatctttcagttagttgttaattaactggaaacatctcaatttctccttcatttattttaatttattaattgtgataaaatgcacataacataaaatttaccatcttaaccatttgtagtggtagtgttcagtagtgctaagaacactcacactgttttgcaaaccaatctccagaactcctttcata

SEQ ID NO: 24037 - DNA, 201 bp, Homo sapiens
gtgcaggtttgttacatatgtatacatgtgccatgttggtgttctgcacccattaactcttcatttacattaggtatttctcctaatgctttccctccccmctcttccctcccccaaccccacgacaggccccagtgtgtgatgttctccaccccgtgtccaggtgttctcattgttcaattcccacctatgagtgagaat

SEQ ID NO: 24038 - DNA, 201 bp, Homo sapiens
ctgcatattttcatttttgaagaataagttttctagatatagaacttttggttgacagctttatttttgtagcactttaaacatgtcataccactctgacwttcctcagtgttttctggtatgaaattggctgttaatctcaatgaggatcccttgtacatgatgcattatttgtttcttgctgctgtccaagttctctct

SEQ ID NO: 24039 - DNA, 201 bp, Homo sapiens
tactagtttacattcctgccagctgtgtaaaagtgttccctttttaccacatccacaccaacacctattatttttttatttttcaattatggccactattrcagaagtaaggtggtattgcattgtggttttcactggcatttccctgataattagggatgctgagcatttttttatgtttgctggccatttgtatatcct

SEQ ID NO: 24040 - DNA, 201 bp, Homo sapiens
ggtttaaagtcttggtctagtaagtccaatgacttggcttccttagggacaggttctgctgatgtatttttttctgcaaatgggccactttcttaaacttytaaatacctcaagaattttcgctgaaaactgaacactttgaatacaacaatctagtaactctggataccatattctttccactccccagagtttcttgtt

SEQ ID NO: 24041 - DNA, 201 bp, Homo sapiens
tatttttttatttttcaattatggccactattgcagaagtaaggtggtattgcattgtggttttcactggcatttccctgataattagggatgctgagcatttttttatgtttgctggccatttgtatatcctcttttgagaattttctattcctgtacttagccttctttttgatgggattattcattttcctcttgctg

SEQ ID NO: 24042 - DNA, 201 bp, Homo sapiens
aagtccaatgacttggcttccttagggacaggttctgctgatgtatttttttctgcaaatgggccactttcttaaacttctaaatacctcaagaattttcrctgaaaactgaacactttgaatacaacaatctagtaactctggataccatattctttccactccccagagtttcttgttgccacttgaggatggagttgt

SEQ ID NO: 24043 - DNA, 201 bp, Homo sapiens
tgtttgctggccatttgtatatcctcttttgagaattttctattcctgtacttagccttctttttgatgggattattcattttcctcttgctgatttgttwgagttccttgtagattctggacatcagtcctttgtcaaatgcatagtttgtgtatatgttctccctctctatgggtcgtctgttaactctgttgattatt

SEQ ID NO: 24044 - DNA, 201 bp, Homo sapiens
ccacactggacatgggtccctctgagcctgagtcccttcccattcccactgtcccctctggcaagaccttccttccaacactgccttcatgctcctccctygcccctgcagggcagcctctccccttggcccctattcccttagggggcttgtggccacccagtcctggcacctgacctacaagtttgccatcttcattcc

SEQ ID NO: 24045 - DNA, 201 bp, Homo sapiens
ccactctctcaggtgtggtgagattcctattatatgactatcggtcatctatacatggattgtactctcagagttgcctttatcagtcggccaatgcctahaacccaaagatgggtcaggcatggtggaggaagagttcctttcttaccttctgaaggtgccatcaacaggaatttctaccctgtggagtctagaggagac

SEQ ID NO: 24046 - DNA, 201 bp, Homo sapiens
ttcattcccccttcttctgttcatcagccccctcctctatcctcccaccctcacagttttccttgtatatgaaatcttcgttcttgtccttttgcccatgygcatttcctgcctcctcagggaggtcgggacagcagacctgtgtgttaaacatcaatgtgaagttatttccaggaagaagtttcacctgtgatttcctct

SEQ ID NO: 24047 - DNA, 201 bp, Homo sapiens
gtgtggtgagattcctattatatgactatcggtcatctatacatggattgtactctcagagttgcctttatcagtcggccaatgcctaaaacccaaagatrggtcaggcatggtggaggaagagttcctttcttaccttctgaaggtgccatcaacaggaatttctaccctgtggagtctagaggagactttccttgaagc

SEQ ID NO: 24048 - DNA, 201 bp, Homo sapiens
tatgactatcggtcatctatacatggattgtactctcagagttgcctttatcagtcggccaatgcctaaaacccaaagatgggtcaggcatggtggaggamgagttcctttcttaccttctgaaggtgccatcaacaggaatttctaccctgtggagtctagaggagactttccttgaagctgagttgggaatggacattt

SEQ ID NO: 24049 - DNA, 201 bp, Homo sapiens
aagaaagcagtggaaaactggcctatgaaaagaatgcccatatgagacacagtcctatggaaatcactatggtaatttgaggggtgcattaacgtaagacwtgttgatgcctgatatagattggatgttgtccccacccaaatctcatgtcgagatgtaattcccagtgttggagttggggtctggtgggaggtgactcaa

SEQ ID NO: 24050 - DNA, 201 bp, Homo sapiens
atattctctacttctattaaacttgtcatttcaagaaagtgatatgaatggaatcatgcagtatgtgttcttttgatattggctttttttttcactcagcrtgattccctaaagattcaaggattcatttacattcttggatgtatctatcaatagattgttggtttttttgtttttttgttgttgttttttttaattata

SEQ ID NO: 24051 - DNA, 201 bp, Homo sapiens
caattaaaattatacatatatatatgtttttaaaaggttttttttctggaaatagaatctagtttgacagcagttgtctttcagaactttagcgatgttgstcatctgtccctcatttgcattgtttccaatgaaataactgctgtcatctttattattcttcttatgtgttgtgttttgtgtttttcatttttgctttct

SEQ ID NO: 24052 - DNA, 201 bp, Homo sapiens
tgtcatctttattattcttcttatgtgttgtgttttgtgtttttcatttttgctttctgctttttcaattttctctccttctctggttttgaacaaatacrtgttactctcactcacaactataaagcgaacttaggaaacaatctatagggagagtttgttgatgattggttatacattttcagaaacagttgtttattc

SEQ ID NO: 24053 - DNA, 201 bp, Homo sapiens
gacccataaagagctggttggtttgtgtacagcatttgcaagatgaatggacaacaccctgtttggaagtctacccctttgatcaaagaagataaaaacasaacagctcttgtgggctgaattgcagggtgttttcttagcagtgatggaagaattgaacaatgataaaagctcctatgttttagttttactgacttatgg

SEQ ID NO: 24054 - DNA, 201 bp, Homo sapiens
ctgacttatgggcagtgactgatggcctggccatataattaattaagaaagcagtggaaaactggcctatgaaaagaatgcccatatgagacacagtcctrtggaaatcactatggtaatttgaggggtgcattaacgtaagacatgttgatgcctgatatagattggatgttgtccccacccaaatctcatgtcgagatg

SEQ ID NO: 24055 - DNA, 201 bp, Homo sapiens; identical to SEQ ID NO: 4446

SEQ ID NO: 24056 - DNA, 201 bp, Homo sapiens
atggcttgaacctgggaggcagaggctgcagtgagccgagatggcgccactatactgcacccagggcaacagagcaagactgtgtctcaaaagaagaaaamaaaagaagtattctctttaacaagaaaagagacagagacagagaccaaaaaaaaaaaaaaaaaaacgtgaatgggaggtattgccaccatgtggaccact

SEQ ID NO: 24057 - DNA, 201 bp, Homo sapiens
caacagagcaagactgtgtctcaaaagaagaaaaaaaaagaagtattctctttaacaagaaaagagacagagacagagaccaaaaaaaaaaaaaaaaaaaygtgaatgggaggtattgccaccatgtggaccactgagccacattacactaggaaacacacttgcccagaatgtccaacaatggtcagagaaatttgttcc

SEQ ID NO: 24058 - DNA, 201 bp, Homo sapiens
ttggagcctttggcaggcccacatagttgaatcacagcagaggcctccaggattttggagcaaggccctgccatcttctgcagataactactctccttttragagacagctcttagcctgttactgggctttggtagaaactgaacatttgactatgggtcatcaagtcaccatgcaacctgaactgcctatcatgaactg

SEQ ID NO: 24059 - DNA, 201 bp, Homo sapiens
tcctttcttaccttctgaaggtgccatcaacaggaatttctaccctgtggagtctagaggagactttccttgaagctgagttgggaatggacatttggacttttttttttaagagttagtaactccgtggagaaccacacatttatttgcttactttaattctacagcaacattcgaggtggcttactgcaacaaacccag

SEQ ID NO: 24060 - DNA, 201 bp, Homo sapiens
gctgtgctatctactagatcttattcattctaactatatttttgtacccattaaccatccgcactcccccactccccactacccttctcagcctctggtartcgtcattctattgtctctccccatgaggtccattgttttaatttttggctgccacaaataagtgagaacatgcgaagtttgtctctctgggcctggggc

SEQ ID NO: 24061 - DNA, 201 bp, Homo sapiens
ggcagcagtgaaaggaaatcttcctagtgagcagttcacctggttgtgcagtttgcatggaatgagaaatagccagatgtgcgattatatactgattcatrggctgtagccaatggtttggctggagggtcagggacttggaagaagcatgattggaaaattggtgacaaagaaatttggggaagaggtttgtggatggac

SEQ ID NO: 24062 - DNA, 201 bp, Homo sapiens
gagttgggaatggacatttggacttttttttttaagagttagtaactccgtggagaaccacacatttatttgcttactttaattctacagcaacattcgargtggcttactgcaacaaacccagtgtaataaatacatacgaattactttaaaataacaccaaggaaaatatacattttaaaagattaaggctggggtaaa

SEQ ID NO: 24063 - DNA, 201 bp, Homo sapiens
tcactgctgggtgggggcaggcttgcattccctccaggagattagggtctgtgagatccatgaagacagcagcaccaggggctcccggcatttctactacratggggagctcttcctctcccaaaacctggagactcaagaatcgacagtgccccagtcctccagagctcagaccttggctatgaacgtcacaaatttctg

SEQ ID NO: 24064 - DNA, 201 bp, Homo sapiens
tgcagtttgcatggaatgagaaatagccagatgtgcgattatatactgattcataggctgtagccaatggtttggctggagggtcagggacttggaagaarcatgattggaaaattggtgacaaagaaatttggggaagaggtttgtggatggacctctctggtcaaaacccacaaagatatttgtatcccatgtgagtgc

SEQ ID NO: 24065 - DNA, 201 bp, Homo sapiens
taggaatgggattactgtgcttttaccatgtgatgttataggatgtcaaattgttctctgaagaggttgtatcaactcccccctttaaaatcttctttgayattttacaggtcaagttatcttcctccccaactagctgctccgcctcagtcccccttcattggctccttttgctgtagatgctggagcactgtggggttt

SEQ ID NO: 24066 - DNA, 201 bp, Homo sapiens
aacttctttgttttttttcttttgcagagacagtgtctgtgtcacccaggctagagtgcagtggtgcaatcagagctcatggtaaccttgaactcctgggyccaagcaattctcctgtctcagcccctcaaaatgctgagattgcaggtggagtcaccacttccagcccctcaacttcatcctttagaatgtgggcatcca

SEQ ID NO: 24067 - DNA, 201 bp, Homo sapiens
ctactatcattttgcctctctccaggaagaggaaagaaatgtattaaggtgctctttggcacagcatttaatggtaaagaaagaaacagtataactggccrgtgctgggtttcagcatcctgcaatttcagaactactgtgaatacaaaagaaagaaaggtcctgcccaggatgggagtcactcctatatatggtggccct

SEQ ID NO: 24068 - DNA, 201 bp, Homo sapiens
ctatatatggtggccctgggacagcagacctttcctgtcacacctcttccatgagggcccttacttcagtgactgtggtgctttccttctctctatggtcyatctatctatctatccagttggttgggtttctctggagaaccctaatataccaatggacagtaagcaaataaaacctagtattaccactaattgccattg

SEQ ID NO: 24069 - DNA, 201 bp, Homo sapiens
cacaggcctaggtgggtgctgaaggtcatgggaggccaggcctcctcgagcaaggtggggggtcccagggtcatgtcaggtgcagatcctgtggcagccaygtctttccatgctgggcctgctgggccccccaggcttcctgatggggtccccagttaggagctgcctgctcagggctgggaggggaggagtgctgagctg

SEQ ID NO: 24070 - DNA, 201 bp, Homo sapiens
aggagcagtagtgactcaacagcaggtcacaggcctaggtgggtgctgaaggtcatgggaggccaggcctcctcgagcaaggtggggggtcccagggtcakgtcaggtgcagatcctgtggcagccatgtctttccatgctgggcctgctgggccccccaggcttcctgatggggtccccagttaggagctgcctgctcag

SEQ ID NO: 24071 - DNA, 201 bp, Homo sapiens
ctaaggggtctcccctactccacgtggagaaaagtccttgtaggttgcaagggcagtggcctgggtggaatccctgctagggacagagcaggaaggcctcrcagcctcaccaagcagcagccctggggtgaagtaagtggaccaggagtaagtggaccaggcaggagcagtagtgactcaacagcaggtcacaggcctagg

SEQ ID NO: 24072 - DNA, 201 bp, Homo sapiens
tgagtgcccaccaatgggtgatctaagcagaggaggattttaataatcaaataggatgacccgttctgtggacaccactcagtctgttttcccagccactyctgtcatcgcccaatgggccaatgaacaaagtggctatggcagtagggatggagggtatacataggcttagcaacatagactttcactcaccaaggctga

SEQ ID NO: 24073 - DNA, 201 bp, Homo sapiens
gagggattgtcacttctggttccctgtgggcaggaatggtttcctcgtaggtcactggggttttggccaggaaaagggtatgaaattcatgtgccagtttmtcaaaattcctgctttcaatgttgatgtccaataaagatgttcgtaatttcagctctataatcttaataggatttcctctaatactgctgttgtaaagca

SEQ ID NO: 24074 - DNA, 201 bp, Homo sapiens
gaagtttgtcttcactggaatagacacttactccggatatgggtttgcctatcctgcatgcaatgcttctgccaagactaccatcatggagtcacagaatrccttgtccacccttatggtattccacacagcattgcctctaaccaaggcactcacttcatggctaaagaagtgcagcagtgggctcatgctcatggaatt

SEQ ID NO: 24075 - DNA, 201 bp, Homo sapiens
tctgcaaaaacagaggcagtgcaggggacagtgagaggctggggtgtccaggagacctgagtctggcggtaggggcgctggtttctcatccttgaacctarttgcactgtcagtcggcccctcatgcctgagcagatgggaaggttcgtcccctgccctgcagcaagagggccctgtccaggaggcacccacagcaggggc

SEQ ID NO: 24076 - DNA, 201 bp, Homo sapiens
taatacttaataaactcttatatatatatatacacacacacacgtatatgtgctattagttctgttcctctagagaaccgtgactaatacatgtatctatygagataacaatattatttttgtttttcattctgtttatgtgatgtatcacatttattgacttgcgtatgttaaaccatccctgcatccctggtatgaaac

SEQ ID NO: 24077 - DNA, 201 bp, Homo sapiens
ttttttgtgtcctcttcaatgttttgcatcagtgctttatagtttttattggagagatctttcacttcttcagttaagtctattcctaggtattttatttkatttgtagctaatgaaaatgggattcgtttcttgatttctttttcagattatttgctgttagcacatagaaatgctattgatttttgcatgttgattttg

SEQ ID NO: 24078 - DNA, 201 bp, Homo sapiens
cgctgagggacatctggatggtcagcccttcctgcgctatgacaggcagaaacgcagggcaaagccccagggacagtgggcagaagatgtcctgggagctragacctgggacacagagaccgaggacttgacagagaatgggcaagacctcaggaggaccctgactcatatcaaggaccagaaaggaggtgagagtcggca

SEQ ID NO: 24079 - DNA, 201 bp, Homo sapiens
gtggctgtgatctggggagggccagaaactggagaggaatccaaggagaggcggtgcccacccgtgtgcctcctccaggaggcactttccaggttcccacyacctggcctccctgagtttccttgcagatgacacagatgaatagataagcagatgtccctgggccatttgaggagcggggcccagcccctcatcagggca

SEQ ID NO: 24080 - DNA, 201 bp, Homo sapiens
ttttggttatgtcttttcctgcttttggcttcatagaatgatttagggaggatgccctctttaccttttgaaatagtttcagtaagattgagaccaattcktctttgaatgtctgatggaattcagctgtgaattcatctggtcctggactttttttggttggcaatttttttttattgctctttcaatcttgctacttgt

SEQ ID NO: 24081 - DNA, 201 bp, Homo sapiens
tgagctgtggggctgcttttgtggatcagaggcagtaacacctgctccctggccagaagccaacttccaggattcaggactcagaattcagaacttagacrgtcccttggtctctctagaattcagtgctcatttagaccgggctaagaccctcacactcaatggctggaggatccaagcttatggcatgactgcctctgg

SEQ ID NO: 24082 - DNA, 201 bp, Homo sapiens
gctgagggcctggatgatcatggtgtcagagggaggaaatagtaaaggtggctgtgatctggggagggccagaaactggagaggaatccaaggagaggcgrtgcccacccgtgtgcctcctccaggaggcactttccaggttcccaccacctggcctccctgagtttccttgcagatgacacagatgaatagataagcaga

SEQ ID NO: 24083 - DNA, 201 bp, Homo sapiens
tccagggttgagcagggagacacacatgtttttctgatgtgtgaagttctgagggcattttccaaagtacttgttcactgagcaggtgtttccactacttkcattaagtcaggggatatggaagccacttttccagcaatcaaactcaatgagaagatgaacaagaagtgttctgaaagtaagcagaaaaggccctttcca

SEQ ID NO: 24084 - DNA, 201 bp, Homo sapiens
tggggggtccccatgaggtttgggtcatgaagttagagagagaagtcagcatgctgtgtgctgctttccagcctccttcagctcatgggggcaggtgcagygtaggcagaggtggattccaccagctgtgtagttttgccaaacaagtatggcaacgcaagggaggggcaagggagggatggaaattatttacaatagaat

SEQ ID NO: 24085 - DNA, 201 bp, Homo sapiens
agatgctggagcactgtggggttttactgcctcccaatcactctagtgtcctccactcccaggattttaaatatcgtctagacacagatggctcccaaatrtatatctctacatatttctataatcaaaaaactaatggtaccaaaacaggtactctgatatattgcagatgggcctgcaaactggaaatgttttcaggaa

SEQ ID NO: 24086 - DNA, 201 bp, Homo sapiens
ctgttagagccattggataaagacagtgggtctgggactgaactgtccagtgttgtaatctgggaaagcagtgggccctctgacagaagcctgagcctggkgtgggagttaggcaggagaggaagccctcagggccagggctgccccctctgcctcccggcctgcccatcccggagagttccctcctggccccatgaccca

SEQ ID NO: 24087 - DNA, 201 bp, Homo sapiens
tggggatcccagagcctgaggccacagtcccaaggcccatcctcctgctagcctggaggaattaggccccagggtgaggacagacttacagaaggtccggkatctgtgagggattcagccagagtgagaacagtggagaggagcagccctgttccctgcatctcccttagaggggagcagggcttcactggctctgccctt

SEQ ID NO: 24088 - DNA, 201 bp, Homo sapiens
cctgctacatggaacacagcgggaatcacggcactcaccctgtgccctctggtgagcctggggtgaccctggagagggtcaggccagggtaggaacagcarggacggctgtggctctctgcccagtgtataacaagtccctttttttcagggaaggcgctggtgcttcagagtcaacggacagactttccatatgtttctg

SEQ ID NO: 24089 - DNA, 201 bp, Homo sapiens
gaaaaggggacagtttctggagatgggaaagctcctttctaggcagtagggtctcctcattgctcctgcccagacaagacgtaggtgacaaggctgctggracaggggatggaagctggggtatttgggaggggaatgggagctgcatctccatctacacccataagtgcttctcaagccagggctggggcaaggccttcg

SEQ ID NO: 24090 - DNA, 201 bp, Homo sapiens
gtaaaatcaaaaaggaaagaagaaagaaaatgaaagataaaagaaaaaataatccaaatgtctgtcactagcggactagttaaaaaagcattgcaagctgrgcacagtagcattcacctgtgaatacactctactccactctgggtaacatgaggaggcctccctaccttcctaagaaaacccaaacaagcactgcatatc

SEQ ID NO: 24091 - DNA, 201 bp, Homo sapiens
gtctttgtttctcctcttctctcaattattgaatcgaagaagccaatggcaagtatggtctgagagcaaacgtagcaatagatttcaggcggcaacagctrgagcatcatcagttgtgcttcctctagctgaggggctgggatgtgcattctcaagactgccacaacaatccagtggggagaaaggacaaagggtaatgat

SEQ ID NO: 24092 - DNA, 201 bp, Homo sapiens
acaagacgtaggtgacaaggctgctggaacaggggatggaagctggggtatttgggaggggaatgggagctgcatctccatctacacccataagtgcttcycaagccagggctggggcaaggccttcgaatatccagctgtggcctcctcctgctgcaagtgaggagtgggcagcagggagggctgtggcacctgctctgt

SEQ ID NO: 24093 - DNA, 201 bp, Homo sapiens; identical to SEQ ID NO: 1918

SEQ ID NO: 24094 - DNA, 201 bp, Homo sapiens
atacattagcataggctgacacagggtcaagaccaacaatatcaaccatcttcagccttcacatcttgtcccactggaagattttcaggtgtaataacacscatggagctgcatctcctatgataacaatgccttcttctggaatacctcctaaaggacctggctgaggctgttttaatttttttatatatatagaaggag

SEQ ID NO: 24095 - DNA, 201 bp, Homo sapiens
tgctgagggcctggatgatcatggtgtcagagggaggaaatagtaaaggtggctgtgatctggggagggccagaaactggagaggaatccaaggagaggcrgtgcccacccgtgtgcctcctccaggaggcactttccaggttcccaccacctggcctccctgagtttccttgcagatgacacagatgaatagataagcag

SEQ ID NO: 24096 - DNA, 201 bp, Homo sapiens
gtggcacgatctcagctcactgcaagctccgcccgctagcttcatgccattctcccgcctcagcctcccgagtagctgggactacaggcgcccgccaccayacccggctaattttttgtatttttagtagagatagggtttcaccatgttagccaggatggtctcaatctcctgacctggtgatacacccgcctcggcctc

SEQ ID NO: 24097 - DNA, 201 bp, Homo sapiens
ttttttgagatggagtcttgctctgttgcccaggctggagtgcagtggcacgatctcagctcactgcaagctccgcccgctagcttcatgccattctcccrcctcagcctcccgagtagctgggactacaggcgcccgccaccacacccggctaattttttgtatttttagtagagatagggtttcaccatgttagccagg

SEQ ID NO: 24098 - DNA, 201 bp, Homo sapiens
aatctctctctttttcttttttttttttttttttttttttgagatggagtcttgctctgttgcccaggctggagtgcagtggcacgatctcagctcactgyaagctccgcccgctagcttcatgccattctcccgcctcagcctcccgagtagctgggactacaggcgcccgccaccacacccggctaattttttgtattt

SEQ ID NO: 24099 - DNA, 201 bp, Homo sapiens
gttagtctttgtatgactgtgtgtctgttggcattagtgacacgaacttttaatcttgccatttggcccttgggtatatggctgtgagtgttctgtcacartcaccatatatgctgtgtgctgtgttcgtatatatatatgcaatacataccagtgtcagcgtaatggagtggttaggaacacaggcggcttagatttaac

SEQ ID NO: 24100 - DNA, 201 bp, Homo sapiens; identical to SEQ ID NO: 4722

SEQ ID NO: 24101 - DNA, 201 bp, Homo sapiens
gttaccttctcgcttggcaataggcttacctttgagcatagcccttcccatcatgggaagacagtgcctgtggcctcagtaggaatgacaggtatttgccwgaacaccctttttgtgaattgttaccctgcccccaacactggggcagagtggaggaaggaggaagaacctagaacacaggttctgtgttcctgcctctct

SEQ ID NO: 24102 - DNA, 201 bp, Homo sapiens; identical to SEQ ID NO: 4807

SEQ ID NO: 24103 - DNA, 201 bp, Homo sapiens
atttgcagtagtcttcatgtgtgggatcccatggcttggctgaataccccacactctgatgtctgactgaattggcctgtttgctgtgttttcccagtcamagttcacagaacacatgtgtatgcgcctttgcatgatacactgatgtaacaggaccatagaatgtgtgttataaatttgtcatcagtatattttgtgagc

SEQ ID NO: 24104 - DNA, 201 bp, Homo sapiens
tgaaaaagccaaagggaaaagcaccaacaccaaatgagaagtggaagcccccggtatcaccaaatggctggaatccctagggaggcagaaaaagtcagacrggaagccggcaaatctgtcaaggaagggacacaactggacaagaagactcacccctctgctctccggagctggtctctggccctgggggcggggtggagt

SEQ ID NO: 24105 - DNA, 201 bp, Homo sapiens; identical to SEQ ID NO: 4814

SEQ ID NO: 24106 - DNA, 201 bp, Homo sapiens
ctccctccatgcacccacacccaagcctcccctgccccacccaaattctgccaagagagcagccaagcctctcccttcttccctctgagctaaaaaaaggracagacggctgggcgcggtggctcacgcctgtaatcccaacactttgggaggctgaggcgggcagatcacctgaggtagggagttcgagaccagcctgac

SEQ ID NO: 24107 - DNA, 201 bp, Homo sapiens
ctgggaggccagctacttgagaggctgaggcaggagaattgcttgaacccaggaggcatagattgcgatgagccaagatcgcaccattgcatgccagcctsggcaacaaaagtgaaactccatctcaaaaaaaaaaagaaagggaaagactccactggggctcccactaaataaccctctctcaacccgaagtcttccttt

SEQ ID NO: 24108 - DNA, 201 bp, Homo sapiens
tgcctcccttaacctttgtgtctcacttgtttccacctgcacagctaagacccctcacttctctggggtaaggtggctcgggtctcacattgtcctgccaytccccgccccaccttctcttctcagcacatcacgtgcctcagctcctggttcctaagacctttctttccacagatctcgaccgttatactcccacccaca

SEQ ID NO: 24109 - DNA, 201 bp, Homo sapiens
gggaaaaggttagtgcagtcctgccttcgcacaatggctattggctgatacggtctaagtcaatgtgcaatgccaagggattggtaataactcgctacacsctgtcgcctggccaaggagggctttattcgtctgagtagttgtcagtcataaccaaagccataagcaatttgctcgggactacctatagacctcgcccac

SEQ ID NO: 24110 - DNA, 201 bp, Homo sapiens
ggggaggagagaagctaaaaatgtcctgagtggcctggaaggagacccctgtggtgggcagggggtgggttctccacccatacagccagatacggaggagyagcagcagcaaaagcagccacaagttaaaaacatggtttctcacttcccaacttcggccttgagagaaagggacagcacggagcaatcccccaaatgaga

SEQ ID NO: 24111 - DNA, 201 bp, Homo sapiens
aggttagtgcagtcctgccttcgcacaatggctattggctgatacggtctaagtcaatgtgcaatgccaagggattggtaataactcgctacacgctgtcscctggccaaggagggctttattcgtctgagtagttgtcagtcataaccaaagccataagcaatttgctcgggactacctatagacctcgcccactataag

SEQ ID NO: 24112 - DNA, 201 bp, Homo sapiens
ggctaaaacttgacggaaaatggtggttaggtaaaacgcgcctgcgcagcacgcggcgggacgggggtgggccaatcctgtgagggtttaaccttctcttkttccacctcttcacccctatcttgtcgccatggtgactgctctacaattggcgaggcttgcacttcaaagtcctaggctcgcttcatccgggtccttcag

SEQ ID NO: 24113 - DNA, 201 bp, Homo sapiens
aatggtggttaggtaaaacgcgcctgcgcagcacgcggcgggacgggggtgggccaatcctgtgagggtttaaccttctcttgttccacctcttcacccctatcttgtcgccatggtgactgctctacaattggcgaggcttgcacttcaaagtcctaggctcgcttcatccgggtccttcagctgtggactttctgctga

SEQ ID NO: 24114 - DNA, 201 bp, Homo sapiens
aaactgaactaaaggcccacccctttcttaatgttgtacacagagtagaacaggattgacttcaactccgttttaaaccttcagagcaggaaagctctggrctcaacccctttgtgagtggtgcaaaagggacaaagcccgccccttttaaggagacccgcggaggctagacccgccctttcctctttataatttgcccat

SEQ ID NO: 24115 - DNA, 201 bp, Homo sapiens
tctgacccctgttgtcttgcttccgagagatggagtccgaggctggacttgggaggccagagaataaacaggaaaggggggtagggattagtaactgggayggagggcactggggctggggctgggtaccatgtggagagtggggacagatgtgaagaagaggtggtttagagtacctgtgggagctgctgtgggcaggtc

SEQ ID NO: 24116 - DNA, 201 bp, Homo sapiens
gaggtgaggaagtgagaccaaagaagaaagagaggaagtgaaggagatgaagggaaacaaatgaaggcagaggagggagtgggcaagaataggaagagggrccagtgatgtgagttttcctctcctcccctgcccaggtgtgcccctggcttcctgggtgagacgtgccagtttcctgacccctgccagaacgcccagctc

SEQ ID NO: 24117 - DNA, 201 bp, Homo sapiens; identical to SEQ ID NO: 4742

SEQ ID NO: 24118 - DNA, 201 bp, Homo sapiens
atactcccacccacacataccagcaaagtcttatgtctcctgtcgggcttcacctatgggaacgtgccctccgattatctgtatgactgtatgattattckctcctagcctctccagtatataagcgagacccaccacctcccgcccccctcctcgattctcaccagtacaggtggccacacacactgaccacagcttccc

SEQ ID NO: 24119 - DNA, 201 bp, Homo sapiens; identical to SEQ ID NO: 4792

SEQ ID NO: 24120 - DNA, 201 bp, Homo sapiens
gcttgattctgggacgcaaaggttgcagtgagccgggatggcgccactgcactccagcctggcgacagagtgagactttgtctcaaaaaaaaaaaaaaaaraggccaggtgtggtggctcatgcctgtaatcccagcactttgggagaccaaggagggtggatcacctgaggtcaggagttcaagaccagcctggccaaca

SEQ ID NO: 24121 - DNA, 201 bp, Homo sapiens
gaaccaggaacccacaaagaatgggcattgagagagagcggaaacaccaagggggtccccaccctagaccaggcatctgggcacccaggcctcaggctccrcccccaccctccttggggagccaggtcccctccacctggaaatgagccaagtcacactgaggaaatggaactttatttccataaatacagggataacacc

SEQ ID NO: 24122 - DNA, 201 bp, Homo sapiens
cctctcctttctcctctccccaacaaacacatacaaattttcgtgccctctcttttctgcctttcaagttaatttctaatttccttcagccacctctttcygggtctcctcttttcaaccccaaccccatcactccaaaccaaacccctttactagcacattcccccattactcactttcaagctcaataatgtccctatc

SEQ ID NO: 24123 - DNA, 201 bp, Homo sapiens
ctcagcctcccaaagtgctggaattacaggtgtgagccaccacgcccggccacatccccatttaccgtttctgtttgtttgtttgtttgtttgtttgtttkagatggagtcttgccctatagcccaggctggagtgcaatggcacgattttggctcactacaacctgcgctgcccaggttcaagtgattctcctgcctcag

SEQ ID NO: 24124 - DNA, 201 bp, Homo sapiens
ggctggaatccctagggaggcagaaaaagtcagacgggaagccggcaaatctgtcaaggaagggacacaactggacaagaagactcacccctctgctctcyggagctggtctctggccctgggggcggggtggagtttttaatctgaggaagtggagagagaaagttaacagggatttttctcctcccatcttccacaccg

SEQ ID NO: 24125 - DNA, 201 bp, Homo sapiens
cagctcagccacctgttctggctgcagctcttcaggcggcacgggcagcaccgctctgacccaggccccagcctgaccggcccactagaaaggaagagatscctcagggtattgacagtgacgtctggcctcgccccacccagcaggcttggctcacctgctccagccgctccaggcgccctcgcagctcgtgaatctcct

SEQ ID NO: 24126 - DNA, 201 bp, Homo sapiens
gtttattgagcacctactccatctcctattgtcctggcactggagataagacagagtccctgtccttaagctgcttacagcctaaggagggaaacaaaaaygccagtcaacacatagtgtgttgtcaagatcagtggttcttaaattcaggcgcacatcagactcaccagagggcttgttgaaatacagattgctagccag

SEQ ID NO: 24127 - DNA, 201 bp, Homo sapiens; identical to SEQ ID NO: 4736
  misc_feature (1)...(201): n = A,T,C or G, or insertion/deletion polymorphism (see Tables 1-2)

SEQ ID NO: 24128 - DNA, 201 bp, Homo sapiens
cacagtgctcctgcatgcctggatggacaggtaagcgctgctgggggcagccaggaggggacaggcaggagcaatgggctaggctgtgggtggggaagatrgaactggagcctgagaaactgcaagccctttgaagacagaagccatgagaatcaacatgccaattcttggcaatccacttacccacaaccaacattcacc

SEQ ID NO: 24129 - DNA, 201 bp, Homo sapiens; identical to SEQ ID NO: 4716

SEQ ID NO: 24130 - DNA, 201 bp, Homo sapiens
ccgggggcgcactcgcactggtcaggcctaacgcagacgcctccgttcaggcaaggcttggcgcagatggctgaggacagaggaagtggggttcagactcraaccgacgacccagctccccagctccgtggggcgcgcctcccgcaaggcccggaagacccagcctcaccttcacaggtgagcgcccccgggtgccgcttc

SEQ ID NO: 24131 - DNA, 201 bp, Homo sapiens
cacctggcacctccactgctgccgccattaccactggtgcacatggactgtgaagtgagtctccaggtgcctaaacccacttaaagattaggaaatgaggwtcagaaaggcaaagtggctcacccaagggtatacaaccagttgtggcacagcatggtgccacctgagtctcctgcctgcagacgtggggtgcttttcacc

SEQ ID NO: 24132 - DNA, 201 bp, Homo sapiens; identical to SEQ ID NO: 4809

SEQ ID NO: 24133 - DNA, 201 bp, Homo sapiens
aggcccggaagacccagcctcaccttcacaggtgagcgcccccgggtgccgcttcttccagccctggcagcacactgcatgggtctgctgaacctcccgcytcacctcccgccacataacgcggtacatggtcctggaacacagcgcccggctcaggaccctgagtacgggtcctagttggggttcttggggtcccatctc

SEQ ID NO: 24134 - DNA, 201 bp, Homo sapiens
tactgctctgtagtctctgctaggacatggacgaaaagggacgcagccgggagagcgactgccccaggtgggggctggggggacgtaagggaagaataatrattatctggctgtgtttttgtttaaaaaaaaaaaaaaactggtgtaaatctccatagacttcctatcctcgctcccttcacccacccacgcgctcccaag

SEQ ID NO: 24135 - DNA, 201 bp, Homo sapiens
ttcacctctgcctctgtcccccaggtgtgtcctcacaggggctctccggccgcccctctctctgggcagggcaggatgtctccgttggagcctcctcccayagctgatccatgaccctgtcaggtttcataggcccgggctgtgaggtgaatccagacaactgtgtcagccaccagtgtcagaatgggggcacttgccagg

SEQ ID NO: 24136 - DNA, 201 bp, Homo sapiens
aggggctctccggccgcccctctctctgggcagggcaggatgtctccgttggagcctcctcccacagctgatccatgaccctgtcaggtttcataggcccrggctgtgaggtgaatccagacaactgtgtcagccaccagtgtcagaatgggggcacttgccaggatgggctggacacctacacctgcctctgcccagaaa

SEQ ID NO: 24137 - DNA, 201 bp, Homo sapiens
tgagccaggtactattcaaagtacattgcattcatttatttatttaatccttacaaccacctggtgaagtacatgctataatattttacagataaggaaawctgagtaacagaatggttaagtaacttgcccaaaggcacccaatagggtcaagattcaaacccaagtattctggccccatggtctggtctagaggttggc

SEQ ID NO: 24138 - DNA, 201 bp, Homo sapiens
gggctctccggccgcccctctctctgggcagggcaggatgtctccgttggagcctcctcccacagctgatccatgaccctgtcaggtttcataggcccggrctgtgaggtgaatccagacaactgtgtcagccaccagtgtcagaatgggggcacttgccaggatgggctggacacctacacctgcctctgcccagaaacc

SEQ ID NO: 24139 - DNA, 201 bp, Homo sapiens
tcccactcctcccaaggaaacacgccctaaactgccaccgaatgaagcctgctctctttagcgtcctgtgtgaaatcaaggagaaaactggtatgtgggcsccccccggattgctcaactctgggaacagaaccctgttcattatagggctagagtgtgacaacttggggccctgaggaaagtaaggagtcagggggactg

SEQ ID NO: 24140 - DNA, 201 bp, Homo sapiens
atgtctccgttggagcctcctcccacagctgatccatgaccctgtcaggtttcataggcccgggctgtgaggtgaatccagacaactgtgtcagccaccartgtcagaatgggggcacttgccaggatgggctggacacctacacctgcctctgcccagaaacctggacaggtgagttgtttaagccacatccatgacacc

SEQ ID NO: 24141 - DNA, 201 bp, Homo sapiens
tgttccacctcttcacccctatcttgtcgccatggtgactgctctacaattggcgaggcttgcacttcaaagtcctaggctcgcttcatccgggtccttcrgctgtggactttctgctgattgggccttttccttttcccctgattggccgacatcgggaaagacggcgaagagctaggaaaagagggaaaacactagggt

SEQ ID NO: 24142 - DNA, 201 bp, Homo sapiens
tattctgggaatggaaagaaggcctctccaggcttcgttgcccccagcgacccaaaagtccgatttccccgccttgattctccccacttcccaatacaggmgtctggctccgcagcagaacacgaagtttgcattccccaaggggcggccagggggcggaccagggaaaggtagtcctctgcattttgccgtgtgctgggt

SEQ ID NO: 24143 - DNA, 201 bp, Homo sapiens
gggtgatgtatgctatagagaagttgagcagatggggtgggagatagcgtgcaaaatataggtgcagcagaggggcattccctctcatcctgctgttacgrcggtcaatctgagatgcggtggaagtacgggccgcgtgagtttccccccccaactcccaccctcaacaccacactggccctccgctccagcttactgggg

SEQ ID NO: 24144 - DNA, 201 bp, Homo sapiens
aagcccctttctttccttcgcttcctcttttagagaatgtccggattgctattggactttggagcgtatggctccaaatcaactcattggctaaaacttgmcggaaaatggtggttaggtaaaacgcgcctgcgcagcacgcggcgggacgggggtgggccaatcctgtgagggtttaaccttctcttgttccacctcttc

SEQ ID NO: 24145 - DNA, 201 bp, Homo sapiens; identical to SEQ ID NO: 4787

SEQ ID NO: 24146 - DNA, 201 bp, Homo sapiens; identical to SEQ ID NO: 4789

SEQ ID NO: 24147 - DNA, 201 bp, Homo sapiens; identical to SEQ ID NO: 4790

SEQ ID NO: 24148 - DNA, 201 bp, Homo sapiens
ccaccattccctcatctctgggcaggggcttattgtaggagtctctgaagagagctgtggactgacctgctttaacccttccccaggttcccattgtcccyatagtcatgtcctcctaccaagacttctactgcaagaaggagcgtcgcttcacctcgggtgagggctttgagcagttctggggtagggtgtgtccggaga

SEQ ID NO: 24149 - DNA, 201 bp, Homo sapiens; identical to SEQ ID NO: 4791

SEQ ID NO: 24150 - DNA, 201 bp, Homo sapiens
gcaggtggccagaatggatttgtggccaggggcatggatgctgctgctgctgctcttcctgctgctgctcttcctgctgcccaccctgtggttctgcagcyccagtgccaagtacttcttcaagatggccttctacaatggctggatcctcttcctggctgtgctcgccatccctgtgtgtgccgtgcgaggacgcaacgt

SEQ ID NO: 24151 - DNA, 201 bp, Homo sapiens
cccctagtgttcctccactcttcctccgccccccattactagggtgtccaggacattgtgtgactcaggaaacagctcagacgtgaggcttgcagcaggcygaggaggaagaagaggggcagtgggagcagaggaggtggctcctgccccagtgagagctctgagggtccctgcctgaagagggacagggaccggggcttg

SEQ ID NO: 24152 - DNA, 201 bp, Homo sapiens; identical to SEQ ID NO: 4731

SEQ ID NO: 24153 - DNA, 201 bp, Homo sapiens
aatcccagctactcgggaagctgaggcaggagaatcccttgaaccctggaggcagaggttgcagtgaaccaagatcatgccactgcactctagcctgggcracagagcaagactccgtctcaaaaaaacaaacaaaacaaacaaacaaaaaaaacccctagctatataccttcacaccgtacacacaaaccaagcacctgg

SEQ ID NO: 24154 - DNA, 201 bp, Homo sapiens; identical to SEQ ID NO: 4734

SEQ ID NO: 24155 - DNA, 201 bp, Homo sapiens
ggactgggggatccccaaacctgagatgggcctcataggccacagatattccccaacactgacacttcaagaacggaactgtccccataggggagcctcakaaccccactctcatgggtagtccctcttaggagttgggagggctgatgtcaggggactttagagaaaaaagggaacatggggaggagagaagctaaaaat

SEQ ID NO: 24156 - DNA, 201 bp, Homo sapiens; identical to SEQ ID NO: 4735

SEQ ID NO: 24157 - DNA, 201 bp, Homo sapiens
tagaaggggaagtaatcccagggggctcaccagttgctcctccatctccaggacggtctcatttgcatcatagaaaccaaagaagctacaaagagatttgsggggaggttatcagaagagctggagaaaatctggccgggcgcagtggcacacgcctgtaattgcagcactttgggaggccaaggagggcaaatcacctga

SEQ ID NO: 24158 - DNA, 201 bp, Homo sapiens
tgctctctgaggcgccttttagatatgagaatctaggaccctctgcaccgtcttaacccaagagtttgcttgatggagagcgggaagaataatgcaagttscatctccaatatctcccctcccctccacagggttttgaaggccccacctgcagccacagggccccttcctgcggcttccatcactgccaccacggaggcc

SEQ ID NO: 24159 - DNA, 201 bp, Homo sapiens
ggactgtgggtgagcactgatgtggaaattattggaaaaagccatgccaagctcacagtgggaagtgtctctcagaagcagtcaaaggcaaggcaggatcrgttgatagcatgaatggaattttcaaaaatcacaggcgttgcctaagggaaggtcaggagctccccaagctcaagctgcgtggtgggtggcctcagatag

SEQ ID NO: 24160 - DNA, 201 bp, Homo sapiens
ccctggcctcccctactcatagggctcccagccttagccctcgtcccctccccaaccccctgcaggctgggactgctccgaagatgtggatgagtgtgagrcccagggtccccctcactgcagaaacgggggcacctgccagaactctgctggtagctttcactgcgtgtgtgtgagtggctggggcggcacaagctgtga

SEQ ID NO: 24161 - DNA, 201 bp, Homo sapiens
gctggcatggagacatcctgtgaggaaatatggagacatgaccagatgggggttgtcaagggagcaaaatccagagggctcttcttaatctgccctaaaasaggtcccgagattctcacagaggctggggcactcctccccccactgaaggaacagcagagtggaacacatgtcatcccacatgtgtttatacaactgttg

SEQ ID NO: 24162 - DNA, 201 bp, Homo sapiens
tagacccctgccacagccaaccctgctttcatggagggacctgtgaggccacagcaggatcacccctgggtttcatctgccactgccccaaggcaagtgaycacaaatctgccttctctgttgccccctatgctgacaaggcaagaatacctcagttggaatcccagaagggactgtgggtgagcactgatgtggaaatta

SEQ ID NO: 24163 - DNA, 201 bp, Homo sapiens
gcccacctggacgcacaggtatgggggtagagggtatcaggaggtgggaggtagagaaggagggtgagagaagcaccaggaggactgctaggagcttcaartggcctttgagagcctcaccccctcttacccctccaggactcctgtgccacttggaagacatgtgtctgagccagccgtgccatggggatgcccaatgca

SEQ ID NO: 24164 - DNA, 201 bp, Homo sapiens
ggccaggacagccccagtgggaccataccttgcgggagagaatgtagaaagcccaagaatatggtggttaatgaagcaaggaagggaggagaggggcttargtggaatttatgggtgtcctggaagggtaatgggtgctttattttgagaagccataggtaaaaattgtgcttttaaagccactctgccagccgcccaacg

SEQ ID NO: 24165 - DNA, 201 bp, Homo sapiens
attaaaaaaccaaacatctttttccttgaatttgcccagatttggcatctcttgcctacatgaccctctctccaatgttcagcccctcagtccccatgaawttggtcccttatttcctttccatcttaaagacacaagccccttccccaatttggtctcgtctgccacacgcaggcccccacaccttccctgacagtctca

SEQ ID NO: 24166 - DNA, 201 bp, Homo sapiens
catccaggaatgagctaggatggaggcagtgactgatgcagtgtgtgacatctaatctcccccataattacaggccagtggtgtgaggtggagatagaccyctgccacagccaaccctgctttcatggagggacctgtgaggccacagcaggatcacccctgggtttcatctgccactgccccaaggcaagtgaccacaaa

SEQ ID NO: 24167 - DNA, 201 bp, Homo sapiens
cctcagtccccatgaatttggtcccttatttcctttccatcttaaagacacaagccccttccccaatttggtctcgtctgccacacgcaggcccccacacmttccctgacagtctcacctccttgcccttcctgccctgacccctgtggactcccagctcttctctcctcccagcccagcaaggcccaagtccctgtgaac

SEQ ID NO: 24168 - DNA, 201 bp, Homo sapiens
ctctggccaatgccttctactgccagtgtctgcctggacacacaggtgaggccccaagacaaggggcacaagtgtgtctggagcacagccaagcagaccayggagagccagatagtctccacccatgcggcagccgtcacctggtccatcccctgcctccacgcccacccccgcccagaaaagatgccccaggatcccttc

SEQ ID NO: 24169 - DNA, 201 bp, Homo sapiens
ctttccatcttaaagacacaagccccttccccaatttggtctcgtctgccacacgcaggcccccacaccttccctgacagtctcacctccttgcccttccygccctgacccctgtggactcccagctcttctctcctcccagcccagcaaggcccaagtccctgtgaacatggcggttcctgcctcaacactcctggctcc

SEQ ID NO: 24170 - DNA, 201 bp, Homo sapiens
gagcatctgaatggctcccattctgagtggagggagccattatatcacctgggaagactgcagtggtgggaggggcaccgggaagggaaggatgtgacccmgagagtggattgggggccgccccaggaggaggggtgtaaccctggggcaagcttagtgcttcattctaggggctctgcaccagcccctggatccaaatgc

SEQ ID NO: 24171 - DNA, 201 bp, Homo sapiens
cctttaatctccccattgcctagcagctagaagagggtcattgctctgcataccaggggtcctccagacttttgcattctgagcatctgaatggctcccaytctgagtggagggagccattatatcacctgggaagactgcagtggtgggaggggcaccgggaagggaaggatgtgacccagagagtggattgggggccgc

SEQ ID NO: 24172 - DNA, 201 bp, Homo sapiens
aaggtaatcccttaaaatcccaaaagccctgtgatacaacaggaaaatttggtacaacaagaaaaaaattgctgcaagacagcacccacctccaggctagytttaagggggaaaagtcgccccagggagacagcaacagagccaacatcaaggagttgaatgaaatcagaaaaataatcgccaactttatgccaggtactg

SEQ ID NO: 24173 - DNA, 201 bp, Homo sapiens
atcaaggagttgaatgaaatcagaaaaataatcgccaactttatgccaggtactgtctgagcatcttacaggcattgtctcatctacttattacaataacyctatgaggtcagcactgcccattttataactgaagaaactgaggcacagagagtttaagtgacttgtccaaggtcacccagctagcaagtggcagagctg

SEQ ID NO: 24174 - DNA, 201 bp, Homo sapiens
ggagtgagtaaggcaagcataagaagtggctttggcccaatgaaggatgtggctttggcccaatgaaggatgtggaggagctgttttctttttgacccatyttcccaccccaggccagctctgtgaggttcccctgtgtgctcccaacctgtgccagcccaagcagatatgtaaggaccagaaagacaaggccaactgcct

SEQ ID NO: 24175 - DNA, 201 bp, Homo sapiens
aagtaagggatttcgaggagctggagtgggcagaggaccatctctgggctgagaatctgatgctatgtcctgcctcacgctccctcccacccctcagactytgatggacttatgtgcccagaagccctgcccacgcaattcccactgcctccagactgggccctccttccactgcttgtgcctccagggatggaccgggcc

SEQ ID NO: 24176 - DNA, 201 bp, Homo sapiens; identical to SEQ ID NO: 4717

SEQ ID NO: 24177 - DNA, 201 bp, Homo sapiens; identical to SEQ ID NO: 4808

SEQ ID NO: 24178 - DNA, 201 bp, Homo sapiens; identical to SEQ ID NO: 4810

SEQ ID NO: 24179 - DNA, 201 bp, Homo sapiens
gcctcgccccacccagcaggcttggctcacctgctccagccgctccaggcgccctcgcagctcgtgaatctcctgcttcagagcgcgctcatctttttcckcctcccgaactagggacaaaggagaccaagagtgtgaccactacccgagcccggacgcccgtcccgagtccctcgggtggcccgtactcctgcccactca

SEQ ID NO: 24180 - DNA, 201 bp, Homo sapiens
gtaacttcagcaaacaggccactgaggtcctaaatgagtatttctactcccacctgagtaacccatatcctagtgaggaggccaaggaggagcttgccaaraagtgtggcatcaccgtgtctcaggtattatggaggttgcgggaggagttgtcaggcaaagtgcacgcatctcagctaggtgcagtggtgtgttcctgta

SEQ ID NO: 24181 - DNA, 201 bp, Homo sapiens; identical to SEQ ID NO: 4804

SEQ ID NO: 24182 - DNA, 201 bp, Homo sapiens
gagaagtatgagcaggtaaggagaggaggcttgggtgggtggagggaagggctcttgcaggggaatcccatggtcaaagggctcctcctcaccagcccacyggcccccactacaggcatgtaatgagttcacgacccatgtcatgaacctgctgagggagcagagccgcaccaggcccgtggcccccaaagagatggaacg

SEQ ID NO: 24183 - DNA, 201 bp, Homo sapiens
ggaagcagaagatagcccccaacacatgtgactggggggatggtcaacaagaaaggaatggtgagtggtggtggctgtgctctcaattttccctgtctccrtacaggctctgtgggaggatcagggctgggaactctagccctggccctggggatcctgggaggcctggggacagccgccctgctcattggggtcatcttg

SEQ ID NO: 24184 - DNA, 201 bp, Homo sapiens
agagagcagccaagcctctcccttcttccctctgagctaaaaaaaggaacagacggctgggcgcggtggctcacgcctgtaatcccaacactttgggaggytgaggcgggcagatcacctgaggtagggagttcgagaccagcctgaccaacatggagaaaccccatttctactaaaaatacaaaattagccaggcatggt

SEQ ID NO: 24185 - DNA, 201 bp, Homo sapiens
gggcagacagagccaggaccctggaaggaagcaggatggcagccggaacagcagttggagcctgggtgctggtcctcagtctgtggggtgagccactcccycaaccccactgaccctccctgcagaaagcactttaaccccacaccccagtcgtcctagaacttttcccagaacccgaggaagtgcctttcaaggtccctc

SEQ ID NO: 24186 - DNA, 201 bp, Homo sapiens
ggagagacagtagtgactgagggaagacccaatgtatccatttcacctccttttattttttttaaccccacacacccaactaaccacaaagtcatgccacyttatctcctgaagttttctcaagtctgtgctttcaccttcaccctttgtcccactgcctgagtcctgacctttgttgcgttccagatagatacttgcatc

SEQ ID NO: 24187 - DNA, 201 bp, Homo sapiens
agccaagcctctcccttcttccctctgagctaaaaaaaggaacagacggctgggcgcggtggctcacgcctgtaatcccaacactttgggaggctgaggcrggcagatcacctgaggtagggagttcgagaccagcctgaccaacatggagaaaccccatttctactaaaaatacaaaattagccaggcatggtggcacat

SEQ ID NO: 24188 - DNA, 201 bp, Homo sapiens
cgacagcggcccctcctatttctgccactgcccccctggattccaaggcagcctgtgccaggatcacgtgaacccatgtgagtccaggccttgccagaacrgggccacctgcatggcccagcccagtgggtatctctgccaggtgagagggtctgcaggagaagggggaggaaagacaagggtgggctggatgggagagac

SEQ ID NO: 24189 - DNA, 201 bp, Homo sapiens
caggtgagggccattgaagtcaggcgtgctgaggagggaagtggctgggagggaaaccagggagggtcacctggtcccaggccattcaggagaaggttttygaagtaagggatttcgaggagctggagtgggcagaggaccatctctgggctgagaatctgatgctatgtcctgcctcacgctccctcccacccctcagac

SEQ ID NO: 24190 - DNA, 201 bp, Homo sapiens
ttcttcctatcatgccctgtctctgtcttgttcagcccctgtaggaatagggcaacctgccaggacagccctcagggtccccgctgcctctgccccactgkctacaccggaggcagctgccaggtgagggccattgaagtcaggcgtgctgaggagggaagtggctgggagggaaaccagggagggtcacctggtcccagg

SEQ ID NO: 24191 - DNA, 201 bp, Homo sapiens
gagtacctgtgggagctgctgtgggcaggtctctcaggagcacctagaagaggaaaggtggaggcacagcacccagggcttccattgcgcctgcctctccwccctcagggctgctgtgtgggagtttcccagaaccctgtgccaatggaggcacctgcctgagcctgtctctgggacaagggacctgccagtgagtgtgcc

SEQ ID NO: 24192 - DNA, 201 bp, Homo sapiens
gacccacctgtagtgaggagatgacagcttgtcactcagggccatgtctcaatggcggctcctgcaaccctagccctggaggctactactgcacctgccckccaagccacacagggccccagtgccaaaccagcactgactactgtgtgtctggtgagtgcccactgtgtcatggggctggggtccacaggagaatggaag

SEQ ID NO: 24193 - DNA, 201 bp, Homo sapiens
gccccctcctttgggctcccttcgctaggacaggagaagacagccagtgagatgtaggtctgtgagaaatgaccaatggggaaaaggaaggagatggcaargttcttagggcaaggcagtgggagggctcaactggtaagtgttatccaaggagaagagagtccacaaaaactggtggaaacagaggaccagggggtcaga

SEQ ID NO: 24194 - DNA, 201 bp, Homo sapiens; identical to SEQ ID NO: 4778

SEQ ID NO: 24195 - DNA, 201 bp, Homo sapiens
tgaggcacgagaattgcttgaacccaggcggtggaggttgcagtgagccaaggtcgtgccactgcaatccagcctggactgtctcaaaaaaaaaaaaaaaagtcaatataatgaaaggcaaagtacatttaaggtactgtactcatattaaaggaaactaaaaagactcgacagctaaatgcaatgcaggatgccaaatga

SEQ ID NO: 24196 - DNA, 201 bp, Homo sapiens; identical to SEQ ID NO: 4779

SEQ ID NO: 24197 - DNA, 201 bp, Homo sapiens
gccggacagaagcttggaaggtcctgtctccccagggaggaggcccctgggacagtgtggctcgtgtccttcccaacggctccctcttccttccggctgtsgggatccaggatgaggggattttccggtgccaggcaatgaacaggaatggaaaggagaccaagtccaactaccgagtccgtgtctaccgtaagaattcca

SEQ ID NO: 24198 - DNA, 201 bp, Homo sapiens; identical to SEQ ID NO: 4739

SEQ ID NO: 24199 - DNA, 201 bp, Homo sapiens
cagcaggccgaggaggaagaagaggggcagtgggagcagaggaggtggctcctgccccagtgagagctctgagggtccctgcctgaagagggacagggacyggggcttggagaaggggctgtggaatgcagcccccttcactgctgctgctgctgctgctgctgctgctgctatgtgtctcagtggtcagacccagaggtg

SEQ ID NO: 24200 - DNA, 201 bp, Homo sapiens
ctgctgctgctgctgctgctgctatgtgtctcagtggtcagacccagaggtgaggcatggcgtgggtgaggtgaggggacccagctcccttaggaggatgwtcagtggggtgggggaagagggccaagccccaggccgtgtgagggatgctggatggaggagattctcactgcccaaatagagacggcctccagggaaaga

SEQ ID NO: 24201 - DNA, 201 bp, Homo sapiens; identical to SEQ ID NO: 4785

SEQ ID NO: 24202 - DNA, 201 bp, Homo sapiens
agcaatcacccaaggccacttgaagctctctctagccaagccaaggagtcctccaaatctgtctttgctccccaaaatctctactcttacatccccaaatyttcccttgcttacttgcccattctcatctctgtcctaccaaatcacccaaagatccctcctttccagtcctcctgcacagcctctgtgtatgcatgttga

SEQ ID NO: 24203 - DNA, 201 bp, Homo sapiens
gactcaacgtggagcaactcaactctgtcctgatcatcataacccaggcagagtggaccacacttaatccagctacactcaacgcatttcaccccaccccwctcacttcgatgtcacgccaccctctttgtaaaagaacactaaaataaggtttgatatgagaagagctcgggaaagagattatgatggagttaagggata

SEQ ID NO: 24204 - DNA, 201 bp, Homo sapiens
tattaactccttgggcccagaccagtctccacccaggaatgttagtggtccccaaggtaaaggcctctacacccagagattgggccctgaatacacccttyctcctcctcacataccttatttatttatttatttatttatttatttatttatttatttttgagatggagtcccagtctgtcacccagggtggagtgcagt

SEQ ID NO: 24205 - DNA, 201 bp, Homo sapiens
cataccttatttatttatttatttatttatttatttatttatttatttttgagatggagtcccagtctgtcacccagggtggagtgcagtggcacgatctyggctcactgcaaccttcacctcctaggttcaagtgattctcctgcctcagcttcccaagtagctgggattcgtgtgccaccatgcccagctaattttttt

SEQ ID NO: 24206 - DNA, 201 bp, Homo sapiens
agtagagacggggtttccccatgtttgccaggctggtctcacactcctaacctggtgatccacctgcctcggcctcccaaagtgctgggattacaggcgtragccatggcgcccggccccccacttatctttgtatatccctgtttgtctctctccccaggcatagacgtctcttccctttgccacaatggaggcctctgt

SEQ ID NO: 24207 - DNA, 201 bp, Homo sapiens
ttgcctctcagcctttatccctgctattgacactacctggaatggccttcccaacccctcttccacaggctggtgttcaggaggcatcttcttcaggaagrtgtccctaacttctccccaggctggattagggcctcttctttgtggtccaggtcactaagccaggagaggcaaagctggcattcaagtctaagcagcctg

SEQ ID NO: 24208 - DNA, 201 bp, Homo sapiens
tcttttgttattgacaaacggtagtcatacgtatctatggggtacatgtgagttttttggtttctttttttttttctctctcgtttttggagacagagtcrctctatcccccaggctgaagggcagtggcataatcttggctcactgaaacccccgcctcccaggttcaagcagttctcatgtctcagcctcccgagtagc

SEQ ID NO: 24209 - DNA, 201 bp, Homo sapiens
tagtcatacgtatctatggggtacatgtgagttttttggtttctttttttttttctctctcgtttttggagacagagtcgctctatcccccaggctgaagkgcagtggcataatcttggctcactgaaacccccgcctcccaggttcaagcagttctcatgtctcagcctcccgagtagctgggattacaggaacgcgcca

SEQ ID NO: 24210 - DNA, 201 bp, Homo sapiens
cagaaaagatgccccaggatcccttcacctgcacatctagcactgggccaacatccaggaatgagctaggatggaggcagtgactgatgcagtgtgtgacrtctaatctcccccataattacaggccagtggtgtgaggtggagatagacccctgccacagccaaccctgctttcatggagggacctgtgaggccacagca

SEQ ID NO: 24211 - DNA, 201 bp, Homo sapiens
atctatggggtacatgtgagttttttggtttctttttttttttctctctcgtttttggagacagagtcgctctatcccccaggctgaagggcagtggcatratcttggctcactgaaacccccgcctcccaggttcaagcagttctcatgtctcagcctcccgagtagctgggattacaggaacgcgccaccacgcctggc

SEQ ID NO: 24212 - DNA, 201 bp, Homo sapiens
atttatggacctcagatgcatggaattagactaatcttaagctttggttcctgatacactgacattggtttatgcctggtcttcttttattttattattctaacaatgtaacacccatgaacctaacccaagaatttcaatattaataataacttacatctacttaagtcctcctcctgtatcctgttccctctccagagg

SEQ ID NO: 24213 - DNA, 201 bp, Homo sapiens
cgccaccacgcctggctaatttttgtatttttagtagagatggggtttcaccatgttgggcaggctggtctcagaactcctgacctaaagtgatccacccrctcagcctgccaaagtgataagattacaggtatgagccaccgcacctggacacatgtgatattttgatacatgcatacaatgtatcatgatcaaatcagg

SEQ ID NO: 24214 - DNA, 201 bp, Homo sapiens
ttcaggtgaatctgatccagactcgtttgagaaaaccactgctaggccgggcgtggtggctcacgcctgtaatcccagcactttgggaggccaaggcgggyggatcacaaggtcaggagatcgagaccatcctggctaacacagtgaaaccccgtctctactaaaaatacaaaaaattagccgggcgtggtggcgggagcc

SEQ ID NO: 24215 - DNA, 201 bp, Homo sapiens
aatttaaaatgttaggcaatctgttttaacaagcccttcaggtgaatctgatccagactcgtttgagaaaaccactgctaggccgggcgtggtggctcackcctgtaatcccagcactttgggaggccaaggcgggtggatcacaaggtcaggagatcgagaccatcctggctaacacagtgaaaccccgtctctactaaa

SEQ ID NO: 24216 - DNA, 201 bp, Homo sapiens
tttcaccatgttggtcaggctggtcctgaactcctgacctcgtgatctgcccacctcggcttcccaaagtgctgggattacaggcgtgagccactgcgccyggcccaagattataatttcaaaatgtagtcagcataaaagattagtaatggatatctcacattttgttttttattcagtctttgaaatctgatgtgtatt

SEQ ID NO: 24217 - DNA, 201 bp, Homo sapiens; identical to SEQ ID NO: 4737

SEQ ID NO: 24218 - DNA, 201 bp, Homo sapiens
aagggcagctctgtgaggtggagaccaacgagtgtgcctcagctccctgcctgaaccacgcggattgccatgacctgctcaacggcttccagtgcatctgyctgcctggtgagtacagatgcctctctggccaccctcagaccccaggcctctgaacctgcagagttcaggctcagcaatcacccaaggccacttgaagct

SEQ ID NO: 24219 - DNA, 201 bp, Homo sapiens
catgtccccaggcttagaagggcagctctgtgaggtggagaccaacgagtgtgcctcagctccctgcctgaaccacgcggattgccatgacctgctcaacrgcttccagtgcatctgcctgcctggtgagtacagatgcctctctggccaccctcagaccccaggcctctgaacctgcagagttcaggctcagcaatcacc

SEQ ID NO: 24220 - DNA, 201 bp, Homo sapiens
caagccccaggccgtgtgagggatgctggatggaggagattctcactgcccaaatagagacggcctccagggaaagacggctctgcccatggagctgcttygggcctggtgccaggggtggtgactgctgggggatgggtgagagggtgcccacctccaggaagaacctcgtcagcactggcactggaggactcttgcagc

SEQ ID NO: 24221 - DNA, 201 bp, Homo sapiens; identical to SEQ ID NO: 4740

SEQ ID NO: 24222 - DNA, 201 bp, Homo sapiens
agaaacggctccctctgtcctctgcctcaggtgagcagtgccagcttcgggacttctgttcagccaacccatgtgttaatggaggggtgtgtctggccacrtacccccagatccagtgccactgcccaccgggcttcgagggccatgcctgtgaacgtgatgtcaacgagtgcttccaggacccaggaccctgccccaaag

SEQ ID NO: 24223 - DNA, 201 bp, Homo sapiens; identical to SEQ ID NO: 4767

SEQ ID NO: 24224 - DNA, 201 bp, Homo sapiens
gagccacagccctcatggtccccatgtccccaggcttagaagggcagctctgtgaggtggagaccaacgagtgtgcctcagctccctgcctgaaccacgcrgattgccatgacctgctcaacggcttccagtgcatctgcctgcctggtgagtacagatgcctctctggccaccctcagaccccaggcctctgaacctgca

SEQ ID NO: 24225 - DNA, 201 bp, Homo sapiens
aattaaaaaaccaaacatctttttccttgaatttgcccagatttggcatctcttgcctacatgaccctctctccaatgttcagcccctcagtccccatgartttggtcccttatttcctttccatcttaaagacacaagccccttccccaatttggtctcgtctgccacacgcaggcccccacaccttccctgacagtctc

SEQ ID NO: 24226 - DNA, 201 bp, Homo sapiens
tatctcccaggggcagtagtaggtgctcaaaacatcacagcccggattggcgagccactggtgctgaagtgtaagggggcccccaagaaaccaccccagcrgctggaatggaaactggtaagcggggctcctgttgcagcctcccaacttccagggagaccagcaatgatttggatccccgtcactctgcctcacagtcct

SEQ ID NO: 24227 - DNA, 201 bp, Homo sapiens
ccaaccatgagggacatgactcaacgtggagcaactcaactctgtcctgatcatcataacccaggcagagtggaccacacttaatccagctacactcaacrcatttcaccccaccccactcacttcgatgtcacgccaccctctttgtaaaagaacactaaaataaggtttgatatgagaagagctcgggaaagagattat

SEQ ID NO: 24228 - DNA, 201 bp, Homo sapiens
tgttcgaatgggggcacctgccagctgatgccagagaaagactccacctttcacctctgcctctgtcccccaggtgtgtcctcacaggggctctccggccrcccctctctctgggcagggcaggatgtctccgttggagcctcctcccacagctgatccatgaccctgtcaggtttcataggcccgggctgtgaggtgaat

SEQ ID NO: 24229 - DNA, 201 bp, Homo sapiens; identical to SEQ ID NO: 4786

SEQ ID NO: 24230 - DNA, 201 bp, Homo sapiens
tctcgaactcctgacctcaaatgatcttcccgcctcaacctctgaaagtgctgggattacaggcatgggccaccacacttggcccttgtgttttcaataayagccactttaactggtgtgagatgatatctcattgtggttttgatttacatttccctgatttgcatccatatacctgttggccatttgtatgtcttcttt

SEQ ID NO: 24231 - DNA, 201 bp, Homo sapiens
ggtcccaggccattcaggagaaggtttttgaagtaagggatttcgaggagctggagtgggcagaggaccatctctgggctgagaatctgatgctatgtccwgcctcacgctccctcccacccctcagactctgatggacttatgtgcccagaagccctgcccacgcaattcccactgcctccagactgggccctccttcca

SEQ ID NO: 24232 - DNA, 201 bp, Homo sapiens
cgaactcctgacctcaaatgatcttcccgcctcaacctctgaaagtgctgggattacaggcatgggccaccacacttggcccttgtgttttcaataatagscactttaactggtgtgagatgatatctcattgtggttttgatttacatttccctgatttgcatccatatacctgttggccatttgtatgtcttcttttga

SEQ ID NO: 24233 - DNA, 201 bp, Homo sapiens
actgactcaggaatttaaaatgttaggcaatctgttttaacaagcccttcaggtgaatctgatccagactcgtttgagaaaaccactgctaggccgggcgyggtggctcacgcctgtaatcccagcactttgggaggccaaggcgggtggatcacaaggtcaggagatcgagaccatcctggctaacacagtgaaaccccg

SEQ ID NO: 24234 - DNA, 201 bp, Homo sapiens
gtcaaaggcaaggcaggatcagttgatagcatgaatggaattttcaaaaatcacaggcgttgcctaagggaaggtcaggagctccccaagctcaagctgcrtggtgggtggcctcagataggttattttaactctgtgtgtgtttgtatatgtatttatggacctcagatgcatggaattagactaatcttaagctttggt

SEQ ID NO: 24235 - DNA, 201 bp, Homo sapiens
gcccgccaccacacctggctaattttttgtatttttagtagagacagggtttcaccatgttagccaggatggtctcgatctcctgacctcatgatccaccygcctcagcctcccaaagtgctgagattataggagtaagccactacacccagccactaatttttatatttttagtagagagggggttttgccatgttggcc

SEQ ID NO: 24236 - DNA, 201 bp, Homo sapiens
aaggcaggatcagttgatagcatgaatggaattttcaaaaatcacaggcgttgcctaagggaaggtcaggagctccccaagctcaagctgcgtggtgggtrgcctcagataggttattttaactctgtgtgtgtttgtatatgtatttatggacctcagatgcatggaattagactaatcttaagctttggttcctgatac

SEQ ID NO: 24237 - DNA, 201 bp, Homo sapiens
gctgcctgccgtattaaaacaatggtgcgagcagagggtgatgctggtcctacattcatccacgtctagttaccgaaaaaaggaaggggctgagagagggrgcgggggcaagcacctgggtaggtggggaggacaagctgactcacccacatgacagtgcttccctccccagccgggggcgcactcgcactggtcaggcct

SEQ ID NO: 24238 - DNA, 201 bp, Homo sapiens
atggcgtgaacctgggaggtggagcttgcagtgagccgagatcgcgccactgcactccagcctgggcgacagagggagactccatctcaaaaaaaaaaaaagaaaaataactgctatatcgtactttgtgccttactctaagcattttacattgttacctcatttaatcctcccccacaaccccatgaggcacgtactgct

SEQ ID NO: 24239 - DNA, 201 bp, Homo sapiens
cagaatccatattagactctggggagtgaaaaattaaattaaatcagtaagatggggagtgggggaagagtcagagggaactttgcccacctttgaagatsaaatcaagaaatcagggaaagcaaagacttaggagaggagaaagacattctctcaatccatcctccttccccagggcagagaattaaacaacgttactga

SEQ ID NO: 24240 - DNA, 201 bp, Homo sapiens
gcctgccgtattaaaacaatggtgcgagcagagggtgatgctggtcctacattcatccacgtctagttaccgaaaaaaggaaggggctgagagagggggcrggggcaagcacctgggtaggtggggaggacaagctgactcacccacatgacagtgcttccctccccagccgggggcgcactcgcactggtcaggcctaac

SEQ ID NO: 24241 - DNA, 201 bp, Homo sapiens
ctggaggtgggcaggaagcagacatagctcaaatactgagcagccaaaaaaagaagaagatggcgagaaacaggaagagggaatcctgccagctggaggcygggtgaccctgtcccagatccacacctgtgggagagaggaaagctgtggaagcatatgctcctaggctgggagggggcctgaggggattcacagggctcc

SEQ ID NO: 24242 - DNA, 201 bp, Homo sapiens; identical to SEQ ID NO: 4715

SEQ ID NO: 24243 - DNA, 201 bp, Homo sapiens
tcattgtgtgaaattaccacaggacatggtttcaacatccacaaaatgattaacttgatgctctctgaggcgccttttagatatgagaatctaggaccctctgcaccgtcttaacccaagagtttgcttgatggagagcgggaagaataatgcaagttgcatctccaatatctcccctcccctccacagggttttgaaggc

SEQ ID NO: 24244 - DNA, 201 bp, Homo sapiens
caacatccacaaaatgattaacttgatgctctctgaggcgccttttagatatgagaatctaggaccctctgcaccgtcttaacccaagagtttgcttgatrgagagcgggaagaataatgcaagttgcatctccaatatctcccctcccctccacagggttttgaaggccccacctgcagccacagggccccttcctgcgg

SEQ ID NO: 24245 - DNA, 201 bp, Homo sapiens
actaaacaggggtcgaagactctggactccaacctagggtaatggggtggcatcagtatttaatgtggggcgtggcctttgggctcctctctaagagttgwaggaactcaggtctcaagcctccttccctaagccttgctgccatggagtatttcccctagcagtcagcacctcacagagggaaaagggcctgggactctc

SEQ ID NO: 24246 - DNA, 201 bp, Homo sapiens
gacattggtttatgcctggtcttcttttattttattattctaacaatgtaacacccatgaacctaacccaagaatttcaatattaataataacttacatcyacttaagtcctcctcctgtatcctgttccctctccagaggaagaggaagacatatgatcctatttctaaggagtaagataataatataacagccggccgg

SEQ ID NO: 24247 - DNA, 201 bp, Homo sapiens
tgttgcctttgttgcctggctgttgaggtcttacccaaaaaacttttgcccagaccaatgtcttgaagcatttcccaaatgatttttttttttttttttttgagaaggagtcttgcaccgtcgcctgggctggagtgcagtggcgcaaatttgactcactgcaacctttgcctcctgggttcaagcgattctcctgcctta

SEQ ID NO: 24248 - DNA, 201 bp, Homo sapiens
ttgttgcctttgttgcctggctgttgaggtcttacccaaaaaacttttgcccagaccaatgtcttgaagcatttcccaaatgatttttttttttttttttttgagaaggagtcttgcaccgtcgcctgggctggagtgcagtggcgcaaatttgactcactgcaacctttgcctcctgggttcaagcgattctcctgcctt

SEQ ID NO: 24249 - DNA, 201 bp, Homo sapiens
gttgttgcctttgttgcctggctgttgaggtcttacccaaaaaacttttgcccagaccaatgtcttgaagcatttcccaaatgatttttttttttttttttttgagaaggagtcttgcaccgtcgcctgggctggagtgcagtggcgcaaatttgactcactgcaacctttgcctcctgggttcaagcgattctcctgcct

SEQ ID NO: 24250 - DNA, 201 bp, Homo sapiens
gcctctctgagcctcagacaggcctctgcactgaagacagaaaagggcagattgcttttccaattaaaaaaccaaacatctttttccttgaatttgcccasatttggcatctcttgcctacatgaccctctctccaatgttcagcccctcagtccccatgaatttggtcccttatttcctttccatcttaaagacacaagc

SEQ ID NO: 24251 - DNA, 201 bp, Homo sapiens
tgttgttgcctttgttgcctggctgttgaggtcttacccaaaaaacttttgcccagaccaatgtcttgaagcatttcccaaatgatttttttttttttttttttgagaaggagtcttgcaccgtcgcctgggctggagtgcagtggcgcaaatttgactcactgcaacctttgcctcctgggttcaagcgattctcctgcc

SEQ ID NO: 24252 - DNA, 201 bp, Homo sapiens
cagcctggctattcggggcccacctgccaccaggacctggacgagtgtctgatgggtgaggccactcccacttcagagcctctctgagcctcagacaggcstctgcactgaagacagaaaagggcagattgcttttccaattaaaaaaccaaacatctttttccttgaatttgcccagatttggcatctcttgcctacatg

SEQ ID NO: 24253 - DNA, 201 bp, Homo sapiens
aagcagccacaagttaaaaacatggtttctcacttcccaacttcggccttgagagaaagggacagcacggagcaatcccccaaatgagaggacatgaggtsggggaggcctggaattgtcattcatggaggagcagaggaagggggttctgggaggccaagtctctactaaaaccccgtctctactaaaaatgggggataa

SEQ ID NO: 24254 - DNA, 201 bp, Homo sapiens
tcagacccagaggtgaggcatggcgtgggtgaggtgaggggacccagctcccttaggaggatgatcagtggggtgggggaagagggccaagccccaggccrtgtgagggatgctggatggaggagattctcactgcccaaatagagacggcctccagggaaagacggctctgcccatggagctgcttcgggcctggtgcca

SEQ ID NO: 24255 - DNA, 201 bp, Homo sapiens
gaatgcagcccccttcactgctgctgctgctgctgctgctgctgctgctatgtgtctcagtggtcagacccagaggtgaggcatggcgtgggtgaggtgargggacccagctcccttaggaggatgatcagtggggtgggggaagagggccaagccccaggccgtgtgagggatgctggatggaggagattctcactgccc

SEQ ID NO: 24256 - DNA, 201 bp, Homo sapiens
ggcctcgccccacccagcaggcttggctcacctgctccagccgctccaggcgccctcgcagctcgtgaatctcctgcttcagagcgcgctcatctttttcygcctcccgaactagggacaaaggagaccaagagtgtgaccactacccgagcccggacgcccgtcccgagtccctcgggtggcccgtactcctgcccactc

SEQ ID NO: 24257 - DNA, 201 bp, Homo sapiens
agaaggggctgtggaatgcagcccccttcactgctgctgctgctgctgctgctgctgctgctatgtgtctcagtggtcagacccagaggtgaggcatggcrtgggtgaggtgaggggacccagctcccttaggaggatgatcagtggggtgggggaagagggccaagccccaggccgtgtgagggatgctggatggaggag

SEQ ID NO: 24258 - DNA, 201 bp, Homo sapiens
tttgggttggggcagagttcattggtgggtgtttgatggttgggatgtgagaatagaatgagaatggtatcctttaaagttatttagtgtaaaacctgcayaattgtacaaccatggggacaagggcaggggttaccgtagggcccacatgggcccagtgtaaatggtgtgattgcggcttgggagcagaggacggggctc

SEQ ID NO: 24259 - DNA, 201 bp, Homo sapiens
gtgatggctgagatgagtcttgaaagataagcagaggctgggcgtggtggctcacgcctatagtcccagcacttcgggaagccgaggcgggtggatcaccygagattaggagttcgagatcagcctggccaacatggtgaaaccttgtctctattaaaaatacaaaaattacaatttgggaggccgaggcgggtggatcat

SEQ ID NO: 24260 - DNA, 201 bp, Homo sapiens
cagtgggagggctcaactggtaagtgttatccaaggagaagagagtccacaaaaactggtggaaacagaggaccagggggtcagagcagaaagaagagcaytaaatcccagggcgaattaatcattcattagaaaaatatctgctgaggccaggcgcagtgctgattacggtctcatgccggtaatcccagcactttggga

SEQ ID NO: 24261 - DNA, 201 bp, Homo sapiens
gatggagaattcctggccccaggggctatagcagatccgatagaggttagaccgcatggaggtggggaacagccacttcaagtagtccgtgtctggcaagygaatggcaatgctaagtgaccataaacctctgttcccccaaaactcagggcattctatggagtctagtgcccactcacctccatactgtcccatctgtgg

SEQ ID NO: 24262 - DNA, 201 bp, Homo sapiens
ggccattggacacctcactatggccccccgggccaatagagtcttcaacccaaaagaatcccgcagataaaccttcaaggtggtcgaaggggcgtggaagyatggaagagagacacaaggagagacaaagtgagttactgctgggatcctggacctcctccccacagggtgaacccttcagctcaggagtcacagagaggg

SEQ ID NO: 24263 - DNA, 201 bp, Homo sapiens
aggctaaggtgggaggatgacttgagcccagaaggttaagactgcagtgagctctgatggcaccactgcctgggtaacagagcaagaccctatctaaaaayaataaaatatcatataaataaaaattaattggatggcagtgagctgtcgttttgatgggggtggggggtgtatgtcctatgtacagtgtgactgaggtca

SEQ ID NO: 24264 - DNA, 201 bp, Homo sapiens
ccctccttccactgcttgtgcctccagggatggaccgggcctctctgcaaccttccactgtcctcctgccagaaggctgcactgagccaaggtaaccaacrccggcactgactggagagcaaatgaagaaaatatgggtgttctcacctgccccgttcctgtgggcttccacacagcttttggccaaaacaaccacctgag

SEQ ID NO: 24265 - DNA, 201 bp, Homo sapiens
ggacgcagccgggagagcgactgccccaggtgggggctggggggacgtaagggaagaataatgattatctggctgtgtttttgtttaaaaaaaaaaaaaaactggtgtaaatctccatagacttcctatcctcgctcccttcacccacccacgcgctcccaagatgcaataagcaaataaaaagactaataacgctgtact

SEQ ID NO: 24266 - DNA, 201 bp, Homo sapiens
ctgctattgacactacctggaatggccttcccaacccctcttccacaggctggtgttcaggaggcatcttcttcaggaagatgtccctaacttctccccasgctggattagggcctcttctttgtggtccaggtcactaagccaggagaggcaaagctggcattcaagtctaagcagcctgattcatatgctcagaaccac

SEQ ID NO: 24267 - DNA, 201 bp, Homo sapiens
aaggcctctccaggcttcgttgcccccagcgacccaaaagtccgatttccccgccttgattctccccacttcccaatacaggcgtctggctccgcagcagracacgaagtttgcattccccaaggggcggccagggggcggaccagggaaaggtagtcctctgcattttgccgtgtgctgggtgagtggcagggtggcctg

SEQ ID NO: 24268 - DNA, 201 bp, Homo sapiens
tgagtagttgtcagtcataaccaaagccataagcaatttgctcgggactacctatagacctcgcccactataagcccctttctttccttcgcttcctcttytagagaatgtccggattgctattggactttggagcgtatggctccaaatcaactcattggctaaaacttgacggaaaatggtggttaggtaaaacgcgcc

SEQ ID NO: 24269 - DNA, 201 bp, Homo sapiens; identical to SEQ ID NO: 4724

SEQ ID NO: 24270 - DNA, 201 bp, Homo sapiens
tggcatcagtatttaatgtggggcgtggcctttgggctcctctctaagagttgtaggaactcaggtctcaagcctccttccctaagccttgctgccatggrgtatttcccctagcagtcagcacctcacagagggaaaagggcctgggactctcctttagaaacagaggagagcttgggagggtacagagaggggacagtc

SEQ ID NO: 24271 - DNA, 201 bp, Homo sapiens; identical to SEQ ID NO: 4726

SEQ ID NO: 24272 - DNA, 201 bp, Homo sapiens
gggccagacaccagtttttttaagagggcagagggaggaaagggagccagggaccaatacagaggtctctgaggtgcctcctctacaggtttgtggtggtmatgggtgtggatttgtcccgctgtggccctgaccacccggcatcccgctgtccctgggaccctgggcttctactccgcttccttgctgcgatggctgcag

SEQ ID NO: 24273 - DNA, 201 bp, Homo sapiens; identical to SEQ ID NO: 4727

SEQ ID NO: 24274 - DNA, 201 bp, Homo sapiens
tcccaccagcaccccctgccaaccagcttccctggcctgtgctgtgctccccagtggccggggtgattctcctggccctaggggctcttctcgtcctccarctcatccggcgtcgacgccgagagcatggagctctctggctgccccctggtttcactcgacggcctcggactcagtcagctccccaccgacgccggcccc

SEQ ID NO: 24275 - DNA, 201 bp, Homo sapiens
cagaggaagaaactgaagtcagagaaaagcagaaaagtcacttggctaaagccacacagagccagaacttagcttcccaacacctcaggttttgattctcyctgagcttacatgttgtcccttcccccttgttgtgtcctttagattgacccattactctgtcttaccaacagatggggtgacacccctgatgtcagcagt

SEQ ID NO: 24276 - DNA, 201 bp, Homo sapiens
acctgacagggaaactgcggaggatggctgaatatggattgcgagtggggttaatagtgtaaggaactcgagttggcagtccaaggtaccccaggggtcastggccctctgtctccccagcttctgctccgtagcagacaaactgcagtggacgctcgcacagaggacgggaccacacccttgatgctggctgccaggctg

SEQ ID NO: 24277 - DNA, 201 bp, Homo sapiens; identical to SEQ ID NO: 4732

SEQ ID NO: 24278 - DNA, 201 bp, Homo sapiens
gcagcaatatgttgctaggtttgaaacatggagtcatgaggcattttgaaagccaataatatctacagtttattaagtattcactatgcatcaagtgcttyattacattattaatacatcaaccctatgaagtaggtgctattaaaaccctatttcactcagaaattgaggcacagagatctgcccaagattgcaaggaat

SEQ ID NO: 24279 - DNA, 201 bp, Homo sapiens
cagctaattttttgtattttagtaaagatggggtttcaccatgttccccaggctggtctccaactcctgagctcaggcaatccacccgcctcagcctcccraagtgctaggattacaggtgtgagccaccgcagccggccatctcctgaatagattttaaatacctagaggtcagggatgattattcaatacatatatatt

SEQ ID NO: 24280 - DNA, 201 bp, Homo sapiens
aggtgtcccctgccagacctcattgatgtattccagcaggtggcggaagctgtacgagctgtcgaagagcccatgcaccacgatgaccggcttgtaggackcgcggtggggcgcgggggctgcaagcagcagcagcggcaggaaaggcaacagaagcaggacccacgccgcggggagccgctgcccccagagccccagcat

SEQ ID NO: 24281 - DNA, 201 bp, Homo sapiens
gcctgagtgacccatgtcccgttggagccagctgccttgatcttccaggagccttcttttgcctctgcccctctggtttcacaggttcacaggggaggcaytggaaagaactggcagaatattttattccatttgggttggggcagagttcattggtgggtgtttgatggttgggatgtgagaatagaatgagaatggtat

SEQ ID NO: 24282 - DNA, 201 bp, Homo sapiens
acttagttagccttcctgcttgtctgatcttccaacacctaaagctctgtccatcctcaacacactcaaccctctcctttctcctctccccaacaaacacrtacaaattttcgtgccctctcttttctgcctttcaagttaatttctaatttccttcagccacctctttctgggtctcctcttttcaaccccaaccccatc

SEQ ID NO: 24283 - DNA, 201 bp, Homo sapiens
ctgttgttgcctttgttgcctggctgttgaggtcttacccaaaaaacttttgcccagaccaatgtcttgaagcatttcccaaatgatttttttttttttttttttgagaaggagtcttgcaccgtcgcctgggctggagtgcagtggcgcaaatttgactcactgcaacctttgcctcctgggttcaagcgattctcctgc

SEQ ID NO: 24284 - DNA, 201 bp, Homo sapiens
ccttcaatcttccctaagcaacacctccagtctctcacctgggatcctggggcttctggctccctcgcccataaagcgggacaaccttctctctgctgatmccagctttacatactggacactcttgccgttctggccgtgtctccagccactggggagaaaaaaggtggtttccagtatacaagagggtcttacagctcc

SEQ ID NO: 24285 - DNA, 201 bp, Homo sapiens
atggcagggacatggtgtacccctatcctggggcccgggctgaagaaaagctaggaggaactcgggaccccacctatcaggagagagcagcccctcaaacrcagcccctgggcaaggagaccgactccctcagtgctgggtaagaagctaggtggagggaagggccagacaccagtttttttaagagggcagagggaggaa

SEQ ID NO: 24286 - DNA, 201 bp, Homo sapiens
ctggctgtgttagtttacattcccaccaacagtgtatgagggttcccctttctctgcatccttgccagcatctgctattttttgcattttttttccttttytgagacagagtcttgctgtgttgcccaggctggatcacagtgacttgatctcagctcactgcaacctctgcctcccagattcaagcgattcttgtacttc

SEQ ID NO: 24287 - DNA, 201 bp, Homo sapiens
gtattgctctgttgcccagcctggagtgcagtggcacaaatggctcactgcagccacaacctcctgggctcaagcaatcttcctacctcagcctctcattkttccatatctatatctcttatgcccaaaataaactttcccctgccccttgtctgcactaaactataagtttccaaaatgaacccttcccgtactctattt

SEQ ID NO: 24288 - DNA, 201 bp, Homo sapiens
tgtgtgtgtggttgccattttattttcttttgttattgacaaacggtagtcatacgtatctatggggtacatgtgagttttttggtttctttttttttttctctctcgtttttggagacagagtcgctctatcccccaggctgaagggcagtggcataatcttggctcactgaaacccccgcctcccaggttcaagcagtt

SEQ ID NO: 24289 - DNA, 201 bp, Homo sapiens
agccggcaaatctgtcaaggaagggacacaactggacaagaagactcacccctctgctctccggagctggtctctggccctgggggcggggtggagttttyaatctgaggaagtggagagagaaagttaacagggatttttctcctcccatcttccacaccgttttccaagggcagaagccttcaatcttccctaagcaac

SEQ ID NO: 24290 - DNA, 201 bp, Homo sapiens
tgggctcaagcaatcttcctacctcagcctctcattgttccatatctatatctcttatgcccaaaataaactttcccctgccccttgtctgcactaaactrtaagtttccaaaatgaacccttcccgtactctatttggtacacatcttgtctcctgaatagagtgtattttttattttattttattttggagacggagtc

SEQ ID NO: 24291 - DNA, 201 bp, Homo sapiens
ttgtgtgtgtggttgccattttattttcttttgttattgacaaacggtagtcatacgtatctatggggtacatgtgagttttttggtttctttttttttttctctctcgtttttggagacagagtcgctctatcccccaggctgaagggcagtggcataatcttggctcactgaaacccccgcctcccaggttcaagcagt

SEQ ID NO: 24292 - DNA, 201 bp, Homo sapiens
gtgaccctgtcccagatccacacctgtgggagagaggaaagctgtggaagcatatgctcctaggctgggagggggcctgaggggattcacagggctccctsatgggagctgagtgtgactcttacctgtaccccggcggaaaggctcatgggcattgaagacggtggtgaaaaagccaaagggaaaagcaccaacaccaaa

SEQ ID NO: 24293 - DNA, 201 bp, Homo sapiens
atcacttgaacccaagaggcggaggttgcagtcagccaagatcatgccactgcactccagcctgggtgacagagcaagactccgtctcaaaaaaaaaaaaatctgctgagcacctactttgtgtggctactgttccaggccctgggggaaacacaaagcaaaagagataaagcaactgctctcgtagagctttcattctaa

SEQ ID NO: 24294 - DNA, 201 bp, Homo sapiens
ccgccgccccgcccccgccggcgccagcccagactgcccaggcccctggcttcgtggtgcccacgcacgcggggactgtgggcacgctgccgctggggggytacgtagcgcccggataccccctgcagctgcagccttgcactgcttacgtgccggtctacccggtgggcacggtgagtgccgggcagacagggacatggg

SEQ ID NO: 24295 - DNA, 201 bp, Homo sapiens
aggaaaactgagtaacagaatggttaagtaacttgcccaaaggcacccaatagggtcaagattcaaacccaagtattctggccccatggtctggtctagargttggcaaactgtgaccaaaggaccaaatccagcctgctacttgtttttgtaaatgaagttttactggaacacaggcacattcattcacatatggtacat

SEQ ID NO: 24296 - DNA, 201 bp, Homo sapiens
gacctgtgaagtccctgcccagccctctcctcaaatccactggatgaaggatgtgagtgacctggagagaggggctgggaggtagggtgaaccataactakcaacagggagggcagagggctaacgagggaaaggcaggctaggagctgaggaggaagagagggtatctgaagatatggagacaaaaagacaagggttttg

SEQ ID NO: 24297 - DNA, 201 bp, Homo sapiens
gggcagtagtaggtgctcaaaacatcacagcccggattggcgagccactggtgctgaagtgtaagggggcccccaagaaaccaccccagcggctggaatgraaactggtaagcggggctcctgttgcagcctcccaacttccagggagaccagcaatgatttggatccccgtcactctgcctcacagtcctttcccaaagg

SEQ ID NO: 24298 - DNA, 201 bp, Homo sapiens
tccacccgctgtttacttatcccaagtctggaacccacggtggcggggggaagggtgaggaaagagagcgcaggggaatgacggatgggagggggaagggcgggctgcttggggtcgcgcaaatccgtcacgtccggggctttctctggcaaccgcgcgagcgttccccgcaacacagacccaggacaggaggggcaatgg

SEQ ID NO: 24299 - DNA, 201 bp, Homo sapiens
gtgcaggacagcacaggctctaatttcctgccccattctggccttatccctaacagccaccccacctctccctccatgcacccacacccaagcctcccctrccccacccaaattctgccaagagagcagccaagcctctcccttcttccctctgagctaaaaaaaggaacagacggctgggcgcggtggctcacgcctgta

SEQ ID NO: 24300 - DNA, 201 bp, Homo sapiens
caggcatggtggcacatgcctgtaatcccagctacctgggaggccagctacttgagaggctgaggcaggagaattgcttgaacccaggaggcatagattgygatgagccaagatcgcaccattgcatgccagcctgggcaacaaaagtgaaactccatctcaaaaaaaaaaagaaagggaaagactccactggggctccca

SEQ ID NO: 24301 - DNA, 201 bp, Homo sapiens
ggggcttggaggaaagagggaatgcctgaatggagaggggtcttggggaaagttggggaatagaagtcaaggcgggaggagtgtgaggactcacaggcacmtagcctctcctccagcagcagcacctggtcgctgagagattcgatccggtcaccccggccccacagctcagccacctgttctggctgcagctcttcaggc

SEQ ID NO: 24302 - DNA, 201 bp, Homo sapiens
gaatacagcaccaggggatccagagctgaaagggagttagagaaaaaaaagatgcagctggagccagagatgggggcaaagaccgagggagagccctgggscggggctcgcaagaggacactggtagatgtggggaggagatgccagagtttctgggagacgattggcaaaacaggctgcccatcaccgccctccacttcc

SEQ ID NO: 24303 - DNA, 201 bp, Homo sapiens
gctcattgcaacctccgcctcctggtttcaagttctcctgcctcagcctcctgagtagctggaactacaggcgtgcgccaccaggcccactaatttttgtrtttttagtagagatggggtttctcaatgttagccagctgttctcgaactcctgacctcaggtgatccacccgcctcggcttcccaaagtgctgggattat

SEQ ID NO: 24304 - DNA, 201 bp, Homo sapiens
ggtgtgcccctggcttcctgggtgagacgtgccagtttcctgacccctgccagaacgcccagctctgccaaaatggaggcagctgccaagccctgcttccygctcccctagggctccccagctctccctctccattgacacccagcttcttgtgcacttgcctccctggcttcactggcgagagatgccaggccaagcttg

SEQ ID NO: 24305 - DNA, 201 bp, Homo sapiens
agacatccgtgcaggtccctgaccttcctgctgtgccacaggctttgaagggccacgctgtcaaacagaggtggatgagtgcctgagtgacccatgtcccsttggagccagctgccttgatcttccaggagccttcttttgcctctgcccctctggtttcacaggttcacaggggaggcattggaaagaactggcagaata

SEQ ID NO: 24306 - DNA, 201 bp, Homo sapiens
atattaatgtaaacatgacaaaatgttaacatttgcgaaatctaggtgaggagtataaatgactgctttttgctattttggtaacttttttttttttttttgagacagggtcttactctgtcacccaggcaggagtgcaatggtgagatctcggctcactgcagccttggcctcctaggctcaagcaattctcgtacctca

SEQ ID NO: 24307 - DNA, 201 bp, Homo sapiens
ggagggagtgggcaagaataggaagaggggccagtgatgtgagttttcctctcctcccctgcccaggtgtgcccctggcttcctgggtgagacgtgccagwttcctgacccctgccagaacgcccagctctgccaaaatggaggcagctgccaagccctgcttcccgctcccctagggctccccagctctccctctccatt

SEQ ID NO: 24308 - DNA, 201 bp, Homo sapiens
aggagggtggatcatctgaggtcaggaattcgagaccagcctggccaacacggagaaaccctgtctctactaaaaatacaaaattagctgggcgtggtggrcgcctgtaatcccagctactcaggaggcagaggcaggagaattgcttgattctgggacgcaaaggttgcagtgagccgggatggcgccactgcactccag

SEQ ID NO: 24309 - DNA, 201 bp, Homo sapiens
aaaggggggtagggattagtaactgggacggagggcactggggctggggctgggtaccatgtggagagtggggacagatgtgaagaagaggtggtttagartacctgtgggagctgctgtgggcaggtctctcaggagcacctagaagaggaaaggtggaggcacagcacccagggcttccattgcgcctgcctctcctcc

SEQ ID NO: 24310 - DNA, 201 bp, Homo sapiens; identical to SEQ ID NO: 4813

SEQ ID NO: 24311 - DNA, 201 bp, Homo sapiens
atctgaatcctccacttcccactggaaccatgcccctcccagtcccggtaagtaagagggaagatcgggagggccaaatcctacaccagggtctatcttarggagggaagggacctggctggggggagggggattctgaggagtgaaaccacttcctgtgtagctagttcctgtgttgacagaaagagcagaagaggaggt

SEQ ID NO: 24312 - DNA, 201 bp, Homo sapiens
taataacctggcaaattaagcatcctctcctgggaggaggaatacagaactctgtaaccacccaatacctgtttccaggtcctgcccctcctggggcacasggcagccaccttgcaattctcatccctagaaaggagagaccagatcaacaaacagcagggctgggactgcccagggggttccgagattccttctcccctc

SEQ ID NO: 24313 - DNA, 201 bp, Homo sapiens
cccaggaccccttcacacaccctacactgatctccccagttagctcggcacccccagccccactctgccacctcaaactctgactcttctcaaccccagcytctgtctctctccctctgaaacctaccaagtcactttcctttctccatccactcccagattcctcctcctacctttctagaccatctcccaaagcccgca

SEQ ID NO: 24314 - DNA, 201 bp, Homo sapiens
cagggaatggggcgagcttacaagtaaagctggacagaagcatcccctagagtttgacaaggaggaaattggtgtgattgggaacctgacagggaaactgyggaggatggctgaatatggattgcgagtggggttaatagtgtaaggaactcgagttggcagtccaaggtaccccaggggtcactggccctctgtctcccc

SEQ ID NO: 24315 - DNA, 201 bp, Homo sapiens; identical to SEQ ID NO: 4815

SEQ ID NO: 24316 - DNA, 201 bp, Homo sapiens
ccctgagctgccatgctgcacaacatggtactccatgacaatggtgactctggggtcatgccatgtgacagccctgccaggacatcaacatcctcctcacygctcttctccctcctctgtagacgaaagcgccgtaacttcagcaaacaggccactgaggtcctaaatgagtatttctactcccacctgagtaacccatat

SEQ ID NO: 24317 - DNA, 201 bp, Homo sapiens
aacctgacagggaaactgcggaggatggctgaatatggattgcgagtggggttaatagtgtaaggaactcgagttggcagtccaaggtaccccaggggtcwctggccctctgtctccccagcttctgctccgtagcagacaaactgcagtggacgctcgcacagaggacgggaccacacccttgatgctggctgccaggct

SEQ ID NO: 24318 - DNA, 201 bp, Homo sapiens
ctatgctgtcaagaccgccgtgtcagtcacccaggggggccacagccgcaccagctccccgacacccccttcctctgcaggtggatcccactgtcaccccrgctgactgttttgcacacttcctgcttttgttcccacttcctatctaggcaggatcatagcagagagggggccttttggggtgagagggaccgagctgag

SEQ ID NO: 24319 - DNA, 201 bp, Homo sapiens; identical to SEQ ID NO: 4730

SEQ ID NO: 24320 - DNA, 201 bp, Homo sapiens
tgagggtgagtggatcctgaagctcctctctgtccagttctcacaggacagaggggcattttccctagtaatgttgtgcccacacagggttcccagggctytctctgttttctgtactctgtctctcctttcaggcaaatggcagctggcaagaggctgtgaccccctcttcagtgacatccccaacggagggaccaggga

SEQ ID NO: 24321 - DNA, 201 bp, Homo sapiens
tgggaacctgacagggaaactgcggaggatggctgaatatggattgcgagtggggttaatagtgtaaggaactcgagttggcagtccaaggtaccccaggkgtcactggccctctgtctccccagcttctgctccgtagcagacaaactgcagtggacgctcgcacagaggacgggaccacacccttgatgctggctgcca

SEQ ID NO: 24322 - DNA, 201 bp, Homo sapiens; identical to SEQ ID NO: 4733

SEQ ID NO: 24323 - DNA, 201 bp, Homo sapiens; identical to SEQ ID NO: 4816

SEQ ID NO: 24324 - DNA, 201 bp, Homo sapiens
agatgggggctggagagagggtgcaggccccacctagggcggaggccacagcagggagaggggcagacagagccaggaccctggaaggaagcaggatggcwgccggaacagcagttggagcctgggtgctggtcctcagtctgtggggtgagccactccctcaaccccactgaccctccctgcagaaagcactttaacccc

SEQ ID NO: 24325 - DNA, 201 bp, Homo sapiens
ccagggtcttctccaaggcctccctcttacctaagaaaaagccttcaaccccagccttggcccatgagggcctctgacttccactggcctcatttccacayacagagtttgagaaccttcacaattacagcctctgactggatttttcctccttcagagattcctgggaagccagaaattgtagattctgcctctgaactc

SEQ ID NO: 24326 - DNA, 201 bp, Homo sapiens; identical to SEQ ID NO: 4811

SEQ ID NO: 24327 - DNA, 201 bp, Homo sapiens
aaattagccaggcgtggtggcgggcgcctgcaatcccagctattggggaggctgaggcaagagaatcgcttgaacctgggaagcagtggttgcagtgagcygagatcactccactgcactccagcctgggtgacagagcaagattccatctcaaaaaaaaaagaaggaaggaaggaaggaaagaaggaaggaaggagagaa

SEQ ID NO: 24328 - DNA, 201 bp, Homo sapiens
gagatcagcctggccaacatggtgaaaccttgtctctattaaaaatacaaaaattacaatttgggaggccgaggcgggtggatcatgaggtcaggagatcracactatcctggctaacacggtgaaaccccatctcaactaaaaatacaaaaaaataactgggcgtggtggcgggcgcctatagtcccagctactccagag

SEQ ID NO: 24329 - DNA, 201 bp, Homo sapiens
gcttctctgcttctagaacacaggccggacagaagcttggaaggtcctgtctccccagggaggaggcccctgggacagtgtggctcgtgtccttcccaacrgctccctcttccttccggctgtcgggatccaggatgaggggattttccggtgccaggcaatgaacaggaatggaaaggagaccaagtccaactaccgagt

SEQ ID NO: 24330 - DNA, 201 bp, Homo sapiens
taaaatatttccaaattaagggtgccatgagccccctttgtgcaccatcctgatgcctgtcctagcccctttaatctccccattgcctagcagctagaagagggtcattgctctgcataccaggggtcctccagacttttgcattctgagcatctgaatggctcccattctgagtggagggagccattatatcacctggga

SEQ ID NO: 24331 - DNA, 201 bp, Homo sapiens
ttaaaatatttccaaattaagggtgccatgagccccctttgtgcaccatcctgatgcctgtcctagcccctttaatctccccattgcctagcagctagaagagggtcattgctctgcataccaggggtcctccagacttttgcattctgagcatctgaatggctcccattctgagtggagggagccattatatcacctggg

SEQ ID NO: 24332 - DNA, 201 bp, Homo sapiens
ccacatgtaggtggtggctactttctcggacagcacaagtatagaccattataagacccttaccagctacaagtgttagctattattcttgttgtcatttrttatcaggtatctgtgaattgtagatgtctgtgtcttgtgtctcttgtctgaatatatccggagcctttgggaagagtggtgggagagcagtcctgagct

SEQ ID NO: 24333 - DNA, 201 bp, Homo sapiens
gttaaaatatttccaaattaagggtgccatgagccccctttgtgcaccatcctgatgcctgtcctagcccctttaatctccccattgcctagcagctagaagagggtcattgctctgcataccaggggtcctccagacttttgcattctgagcatctgaatggctcccattctgagtggagggagccattatatcacctgg

SEQ ID NO: 24334 - DNA, 201 bp, Homo sapiens
ctttttttttttttggaaatggagtctcactccattgcccaggctagagtgcagtggcgtgatcttggctcactgcaacctccgcctcccggattcaagcrattctcctgcctcagcctcccgagtagctgggattaaaggcatgcgccaacaggcccggctaatttttgtatttttagtagagacggggtttcaccatgt

SEQ ID NO: 24335 - DNA, 201 bp, Homo sapiens
gctgtttaggagctgtatgacctcaggtaagttatttagcctccctgggcctatttcctataaaatgtaaatagtaatagtactttctagactatcatatkcatcattttaagagtttaacttaatgtatagaccagtactgttctacagaaatataatgcaagccacaatgtaatttttttatggtagccacatttttac

SEQ ID NO: 24336 - DNA, 201 bp, Homo sapiens
tgatcgggaccccaacagcttgctcatctcctgcgctgtctcctaccgaggggcctggtggtacaggaactgccactacgccaacctcaacgggctctacrggagcacagtggaccatcaggtgaggggtggggaggcggctcagagctggggtggctggggctcggcctgcctaggtttcagccccacagtgtaacaggc

SEQ ID NO: 24337 - DNA, 201 bp, Homo sapiens; identical to SEQ ID NO: 5158

SEQ ID NO: 24338 - DNA, 201 bp, Homo sapiens
aagaaatttcagggaaagaagaattaaaataaacacttgagataagaggagcttttagggcagcagttgtctcctgctctgagtaaataaatacaaaccgytccttggtgttgtcaagggcgccgctttccagttgaagccctagactttctccctcactcagagccaggatggtggtgccaagttggcctgtgccaggct

SEQ ID NO: 24339 - DNA, 201 bp, Homo sapiens
acacagacaagagaacggttgagtccactatgctttgcttttgcctctcaaactccagacaaggatgaggagaagcctgggaagtcctcaggcccaccacrcctgggtgagctgacggtgacagacaggacctccgactccttgctcctgcgctggacggtccccgagggcgagtttgactccttcgtgatccagtacaaa

SEQ ID NO: 24340 - DNA, 201 bp, Homo sapiens
gtctgggcacagagcccagtaacctgtattgcaacaagccctccaggtgattctgatgcccctccagcctgaggccccctaagtgaaggaatgttgctatyttgcaaagtgctagctccactatgaatgtgagagaaagcatggggaaactgagggagatgagttcctgaatgagaaagaggttcagatattccttgtctg

SEQ ID NO: 24341 - DNA, 201 bp, Homo sapiens; identical to SEQ ID NO: 5116

SEQ ID NO: 24342 - DNA, 201 bp, Homo sapiens
gcttcagcctccggagacctggattggggaagaactgcggcaggaagcatgagaatgcagctgtgggaaggagcctctccctccaccccagcctctccccyacaacccaggggtgtctaggctccaggtcctcaccctgagaaagggaatcacgtccacaatttggatggaccagtggctccaggtttttaacacctcctg

SEQ ID NO: 24343 - DNA, 201 bp, Homo sapiens
ccgtgttagccaggatggtctcaatctcctgacctcgtgatctgccctcctcggcctcccaaagtgctgggatcataggcgtgagccacggcgcccagccraccatccatttctaacaagattctcatctatcttgatgccactggtccaaggaacacactttttttgttgttttttattgtagtaaagtacacttgacat

SEQ ID NO: 24344 - DNA, 201 bp, Homo sapiens
tccaaatgcctggagatttttgttaaaaagcagatttggattcagcaggcttggcctagggcaagagaccatgcatttctttctttttctttctttctttyttttttttttgagatagagtctcgctttgtcacccaggctggagtacagtggctcaatctcggctcactggaacctccgcctcctgggttcaagtgattc

SEQ ID NO: 24345 - DNA, 201 bp, Homo sapiens
gccttcaagtccctggggacccagcacctcaattcctcaaacttcctttgctcactccagacctagccactaggtgcaggaccagaaactgccttcctgtrtctcattgcacccctaaccattttcagctggggcctggaaatcctttctcttaatttttccattcccaggccgattagctccccagaataaggggtatct

SEQ ID NO: 24346 - DNA, 201 bp, Homo sapiens
tgggctgcggatccccttccccagggactgcggggaggagatgcagaacggagccggtgcctccaggaccagcaccatcttcctcaacggcaaccgcgagyggcccctgaacgtgttttgcgacatggagactgatgggggcggctggctggtgggtggcattgggaagcccaggggtctgtgcagggcagggtctgttgc

SEQ ID NO: 24347 - DNA, 201 bp, Homo sapiens
ctgagcacatcccccaggcacctggcatcctctctatatctccttttctcagctgcagaggaagagacccccagccccacggaactcagcactgaggcccsggagccccctgaggagccgctcctgggggagctgacagtgacaggatcctcccctgactcgctgagcctctcctggaccatcccccagggccacttcgac

SEQ ID NO: 24348 - DNA, 201 bp, Homo sapiens
  misc_feature (1)...(201): n = A,T,C or G, or insertion/deletion polymorphism (see Tables 1-2)
tgtgtccctttttctcagctgcagaggaagagacccccagccccacagaacccagcatggaggccccggagccccctgaggagccgctcctgggggagctnacagtgacaggatcctcccctgactcgctgagcctctcctggaccgtcccccagggccgcttcgactccttcaccgtgcagtacaaggacagggacgggc

SEQ ID NO: 24349 - DNA, 201 bp, Homo sapiens
ttcctccactagaatcactagaatgttttctttctttctttctttctttctttctttctttctttctttctttctttctttctttctttcttccttccttyctttctttctctttctttctttctttcattcttttcttttctttctttctttttagacaaggtctcactctgtcgcctgggctagagtgtactggcacag

SEQ ID NO: 24350 - DNA, 201 bp, Homo sapiens
ccagctcagaattaagcctcaatcctctgcagcggagggtcaggaagggagctctgcggggaggttggttgagtgctgggagctacctccttaaggggaargggaagagcagatgggacatccggctttgactctctcttgacaacccctttcccagggagtgagctggtaccactggaagggcttcgagttctcggtgcc

SEQ ID NO: 24351 - DNA, 201 bp, Homo sapiens
caggtgggctgcggatccccttccccagggactgcggggaggagatgcagaacggagccggtgcctccaggaccagcaccatcttcctcaacggcaaccgsgagcggcccctgaacgtgttttgcgacatggagactgatgggggcggctggctggtgggtggcattgggaagcccaggggtctgtgcagggcagggtctg

SEQ ID NO: 24352 - DNA, 201 bp, Homo sapiens
tattctaagcttggggcaccagcatccagactgtgggcccttggtgtgtctaagagaatcccagagtcccttggttaaaaggaggcccaccaggcatgccyacccattctattttctgatgcagccccaggaaaggatgaagaaatggccccagcctcgacagaacctcccacccctgaaccccccatcaagcctcgcctg

SEQ ID NO: 24353 - DNA, 201 bp, Homo sapiens; identical to SEQ ID NO: 5247

SEQ ID NO: 24354 - DNA, 201 bp, Homo sapiens
ccagggacccacactgggctctgtgaggccctgtgcctggtccctggggtaaggatgggctctgtcaggcactgaccaagtcggtgcagtagagataaatrgagtttgggaatctgacaaactgagttccttcctgtcttcctctgttctcagctgtatgatttttatttttttattttattattatttttttgagacaga

SEQ ID NO: 24355 - DNA, 201 bp, Homo sapiens
ttactaacagccccctaccatctctgtcccagccccacaacaagaagagacccctccagccactgagtccccgctggagccacgcctaggagagctgacartgacagatgtgacccccaactctgtgggcctctcctggacagtccccgagggccagtttgactccttcatagtccagtacaaggacaaggacgggcagcc

SEQ ID NO: 24356 - DNA, 201 bp, Homo sapiens; identical to SEQ ID NO: 5134

SEQ ID NO: 24357 - DNA, 201 bp, Homo sapiens; identical to SEQ ID NO: 5136

SEQ ID NO: 24358 - DNA, 201 bp, Homo sapiens; identical to SEQ ID NO: 5138

SEQ ID NO: 24359 - DNA, 201 bp, Homo sapiens
tactttcagttcaggacaaggagaggctcagggaggggctgggggtgggcctgaggggctgtgaggcaccttgatcttgtctccgaaggtgaggtaacagwtgatgctgcaggtgaggagagagaattcctcctcaatggccacaggggtgccgggctgggctctcatgcgctgtggagaaacagtgtgagttcagcaggc

SEQ ID NO: 24360 - DNA, 201 bp, Homo sapiens
gaaagtgcaacttgaaggggcatccttgatctacttcatttgttctgacaggaccaagcttaggaaaaggctcctcatgcccaggtagtcagagttgccarggcaaagctggagggagagtcctggtgcatgttgggtggaattctggcagatgaacacggggtgcccatgagaggggactctgacagataaatagggggt

SEQ ID NO: 24361 - DNA, 201 bp, Homo sapiens
acaggaacgatgtctgggcttggggaaagggcaccctgtggctgctgtggggagggtggtggacctcttcttcccccatagggcccagatgccacctgacytggatgtccacccccacaccctctctctcttcccactgcccactctcctcttgcatcctccctctctaacaccactgtctttcttccaggcttctcactg

SEQ ID NO: 24362 - DNA, 201 bp, Homo sapiens
ctcgggggagaggtactctgaggctgctggcagctggtgaggggctgggtccaggaacacaccccaagctctggcctcgggaggagtgtgctgagcttgtwgcggagcaaagacagaagcccagtgaacaaaagatggcgaggagacaccagtgcagggaggctaagggtgcagaggccgagtggggctgtgctcaaaaga

SEQ ID NO: 24363 - DNA, 201 bp, Homo sapiens
ggtatccagggaaactcgggggagaggtactctgaggctgctggcagctggtgaggggctgggtccaggaacacaccccaagctctggcctcgggaggagygtgctgagcttgttgcggagcaaagacagaagcccagtgaacaaaagatggcgaggagacaccagtgcagggaggctaagggtgcagaggccgagtgggg

SEQ ID NO: 24364 - DNA, 201 bp, Homo sapiens; identical to SEQ ID NO: 5257
  misc_feature (1)...(201): n = A,T,C or G, or insertion/deletion polymorphism (see Tables 1-2)

SEQ ID NO: 24365 - DNA, 201 bp, Homo sapiens
gtctcctaccgaggggcctggtggtacaggaactgccactacgccaacctcaacgggctctacgggagcacagtggaccatcaggtgaggggtggggaggyggctcagagctggggtggctggggctcggcctgcctaggtttcagccccacagtgtaacaggcaagggactgagtggctgggtgaaatggaacaatcatg

SEQ ID NO: 24366 - DNA, 201 bp, Homo sapiens; identical to SEQ ID NO: 5144

SEQ ID NO: 24367 - DNA, 201 bp, Homo sapiens
gcggtgcgggtgccggggcacgaggacggggtcaccatctcaggcctggagccagaccataaatacaagatgaacctgtacggcttccacggtggccagcrcgtgggccccatctctgtcattggggtgacgggtgagtggatgatggcagccccagggtgggagccgtgggagggtcaccctcttgctctttggtgatga

SEQ ID NO: 24368 - DNA, 201 bp, Homo sapiens
caccaccagtgagagctggggctgtggggaggggtgtcctgagtggagatctggactagagagggaatctgccctccgggagggcagaaggaaggggctgsatgggggctaggctcttggaaggaaagatgatgattgaagaaccagacacccacctgagtcctcctctttaacctggctagtgatcgatgggccccagga

SEQ ID NO: 24369 - DNA, 201 bp, Homo sapiens
aagagcacattccatggtcagatcctcatatgaggggtggggcagccagagtgccctggggagggcacaggtaggaagaggcctcactgccctcctcactstctgaggtcagcactgtcagtgaacgtggtttggaagaaccctcagaggcttcctctcttcccatctcagctcctttctcagacacgaagggagacccct

SEQ ID NO: 24370 - DNA, 201 bp, Homo sapiens
ttattttactttccctgagaccaagcctcccaagctcctgggaatggttctgctggtgccttcactccgagactttggtattgccccaggtcttctgcccrttacacatgggctttttgggttcccaaagaggtgggggaccaggaaaataacacagactgaggcacacctggggttgaccatagcttcagcccatttgag

SEQ ID NO: 24371 - DNA, 201 bp, Homo sapiens
agggagtaaacgctgcccagcttgttgtcacggttaaaggtggtgatgtaacatgtctggcatcttctcagctcattcatcttttgctcagaccttcccgygagggaatccctgtatatccatgttctaatgctggatattttgaaacatgtattttacacgtcctggataaaatagatgaggccctttaggaaagaaatg

SEQ ID NO: 24372 - DNA, 201 bp, Homo sapiens
gcctggagcctgggcgcaagtacaagatgcacctgtacggcctccacgaggggcggcgcgtgggcccagtgtctgctgtgggcgtcacgggtgagtgtgcrctgcagagccctctgggttgggtcttagcaaagtacagcctccagcatctcctccactagggacccagaaccccaagacctcaaacctgtaatacaccct

SEQ ID NO: 24373 - DNA, 201 bp, Homo sapiens
gcaatgctgaggccggtagcatcactggctgtgggccgaggggaggccgtccacacacagtccccaccttgtgctgcctcagctgcatctccacgatgtgrtccctcttctctatggcctgcttcagcctccggagacctggattggggaagaactgcggcaggaagcatgagaatgcagctgtgggaaggagcctctccc

SEQ ID NO: 24374 - DNA, 201 bp, Homo sapiens; identical to SEQ ID NO: 5204

SEQ ID NO: 24375 - DNA, 201 bp, Homo sapiens
tttctctccccctctccgactgcccacagctgtttccaccccttctctttacaaccctgctgtgacttggacacagctgccacctcctgcttctgcccttktttgttgaggcgaagtgctttacatcctgagtcccttctcaggagtcctctgccacctgcctgcactgcattccatcccagccctggagagttttcatct

SEQ ID NO: 24376 - DNA, 201 bp, Homo sapiens
aaaaaaccacggcccaggagagggtgtttgctgtggtctcagtgccaccgatcaggaggtccactgcagccatgtgcacgtgcccttccaggagctgtccrgagccctcttccatgctcggctgcgccaccccttggagcatgtagtccatcatgtccctccactggcctgccacgaggctctcctgcagagggtgaaagg

SEQ ID NO: 24377 - DNA, 201 bp, Homo sapiens
gaagtgctttacatcctgagtcccttctcaggagtcctctgccacctgcctgcactgcattccatcccagccctggagagttttcatctctccaggaggcygcctcactcttgctctgggctccttcctgcccctcatggcttcctgggcacaggttctccatgattgttgtgctgtggcatctggtgaaacccctacccc

SEQ ID NO: 24378 - DNA, 201 bp, Homo sapiens
gtgagcatgtgatagggaggcccagggctcaggtcaggaccagacagggacgcctaagtcaccctgcccatgggtacccaggggacagccaggacctgagkccaggcatgccttagcttggtgacagctttagagagaaggtgaagtgtgtcagataatcacagctggtgcaaaggccaggaggctagaaagagcatggca

SEQ ID NO: 24379 - DNA, 201 bp, Homo sapiens
cccatcccccggggctgcagccgcacttggaaaggctgcatcttgaggatgacactgcagtggggcaggggctgcagggagggcagggcgtccccggaggrcagcagcgtgaaggcctgcagcagtcgggtcagcaccacgaagagctccaggcgcgccagcggctcgcccaggcacacgcgggcaccgcagccgaaggcc

SEQ ID NO: 24380 - DNA, 201 bp, Homo sapiens; identical to SEQ ID NO: 5147

SEQ ID NO: 24381 - DNA, 201 bp, Homo sapiens
gctgtgggggccagcactggggagcctgatgtttgcctcatcgttctgctatggcttctggatacagcacatctggattccggggcccagatgtgtggttrccacagcgacctgggtccctctggtaaatacaggcgcccacccgcctcagagcagagaacaaaacaattgtgtgactttcttttgtcacgagatagaaat

SEQ ID NO: 24382 - DNA, 201 bp, Homo sapiens
gtgcagtacaaggacagggacgggcggccccaggtggtgcgtgtcaggggcgaggagagcgaggtcaccgtggggggcctggagcccgggtgcaaatacargatgcacctgtacggcctccacgaggggcagcgcgtgggcccagtgtccgctgtgggtgtgacaggtgagtaagtgtgagtgaggcgaggtggggaagat

SEQ ID NO: 24383 - DNA, 201 bp, Homo sapiens
cgggtctgggacgtgcacagagcctgcagagaggatcctaaaacttgttcttggccagagctctgcactcatgactcacggttcagcagggctgggatggmtgagagatgcctctgggggcacaggggctccgtcttcactctgtgccccttccaggctccccttgcctctgtctgtctgaacccgcactctccctcacct

SEQ ID NO: 24384 - DNA, 201 bp, Homo sapiens
ctcacctgccgttggagcctgcattcatgaattcctcccactgccaccccccactgcccccttctaccttcaggccctacctggccggggctccagggggsccccaggacaaagcacgagtccattgtccctagaagacgtccccaccccagggtcctggcatccatcctgtggatgcctaaggtcaaggcagcgccttct

SEQ ID NO: 24385 - DNA, 201 bp, Homo sapiens
  misc_feature (1)...(201): n = A,T,C or G, or insertion/deletion polymorphism (see Tables 1-2)
ggatttggcttccccattctccttggacctaagtctctcccttctctctacccactcttcctagtgcctcagagtgacccaagtccagggactccaccccncctgggaaacctgtgggtgacagaccctaccccagattcactgcacctctcctggactgtccctgagggccagtttgacaccttcatggtccagtacagg

SEQ ID NO: 24386 - DNA, 201 bp, Homo sapiens
cccggtttagtcacagtgaggggaatctcttttttcctttgctcacagaaacaaagacacacctttctcaaaaataacttttactataaggggaaagattwaaaaattaaaagtagagaaatagatagttttccagaacatggtttctgtaattccaccaagctcagcctcatcatgacttggttgatttcatttccagaa

SEQ ID NO: 24387 - DNA, 201 bp, Homo sapiens
accagggagagaggatggatgggctggatgcgagtggcctttagctctgccccacaggacccccctgtggctgcaagtccctggttacagatagagaaacyggggcagggaggggggtggaagggacgtgctctgggtcaccaagctggtgtgcttctgtctccaatcccttctcccccacccactccgtgcagggctggc

SEQ ID NO: 24388 - DNA, 201 bp, Homo sapiens
  misc_feature (1)...(201): n = A,T,C or G, or insertion/deletion polymorphism (see Tables 1-2)
ccacctaggcctttggggaaagagcatcccagacagaaggaagagcaaatgcagagactggcaggcgagaagcagccccagatgtctgcagacagtgaggnatgcagtatgttttgtggtggagttggaggagggcaggcaatagggaatgatctaagagatgaatatgggacctcagaggccagtgcaggacttggattt

SEQ ID NO: 24389 - DNA, 201 bp, Homo sapiens; identical to SEQ ID NO: 5221

SEQ ID NO: 24390 - DNA, 201 bp, Homo sapiens
acaaggacagggacgggcagccccaggtggtgcgtgtcaggggcgaggagagcgaggtcaccgtggggggcctggagcccgggcgcaaatacaagatgcayctgtacggcctccacgaggggcagcgcgtgggcccagtgtccaccgtgggcatcacgggtgagtggggggacaggccctcgtccccaggtttacctctgc

SEQ ID NO: 24391 - DNA, 201 bp, Homo sapiens
tggtggctcacacctgtaatcccagcactttgggggctgaggcaggtggatcacctgaggtcaggggtttgagaccagcctggccaacatggcaaatgccrtctccactaaaaatacacacacacacaaaattaggcaggcatggtggcgcacgcctgtagtcccagctacttgggaggctaaggcaggaggatcgcttga

SEQ ID NO: 24392 - DNA, 201 bp, Homo sapiens; identical to SEQ ID NO: 5157
  misc_feature (1)...(201): n = A,T,C or G, or insertion/deletion polymorphism (see Tables 1-2)

SEQ ID NO: 24393 - DNA, 201 bp, Homo sapiens
tctccggcctggagccagacaacaagtacaagatgaacctgtacggcttccacggtggccagcgtgtgggccccgtgtctgccatcggggtgacaggtgartggacgatgggagccccagggtgggagccatgggagggtcaccctcttgctctttggtgatgactggtggggaatgggacgggtctggtcagcaccacag

SEQ ID NO: 24394 - DNA, 201 bp, Homo sapiens
agtgtgtcagataatcacagctggtgcaaaggccaggaggctagaaagagcatggcacgtgagaggcactgaggattgagtggggtgtcctttacggtgagtatctcatcctgaagtgtgggagcagaggaggggaccactcaccaggcctggggtctcccagggatgaggatgtggttgcccaggtctgtgctgagatgg

SEQ ID NO: 24395 - DNA, 201 bp, Homo sapiens
aagtgtgtcagataatcacagctggtgcaaaggccaggaggctagaaagagcatggcacgtgagaggcactgaggattgagtggggtgtcctttacggtgagtatctcatcctgaagtgtgggagcagaggaggggaccactcaccaggcctggggtctcccagggatgaggatgtggttgcccaggtctgtgctgagatg

SEQ ID NO: 24396 - DNA, 201 bp, Homo sapiens
atgggggccctgtggacaccaggaccctgatgagggcacgtatcccacccccaggcaatgaggccctgcacagcctgacacaggcaggtgactactccatscgcgtggacctgcgggctggggacgaggctgtgttcgcccagtacgactccttccacgtagactcggctgcggagtactaccgcctccacttggagggct

SEQ ID NO: 24397 - DNA, 201 bp, Homo sapiens
  misc_feature (1)...(201): n = A,T,C or G, or insertion/deletion polymorphism (see Tables 1-2)
ggtgcctccaggaccagcaccatcttcctcaacggcaaccgcgagcggcccctgaacgtgttttgcgacatggagactgatgggggcggctggctggtggntggcattgggaagcccaggggtctgtgcagggcagggtctgttgccccgggagccagaggctgatggtgcccccacttgcttcccaggtgttccagcgcc

SEQ ID NO: 24398 - DNA, 201 bp, Homo sapiens
ctgaacttgaccgagggattcgccgtgctgcactggaagcccccccagaatcctgtggacacctatgacgtccaggtcacagcccctgggggtgagcaggsctgaggcctctggaggggacttgttcagggtggggattgcaggggggaggctggactctggccgaggatggagggggcaggccttgatgcccctctctac

SEQ ID NO: 24399 - DNA, 201 bp, Homo sapiens; identical to SEQ ID NO: 5169

SEQ ID NO: 24400 - DNA, 201 bp, Homo sapiens
agttcctgacggtcccacacagttgcgtgcactgaacttgaccgagggattcgccgtgctgcactggaagcccccccagaatcctgtggacacctatgacytccaggtcacagcccctgggggtgagcaggcctgaggcctctggaggggacttgttcagggtggggattgcaggggggaggctggactctggccgaggat

SEQ ID NO: 24401 - DNA, 201 bp, Homo sapiens
gagagctggggctgtggggaggggtgtcctgagtggagatctggactagagagggaatctgccctccgggagggcagaaggaaggggctggatgggggctrggctcttggaaggaaagatgatgattgaagaaccagacacccacctgagtcctcctctttaacctggctagtgatcgatgggccccaggacctccgagtg

SEQ ID NO: 24402 - DNA, 201 bp, Homo sapiens
ccagcgcatgggccctgtgtctgtcgtcggggtgacaggtgagtggatgatgggagccccagggtgggagccatgggagggtcaccctcttgctctttggwgatgactggtggggaatgggacaagggtctggtcagcaccacagacctgcttgtggctggggctggggctccccttgggccttcctgtgaggttgaccac

SEQ ID NO: 24403 - DNA, 201 bp, Homo sapiens; identical to SEQ ID NO: 5171

SEQ ID NO: 24404 - DNA, 201 bp, Homo sapiens
tttgggttcccaaagaggtgggggaccaggaaaataacacagactgaggcacacctggggttgaccatagcttcagcccatttgagctgtgtgtcctcaaragactcacacaacctgtctgggcacggtggctcatgcctgtaatcccagcactttgggaggccgaagggggcagatcacttgaggtcaggagttcgagac

SEQ ID NO: 24405 - DNA, 201 bp, Homo sapiens
gtcctgaggaagaggatttttgttttttttttttcaattggagatatttgagcaaggatccagttgagagtgaggagttgaataaaaaagagagagaagcsaagcatggtggctcatgcttttaatcccagctacctgggaggctgaggtgggaggatggcttgagcccaggagttcaagtccagcttcaaccagggggtt

SEQ ID NO: 24406 - DNA, 201 bp, Homo sapiens
  misc_feature (1)...(201): n = A,T,C or G, or insertion/deletion polymorphism (see Tables 1-2)
gaccatcaggtgaggggtggggaggcggctcagagctggggtggctggggctcggcctgcctaggtttcagccccacagtgtaacaggcaagggactgagnggctgggtgaaatggaacaatcatgccagcctcgcagagggagctggagttgatttattggctggaaagggccagctcagaattaagcctcaatcctctg

SEQ ID NO: 24407 - DNA, 201 bp, Homo sapiens; identical to SEQ ID NO: 5120

SEQ ID NO: 24408 - DNA, 201 bp, Homo sapiens
  misc_feature (1)...(201): n = A,T,C or G, or insertion/deletion polymorphism (see Tables 1-2)
acctccctgggctcgggctttcctcactcatccccaaccctcgggagtcacctgctgggccgtgtggtgcggtggggcaaggctaagggcacaacgggccncaggcgcagcacctcggcgatggtggcattgagcaagggcagccgtgcacggtccttgtaggggacccgggagctggaggcaccagggcccagttcgtgg

SEQ ID NO: 24409 - DNA, 201 bp, Homo sapiens
agtcctgaggaagaggatttttgttttttttttttcaattggagatatttgagcaaggatccagttgagagtgaggagttgaataaaaaagagagagaagccaagcatggtggctcatgcttttaatcccagctacctgggaggctgaggtgggaggatggcttgagcccaggagttcaagtccagcttcaaccagggggt

SEQ ID NO: 24410 - DNA, 201 bp, Homo sapiens
gctctgtgaggccctgtgcctggtccctggggtaaggatgggctctgtcaggcactgaccaagtcggtgcagtagagataaatggagtttgggaatctgasaaactgagttccttcctgtcttcctctgttctcagctgtatgatttttatttttttattttattattatttttttgagacagagtcttgctttgtcaccc

SEQ ID NO: 24411 - DNA, 201 bp, Homo sapiens
tcctgcctcagccttccgagtagctgggattacaggcatgcaccagcacatctggctaatttttgtatttttagtacagacaggatttcgccatgttggcsaggctggtctcaagctcctgacctcaggtgatcctcccgcctcggcctcccaaagtgctgggattacaggcctgagccaccacgcctggccctgattgct

SEQ ID NO: 24412 - DNA, 201 bp, Homo sapiens
ccaaagtgctgggattacaggcctgagccaccacgcctggccctgattgctgttttttgtttgtttgtttgtttttgtttgtttgtttttttcttgagaargagtctcgctgtctcccaggatggagtgcagtggcgtgatcttggctcaccgcaagctccgcctcctgggttcatgccattctcctgcctcagcctcctg

SEQ ID NO: 24413 - DNA, 201 bp, Homo sapiens
taaacccttaaactctgtatccccctatattacctttcagccccacaagaggatgtggacgagacccccagccctacagaaccaggcacagaggccccagrgccccccgaggagcctctcctgggggagctgacagtgacaggatcctcccctgactcgctgagcctttcctggaccgtcccccagggccgctttgactcc

SEQ ID NO: 24414 - DNA, 201 bp, Homo sapiens
ccagacaacaagtacaagatgaacctgtacggcttccacggtggccagcgtgtgggccccgtgtctgccatcggggtgacaggtgagtggacgatgggagmcccagggtgggagccatgggagggtcaccctcttgctctttggtgatgactggtggggaatgggacgggtctggtcagcaccacagacctacttgtggct

SEQ ID NO: 24415 - DNA, 201 bp, Homo sapiens
aaatggcaaacatttcttttacaatcagggaaagggaaaagagaaaatatataatgtcttctccttctttacactccatctgtcctactcctctatcgctsttgtggcttatttcatttatttccttcttttttttttttgagatgaagtttcgctcttgtcgcccaggctggagtgcaatggcatgatctcggctcacta

SEQ ID NO: 24416 - DNA, 201 bp, Homo sapiens
gagggtgtttgctgtggtctcagtgccaccgatcaggaggtccactgcagccatgtgcacgtgcccttccaggagctgtccagagccctcttccatgctcrgctgcgccaccccttggagcatgtagtccatcatgtccctccactggcctgccacgaggctctcctgcagagggtgaaaggagcgggctgagcggctggc

SEQ ID NO: 24417 - DNA, 201 bp, Homo sapiens
  misc_feature (1)...(201): n = A,T,C or G, or insertion/deletion polymorphism (see Tables 1-2)
tggtgcgtgttgggggcgaggagagcgaggtcaccgtggggggcctggagcctgggcgcaaatacaagatgcacctgtacggcctccacgaggggcggcgngtgggcccggtgtccaccgtgggcgtgactggtgagtagtgcttggagtctcggggtaaccacctttccctcatgggtacctggtttactgctgtgccct

SEQ ID NO: 24418 - DNA, 201 bp, Homo sapiens
cagcggctcgcccaggcacacgcgggcaccgcagccgaaggccagagctctggagttcttgcctggctccaggaagcgatctgcgggcgggtggacaggtrggtggggaggcgttcagcggcagcggggaccagcctccaccacattttcacggcaggcccccggccccccacataccaggccagaactcatgtggcctct

SEQ ID NO: 24419 - DNA, 201 bp, Homo sapiens
ctgggattacaggtgcatgccaccacgcctggctaatttttgtattttcagtagagaccgggtttcatgatattggccaagctagactcgaattcccaacytcaggtgatccacccgcctcggcctcccaaaatgctaggattacaggcgtgaaccactgctcccagcccagaatttcttttttagcccacgtttttctag

SEQ ID NO: 24420 - DNA, 201 bp, Homo sapiens
tggagatttttgttaaaaagcagatttggattcagcaggcttggcctagggcaagagaccatgcatttctttctttttctttctttcttttttttttttttgagatagagtctcgctttgtcacccaggctggagtacagtggctcaatctcggctcactggaacctccgcctcctgggttcaagtgattctcctacctca

SEQ ID NO: 24421 - DNA, 201 bp, Homo sapiens
tttcttttttagcccacgtttttctagtgaaaataatacagcaacattatgtggaaagcttgaaaaacagaaaacaagaatctcatagtcctactttctcycccagctgccggcattaataacaatgtgtgtagtgcacattcccttcctgtattttgcatgcagagcgtgttttaaagttgcaatcagtgttcataaagt

SEQ ID NO: 24422 - DNA, 201 bp, Homo sapiens
ggagccgtgggagggtcaccctcttgctctttggtgatgactggtggggaatgggccaggggtccggtcagcaccacagacctgcttgtggctggggctcyccttgggccttcctctgaggctgacccctggctcctcctgagcagggaggggccatcaggagttctgctgtgctggtgactgtcccaggtcccccacagc

SEQ ID NO: 24423 - DNA, 201 bp, Homo sapiens
  misc_feature (1)...(201): n = A,T,C or G, or insertion/deletion polymorphism (see Tables 1-2)
aggaactgggcttgtgtttggtgttttaggaaagcatttaaggaagcaaggttttgctctttattagacgctgtcaggaagaagggataaccctattaccnggcgtctcactaagtcttatctttggggaggtcaactagagcaaggccaaagctgccattggtaaagaagcagctatcactcagattagctggatgggtg

SEQ ID NO: 24424 - DNA, 201 bp, Homo sapiens
ccactggctccatggagtcacggatgcccagcagcagggctgagcgggtgagcttcttgtgggctttccagagcagggagtagtctcccaaggacaggtcsgggtagttcctagacaccagcttgtctgcaggaggagttgggggctggagggtgggaactgatgaaggcagctgagggcctgaccttcttcggcctcccc

SEQ ID NO: 24425 - DNA, 201 bp, Homo sapiens
gctccaccactggctccatggagtcacggatgcccagcagcagggctgagcgggtgagcttcttgtgggctttccagagcagggagtagtctcccaaggamaggtccgggtagttcctagacaccagcttgtctgcaggaggagttgggggctggagggtgggaactgatgaaggcagctgagggcctgaccttcttcggc

SEQ ID NO: 24426 - DNA, 201 bp, Homo sapiens
accttgcagcccaaggtggagcctgtagatgggcccgaatttctgagtcaggccaagcagatagatggggaggtcgggctgcagcaggtgcaagaagcccrgggcaagaggcgggaggtggaggctccggagcttccaccagttccacagcaggcgggcgccagccagcaggggcagcagcagcagcaggcccaggagcag

SEQ ID NO: 24427 - DNA, 201 bp, Homo sapiens
ttgggggcaaggagagtgaggtcaccgtgggaggcctagagcccgggcacaagtacaagatgcacctgtacggcctccacgaggggcagcgcgtgggcccrgtgtccgccgtgggcgtgacaggtgagtgaggggcaggggcctgctttggttccctcccactgctggctcccagcttccctgtagccagttgctctcctt

SEQ ID NO: 24428 - DNA, 201 bp, Homo sapiens
ggctgtgggccgaggggaggccgtccacacacagtccccaccttgtgctgcctcagctgcatctccacgatgtgatccctcttctctatggcctgcttcarcctccggagacctggattggggaagaactgcggcaggaagcatgagaatgcagctgtgggaaggagcctctccctccaccccagcctctcccctacaacc

SEQ ID NO: 24429 - DNA, 201 bp, Homo sapiens
ccgagggccagtttgaccatttcttggtccagtttaagaatggggacgggcagcccaaggcggtgcgggtgccgggacacgaggatggggtcaccatctcrggcctggagccagaccacaagtacaagatgaacctgtacggcttccacggtggccagcgcgtgggccccgtgtctgctgttggtttaactggtgagtgtg

SEQ ID NO: 24430 - DNA, 201 bp, Homo sapiens
  misc_feature (1)...(201): n = A,T,C or G, or insertion/deletion polymorphism (see Tables 1-2)
gatggactgggacccggggcaagaggtgggagccaagaaaacggcatgggtgggagttgagagagaacgaggagggtgaaagggaggtggtggaggctccnattgcggacgggaggccagtggagtctggggaggcacggagtagagagagccgcggggacccttctgagcccctccccttcccccagttcctgacggtcc

SEQ ID NO: 24431 - DNA, 201 bp, Homo sapiens
gcctttgccatgtgctcatcgcctcgcatttcctctcccccctgcactctgcccaccctccagccgccctggggttccctgggtaaccctcgatccccaargttttcaggggagcctcagagtgtgcaggtggatggccaggcccggacccagaaactccaggggctgatcccaggcgctcgctatgaggtgaccgtggtc

SEQ ID NO: 24432 - DNA, 201 bp, Homo sapiens
gccatcggggtgacaggtgagtggacgatgggagccccagggtgggagccatgggagggtcaccctcttgctctttggtgatgactggtggggaatgggaygggtctggtcagcaccacagacctacttgtggctggggctggggctcccattgtacctttttgtgtggttgacccctggctccccctgagcagggagggg

SEQ ID NO: 24433 - DNA, 201 bp, Homo sapiens
ccggggctgggggttgagatgagggtatggtgagacagtgatgctagacagggagtgggggctggggtgggggcaggagaagaggaggggtggcatgtggkagggcctgggaggggtgggaggacctgccctatctccgctcccctccctgacctcatcctggtcctccccttctcctcccctgctcgctgcagactccct

SEQ ID NO: 24434 - DNA, 201 bp, Homo sapiens
cctggaggaatctgcagagcgacttccattcctggggactagaggaaaaggggtggtgagcctgtgctggagcagaggcgagggggggactcgcagggagyagcctccctgcccctgcctgcgtcattgttccttgacccctctgcagttctggagagcccccgtgacctccaattcagtgaaatcagggagacctcagcc

SEQ ID NO: 24435 - DNA, 201 bp, Homo sapiens
  misc_feature (1)...(201): n = A,T,C or G, or insertion/deletion polymorphism (see Tables 1-2)
ctggaggaagttccaggtgatcattggttgagtccagatggctgggtacctgaagctgctgtaaaggctttcttagcctgcttgacactgggcactgaggnctctgcagcatctccagcaagcattggtcccacacagttggaacacctggtaacagagagctcagtacttcctgaggctgtccagtccattgttggtcat

SEQ ID NO: 24436 - DNA, 201 bp, Homo sapiens; identical to SEQ ID NO: 5227
  misc_feature (1)...(201): n = A,T,C or G, or insertion/deletion polymorphism (see Tables 1-2)

SEQ ID NO: 24437 - DNA, 201 bp, Homo sapiens
gggggcagatcacttgaggtcaggagttcgagaccagcctggccaacatcatgaaacccccatctctactaaaaatacaaaaattagctgggtgtggtggyacatgcctgtagtcccagctactcgggaggctaaggcgggagaatcgcttgaacccaggaggcggaggttgcagtgagccgagatcgagccactgcactc

SEQ ID NO: 24438 - DNA, 201 bp, Homo sapiens
  misc_feature (1)...(201): n = A,T,C or G, or insertion/deletion polymorphism (see Tables 1-2)
acagggacgggcggccccaggtggtgcgtgttgggggcgaggagagcgaggtcaccgtggggggcctggagcctgggcgcaaatacaagatgcacctgtanggcctccacgaggggcggcgcgtgggcccggtgtccaccgtgggcgtgactggtgagtagtgcttggagtctcggggtaaccacctttccctcatgggta

SEQ ID NO: 24439 - DNA, 201 bp, Homo sapiens
gaacccgcctcatagcaatgctgaggccggtagcatcactggctgtgggccgaggggaggccgtccacacacagtccccaccttgtgctgcctcagctgcwtctccacgatgtgatccctcttctctatggcctgcttcagcctccggagacctggattggggaagaactgcggcaggaagcatgagaatgcagctgtggg

SEQ ID NO: 24440 - DNA, 201 bp, Homo sapiens
gcctcatagcaatgctgaggccggtagcatcactggctgtgggccgaggggaggccgtccacacacagtccccaccttgtgctgcctcagctgcatctccwcgatgtgatccctcttctctatggcctgcttcagcctccggagacctggattggggaagaactgcggcaggaagcatgagaatgcagctgtgggaaggag

SEQ ID NO: 24441 - DNA, 201 bp, Homo sapiens
agatgaacctgtacggcttccacggtggccagcgcgtgggccccatctctgtcattggggtgacaggtgagtgtacgatgggagccccagagtggggcctrtgggagggtctccctttctctggtgatgggtgaactggcccaggaagcccctctgctcttggctgagccatggtacttttttgtctttccccacttccct

SEQ ID NO: 24442 - DNA, 201 bp, Homo sapiens
cctgcctgagctccccggcatcatccccctcaacattctcacaggcagcccacgctccttcaccaggcccagtgggagccttagttctcccgggccagccrgtgcagaataagaaagggaacggagaagggtgagaactacctgtgtcgtaacatcctgcctccctgacctgccgagtgcccccatcagggatcctgcgct

SEQ ID NO: 24443 - DNA, 201 bp, Homo sapiens
gcttgtcatgtgtgttgactgtaaactgagcaagaccacccagctccaaagatgggcctctccaagctgaccccaggacccccactcatggccacagcttygctctccttcctcacaagacccaaggacatcccccagggaagctgcctcaccttctctgtcccctcttctcagctgcagaggaagaaactcccgccccca

SEQ ID NO: 24444 - DNA, 201 bp, Homo sapiens
  misc_feature (1)...(201): n = A,T,C or G, or insertion/deletion polymorphism (see Tables 1-2)
ccaggctggagtgcaatggcgcgatctcggctcactgcaacctccgcttcccaagttcaagcaattctcctgcctcagcctcccgagtaactgggattacnggcacgtgccaccacacccagctaattttttgtatttttagtagaaacagggtttcgccatgttggccaggctggcctcaaactcctgacctcaggtgat

SEQ ID NO: 24445 - DNA, 201 bp, Homo sapiens
attgtagtaaagtacacttgacataattcgccattctaatcgctttctagtttgcagtccagcatgaagtccactcacattgctgtggactgtcaccctcyacttccagaactcctcttcccacactgaaacttcctacccactagacacgaactcccattctccccttgccccagcccctggcaacaccattctactctc

SEQ ID NO: 24446 - DNA, 201 bp, Homo sapiens
  misc_feature (1)...(201): n = A,T,C or G, or insertion/deletion polymorphism (see Tables 1-2)
gaggggaggccctcatggctccttcctccaccctgcccaggggactccatgagctaccacagcggcagtgtcttctctgcccgtgatcgggaccccaacancttgctcatctcctgcgctgtctcctaccgaggggcctggtggtacaggaactgccactacgccaacctcaacgggctctacgggagcacagtggaccat

SEQ ID NO: 24447 - DNA, 201 bp, Homo sapiens
tttctctttctttctgtctctctctctctctttctttctttttttcctttctttctgttttttgagctctgttgcccaggctggaatgcagtggtgcaatyttggctcactgcaacctttgcctcccaggttcaagtgattctcctgcctcagcctcccgagtagctgggattacaggcatgcaccaccacacctggctaa

SEQ ID NO: 24448 - DNA, 201 bp, Homo sapiens
  misc_feature (1)...(201): n = A,T,C or G, or insertion/deletion polymorphism (see Tables 1-2)
ccccacagtgtaacaggcaagggactgagtggctgggtgaaatggaacaatcatgccagcctcgcagagggagctggagttgatttattggctggaaaggnccagctcagaattaagcctcaatcctctgcagcggagggtcaggaagggagctctgcggggaggttggttgagtgctgggagctacctccttaaggggaa

SEQ ID NO: 24449 - DNA, 201 bp, Homo sapiens
gatggggtggcagggagcctagaggcagggaagccaataggcagttggtggccctggtgagaggtgacagtggctcaaactaggatcggggactggaggtkggggaggaaggtatccagggaaactcgggggagaggtaactctgaggctgctggcagctggtgaggggctgggtccaggaacacaccccaggctctggcc

SEQ ID NO: 24450 - DNA, 201 bp, Homo sapiens
ggcggccccaggtggtgcgtgtcaggggcgaggagagcgaggtcaccgtggggggcctggagcccgggtgcaaatacaagatgcacctgtacggcctccaygaggggcagcgcgtgggcccagtgtccgctgtgggtgtgacaggtgagtaagtgtgagtgaggcgaggtggggaagatggccctggaagacactgctgtc

SEQ ID NO: 24451 - DNA, 201 bp, Homo sapiens
gcctctttccctccacctcctacaatgcacggctccaggccatgtggggccagagcctcctgccgcccgtgtccacctctttcaccacgggtacctggacrcacgggcccggggccgggggctgggtgggcagccagggcctaaggcttggaaaaggactggcccctgctctcctctcccaggtgggctgcggatcccctt

SEQ ID NO: 24452 - DNA, 201 bp, Homo sapiens
gcacgtgcccttccaggagctgtccagagccctcttccatgctcggctgcgccaccccttggagcatgtagtccatcatgtccctccactggcctgccacsaggctctcctgcagagggtgaaaggagcgggctgagcggctggcctggggagaggagtacagagtggcaacaggcccataactggggtatgcaaaagaac

SEQ ID NO: 24453 - DNA, 201 bp, Homo sapiens
ggagagggtgtttgctgtggtctcagtgccaccgatcaggaggtccactgcagccatgtgcacgtgcccttccaggagctgtccagagccctcttccatgstcggctgcgccaccccttggagcatgtagtccatcatgtccctccactggcctgccacgaggctctcctgcagagggtgaaaggagcgggctgagcggct

SEQ ID NO: 24454 - DNA, 201 bp, Homo sapiens
cgcacctcagggtggtgaagcaaaaaaaccacggcccaggagagggtgtttgctgtggtctcagtgccaccgatcaggaggtccactgcagccatgtgcamgtgcccttccaggagctgtccagagccctcttccatgctcggctgcgccaccccttggagcatgtagtccatcatgtccctccactggcctgccacgagg

SEQ ID NO: 24455 - DNA, 201 bp, Homo sapiens
gcaccactgcactccagcctgggcaataagagtgaaactccgtctcaaacaaacaaacaaaacaaaacaaaacaaaacaaaacaaaaaaaccagtgtaggrgaacacaatagaaaagggggtgaggagcagggtaaataaatgatatcagagaggtagagaacagacttgcccagggagggtatcctttagggttgggcgg

SEQ ID NO: 24456 - DNA, 201 bp, Homo sapiens
tgtccatttctgtgggtacagagtatattcaatagctgtctgtcctctggctgctgctgtcatcctagaagcctatctctacctcttaccttccctcttcscagaagcacttctctctcaaagcccaaactctgctattccagatcaagggacatacctagttattggaattatttttcagaatgcagaagaagaaagttt

SEQ ID NO: 24457 - DNA, 201 bp, Homo sapiens
gcctgtgagcggagacctccgagcggtcgccgtctcggggctggacccggcccgcaagtacaagttcctgctctttggactccagaatgggaaacgccacrgcccagtccctgtggaggccaggaccggtgagtgagggctggaggcctcccgcggccagagccttcgcccccttgtggcacctgttggaatttcacgttc

SEQ ID NO: 24458 - DNA, 201 bp, Homo sapiens; identical to SEQ ID NO: 5224

SEQ ID NO: 24459 - DNA, 201 bp, Homo sapiens
cagggtaaacaaaggccctctctgcacccccagccacccatccctcgggagatgatctgtaatgaatttggcgcatcctcgatcacagcagggaaggggcrgggcaggaaggagtttgggcagcagcctccagaggaggagggggctgttctccctcattcctgtggggcatggcgggagcaggcctgtgtgtctcctcaa

SEQ ID NO: 24460 - DNA, 201 bp, Homo sapiens
cgtgcattggccggctgcccagaccagctctcgatgtttggggtgtctccgtgacaacccagagacctccggggagtctctctcagctctggcctcattcrtgctcaggggctgggggtcagggtaaacaaaggccctctctgcacccccagccacccatccctcgggagatgatctgtaatgaatttggcgcatcctcga

SEQ ID NO: 24461 - DNA, 201 bp, Homo sapiens; identical to SEQ ID NO: 5170

SEQ ID NO: 24462 - DNA, 201 bp, Homo sapiens
gaatgcagctgtgggaaggagcctctccctccaccccagcctctcccctacaacccaggggtgtctaggctccaggtcctcaccctgagaaagggaatcaygtccacaatttggatggaccagtggctccaggtttttaacacctcctggatacatttgtaataggcaggcattaagttgtcgtcctgccagaaaaggagg

SEQ ID NO: 24463 - DNA, 201 bp, Homo sapiens
ggtggttcacgcttgtaatcccagcactttgggaggccaaggcaggtggatcacttgaggtaaagagttcaagaccagcctgaccaacatggtgaaacccygtctctactaaaaataataataataataataaattttaaaaagtacaaaaaagcggagcgtggtggcacgtgcctgtagtcccagctacttggcgggggt

SEQ ID NO: 24464 - DNA, 201 bp, Homo sapiens
gaggaaggatataggctgagaggaaaccactggggtcagagaggaggggcagcaggtggagaaatggtggggaaaaaagaaatggcaggaagggtgggggrtgtcaagttgggcaaaaattagggtgagctaaaaatggcatagggaaaggacgtgggaggtaagaccggggctgggggttgagatgagggtatggtgaga

SEQ ID NO: 24465 - DNA, 201 bp, Homo sapiens
ggctagcgggaagataggactaggctgaactggtggccagctgaaccttggaaggaaagtgcttgcggaatcccaaatgtcgggctagagcagctgagccyaggctctgggggctccaggctccaggaggtgccagagggtgcttctttgggcatccaaatggggactccctaggtggcagcgtgagagttgcagggaggg

SEQ ID NO: 24466 - DNA, 201 bp, Homo sapiens
ttgtctgtcccacaggagatcctgctcccaggagggatcacatctcaccagctccttggcctctttccctccacctcctacaatgcacggctccaggccaygtggggccagagcctcctgccgcccgtgtccacctctttcaccacgggtacctggacgcacgggcccggggccgggggctgggtgggcagccagggccta

SEQ ID NO: 24467 - DNA, 201 bp, Homo sapiens
  misc_feature (1)...(201): n = A,T,C or G, or insertion/deletion polymorphism (see Tables 1-2)
ttccctttttagtctcactcctagaatccttctaccttcacctctcattgccagattcaactgagggtgtagcaggagggtcagagggaggcatgggggcnggaccagaacccccatctgtggaacatcttttatggaagccagcccctctccccaccccttgggacctatacagtccctaatgagcaaagtgtcaaagtt

SEQ ID NO: 24468 - DNA, 201 bp, Homo sapiens
ttgttcctctcacaccatccaggttctttcactcacagagctgccctcggagccaacaagaaatcagccttcttaggcatcacccaatgactaggtgtggrggaaacctgaaggggagattgggtgtgtgtgcacgtgtgtgcatgggcacccatatgtgtacctacaaggatgcaggttttgggggtggatttgtgtgtc

SEQ ID NO: 24469 - DNA, 201 bp, Homo sapiens
ggccctattctgtttcatctgtctatccttgcacctttaaaataagtcttgatatttgatcatgtaagtcctgaggaagaggatttttgttttttttttttcaattggagatatttgagcaaggatccagttgagagtgaggagttgaataaaaaagagagagaagccaagcatggtggctcatgcttttaatcccagcta

SEQ ID NO: 24470 - DNA, 201 bp, Homo sapiens
agtgggtggatcatctgaggtcaggagtttgagaacagcctgaccaacatagtgaaaccccatctctactaaaaatacaaaattagctgagcatggtggtrtatgcctgtaatcccagctacttgggaggctaaggaagaatcccttgaatcttggaggcggaggttgtagtgagctgagatcgtgccattgcactccagc

SEQ ID NO: 24471 - DNA, 201 bp, Homo sapiens
atggcgggctgagacctgaaggatgagaaggccaagagagaagggaacagtgttccacacggatggaacagagtatacaaagatctggggttggggatggrcacagagagtatgagggacttgaaggtcagtggagctggaatggagggagggagggaaatgttatgggtggtgaagtgggagcaggggatacatgatggt

SEQ ID NO: 24472 - DNA, 201 bp, Homo sapiens
gttgtggtgagctgagatcgcaccactgcactccagcctgggcaataagagtgaaactccgtctcaaacaaacaaacaaaacaaaacaaaacaaaacaaaacaaaaaaaccagtgtaggggaacacaatagaaaagggggtgaggagcagggtaaataaatgatatcagagaggtagagaacagacttgcccagggagggt

SEQ ID NO: 24473 - DNA, 201 bp, Homo sapiens
gaggcatgcataggctataaggaaatgtaaacatcaaatacaaataaattttgacaactgtggccatgaagtagaggagagaaatatgtggtggctggagsgggtgtgagattggggataggttttttaaggtttcatttttttttttttttgagatggagtctcgctctgttgcccaggctggagtgcagtggcacaatc

SEQ ID NO: 24474 - DNA, 201 bp, Homo sapiens
ggttgtggtgagctgagatcgcaccactgcactccagcctgggcaataagagtgaaactccgtctcaaacaaacaaacaaaacaaaacaaaacaaaacaaaacaaaaaaaccagtgtaggggaacacaatagaaaagggggtgaggagcagggtaaataaatgatatcagagaggtagagaacagacttgcccagggaggg

SEQ ID NO: 24475 - DNA, 201 bp, Homo sapiens
aaggtggagcctgtagatgggcccgaatttctgagtcaggccaagcagatagatggggaggtcgggctgcagcaggtgcaagaagcccggggcaagaggcrggaggtggaggctccggagcttccaccagttccacagcaggcgggcgccagccagcaggggcagcagcagcagcaggcccaggagcagcatggcaagacg

SEQ ID NO: 24476 - DNA, 201 bp, Homo sapiens
aggttgtggtgagctgagatcgcaccactgcactccagcctgggcaataagagtgaaactccgtctcaaacaaacaaacaaaacaaaacaaaacaaaacaaaacaaaaaaaccagtgtaggggaacacaatagaaaagggggtgaggagcagggtaaataaatgatatcagagaggtagagaacagacttgcccagggagg

SEQ ID NO: 24477 - DNA, 201 bp, Homo sapiens
aggaggtggaggctgcagggagctgagattgcgccactgcactccagcctgggtgatagagccagactccgtctcaaaaaagaccaaaaaaaaaaaaaaaagaaagaaaagccgcaaagcagatgaggaccaggagagtggggccagttcctgggtctgctgtcccctgctgactctgcctctcttctcgtaatttccact

SEQ ID NO: 24478 - DNA, 201 bp, Homo sapiens
acacaagtatacagcagtcctgggatagatgaggtccttgttctcatggagctcccattgtagcattgagagaaaggtaataagtaaactgataactcagrcagcagtaaatgccatgaagaacaggaacaggatattgtgatagagagtaatggaagactgccctaactgggagttaagatttgaagatggagccagcct

SEQ ID NO: 24479 - DNA, 201 bp, Homo sapiens
gaggttgtggtgagctgagatcgcaccactgcactccagcctgggcaataagagtgaaactccgtctcaaacaaacaaacaaaacaaaacaaaacaaaacaaaacaaaaaaaccagtgtaggggaacacaatagaaaagggggtgaggagcagggtaaataaatgatatcagagaggtagagaacagacttgcccagggag

SEQ ID NO: 24480 - DNA, 201 bp, Homo sapiens
ggaggttgtggtgagctgagatcgcaccactgcactccagcctgggcaataagagtgaaactccgtctcaaacaaacaaacaaaacaaaacaaaacaaaacaaaacaaaaaaaccagtgtaggggaacacaatagaaaagggggtgaggagcagggtaaataaatgatatcagagaggtagagaacagacttgcccaggga

SEQ ID NO: 24481 - DNA, 201 bp, Homo sapiens
atccagtacaaagacagggacgggcagccccaggtggtgcccgtggaaggaccccagcgctcggccgtcatcacctccctggatcctggccgcaagtacaratttgtcctgtatgggtttgttggcaagaagaggcatggtccgctggtggctgaagccaagatctgtgagtgacagcagtaacaccctgccctctgtact

SEQ ID NO: 24482 - DNA, 201 bp, Homo sapiens
gtgaggctgggaggggaggccctcatggctccttcctccaccctgcccaggggactccatgagctaccacagcggcagtgtcttctctgcccgtgatcggraccccaacagcttgctcatctcctgcgctgtctcctaccgaggggcctggtggtacaggaactgccactacgccaacctcaacgggctctacgggagcac

SEQ ID NO: 24483 - DNA, 201 bp, Homo sapiens
atcacttgagctaggagacagaggttgcagtgagccgagatcgcaccactgcactccagcctgggcgacagagtaagattccatctcaaaaaaaaaaaaaagtgagagagagagggagaagataatctgcacttttcttagaagacagtaggagctgggatccaggtgtttggggaaggattggccctaggtactcatcca

SEQ ID NO: 24484 - DNA, 201 bp, Homo sapiens
actttgggaggccaaggcagatcacttgaggtcaggagtttgagaccagcctggccaacttggtgaaaccctgtctctactaaaaaaaaaaaaaaaaaaaaggctgggtgcggtggctcacgcctgtaatcccagcactgtgggaggccaaggtgggcggatcacgaggtcaggagatcgagaccatcctggctaacacgg

SEQ ID NO: 24485 - DNA, 201 bp, Homo sapiens
gcgcttttacatcaaaaccatcatgcgggttccacaaatgcaacagacatcgctgggtgtggtggctcacacctgtaatcccagcactttgggggctgagrcaggtggatcacctgaggtcaggggtttgagaccagcctggccaacatggcaaatgccgtctccactaaaaatacacacacacacaaaattaggcaggca

SEQ ID NO: 24486 - DNA, 201 bp, Homo sapiens; identical to SEQ ID NO: 5191

SEQ ID NO: 24487 - DNA, 201 bp, Homo sapiens
  misc_feature (1)...(201): n = A,T,C or G, or insertion/deletion polymorphism (see Tables 1-2)
caggcggtgcgtgttgggggccaggagagcaaggtcactgtgaggggcctggagcctgggcgcaagtacaagatgcacctgtacggcctccacgaggggcngcgcctgggcccggtgtctgccgtgggcgtcacaggtgagtgagtgtgggtggggcagggttggaagacagccctagaaaatgtgcccttctctaccatt

SEQ ID NO: 24488 - DNA, 201 bp, Homo sapiens
tatgacctctgttgacagcaccagcaaagcaagttgcccttaaacccttaaactctgtatccccctatattacctttcagccccacaagaggatgtggacragacccccagccctacagaaccaggcacagaggccccagagccccccgaggagcctctcctgggggagctgacagtgacaggatcctcccctgactcgct

SEQ ID NO: 24489 - DNA, 201 bp, Homo sapiens
tgcgtgttgggggccaggagagcaaggtcactgtgaggggcctggagcctgggcgcaagtacaagatgcacctgtacggcctccacgaggggcggcgcctrggcccggtgtctgccgtgggcgtcacaggtgagtgagtgtgggtggggcagggttggaagacagccctagaaaatgtgcccttctctaccattttcctat

SEQ ID NO: 24490 - DNA, 201 bp, Homo sapiens; identical to SEQ ID NO: 5261

SEQ ID NO: 24491 - DNA, 201 bp, Homo sapiens; identical to SEQ ID NO: 5203

SEQ ID NO: 24492 - DNA, 201 bp, Homo sapiens
acatccccctcactctctcttcctccttctcagctgcagaggaagagacccccagccccacagaacccagcatggaggccccggagcccgctgaggagccrctcctgggggagctaacagtgacaggatcctcccctgactcgctgagcctctcctggaccgtcccccagggccgcttcgactccttcaccgtgcagtaca

SEQ ID NO: 24493 - DNA, 201 bp, Homo sapiens
  misc_feature (1)...(201): n = A,T,C or G, or insertion/deletion polymorphism (see Tables 1-2)
aacatcctgcctccctgacctgccgagtgcccccatcagggatcctgcgctcctcggggccggccaaatcacccctttcctcaggggccggccaaatcacngccaaatcgtgtgctcctgggtaagaggagatagagacccagtctgtaagaagctgcaccctgctggggaagcagtctgtgagaggcggaaagaggctgg

SEQ ID NO: 24494 - DNA, 201 bp, Homo sapiens; identical to SEQ ID NO: 5266

SEQ ID NO: 24495 - DNA, 201 bp, Homo sapiens; identical to SEQ ID NO: 5421

SEQ ID NO: 24496 - DNA, 201 bp, Homo sapiens; identical to SEQ ID NO: 5267
  misc_feature (1)...(201): n = A,T,C or G, or insertion/deletion polymorphism (see Tables 1-2)

SEQ ID NO: 24497 - DNA, 201 bp, Homo sapiens
agtgccgggattacaggcatgagccactgcacccagcctctgcctgtttttgaacctcatataaacggcattattcagagtgttttcttttttcttttttctttttttggtagctcaggaagggtatataagagtataagagcattctctttctgtgtgtgatattttttactcagcactatgtgtgtgaaattcacccat

SEQ ID NO: 24498 - DNA, 201 bp, Homo sapiens; identical to SEQ ID NO: 5269

SEQ ID NO: 24499 - DNA, 201 bp, Homo sapiens
ccctgtgtcctacaccacaggccttcaggtatttggagacaccagcctgatgtcttcattcctcaggcaaaacctcccagtttcttcgccccttttccctmagtctttattctctgaatcctttaccttcctgtgattcttgcttttttcatgtgcccccaaaatgtggggacagagaggggcccactgacttactctgaa

SEQ ID NO: 24500 - DNA, 201 bp, Homo sapiens; identical to SEQ ID NO: 5211

SEQ ID NO: 24501 - DNA, 201 bp, Homo sapiens
gggattcaagcaattcttttgccttagcctcccaggtagctgggactacaggtgtgtgccaccatgcccagctaatttttgtatttttagtagagacagggtttcaccgtgttggccaggatggtctccatctcttgacctcgtgatccgcccgcctcggcttcccaaagtgccgggattacaggcatgagccactgcacc

SEQ ID NO: 24502 - DNA, 201 bp, Homo sapiens
ctgcagcctggaaatcagggctaggctaagtgttcactgggactcaaaacctcacagcctcagagaagtttttgcttgggtctagtctaaaaacagcaatgagggtgagataagctccaaggaccagccaaggtagagttcatctggagccacgaggttaatattgagataaactctaaaacttcccaagaacaaaatcag

SEQ ID NO: 24503 - DNA, 201 bp, Homo sapiens
gagatcagcctctcaccttgcagcccaaggtggagcctgtagatgggcccgaatttctgagtcaggccaagcagatagatggggaggtcgggctgcagcargtgcaagaagcccggggcaagaggcgggaggtggaggctccggagcttccaccagttccacagcaggcgggcgccagccagcaggggcagcagcagcagc

SEQ ID NO: 24504 - DNA, 201 bp, Homo sapiens
gccgcttcgactccttcaccgtgcagtacaaggacagggacgggcagccccaggtggtgcgtgtcaggggcgaggagagcgaggtcaccgtggggggcctrgagcccgggcgcaaatacaagatgcatctgtacggcctccacgaggggcagcgcgtgggcccagtgtccaccgtgggcatcacgggtgagtggggggaca

SEQ ID NO: 24505 - DNA, 201 bp, Homo sapiens
tctgggattcaagcaattcttttgccttagcctcccaggtagctgggactacaggtgtgtgccaccatgcccagctaatttttgtatttttagtagagacagggtttcaccgtgttggccaggatggtctccatctcttgacctcgtgatccgcccgcctcggcttcccaaagtgccgggattacaggcatgagccactgc

SEQ ID NO: 24506 - DNA, 201 bp, Homo sapiens
ccctgaagcagacgggacgctgctgactgacctgatgccaggcgtagaatatgtggtgactgtcacagcggagcggggccgggcagtcagctacccagctkctgtcagggccaacacaggtatggctggccagaggttagggaagggccctggtttcccagccttggatcctcctcctcaggagcccaggctcagggctca

SEQ ID NO: 24507 - DNA, 201 bp, Homo sapiens
cctatggtgagggccagagcgagatcagcctctcaccttgcagcccaaggtggagcctgtagatgggcccgaatttctgagtcaggccaagcagatagatkgggaggtcgggctgcagcaggtgcaagaagcccggggcaagaggcgggaggtggaggctccggagcttccaccagttccacagcaggcgggcgccagcca

SEQ ID NO: 24508 - DNA, 201 bp, Homo sapiens
accacaggtagtgtgggctggggccacgggacacctatcccttgtccagcctcacctgccgttggagcctgcattcatgaattcctcccactgccaccccycactgcccccttctaccttcaggccctacctggccggggctccagggggcccccaggacaaagcacgagtccattgtccctagaagacgtccccacccca

SEQ ID NO: 24509 - DNA, 201 bp, Homo sapiens; identical to SEQ ID NO: 5152

SEQ ID NO: 24510 - DNA, 201 bp, Homo sapiens
gagctaaagatggggatggggtggcagggagcctggaggcagggaggccagtaggcagttggtggccctggtgagaggtgacagtggctcaaactaggatyggggactggaggtgggggaggaaggtatccagggaaactcgggggagaggtactctgaggctgctggcagctggtgaggggctgggtccaggaacacacc

SEQ ID NO: 24511 - DNA, 201 bp, Homo sapiens
tgcagggagggcagggcgtccccggagggcagcagcgtgaaggcctgcagcagtcgggtcagcaccacgaagagctccaggcgcgccagcggctcgcccargcacacgcgggcaccgcagccgaaggccagagctctggagttcttgcctggctccaggaagcgatctgcgggcgggtggacaggtgggtggggaggcgtt

SEQ ID NO: 24512 - DNA, 201 bp, Homo sapiens; identical to SEQ ID NO: 5219

SEQ ID NO: 24513 - DNA, 201 bp, Homo sapiens
gtagtcccagctacttgggaggctaaggcaggaggatcgcttgaacccgggaggcagaggctgcagtgagccgaggtcgcccactgctctgggtgacagcragactccatctcaaaaataaaaaataaaaaataaataactagacatcattactataagaaaagggggattctttactaacagccccctaccatctctgtc

SEQ ID NO: 24514 - DNA, 201 bp, Homo sapiens
gcagcccaaggtggtgcgggtgccggggcacgaggacggggtcaccatctcaggcctggagccagaccacaagtacaagatgaacctgtacggcttccacrgtggccagcgcgtgggccccatctctgtcattggggtgacaggtgagtgtacgatgggagccccagagtggggcctgtgggagggtctccctttctctgg

SEQ ID NO: 24515 - DNA, 201 bp, Homo sapiens
ggcggccccgggcggtgcgtgttgggggcaaggagagtgaggtcaccgtgggaggcctagagcccgggcacaagtacaagatgcacctgtacggcctccaygaggggcagcgcgtgggcccggtgtccgccgtgggcgtgacaggtgagtgaggggcaggggcctgctttggttccctcccactgctggctcccagcttcc

SEQ ID NO: 24516 - DNA, 201 bp, Homo sapiens
accctgccatcctctctgtgtccctttttctcagctgcagaggaagagacccccagccccacagaacccagcatggaggccccggagccccctgaggagcygctcctgggggagctaacagtgacaggatcctcccctgactcgctgagcctctcctggaccgtcccccagggccgcttcgactccttcaccgtgcagtac

SEQ ID NO: 24517 - DNA, 201 bp, Homo sapiens
gctccttcctccaccctgcccaggggactccatgagctaccacagcggcagtgtcttctctgcccgtgatcgggaccccaacagcttgctcatctcctgcrctgtctcctaccgaggggcctggtggtacaggaactgccactacgccaacctcaacgggctctacgggagcacagtggaccatcaggtgaggggtgggga

SEQ ID NO: 24518 - DNA, 201 bp, Homo sapiens
ccagggactgcggggaggagatgcagaacggagccggtgcctccaggaccagcaccatcttcctcaacggcaaccgcgagcggcccctgaacgtgttttgsgacatggagactgatgggggcggctggctggtgggtggcattgggaagcccaggggtctgtgcagggcagggtctgttgccccgggagccagaggctgat

SEQ ID NO: 24519 - DNA, 201 bp, Homo sapiens; identical to SEQ ID NO: 5126

SEQ ID NO: 24520 - DNA, 201 bp, Homo sapiens
  misc_feature (1)...(201): n = A,T,C or G, or insertion/deletion polymorphism (see Tables 1-2)
tgagagctgctgcctggtggaggggtggagctggatcgggagggtggtggaggtgaggacatggctgcaatcagtgtagacatcactttctggaatctggnctgggaatgagagcaaagagggaagatggaggctagagagagatgcacacagagtgggggtgaggaggggtgtgacagtagcttgttgaaatgctgatgg

SEQ ID NO: 24521 - DNA, 201 bp, Homo sapiens
gaagagccagggtccttcaccacccagccgctggaggaagccttctctgccagcgatctcgcagcactgtgtttacaggggggaggggaggggttcgtacrggagcaataaaggagaaactgaggtacccggctggcatcggtcctgccccatcactggctctggcccgggctgtgggcccccatcccccggggctgcagc

SEQ ID NO: 24522 - DNA, 201 bp, Homo sapiens
cactctccccacacgtgtctgtccagctccagaggatgaagcagagaccacccaagcagtgcccaccacaacccctgagccccccaacaagcctcgcctcrgggagctgaccgtgacagatgccacccctgactccctcagcctgtcctggatggtccccgagggccagtttgaccacttcctggtccagtacaggaatgg

SEQ ID NO: 24523 - DNA, 201 bp, Homo sapiens
catggagtcacggatgcccagcagcagggctgagcgggtgagcttcttgtgggctttccagagcagggagtagtctcccaaggacaggtccgggtagttcytagacaccagcttgtctgcaggaggagttgggggctggagggtgggaactgatgaaggcagctgagggcctgaccttcttcggcctccccaacccctgct

SEQ ID NO: 24524 - DNA, 201 bp, Homo sapiens
acgtccacaatttggatggaccagtggctccaggtttttaacacctcctggatacatttgtaataggcaggcattaagttgtcgtcctgccagaaaaggakggagtactttcagttcaggacaaggagaggctcagggaggggctgggggtgggcctgaggggctgtgaggcaccttgatcttgtctccgaaggtgaggta

SEQ ID NO: 24525 - DNA, 201 bp, Homo sapiens
acatcccgtcgaaaccccaagccccagtcccaggctgccagttcagcacctggctggatctccttgtttacagctccagagaggaaagaggagcccccccrccctgagttcctggagcagcccctcctgggggaactgacagtgaccggcgtgaccccagactccttgcgtctctcatggacagtggcccagggccccttc

SEQ ID NO: 24526 - DNA, 201 bp, Homo sapiens; identical to SEQ ID NO: 5133

SEQ ID NO: 24527 - DNA, 201 bp, Homo sapiens; identical to SEQ ID NO: 5296

SEQ ID NO: 24528 - DNA, 201 bp, Homo sapiens
ccaaagcagcgtcagcggagagaggaccctctccgtcacctccgccccctcctatggtgagggccagagcgagatcagcctctcaccttgcagcccaaggwggagcctgtagatgggcccgaatttctgagtcaggccaagcagatagatggggaggtcgggctgcagcaggtgcaagaagcccggggcaagaggcgggag

SEQ ID NO: 24529 - DNA, 201 bp, Homo sapiens
agatagatggggaggtcgggctgcagcaggtgcaagaagcccggggcaagaggcgggaggtggaggctccggagcttccaccagttccacagcaggcgggygccagccagcaggggcagcagcagcagcaggcccaggagcagcatggcaagacgcccgtcagggccctgaggtgccacttatagctcaagagccccagcc

SEQ ID NO: 24530 - DNA, 201 bp, Homo sapiens
ttgcagtggacagcagtccatggtcccatcagccagtttctgctgggggtgaaggctccttggggcagggggctccacagccatcaggacttcagacatgratgaggtttgcaggaccagtgaaagacaggtcctggggtacctggctttcacatcccctctttgttcctctctgtgggaccagggtggctgactcatccc

SEQ ID NO: 24531 - DNA, 201 bp, Homo sapiens
aggacttcagacatggatgaggtttgcaggaccagtgaaagacaggtcctggggtacctggctttcacatcccctctttgttcctctctgtgggaccaggrtggctgactcatcccccagctccaggtcaagctcaccactggaagagagggtggtaagagagacagcagctcaggtgggcagaggagctttcagactgct

SEQ ID NO: 24532 - DNA, 201 bp, Homo sapiens
agcctccggagacctggattggggaagaactgcggcaggaagcatgagaatgcagctgtgggaaggagcctctccctccaccccagcctctcccctacaayccaggggtgtctaggctccaggtcctcaccctgagaaagggaatcacgtccacaatttggatggaccagtggctccaggtttttaacacctcctggatac

SEQ ID NO: 24533 - DNA, 201 bp, Homo sapiens
gagcgaggtcaccgtggggggcctggagcctgggcgcaaatacaagatgcacctgtacggcctccacgaggggcggcgcgtgggcccggtgtccaccgtgrgcgtgactggtgagtagtgcttggagtctcggggtaaccacctttccctcatgggtacctggtttactgctgtgccctttcaccaagccctgtgggtcca

SEQ ID NO: 24534 - DNA, 201 bp, Homo sapiens
acttcctggtccagtacaggaatggggatgggcagcccaaggcggtgcgggtgccggggcacgaggacggggtcaccatctcaggcctggagccagaccayaaatacaagatgaacctgtacggcttccacggtggccagcgcgtaggccctgtgtctgccattggggtgacgggtgagtgaatgatgggagccccagggt

SEQ ID NO: 24535 - DNA, 201 bp, Homo sapiens
gcagtgcctgttgcgggggatgagaatgaggttactgtccccggcctggatcccgaccggaagtataagatgaacctctacgggcttcgtggcaggcagcrtgtggggcccgagtctgtggtggccaagactggtgagtcatggctgccaggcctccctcccctgctagccccatcctgtgagcgggacttggctggggct

SEQ ID NO: 24536 - DNA, 201 bp, Homo sapiens
acagacagacttctggagggactgggaggactatgcccatggttttgggaacatctctggagagttctggctgggtcagtgcctcacagggactggggaastacggatggggatgggggccctgtggacaccaggaccctgatgagggcacgtatcccacccccaggcaatgaggccctgcacagcctgacacaggcaggt

SEQ ID NO: 24537 - DNA, 201 bp, Homo sapiens
tcggcgatggtggcattgagcaagggcagccgtgcacggtccttgtaggggacccgggagctggaggcaccagggcccagttcgtggtctagctcctcctycagtcgctgctgaatctggggaatgatcgggtggagtcctgccccagcagcccacagctgcccagcctccagccgctccctcagcaacccagtgagcctg

SEQ ID NO: 24538 - DNA, 201 bp, Homo sapiens; identical to SEQ ID NO: 5149

SEQ ID NO: 24539 - DNA, 201 bp, Homo sapiens
  misc_feature (1)...(201): n = A,T,C or G, or insertion/deletion polymorphism (see Tables 1-2)
gggaatcacgtccacaatttggatggaccagtggctccaggtttttaacacctcctggatacatttgtaataggcaggcattaagttgtcgtcctgccagnaaaggagggagtactttcagttcaggacaaggagaggctcagggaggggctgggggtgggcctgaggggctgtgaggcaccttgatcttgtctccgaagg

SEQ ID NO: 24540 - DNA, 201 bp, Homo sapiens
ccctgagaaagggaatcacgtccacaatttggatggaccagtggctccaggtttttaacacctcctggatacatttgtaataggcaggcattaagttgtcstcctgccagaaaaggagggagtactttcagttcaggacaaggagaggctcagggaggggctgggggtgggcctgaggggctgtgaggcaccttgatcttg

SEQ ID NO: 24541 - DNA, 201 bp, Homo sapiens
taccaggccagaactcatgtggcctctcccagaccgtctcatccaggtgggcgccttggaggttcggaatgatgactgtgccctcagggatgtcgtagccrgagatgctgaagggggctggagttagaggctggccaggacctccctgggctcgggctttcctcactcatccccaaccctcgggagtcacctgctgggccg

SEQ ID NO: 24542 - DNA, 201 bp, Homo sapiens; identical to SEQ ID NO: 5153

SEQ ID NO: 24543 - DNA, 201 bp, Homo sapiens; identical to SEQ ID NO: 5155

SEQ ID NO: 24544 - DNA, 201 bp, Homo sapiens
  misc_feature (1)...(201): n = A,T,C or G, or insertion/deletion polymorphism (see Tables 1-2)
tggcttatttctagaagacgctaaggtggaaaagagactgtccatctcccaaccaggtttctgccaggacactcgtgtcctcccatcctttctgtctcccnaggggaacacattatcttcattaccgtttctctcaacctaggtgctggacatcccgagagtgctggacatgctgaggcaacagagaatgatgctggtgca

SEQ ID NO: 24545 - DNA, 201 bp, Homo sapiens
  misc_feature (1)...(201): n = A,T,C or G, or insertion/deletion polymorphism (see Tables 1-2)
tgtcctgctcatggaaattatcaaaaataatgaatttagaaattgtaatcttgagtatactgtatcatcaagaaagacattttatcagttgacatcttttnttgatcctatagctgttttcctattttagctttggaccaacttgtaataactacattgtatacctctaagatttatttcaactagttacaagaaccattg

SEQ ID NO: 24546 - DNA, 201 bp, Homo sapiens
catagacaaaaactacttaacaaaaaaagtaccacagatttaaatttgctttttttttttttttttttttttttagaacagtcttgccctgttgcccaggytggagtgcagtggtgtgatctcagttcactgcaacctctgcctcctgggttcaagcgattcccctgccttgtgatctggctgcctcagcctcccaaagtg

SEQ ID NO: 24547 - DNA, 201 bp, Homo sapiens
cagcgtgtcccagtgtgggatattttgagtcattttcaggcagagaagtgccagagctagttcatattgactagcaagagccgacttaaatgttcaggaarcttgtgagccaattgatgtgacattaacagtttgaaattggctgtgatgggagtatttacaccatggatatgggcaaacaccgatcaaaacttccttcca

SEQ ID NO: 24548 - DNA, 201 bp, Homo sapiens
gtcctgttagtgccttttttccagtggagagggacggcttgttctttggccacagcttgactggcttttctttatataagcaaagcccagcgttacgtttrcttaactaacggcgttcctctttccccagcgctggcgtcaatgctcccttcctcgggccattggagactccgttgctttttaatggcggcagcggctgct

SEQ ID NO: 24549 - DNA, 201 bp, Homo sapiens
attcagatattttaaaatttatttttattgtattgttttagataaacaccctagttttaaacatttgtgacaaactgtactgcaagctgggaaatccacayaccagtgctagataaaaagcgtctatcagacagagccaaagtcatgtctactctccatgtgcgaaaccactctgcccccaacactgttaccaggactcag

SEQ ID NO: 24550 - DNA, 201 bp, Homo sapiens
gattttgtcggagatcatgatcgcctgcctggaacacaatgaggtgatggcgcttatgatcacctggcctttttgggtggaaatgaggctggggaagagarggacatagtgacttaatagctctttttgcgcacatttccttggactgtggtggcctcaagatgttactaatgttccctgcaaaaggctgtgtcttcttgg

SEQ ID NO: 24551 - DNA, 201 bp, Homo sapiens
aaatttccattttctaatatacccccaaaggtcatcctgatctctagtacagtttactgacttcattctttcttttttgttcattttaatttttttagagwcaaggtaggtctagctatgttgcccaggttggtctcaaattcctaggctcaagcgatcctcccgcgataggcatgtgccaccatgtccggctcttgactt

SEQ ID NO: 24552 - DNA, 201 bp, Homo sapiens
tgctagctgattaaaaccactgtttttttttttcttttttctgttttggttttttttgagacagagtctcgttctgttgcccagactggcatgcagtggcrcaatcttggttcactgcaacttctgcctcccaggttcagacaattcttctgcctcagcctcccaagtagctgggattacaggtgcctgccacctcgcctg

SEQ ID NO: 24553 - DNA, 201 bp, Homo sapiens
ggttacaggcatgagtcaccatgcccagccctgatatttgggataataagcaattacttggtggtttaagaaaagttcaagatttcaccctaagatttttyagggagttgttttatcccccaccttcccactcatctgccttaagtatggagagcaggatctcatgtgataccctcagcattcagcacatactggttttca

SEQ ID NO: 24554 - DNA, 201 bp, Homo sapiens; identical to SEQ ID NO: 5479

SEQ ID NO: 24555 - DNA, 201 bp, Homo sapiens
tgtatcattcttcttgtcagatacacactttatgtgaatatggcattttcttttctattaacaaggattcatcattcttttaacagtatgccaatttagcraatattttcctattcagttctctgagcaatttgttcataaacaaatgtcacttagatttcctttatcttttaatgaattgacagaacatacagaggcaat

SEQ ID NO: 24556 - DNA, 201 bp, Homo sapiens
ggattcgcttgaacctgggaggtggaggttgcagtgagctgagatcgtgccactgcactccagcctggtgacagagcaaaaaaaaaaaaaagaaaaagatytagttacctctacgtgtggtagaggtggaaattgaaagcagatcagtttcattagaacctattgcttatccccttccaaataaaataaacttttgcctct

SEQ ID NO: 24557 - DNA, 201 bp, Homo sapiens
tcccttatgggtttggtgttcacattccacgagataatcatgtacagtccttagcacagtttcaataaataatattgattttacttgggctggtagacttktttcttttttttaaagacaccaggtcctagtatcccagtttcccaggtagaatatggtgggaattcgcagatgggatcgtagtgcactacagccatgaac

SEQ ID NO: 24558 - DNA, 201 bp, Homo sapiens
ctgaggtgggcagatcacgaggtcaggagatcgagaccatcctggcaaacatgttgaaaccctgtctccactaaaatacaaaaaattagccaggtgtggtrgcatgcaccggtagtctcagctactcagaaggctgaggcaggggattcgcttgaacctgggaggtggaggttgcagtgagctgagatcgtgccactgcac

SEQ ID NO: 24559 - DNA, 201 bp, Homo sapiens
  misc_feature (1)...(201): n = A,T,C or G, or insertion/deletion polymorphism (see Tables 1-2)
ggctcttgtgagaagccagttaattccttagaaagatgattacctatgtaaacaaagctcccatatagtaacaatagtcataattttgcctgatagtgacnagagtcattaacagtcaatggccatgattccttctaagaaattggggtgaattgtcacatacttaccactgtgtgttttcttcagggatggttacaagat

SEQ ID NO: 24560 - DNA, 201 bp, Homo sapiens
gcacgccaccacgcctggctaatttttgtattttttagtagacatggggtttcaccatgttggccagactggtctcaaactcctgacctcagatgatccasgtatatttgggttcttgaatgtatgtaaaaacatgcagtatcaaattttgatgctccactggtctcaaatttggccaatgggaaactatcaagctggttc

SEQ ID NO: 24561 - DNA, 201 bp, Homo sapiens
tccttttgccttagcctgccaagagctgggactacaggtacactccaccacacccagctaattttttttttaacttgtgtttttgagatggagtcttgctrtgtcgcccaggctggtctgggagttgtttcctctagttatcttcctgcctcaactttgtgagtaggtgggattacaggcgtgtgccaccttgcctggctt

SEQ ID NO: 24562 - DNA, 201 bp, Homo sapiens
tgtttggtttctttttatttatttcaataggtttttggggaacaggtggtgtttgcttacatgaataagttcttcttatttatttagttacttttttttttgagatggagtctcgctctatggaccaggctggagtgcagtggcacgatctcggctcactgcaacctcctccgcctcctgggttcaagcgattctcctgcc

SEQ ID NO: 24563 - DNA, 201 bp, Homo sapiens
tcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagt

SEQ ID NO: 24564 - DNA, 201 bp, Homo sapiens
aaagggcatccaaatcggtaaagaggaagtcaaaccgtctctattcactgatgatatgaacgtatacctagaaaacccctaagactcatccaaaaagctcytagatcgataaatgaattcagtaaatgttttagtctgttttcatgctgctgatagtcatagctgagactgggcaacttacaaaaggaagatttaatggac

SEQ ID NO: 24565 - DNA, 201 bp, Homo sapiens
aacagcattaaaaacaatatgatcatctcaatagatgcagaaaaggcatttaacaaaatccagcattcctttatgattaaaaccctcagtaaaattggcayagaagggacataccttaaggtaataaaagccatctatgacaaacccagagctaacattatactgaatggggaagagttgaaagcattccccctgaaaact

SEQ ID NO: 24566 - DNA, 201 bp, Homo sapiens
aaaattttttgtaaagacagggtcttgctttgttgcccaggctggtcttgaactcttggcctcaagtttctcccactttggcctcctaaagtgctaggatyacaggcatcagccactgtgcctggcaagttttgtaattttgaaataagtttatctatttttttctttgttgctcatgtttttggtgttatactcaagcat

SEQ ID NO: 24567 - DNA, 201 bp, Homo sapiens
  misc_feature (1)...(201): n = A,T,C or G, or insertion/deletion polymorphism (see Tables 1-2)
aaacaagaattcttggatctgcaaattccgacttgtgatttctgcaaatcctgattagattggccgctcttggcatgctcgtcctattttcttttttgctnagaaagccttatactaatagcgtatgctcacaaacacattcagaacattcgtgtgctccaagtgacaactgctgtatgcctaatagttgctgacagttta

SEQ ID NO: 24568 - DNA, 201 bp, Homo sapiens
aggtcttacctcctttttttccttcagtttttgctgttgttcttctctgagaagaaaggcaataagagactgctgtcatttggtcacaggtcagggattaktgcgactgaagtcattgaaatccttttgtatgttattgcctccttcaatgaccttctgtctttccaggtcacttacttcagcctctggtactacaacaag

SEQ ID NO: 24569 - DNA, 201 bp, Homo sapiens
cctttcattacaacagaactttgtaaccaatagtgtttcaaaaccttctatctggaagactttatcagggctttggccttgaaaggaatgtcttcctactmatgtttgttaaacaagtggtgtgtgaaggagtgtaatctttctgggtttattggcaaaggagaacactccctctgtgtgttcctggtcttcagtgcattg

SEQ ID NO: 24570 - DNA, 201 bp, Homo sapiens
agtaagtaactccagactcccatatatttgtaattctttgtaaattctatttaaggggtttttgtttgttatgtacgtgttctcctttgctaaaaagaatrttgcccatcacttccctctactgccaacttgctattattaaataagcccttttcctttaatttgtcatcttttaatctgctttggattggattaccaaat

SEQ ID NO: 24571 - DNA, 201 bp, Homo sapiens
atagcacaagtgatccccaaagccccaaccctccgttgttggtccactgcagtgctggggtaggaaggactggcgtggtgattttgtcggagatcatgatygcctgcctggaacacaatgaggtgatggcgcttatgatcacctggcctttttgggtggaaatgaggctggggaagagagggacatagtgacttaatagct

SEQ ID NO: 24572 - DNA, 201 bp, Homo sapiens
ctgcagttttcacatgagaagtataaggaattgtatttataacaaacccccaagctgaagtttaagcagtcaattaacatttactctatactctctctgtrtggggctataccaaatgctaaggaggtttatgcagatgagtatttccacatcttaagaagtttatcttcagcctggaccacagggccagaccctgtctct

SEQ ID NO: 24573 - DNA, 201 bp, Homo sapiens
gacattctatttatagctaaaactaatcagaaaatcagaagtaggcaatcatggcttatttctagaagacgctaaggtggaaaagagactgtccatctccyaaccaggtttctgccaggacactcgtgtcctcccatcctttctgtctccctaggggaacacattatcttcattaccgtttctctcaacctaggtgctgga

SEQ ID NO: 24574 - DNA, 201 bp, Homo sapiens
aaatatactttatatagctataacaaatttgacttctgaaatattagcataccatctagatatactgcgtattgaattttgttgtgcatattttgcaatgmaatttaaatataattaacgtgaatgtttgtcattctatatagcggattttggtgactttgatcagtatgaatcccaggactttcttcagaaatttgcctt

SEQ ID NO: 24575 - DNA, 201 bp, Homo sapiens
ttcccaagtcattttgaaactgtttaatatgagaatcacactgttagaacagattgttttgtcttcataaattaaatcctacttgtggtattcataccatyggcacagtgttggaaaatgaaaggcttatagtgttctgaaagtgactttgtcatatgatgtcacccattatgtctttagacaaactctgcattaaacgta

SEQ ID NO: 24576 - DNA, 201 bp, Homo sapiens
  misc_feature (1)...(201): n = A,T,C or G, or insertion/deletion polymorphism (see Tables 1-2)
tgcgacaagtgtgtgggtgatgtagccttgtctctttccccactgcttatggctaatccagaggtttattggatgggcctgggaagtatgctctgatcccnttgtgggtccaggcgatgatgctgtgtggggagcctgaaaccacagggcaggttgacgggttggggcagcaggaaagggctgaggccccacgggccgaca

SEQ ID NO: 24577 - DNA, 201 bp, Homo sapiens
gtatagcatttaaacagaaactttgaggtgtgattttttatataagacattgaaccagaaatgaataagttagagcaaatatggaagagtcaattctcatracagtataatgtaaggcaaaaatatttttgtggaaggctacattaattgggtccaagtatgttgctttttcatgttttttgttttttgttttgagacaga

SEQ ID NO: 24578 - DNA, 201 bp, Homo sapiens
gatttatttcaactagttacaagaaccattgtaattcttgaaaggtaaaaagggaataatatcctttatttgtttaaatcaatcctctggtaagcattttkagtcattaaagattattcagcttttccagctatctgaagaatttttgcccctccttcctggtgtgcatttttcttagcccacatgggtttcttactgttt

SEQ ID NO: 24579 - DNA, 201 bp, Homo sapiens
gaaatgaataagttagagcaaatatggaagagtcaattctcataacagtataatgtaaggcaaaaatatttttgtggaaggctacattaattgggtccaartatgttgctttttcatgttttttgttttttgttttgagacagactctctctgtgatgcccaggctggagtgcaatggcaccatcttagctcactgcaacc

SEQ ID NO: 24580 - DNA, 201 bp, Homo sapiens
atttatttcaataggtttttggggaacaggtggtgtttgcttacatgaataagttcttcttatttatttagttacttttttttttgagatggagtctcgcyctatggaccaggctggagtgcagtggcacgatctcggctcactgcaacctcctccgcctcctgggttcaagcgattctcctgcctcagcctcccgagtac

SEQ ID NO: 24581 - DNA, 201 bp, Homo sapiens
  misc_feature (1)...(201): n = A,T,C or G, or insertion/deletion polymorphism (see Tables 1-2)
ttagatcagaaatctgcttcaaacccactgtctctcactctaagccccagaactggtcatgctgtaagcaccctccctgatttatataaggaaaatgccgngagagttggggagtcatgagaggccccttggtgtaggtggctcccctgctcttttctgtgaggaaaagggaggatggtatccttcaacctgcaaagccaa

SEQ ID NO: 24582 - DNA, 201 bp, Homo sapiens
acagtataatgtaaggcaaaaatatttttgtggaaggctacattaattgggtccaagtatgttgctttttcatgttttttgttttttgttttgagacagastctctctgtgatgcccaggctggagtgcaatggcaccatcttagctcactgcaacctctgcttcctgggttcaagcgattctcctgcctcagcctcccaa

SEQ ID NO: 24583 - DNA, 201 bp, Homo sapiens
ctatgctatgtattcatctagttcaaagactttgtctgctaataggtcatattttaagaagaaagatatgccagtcagtgagtttgatgaggttatattcrcttacagtttaagtacacttcatatgtttggtttctttttatttatttcaataggtttttggggaacaggtggtgtttgcttacatgaataagttcttct

SEQ ID NO: 24584 - DNA, 201 bp, Homo sapiens
cagttctctatttgctgttctttaggtggcatgacattgccaacatgtcccacaacaagtccttttttgcattagagctggcaaataaagaggagaccatycaatttcaaactgtgagtaaacattaggggtctgcatggaatgtttttcctaaaagttaacaagttctacttctgcgtgcctgtatgtgtttggaggcag

SEQ ID NO: 24585 - DNA, 201 bp, Homo sapiens
tttgcacagtgacaaaatctgatgatgcctttctcaacacattcccatccttgacacatgactatatacatatacatttattaatactatgctatgtattyatctagttcaaagactttgtctgctaataggtcatattttaagaagaaagatatgccagtcagtgagtttgatgaggttatattcgcttacagtttaagt

SEQ ID NO: 24586 - DNA, 201 bp, Homo sapiens
  misc_feature (1)...(201): n = A,T,C or G, or insertion/deletion polymorphism (see Tables 1-2)
aggtgtgtagtaggctatacaatatagcctaggtgtggagtaggctgcaccacctaggtttgtgtaagtatactctgatgtttgcacagtgacaaaatctnatgatgcctttctcaacacattcccatccttgacacatgactatatacatatacatttattaatactatgctatgtattcatctagttcaaagactttgt

SEQ ID NO: 24587 - DNA, 201 bp, Homo sapiens
tctcattttgaactcattttttctagataacctctttgtgcccaaccagaacggatactactgtcactctcagacaagcttggatagagcccagattgacytcaacggtcggatccgtaatggcagtgtctacagtgcacacagcaccaactccttaaataatcctcagccctacttgcagccctcgccgatgtcgtccaa

SEQ ID NO: 24588 - DNA, 201 bp, Homo sapiens
  misc_feature (1)...(201): n = A,T,C or G, or insertion/deletion polymorphism (see Tables 1-2)
tcatgttataggtcaacagagcaaacagtacaataaatagaagtatgtatatatgtgtgtatacacacacatatgtacaatcatatgccgaatgacatttngttcaacaaaagacctcatataggacagtggtcccataaaattataacactatttttagcgtaccttttctgtgtttagatacacaaataccattgtgtt

SEQ ID NO: 24589 - DNA, 201 bp, Homo sapiens
gccttcagtttctcagctgcagcaggagattaccaggtgagaaattacatgccgtttgtttttaggaaatagtctagtgagatgtaaaaagtgaaactaargttgaagtcagaagataagtttgaaactttgccctctcgccccacatttttagccacggtgttacaaagagattctcatatgtggcatgtcagagtgttt

SEQ ID NO: 24590 - DNA, 201 bp, Homo sapiens
atcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacag

SEQ ID NO: 24591 - DNA, 201 bp, Homo sapiens
  misc_feature (1)...(201): n = A,T,C or G, or insertion/deletion polymorphism (see Tables 1-2)
tgaaataagatgataaagactcatatgaaatgattaaaggggtgggctgtcagaggaattcaaacatgaactgtaactgggttgcacttcacaggcaccanatacggaggacagtttggattccagatggctccatagactgcactggcagagtgtctgtgatttccatttagtacggtatccccagcatctagaataatg

SEQ ID NO: 24592 - DNA, 201 bp, Homo sapiens
ggatcccagaactgccagcatcccattagctatagagggaaatccatgggtttggctgttagcaggtggaaggagaaaagctggatccaaattcttcttamttgaatggatggtgttttggtcaggttctttggtaataaagaacagaggtttacatgtctgtggctgaaataagatgataaagactcatatgaaatgatt

SEQ ID NO: 24593 - DNA, 201 bp, Homo sapiens; identical to SEQ ID NO: 5487

SEQ ID NO: 24594 - DNA, 201 bp, Homo sapiens
ctgaaaatgcagaaagaaatcgattccaagatgttcttccttatgatgatgtgagagtggagttggtcccaactaaagaaaacaacactggttacatcaaygcatcacatattaaggtgagaggaacgcctcaagtaatcaacagcacatgcagtttcagttaagttacaagaatggtaagaattgtattcatgtctgttt

SEQ ID NO: 24595 - DNA, 201 bp, Homo sapiens
  misc_feature (1)...(201): n = A,T,C or G, or insertion/deletion polymorphism (see Tables 1-2)
cctgggtggcatagcgagacttcgctctataaaacacgttgtaaggagcgtattttgaggtcctgtggctccaaagcgggcatcctatggggcccgcccancctctccaccgccagtagggcacgcgctggtccctttaaatgttcccttcgggagccgagggaccggtccttttagagcgcgtccgtccagaaacgcggc

SEQ ID NO: 24596 - DNA, 201 bp, Homo sapiens; identical to SEQ ID NO: 5477

SEQ ID NO: 24597 - DNA, 201 bp, Homo sapiens
catccttgtttgaaactgtctaggggctctgtgtggtggttcatgtccgtagtcccaacattttgaatccaagcactaggattgcctgagcccaggagttkgagaacagcctgggcaacatggtgaaactcccatctctgtaaaaaatagaaaaatttgtcaggcatagtggtatgcacctgtagtcccagctactcagga

SEQ ID NO: 24598 - DNA, 201 bp, Homo sapiens; identical to SEQ ID NO: 5483

SEQ ID NO: 24599 - DNA, 201 bp, Homo sapiens
gctacattaattgggtccaagtatgttgctttttcatgttttttgttttttgttttgagacagactctctctgtgatgcccaggctggagtgcaatggcaycatcttagctcactgcaacctctgcttcctgggttcaagcgattctcctgcctcagcctcccaagtagctgggactacaggcatgtgccaccacgcctgg

SEQ ID NO: 24600 - DNA, 201 bp, Homo sapiens; identical to SEQ ID NO: 5485

SEQ ID NO: 24601 - DNA, 201 bp, Homo sapiens
ttttttttttcttttgccttttttgagatagagtcttgctctgtcgcccagacaggtggagtgcagtggtatgatcatggctccctacagccttgaccttstgttgcctggctttagaactttgtccttctaaatctgaagacctctttttagctcataaattctgggagccactgaattgctagtttttcctcatcacat

SEQ ID NO: 24602 - DNA, 201 bp, Homo sapiens
tgcgagccccatgagcgcgccgcggcccgggctggcgtgcgggtgcggctgcggcggccgcgcggcggggccccgggaggcgggtcgctgagcggggcgckcggccccgaggatgcgggagcgggagcgggagcaggtgagggcgcggtccccggccggcgggaggggcgggcggctggcccgagcggtggggtgtgtcca

SEQ ID NO: 24603 - DNA, 201 bp, Homo sapiens
tgagttgggggtcagggagaggagaggaaaatggatccgtggcttcacctgaagagcagggctctgatggtgcccaaagtgtcacatggaaacttgaggcwtctacctggcttcctttatcactggataggaattttcacagttgccttaatgtgatgctaataatctttagatttaacaaacaacggaatccgtactaag

SEQ ID NO: 24604 - DNA, 201 bp, Homo sapiens
ttaattgggtccaagtatgttgctttttcatgttttttgttttttgttttgagacagactctctctgtgatgcccaggctggagtgcaatggcaccatctyagctcactgcaacctctgcttcctgggttcaagcgattctcctgcctcagcctcccaagtagctgggactacaggcatgtgccaccacgcctggctaatt

SEQ ID NO: 24605 - DNA, 201 bp, Homo sapiens
  misc_feature (1)...(201): n = A,T,C or G, or insertion/deletion polymorphism (see Tables 1-2)
tatcatcaagaaagacattttatcagttgacatcttttcttgatcctatagctgttttcctattttagctttggaccaacttgtaataactacattgtatncctctaagatttatttcaactagttacaagaaccattgtaattcttgaaaggtaaaaagggaataatatcctttatttgtttaaatcaatcctctggtaa

SEQ ID NO: 24606 - DNA, 201 bp, Homo sapiens
gtatgttcagtcctgtgaaggggtgatggtaccctcattttactggtgatagaatttaaattcaccagattatgacttgcccaagttcgtgcagaatactratttggagagttcaggtctacttgactctaaaccttgttctggtaactgatgccctatatattgaaagtacaaacagggtggtaaacagaagtaaaccca

SEQ ID NO: 24607 - DNA, 201 bp, Homo sapiens
agggaccattacagaatacctgtcaagatttttggcagatggtatgggaacagggaattgcaattatagcaatggtgacagcagaagaggtaggtacttayttctcttaagtgattttctcagcctctgaagaacagttaatgttaatcatctggaatcctgacctgtggagaaaaaggcagggtagggttgtggttctgt

SEQ ID NO: 24608 - DNA, 201 bp, Homo sapiens
attgagacaaacatttgctaggtatttccaccatctaacacttttatttatttatttatttaaagagacggggtcttgctctgtcttccaggctggagtgyggtggtgtgatcatagctcactgtaacctcagactcccgggcttaagggatccactggcctcagccctcagcttctgaagtagccaggattataagcgtg

SEQ ID NO: 24609 - DNA, 201 bp, Homo sapiens
acaacactgtcacctatggaaggtttaagatcacgacccggttccgcacagactctggctgctatgccaccacaggcctgaagatgaagcacctccttacygggcaagagaggaccgtctggcacctccaatacacagactggcctgaacatggctgtccagaagacctcaagggatttttatgtgagtgactttaacttt

SEQ ID NO: 24610 - DNA, 201 bp, Homo sapiens
  misc_feature (1)...(201): n = A,T,C or G, or insertion/deletion polymorphism (see Tables 1-2)
ctttaattccttaaaatctgttatctggaaaacccaaagttcatgtccaaccaaaagcttatattgtttttataaggcaggaaaacatattctatcacttntgttttttggttcctttgtgtctaccatttgttgagtgcttatcatgagtcagataaactatgctgagcattttttgtgaattttttttagtgtaatctt

SEQ ID NO: 24611 - DNA, 201 bp, Homo sapiens
tttttattttttaaaacccagacacgccatgcagacttgtgtcaccaaaataaatactggaagaatggaatatcttttggaaaagagacatttatttttcmttaacagcctgaatactttccagtaacaaagaaatgaaattatttataaaagctagtaaaagcagttgtaatcacctgatgttaaaactagtatgtacta

SEQ ID NO: 24612 - DNA, 201 bp, Homo sapiens
  misc_feature (1)...(201): n = A,T,C or G, or insertion/deletion polymorphism (see Tables 1-2)
tgaaatggtcttgaaatagagttcctaaggagggccaaactttttcaatttttatacttacctataagatcatagatctcattcagacttttgtcttcctnaatagttactctgtaggtcttcggaactttctacatctgggaaaccagtccagggaactctagcagcagttcctctgcatctgcttcctgggtgtttctt

SEQ ID NO: 24613 - DNA, 201 bp, Homo sapiens
atttttattgtattgttttagataaacaccctagttttaaacatttgtgacaaactgtactgcaagctgggaaatccacataccagtgctagataaaaagygtctatcagacagagccaaagtcatgtctactctccatgtgcgaaaccactctgcccccaacactgttaccaggactcagggcgcacttatttgcccggc

SEQ ID NO: 24614 - DNA, 201 bp, Homo sapiens
ctgcatggagctgcggcattggagaatcccagaaggtgatccagaggaaatgatgcatagacagagtcttgaaggatattagggattggccaggtccacargtgagtcacaggcacaccaagaagagggattctcatgtgcaaaagcccagaggggctagggaacatattctatctgaagagatgcagagtttgggatggc

SEQ ID NO: 24615 - DNA, 201 bp, Homo sapiens
ttagctggattgagagagaatgggcctattagagtcaatcaataggattgctcatcgattaggtataggagcacctgatagagaagttgtatcggtaaggrttaagtatagctatatataacaaaaaccctaaatatcattgacttctgtgagagttcagaagtcagccttgcagagcttgtctgacagctccacagagtc

SEQ ID NO: 24616 - DNA, 201 bp, Homo sapiens
aagctctttctattaaaccagatttttgttttctataagttgcagtttaaaaaaagaaaagaacagtacttgttttctataaatgtatgatacatattctrtgcttacagataataagcaattcattttaaaatgtcataacctcagaatataattaacaatgggacttggcctttcagatatattacaatgtgcttggat

SEQ ID NO: 24617 - DNA, 201 bp, Homo sapiens
gttcagtatatgccttttcaccttcttggtcaaatttattcctacatattttgttcttttggatattactgtaaatggaattgttttctttttttgacatrtacattgctggtatatagcagctgatttttgcatgttgatcttgtaccctgcaaacttcactgaatgtattacctcgagtagggcaggggtgtgtgtgtg

SEQ ID NO: 24618 - DNA, 201 bp, Homo sapiens; identical to SEQ ID NO: 5484

SEQ ID NO: 24619 - DNA, 201 bp, Homo sapiens
ttatttctttgggaaatgaagcgcttcataactaactttgcctgataaacaaggttgactcctttgtccaaactatttggagtgctaagttttggaaacartttataaatttctatctgtcgtaaataaaggatactacctctgcttttaggaacagtgattgttgttgaatacatgactaattaatgtttggagttattt

SEQ ID NO: 24620 - DNA, 201 bp, Homo sapiens
tttgagataggttctcatggttcactgcagcctcaacctcctgggctcaagcaatcctcctgcctcatcctcccaagtagatgggaccacaggcatgcacyaccacacctggctcgttttttaattttttgcagagacggggtctcactgtgtttctcaggctggtcctgaactcctaggctcaagtgatcctccctcctt

SEQ ID NO: 24621 - DNA, 201 bp, Homo sapiens
ttttgttgcagtgctcaggcttccagctcttcctggcccacatctccactcctcatgccctgcacttgagccaggctaacttgattagggcctccatcctwtctcctgttggcttccagtgtcctggcaactagggttctcctccccccatcgctgctaaactgcaaactccgacaggacggctcatctcaagtgtggttc

SEQ ID NO: 24622 - DNA, 201 bp, Homo sapiens
  misc_feature (1)...(201): n = A,T,C or G, or insertion/deletion polymorphism (see Tables 1-2)
attcttaagaaacggctagttgatggggagtgctcaacagcacgactccctgaaaatgcagaaagaaatcgattccaagatgttcttccttatgatgatgngagagtggagttggtcccaactaaagaaaacaacactggttacatcaacgcatcacatattaaggtgagaggaacgcctcaagtaatcaacagcacatgc

SEQ ID NO: 24623 - DNA, 201 bp, Homo sapiens
actggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaatt

SEQ ID NO: 24624 - DNA, 201 bp, Homo sapiens
ttatctcatataagcttcggacttgttttaacataaagaatacaagtgttttggggagggttaacgaggtttataaattatgatttggtagtgagtagaaygccacagctgactcagtatctccgtcatttcattttgtagatcagaaagtggacagaggtagtgacttgctcagggtcacactgtccctttgtggttggg

SEQ ID NO: 24625 - DNA, 201 bp, Homo sapiens
tcttacctcctttttttccttcagtttttgctgttgttcttctctgagaagaaaggcaataagagactgctgtcatttggtcacaggtcagggattattgygactgaagtcattgaaatccttttgtatgttattgcctccttcaatgaccttctgtctttccaggtcacttacttcagcctctggtactacaacaagcaa

SEQ ID NO: 24626 - DNA, 201 bp, Homo sapiens
catggaaattatcaaaaataatgaatttagaaattgtaatcttgagtatactgtatcatcaagaaagacattttatcagttgacatcttttcttgatcctrtagctgttttcctattttagctttggaccaacttgtaataactacattgtatacctctaagatttatttcaactagttacaagaaccattgtaattcttg

SEQ ID NO: 24627 - DNA, 201 bp, Homo sapiens
gaaggactggcgtggtgattttgtcggagatcatgatcgcctgcctggaacacaatgaggtgatggcgcttatgatcacctggcctttttgggtggaaatraggctggggaagagagggacatagtgacttaatagctctttttgcgcacatttccttggactgtggtggcctcaagatgttactaatgttccctgcaaaa

SEQ ID NO: 24628 - DNA, 201 bp, Homo sapiens
ataattaacaatgggacttggcctttcagatatattacaatgtgcttggattttcaaaaattttatttgcatgcagcttgtcaaggattttttttttttttaaggcagagtctcactttgttacccaggctggagtgcagtggtgcagtcttagctgactgcagcctctgtctacctcctgggttcaagtgatcagcctgc

SEQ ID NO: 24629 - DNA, 201 bp, Homo sapiens
atacatgtatccaatgtagttaacttaggttgctaactttcttttaaattcaccatatttgaactacagaaagtaacttctttttttttttttttttttttatttgagacagagtctcgctctatcgcccaggctggagtgcagtggcgtgatctcggctcactgcaacctccgtctcccaggttcatgccattctcctgt

SEQ ID NO: 24630 - DNA, 201 bp, Homo sapiens
ctaatttttttttttagttttttagagatggggtcttgctgtgttgcccaggctggtcttaaacccctggcctcaagtgatcctcacatctcagcctcctragtacctgggattacaggaaggaatctattccttgaactatctattagtgcatgagctttcaatggcatctttttgtttatcaaaatcttaactccctta

SEQ ID NO: 24631 - DNA, 201 bp, Homo sapiens
tgatccttgagtacttttctatttcattgattttccacagcatatcttgaagagatccagtctgttcgacgccatacaaatagcacaagtgatccccaaarccccaaccctccgttgttggtccactgcagtgctggggtaggaaggactggcgtggtgattttgtcggagatcatgatcgcctgcctggaacacaatgag

SEQ ID NO: 24632 - DNA, 201 bp, Homo sapiens
aaagaaattgtggggactgttttacagggcatgaagcagatgactaattgtcttataggatcgttttaattttgaaataactataatctgggataagtaaytcatcacatatactttaatatgtgtaagtgtcatgtggttgaggactttctcatccttgtttgaaactgtctaggggctctgtgtggtggttcatgtccg

SEQ ID NO: 24633 - DNA, 201 bp, Homo sapiens
gggagtggttcaggtacagatggtagccacctggagttggatagggttggagagaggtggttggaatctggatcaggacctaccgagtaatagagaagggwtagcatgggtcctggttgatattcaggttttcagtagatggtggggctataacagagaggaaatgtgaaaggaagtgcagatctattaggggcaaggagg

SEQ ID NO: 24634 - DNA, 201 bp, Homo sapiens
ttttgtattttttgttgtgatggggtctcactatgttgcccaggctgttcttgaactccttggctcaagtgatcctctggcctcagtctcccaaagcactrggattacagatgggagctactgcacctggcctacagttaacttttttataaataggagtacactctaaataaaaagtataataaatgcataaatcagtaa

SEQ ID NO: 24635 - DNA, 201 bp, Homo sapiens
ctatctaaaaaaaaaaaaaaaaacacacacaaccatgtgggattaaggttttatttcactggtttatgcttctctaccaaattatggttaaatgcattgtrtctcaatgagataatattgacattgaccttatacaactgacattttttataggtatcagtattatctgcaactgaagaaagatatcttggaaggaagtat

SEQ ID NO: 24636 - DNA, 201 bp, Homo sapiens
tcaggtgatcctcccacctcggcctcctaaagtgctgggattacaggcatgagccaccacacctggccttcgataataaattaacctcagcttactataaygtttttgctttacaaacttttaaatttttaaaacttttgactcttgtaataacataggttaaaacacagacacattgtacagctatacaaaaatatctat

SEQ ID NO: 24637 - DNA, 201 bp, Homo sapiens
attttgaaataactataatctgggataagtaattcatcacatatactttaatatgtgtaagtgtcatgtggttgaggactttctcatccttgtttgaaacygtctaggggctctgtgtggtggttcatgtccgtagtcccaacattttgaatccaagcactaggattgcctgagcccaggagttagagaacagcctgggca

SEQ ID NO: 24638 - DNA, 201 bp, Homo sapiens
tgtgctgtacaggtttgtagcctagcagcagtaggctatatcacatgccctaaatgtgtaggaggctataccatttaggtttgtgtaagtacactccatamtgttcacacaatgaaatagcctaatgatgcattcccacatcgttaagggacacgtgactactaaaatttcccctttaatcctagtttactctttaaaaac

SEQ ID NO: 24639 - DNA, 201 bp, Homo sapiens; identical to SEQ ID NO: 5482
  misc_feature (1)...(201): n = A,T,C or G, or insertion/deletion polymorphism (see Tables 1-2)

SEQ ID NO: 24640 - DNA, 201 bp, Homo sapiens
cactggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaat

SEQ ID NO: 24641 - DNA, 201 bp, Homo sapiens
gtaggatacagtgaagggtggagtctgaccctgagcctagcacaactctgagataaaattccaccctgccttccgggtcctgttagtgccttttttccagyggagagggacggcttgttctttggccacagcttgactggcttttctttatataagcaaagcccagcgttacgtttgcttaactaacggcgttcctctttc

SEQ ID NO: 24642 - DNA, 201 bp, Homo sapiens
  misc_feature (1)...(201): n = A,T,C or G, or insertion/deletion polymorphism (see Tables 1-2)
ataaaattccaccctgccttccgggtcctgttagtgccttttttccagtggagagggacggcttgttctttggccacagcttgactggcttttctttatanaagcaaagcccagcgttacgtttgcttaactaacggcgttcctctttccccagcgctggcgtcaatgctcccttcctcgggccattggagactccgttgc

SEQ ID NO: 24643 - DNA, 201 bp, Homo sapiens
ctatgaaaaaacaacaccttatccaaaataggaagaggatcacaattactaactacaaaatttgggattatagtagtgctggctattatctcatttaatcytgaggatggcccagtttgctatccctatttgtaggatacagtgaagggtggagtctgaccctgagcctagcacaactctgagataaaattccaccctgcc

SEQ ID NO: 24644 - DNA, 201 bp, Homo sapiens
ttatagcatggttgtaatctctttaaagacagcgacggtttagggattcgtcttagatttctcacgatgctcattacgctgtcttgttcccagagacgcartacacatttgtggaatggaatttcaaaatgttaagtttggcaaagccgagggtagtagcggaacccttttctccaggtctgccattccctaaccctaagt

SEQ ID NO: 24645 - DNA, 201 bp, Homo sapiens
ctctgacatttggagtattacaacctgaaagagttacctatgaaaaaacaacaccttatccaaaataggaagaggatcacaattactaactacaaaatttrggattatagtagtgctggctattatctcatttaatcctgaggatggcccagtttgctatccctatttgtaggatacagtgaagggtggagtctgaccctg

SEQ ID NO: 24646 - DNA, 201 bp, Homo sapiens
ttcaggttcgctctcatatacttgagtaatttctaaaaggagtcttgaacttctattccgaacgccctggccgattgttgcgggttaattctggatcaggsttttaaatgtgttaggcatatttgtgcctctcagaatatataaacgtgaaattcgccagataactttggcgagaaggggcgcagggaaggactgtttggt

SEQ ID NO: 24647 - DNA, 201 bp, Homo sapiens
ttcttccttacccttactatagtgagctcaaaaggtgtaagtcattgagacaaacatttgctaggtatttccaccatctaacacttttatttatttatttwtttaaagagacggggtcttgctctgtcttccaggctggagtgtggtggtgtgatcatagctcactgtaacctcagactcccgggcttaagggatccactg

SEQ ID NO: 24648 - DNA, 201 bp, Homo sapiens
agccaattgatgtgacattaacagtttgaaattggctgtgatgggagtatttacaccatggatatgggcaaacaccgatcaaaacttccttccaagagccwgttgttaaatattaccagcacatcactgttttctgcacgttagaatcattaaatttcagcctaagcaggaagtgtttagtctgtatgcctgtgtctggat

SEQ ID NO: 24649 - DNA, 201 bp, Homo sapiens
ctgaggcaggggattcgcttgaacctgggaggtggaggttgcagtgagctgagatcgtgccactgcactccagcctggtgacagagcaaaaaaaaaaaaaagaaaaagatttagttacctctacgtgtggtagaggtggaaattgaaagcagatcagtttcattagaacctattgcttatccccttccaaataaaataaac

SEQ ID NO: 24650 - DNA, 201 bp, Homo sapiens; identical to SEQ ID NO: 5507

SEQ ID NO: 24651 - DNA, 201 bp, Homo sapiens
gagattttgatttctgtaacttcctggttgtgaaagcactgtgtaaggttaagttatggtaacagagcctttgccatttctgaggccctaaataactacayttactctatgtttttatggtcattaacctccactggacctctggataacaaatttcctaatgtggtattagaagagaagggatatcaaaagcagattaaa

SEQ ID NO: 24652 - DNA, 201 bp, Homo sapiens
ctacagagtgttagatcggctgtatgcagtttattatagatattagagactaatccagtgaactggaaagtttatataatttgaatgagacagctgatgayggtgaatataaaggttttgtttagatgcaataaaaggtgaccaggcctccatggagtatgggttcattactgagaaatgcaagttacgatgctactcttg

SEQ ID NO: 24653 - DNA, 201 bp, Homo sapiens; identical to SEQ ID NO: 5510

SEQ ID NO: 24654 - DNA, 201 bp, Homo sapiens
ttgtcaatattactcagtgttgacccttacaactgggtgattgggtctcacatgacagtttaattccctccaattttaactgtggctccttctctaacttycttatcttccctttgactgtgaagcaagactatattcagctggccagaaagggatgctttcttgggcctgggagatttgcattaattgctattgataaca

SEQ ID NO: 24655 - DNA, 201 bp, Homo sapiens
ctggctaatttttgtatttttagtagacacggggttttgccatgtttgtcatgctggtctcgaacttgtgacctcaggtgatccacctgcctcagcctccrgaagtgctaggatgacaggtgtgagccactgagcccggccactggttgtagagctttatttattgcaggccatctcagtccctttaatattccagtgtgg

SEQ ID NO: 24656 - DNA, 201 bp, Homo sapiens
cagcttggctggcagcagctggagccgcatgtcccactggtggagcagctgggatatccacagaagctggtctggcagcaggtcatggtgttgggagctgstatgaagtctgggttgcttggaggagtttctgagttttggtgatggctgccacattgggccttttataagcctgggccagctactgtttacataattcca

SEQ ID NO: 24657 - DNA, 201 bp, Homo sapiens
aatttcctcatggtcaaggaataattgactgatgcctcacctttaaggattgtcaatattactcagtgttgacccttacaactgggtgattgggtctcacrtgacagtttaattccctccaattttaactgtggctccttctctaactttcttatcttccctttgactgtgaagcaagactatattcagctggccagaaag

SEQ ID NO: 24658 - DNA, 201 bp, Homo sapiens
tttagcaggtgggctcacaggagtagcagcagcagactgggcggcagcaggactgtccacagtaggatgggcggcagcaggaggcctcggcgtggtgcagytggcagcaggttgggggtgtgcagctcaccacacagcaggggggcaggcaggtaccctccacacggcagtctgggcggcaccacctgatacgggtgctca

SEQ ID NO: 24659 - DNA, 201 bp, Homo sapiens; identical to SEQ ID NO: 5511

SEQ ID NO: 24660 - DNA, 201 bp, Homo sapiens; identical to SEQ ID NO: 5512

SEQ ID NO: 24661 - DNA, 201 bp, Homo sapiens; identical to SEQ ID NO: 1591

SEQ ID NO: 24662 - DNA, 201 bp, Homo sapiens
  misc_feature (1)...(201): n = A,T,C or G, or insertion/deletion polymorphism (see Tables 1-2)
gggatcagcgctagaatgtcgccctcccttgaatggagaatggcatgagttttcctgagtttcctctgagggccccctcttctctctaggacaattaaggratgacgtctctgaggaaatggannnnnnnnnnnnnnnnnnnnaggagtgacagggtggcggggactaaggggagcgggggtgtgagggatgagaggggca

SEQ ID NO: 24663 - DNA, 201 bp, Homo sapiens
atcagtttccctacacaagatccaagaggagaggtaaggagtgagaggcagggagtccagttcagggacagggattccaggaggagaagtgaaggggaagsggctgggcgcagcctgggggtctctccctggtttccacagacagatccttgtccaggactcaggcagacagtgtgacaaagaggctggtgtaggagaaga

SEQ ID NO: 24664 - DNA, 201 bp, Homo sapiens
tcccacgatgcctgctgctgcgcttccaaggcaggaagccgagggacccatgtctgggagtggagaactttctgtgagacatcacgccatcaaatcctgcyggtagagcatatttgccacattttctttatccagtctaccattgatggacatttaggttgattccatgtctttgctattgtgaatagtgctgcaatgaac

SEQ ID NO: 24665 - DNA, 201 bp, Homo sapiens
atcccagagttttctgatttcccataacgtcagtgattaaactcctgatctgtctgactagctagacatgctgactgactgacagttccattgctactttrcataatttaagatcaacagctacatttggatctcagatcatctaggcccagctgcagttagtctttcctagtctcagagattccctctctgcctgttaat

SEQ ID NO: 24666 - DNA, 201 bp, Homo sapiens
tccgatgcactcccattccaggccggaattcccttttgggtgcccctctctctcacaagaaggagctgtttccctttgtctttcttttgcctattaaaccmtttgatcctaactcactcctcgtgtgtcagtgtccttaatcttcttggcgtgagatgacgaacacttagtatttacctgagacaatgacacctcttcagc

SEQ ID NO: 24667 - DNA, 201 bp, Homo sapiens
tctccctggtttccacagacagatccttgtccaggactcaggcagacagtgtgacaaagaggctggtgtaggagaagagggatcaggacgaagtcccaggycccggacggggctctcagggtctcaggctccgagggccgcgtctgcaatggggaggcgcagcgttggggattccccactcccacgagtttcacttcttct

SEQ ID NO: 24668 - DNA, 201 bp, Homo sapiens
tgcactcccattccaggccggaattcccttttgggtgcccctctctctcacaagaaggagctgtttccctttgtctttcttttgcctattaaaccctttgrtcctaactcactcctcgtgtgtcagtgtccttaatcttcttggcgtgagatgacgaacacttagtatttacctgagacaatgacacctcttcagcaggtg

SEQ ID NO: 24669 - DNA, 201 bp, Homo sapiens
cctcctgctgctctcgggaggcctggccctgaccgagacctgggcctgtgagtgcggggttgggagggaagcggcctctgcggagaggagcgaggggccckcccggcgagggcgcaggacccggggagccgcgcagggaggtgggtcgggcgggtctcagcccctcctcgcccccaggctcccactccatgaggtatttcg

SEQ ID NO: 24670 - DNA, 201 bp, Homo sapiens
tttagctgtttttttagtccccttgtggaatctttgatgtttcactcattgaggcctaggagaccctgacacatagtaactgcctaataaatgtttgctarataaatgtgaggttcaccatgagataccacgttatacatgcaagaatggcattaatttggctgggcgcggtggctcaagtctgtaatcccagcactttgg

SEQ ID NO: 24671 - DNA, 201 bp, Homo sapiens
gtcatggcgccccgagccctcctcctgctgctctcgggaggcctggccctgaccgagacctgggcctgtgagtgcggggttgggagggaagcggcctctgsggagaggagcgaggggcccgcccggcgagggcgcaggacccggggagccgcgcagggaggtgggtcgggcgggtctcagcccctcctcgcccccaggctc

SEQ ID NO: 24672 - DNA, 201 bp, Homo sapiens
cgagatgcgggtcatggcgccccgagccctcctcctgctgctctcgggaggcctggccctgaccgagacctgggcctgtgagtgcggggttgggagggaadcggcctctgcggagaggagcgaggggcccgcccggcgagggcgcaggacccggggagccgcgcagggaggtgggtcgggcgggtctcagcccctcctcgc

SEQ ID NO: 24673 - DNA, 201 bp, Homo sapiens
ccacgtcaggacctcttggagctggaattatgttccttggaggcatccatatttgaggaaagaggagaccgaacagtctccgtctcctcctcctcctccttctcctcctccgtcgccgcctcctcctcctcctccctactgcggggttggggattctggcccaggctcctgaggctctcccatgggtgggtggggagggag

SEQ ID NO: 24674 - DNA, 201 bp, Homo sapiens
gaaatggataaattcctggaaacaaacaacctgccaagattacattaggaagaatagaaaacctgaagccctaacatacatgaaccattctcacagtggtyccagtgggcccctgacctctctgtgattatttcctcagtgcttgtttgcataattgaaatagacctactcagcaacagccaaaatccacagatcagttcc

SEQ ID NO: 24675 - DNA, 201 bp, Homo sapiens
ctgagaaatcctttgttcaagtgctcattttctttgtgacttcgagctttatttctaacagactcaaacaaaatcagaaaagaaaagagaaacattacaastgatattgcaaaagtacaaaagaccatcagagactattatgaacaattgtgtactgacaaactggaaaacctggaggaaatggataaattcctggaaaca

SEQ ID NO: 24676 - DNA, 201 bp, Homo sapiens
atttgccacattttctttatccagtctaccattgatggacatttaggttgattccatgtctttgctattgtgaatagtgctgcaatgaacatatgcatacrtgtaagacatgggctttctttttttaatttgctttgttttattttactttaggttccaggatacatgtgcagaacctgcaggtttgttacatacgtatag

SEQ ID NO: 24677 - DNA, 201 bp, Homo sapiens
tgggagatctccaggatccttcctggactccaagatacccagagaagccggatcctgtgtcccggaacccccttcctgttcctctgtgggccctgaccttrgggagaactgggctggtgagaagatcaggatgaactgggctggggaggcaagagggaaagggcggcttggagggcttagtagctcctctcgcggcgcctc

SEQ ID NO: 24678 - DNA, 201 bp, Homo sapiens
agagacggaaaagtgggaatgtatccattatgtgcaacctacttaacatctcctaaccacatctcccgggagggctgagaggatgccccccttaccaaggyattaaggtgccacatgacacatacaggtataaaaactgctaggtctgctgagcagtcaccaatcttgagtcctggatattcagaaattcttatccagtag

SEQ ID NO: 24679 - DNA, 201 bp, Homo sapiens
cagctcagagagacggaaaagtgggaatgtatccattatgtgcaacctacttaacatctcctaaccacatctcccgggagggctgagaggatgcccccctyaccaaggcattaaggtgccacatgacacatacaggtataaaaactgctaggtctgctgagcagtcaccaatcttgagtcctggatattcagaaattctta

SEQ ID NO: 24680 - DNA, 201 bp, Homo sapiens
ccagattttgctatatgcaacagtttgtgaaaaccactagcctatatcaacagaatccctatcacaggcatactgcagaggaaagtgtctgaacacagctsagagagacggaaaagtgggaatgtatccattatgtgcaacctacttaacatctcctaaccacatctcccgggagggctgagaggatgccccccttaccaa

SEQ ID NO: 24681 - DNA, 201 bp, Homo sapiens
gaggttgcagtgagccaaggtaatgccactgcactccatcctgggcaacagaacaagaccctgtctcaaataaataagtaagtaaataaataaataaataaccagctgtaaccatgtgagcacttacagaaataaagacagtaaatgttatcagcattacttctttatgtttttataatgatatttatgtctgtgtgtatg

SEQ ID NO: 24682 - DNA, 201 bp, Homo sapiens
gtggctggccgggcgggggctgaccccattaattgcacaagggatgctatgagggaatagctgagcaactaggacccaccaatcagatgacttgggaaaayagaacagcactagacatgatactagcagaaaaaggcaaggtttgtgttatgattggaactcaatgttgtacttttatccttaataatactgcccctgatc

SEQ ID NO: 24683 - DNA, 201 bp, Homo sapiens
ggaggttgcagtgagccaaggtaatgccactgcactccatcctgggcaacagaacaagaccctgtctcaaataaataagtaagtaaataaataaataaataaccagctgtaaccatgtgagcacttacagaaataaagacagtaaatgttatcagcattacttctttatgtttttataatgatatttatgtctgtgtgtat

SEQ ID NO: 24684 - DNA, 201 bp, Homo sapiens
aaggagctggggtgggcggggcgacctccctcccctccctggccccgcctccggctcaccctggggcaggtccagggcaccgcacctgcagatgctgctgyctggctgggtggtggctccggacaggagcttcctcgaaggacactttaagtccgcctacgacaaggagatttcatgtccctgaacgaggacctgcagacc

SEQ ID NO: 24685 - DNA, 201 bp, Homo sapiens
ggccgggcggaggcgcccccaacctccctcccggacggggcggctggccgggcgggggctgcccccccacctccctcccggatgggctggctggccgggcrggggctgaccccccacctccctccctgacggagtggctggccgggcgggggctgaccccattaattgcacaagggatgctatgagggaatagctgagcaa

SEQ ID NO: 24686 - DNA, 201 bp, Homo sapiens
ctcaaagcagtggttctcaatatttggtatgtatcaaaatcatctgggaattgtagcaaaactacacaggcccagatattattctaatttaacaggctagrgccttgagtttattaaaacaaatcatctctccagattttgctatatgcaacagtttgtgaaaaccactagcctatatcaacagaatccctatcacaggca

SEQ ID NO: 24687 - DNA, 201 bp, Homo sapiens
tcaaactttaaagagtcatctaaccaaattaattttagaaactcgcctaccatggacaaaatctcttcccattgctttactaagaatccacaaacttctcytcggagggatcttggcttgtctccttatgaaatgctttatgggttaccttatctaaacactactactgaccttcctatgatcgaaacaaaagatcagttc

SEQ ID NO: 24688 - DNA, 201 bp, Homo sapiens; identical to SEQ ID NO: 1592

SEQ ID NO: 24689 - DNA, 201 bp, Homo sapiens
gaatgaatcaaactttaaagagtcatctaaccaaattaattttagaaactcgcctaccatggacaaaatctcttcccattgctttactaagaatccacaaacttctcctcggagggatcttggcttgtctccttatgaaatgctttatgggttaccttatctaaacactactactgaccttcctatgatcgaaacaaaaga

SEQ ID NO: 24690 - DNA, 201 bp, Homo sapiens; identical to SEQ ID NO: 12628

SEQ ID NO: 24691 - DNA, 201 bp, Homo sapiens
gtgtatgtgtgtgtgttactctgtgacttcctcatacttggcaccaccctggccttttcctggttgccccccacaccataggttgtaggggacagaacagygctccacctgcaggcatagaacgggggtcaggataagtgttggggagagctggtttcatcacacctggaataaggaaacaggacctaaatggatgggtcc

SEQ ID NO: 24692 - DNA, 201 bp, Homo sapiens; identical to SEQ ID NO: 12631

SEQ ID NO: 24693 - DNA, 201 bp, Homo sapiens
tgggtggggtggcgggtctgggggtgggtggggcagtggggaaaggcctgggtaatggagattctttgattgggatgtttcgcgtgtgtggtgggctgttyagagtgtcatcacttaccatgactaaccagaatttgttcatgactgttgttttctgtagcctgagacagctgtcttgtgagggactgagatgcaggattt

SEQ ID NO: 24694 - DNA, 201 bp, Homo sapiens
attgaataaatacatcatatattaaattaacccttctctcgtttatggtcatttcatttgttgtcagattttttaaaattacaagcaatgctgttacaagycttctagcactagtctgttggcacaatgggcacatatctgtcaaaattatacacctaggagtggagttactggtatatgtgtatgatatcccactcaaag

SEQ ID NO: 24695 - DNA, 201 bp, Homo sapiens
gggacccatgtctgggagtggagaactttctgtgagacatcacgccatcaaatcctgccggtagagcatatttgccacattttctttatccagtctaccaytgatggacatttaggttgattccatgtctttgctattgtgaatagtgctgcaatgaacatatgcatacatgtaagacatgggctttctttttttaatttg

SEQ ID NO: 24696 - DNA, 201 bp, Homo sapiens
ttctccccagaggccgagatgcgggtcatggcgccccgagccctcctcctgctgctctcgggaggcctggccctgaccgagacctgggcctgtgagtgcgrggttgggagggaagcggcctctgcggagaggagcgaggggcccgcccggcgagggcgcaggacccggggagccgcgcagggaggtgggtcgggcgggtct

SEQ ID NO: 24697 - DNA, 201 bp, Homo sapiens
ctgccatagcctaagtgtatgcttcatcctgaaggacattacccatcctgataggatgtgatcttcaagataaaacccagctgcaccctcaagagaccatyccactgctctatcagctggcagcgtgtgtgatgcagtatggggtagaaccaggagatctcatggtcgtgtgcccactaccagacagcgttcgctataaag

SEQ ID NO: 24698 - DNA, 201 bp, Homo sapiens
catgcagttatttctcaaagagcttgtactccttagatttgctggaattcctcaagttaaaaagaccagggcctcaataatgggaggtctcattgccaatrgctacaaccggctgtagaatttattaaaaacatgtgagtgcattgtttggggaaagaatcaagaacaaaagcagtgcttgttttgtacttcactgaacta

SEQ ID NO: 24699 - DNA, 201 bp, Homo sapiens
tcagcgtctccgcagtcccggttctaaagtccccagtcacccacccggactcacattctccccagaggccgagatgcgggtcatggcgccccgagccctcmtcctgctgctctcgggaggcctggccctgaccgagacctgggcctgtgagtgcggggttgggagggaagcggcctctgcggagaggagcgaggggcccgc

SEQ ID NO: 24700 - DNA, 201 bp, Homo sapiens
cccacgcgggttaccggaagtgctggtgagtatagtcattccttcttccagcactggtggttagagacttacttactctacctgttggagacttggcactrtgtaacagctgctgccatagcctaagtgtatgcttcatcctgaaggacattacccatcctgataggatgtgatcttcaagataaaacccagctgcaccct

SEQ ID NO: 24701 - DNA, 201 bp, Homo sapiens
agccaatcagcgtctccgcagtcccggttctaaagtccccagtcacccacccggactcacattctccccagaggccgagatgcgggtcatggcgccccgarccctcctcctgctgctctcgggaggcctggccctgaccgagacctgggcctgtgagtgcggggttgggagggaagcggcctctgcggagaggagcgaggg

SEQ ID NO: 24702 - DNA, 201 bp, Homo sapiens
aaaactcatgtccatgagcaactgcaggggtgactggagtgttgttgtcctcttccagggagggaggtggtgtctgtctcctctcaacattttacatgttrtaaaccaaaaataaacatcaaagccaccccttcccaatcattttaatggacaccctcagccagggtgctcaaaagttaacctgaaagactggctcaggcc

SEQ ID NO: 24703 - DNA, 201 bp, Homo sapiens
gggagggaggtggtgtctgtctcctctcaacattttacatgttgtaaaccaaaaataaacatcaaagccaccccttcccaatcattttaatggacaccctyagccagggtgctcaaaagttaacctgaaagactggctcaggccaccaagggaagcaggtattgaacatgtcttattatgccctcttccctcttggaattc

SEQ ID NO: 24704 - DNA, 201 bp, Homo sapiens
ggggatgggaagcaccaacaccccacgcgggttaccggaagtgctggtgagtatagtcattccttcttccagcactggtggttagagacttacttactctrcctgttggagacttggcactatgtaacagctgctgccatagcctaagtgtatgcttcatcctgaaggacattacccatcctgataggatgtgatcttcaa

SEQ ID NO: 24705 - DNA, 201 bp, Homo sapiens
tcccagagttttctgatttcccataacgtcagtgattaaactcctgatctgtctgactagctagacatgctgactgactgacagttccattgctactttgyataatttaagatcaacagctacatttggatctcagatcatctaggcccagctgcagttagtctttcctagtctcagagattccctctctgcctgttaatt

SEQ ID NO: 24706 - DNA, 201 bp, Homo sapiens
tggaggttgcagtgagccaaggtaatgccactgcactccatcctgggcaacagaacaagaccctgtctcaaataaataagtaagtaaataaataaataaataaccagctgtaaccatgtgagcacttacagaaataaagacagtaaatgttatcagcattacttctttatgtttttataatgatatttatgtctgtgtgta

SEQ ID NO: 24707 - DNA, 201 bp, Homo sapiens
gtggaggttgcagtgagccaaggtaatgccactgcactccatcctgggcaacagaacaagaccctgtctcaaataaataagtaagtaaataaataaataaataaccagctgtaaccatgtgagcacttacagaaataaagacagtaaatgttatcagcattacttctttatgtttttataatgatatttatgtctgtgtgt

SEQ ID NO: 24708 - DNA, 201 bp, Homo sapiens
gtgcttgtagtcccagctacttaggaggttgaggtagaaggatcacttgtgcccaggaggtggaggttgcagtgagccaaggtaatgccactgcactccakcctgggcaacagaacaagaccctgtctcaaataaataagtaagtaaataaataaataaataaccagctgtaaccatgtgagcacttacagaaataaagac

SEQ ID NO: 24709 - DNA, 201 bp, Homo sapiens
gcaaaatgctgaaactccatctctactgaaaataaatacaaaaaattagtcagacttggtggtgtgcttgtagtcccagctacttaggaggttgaggtagraggatcacttgtgcccaggaggtggaggttgcagtgagccaaggtaatgccactgcactccatcctgggcaacagaacaagaccctgtctcaaataaata

SEQ ID NO: 24710 - DNA, 201 bp, Homo sapiens
caggaaaagaaacctgatcagctgagggacttgctgaaagcaatgggaatatgggatggttagtgaaaaacaacaaaaaaaaagtatttataaatactagytgtggccagcacagtggctcatgcctgtaatcccagcactttgggaggctgaggcaggtggattgcttaagtctaggaatgtgagaccaacctgagcaaa

SEQ ID NO: 24711 - DNA, 201 bp, Homo sapiens
ttatctgggaggtgtgcttcaatccaactagcagtgactcctggactgatggcttcttcaggaacactgagagaatgtaaaatacaggaatcctgataatmctgcattctttgagcatccattataatcaagctgatgtttttatccatcatcattgtgtatagttcctttgctgtgattgctcctttctctttggtctca

SEQ ID NO: 24712 - DNA, 201 bp, Homo sapiens
gtttacattcccaacaacagtgtaaaagtgttcctatttctccacagcctcaccagcatctattgtttcttgactttttaataattaccattctgactggygggagatggtatctcattgtggctttgatttacatttctctaatgagcagtgatattgagcttttttaatttttctcattaagattttaatgtctcattt

SEQ ID NO: 24713 - DNA, 201 bp, Homo sapiens
atcatttaaacctcacaagagccctatgacctagagacagctatcagccccattttacagacaaggaaactgaggtcactaggaagtttagtaactgtcartgggctgactcatgactctaaggagacagtctgactgctgagcccaagtaactgctctgtcatactcaccctcacacccacctactactggctccctgtg

SEQ ID NO: 24714 - DNA, 201 bp, Homo sapiens
aaaattatacacctaggagtggagttactggtatatgtgtatgatatcccactcaaagagatgatgccacactgctagataaagtggctgtggcaagcaaygtgtggtagatcttgatggtctgtattctcatcagtgtttggaaaactcaataattttaatatagaaattctagtgcatttttcaaaatatctcattatg

SEQ ID NO: 24715 - DNA, 201 bp, Homo sapiens
aatgcataggtatcagtagtgactacttaagcatgtgtaacttagaggtaataaaaacaaaaatgttaggtaatatctatctattccagattaaaatctayatcaataaattcaaacttctaggaaaaatatctgcatatgtaatatatgactgtgactccgatagacgaacgtgggaatatagtatgaagatacttctca

SEQ ID NO: 24716 - DNA, 201 bp, Homo sapiens
gccagcatttcccaagaggaggtctcttgctgacatcaacttccaacagggtaaattttcatgggaacccaaagagaagaggaagacctcaagaaaaaggrcctaaagaaatgacaagaatgataacattttacacttttattgtgctatgtgtcaaatagtggtcttcgcactttaaaaatgccaattcattttattctg

SEQ ID NO: 24717 - DNA, 201 bp, Homo sapiens
tgatggtctggacccacgattccaggagagaaagacaaggattatgtcactcagggaaaatatccaaagtctctggtttaaacttaagcatctccagctcyaggacaggtggctggtgggaagacaaactaagccaaagccacagctctgaagatttccctctcctgagaattctgcaggggtttccctgacctcatggcc

SEQ ID NO: 24718 - DNA, 201 bp, Homo sapiens
aggagatttcatgtccctgaacgaggacctgcagacctggacagcggctcaaagagcggcttggaggatccatcacacctgggagaggttctggaccgcgkaggccacaagggaagccccgatgggtcactgcactaggtggctgctcagacacctggagcatggcaaggagatgatgctgccggcaggtactggggtcct

SEQ ID NO: 24719 - DNA, 201 bp, Homo sapiens
ccttcttgttcaccttggatcctggcctgtcgacttcccgcacgatgtgggtcatgccagccttgtatcccaggaaggctgtgaggtggaccggcttggaygggtcatccttagggaagctcttcaccttcccacgatgcctgctgctgcgcttccaaggcaggaagccgagggacccatgtctgggagtggagaactttc

SEQ ID NO: 24720 - DNA, 201 bp, Homo sapiens
gttgaggggatgggaagcaccaacaccccacgcgggttaccggaagtgctggtgagtatagtcattccttcttccagcactggtggttagagacttacttmctctacctgttggagacttggcactatgtaacagctgctgccatagcctaagtgtatgcttcatcctgaaggacattacccatcctgataggatgtgatc

SEQ ID NO: 24721 - DNA, 201 bp, Homo sapiens
gttgattcgtaatttaaaatttattttgaatagctaatacaagaacaatatttaaaagattataataataaaaatgtgtatagtgtgcaaagcaaatttcsttctccaccccatccacaattcttccaaattccttgcctggatgcaaccactgttaccagtttcagcaagaaattaagacagaaattaaagttctgctcc

SEQ ID NO: 24722 - DNA, 201 bp, Homo sapiens
agaaccaggctggaaactacacatccaagaacagaattcacagcccaccctggatcaggtccctcctaggaacaactgcctctgctgctgagcacagacascactgctcacacctctgacaccctggtcctggacactggaccctgaggctaggacagatgtcactgctgcatctggaaattggacatcactactgtcact

SEQ ID NO: 24723 - DNA, 201 bp, Homo sapiens
acctgtcccccaaaaactattgaaataaaaaaattttttagataaatgtggggttgattcgtaatttaaaatttattttgaatagctaatacaagaacaakatttaaaagattataataataaaaatgtgtatagtgtgcaaagcaaatttcgttctccaccccatccacaattcttccaaattccttgcctggatgcaac

SEQ ID NO: 24724 - DNA, 201 bp, Homo sapiens
ctagttttattgtggggaaggccacagaaccaggctggaaactacacatccaagaacagaattcacagcccaccctggatcaggtccctcctaggaacaamtgcctctgctgctgagcacagacagcactgctcacacctctgacaccctggtcctggacactggaccctgaggctaggacagatgtcactgctgcatctg

SEQ ID NO: 24725 - DNA, 201 bp, Homo sapiens
actactaaagaactcacacacataaccaaaaactacctgtcccccaaaaactattgaaataaaaaaattttttagataaatgtggggttgattcgtaattyaaaatttattttgaatagctaatacaagaacaatatttaaaagattataataataaaaatgtgtatagtgtgcaaagcaaatttcgttctccaccccatc

SEQ ID NO: 24726 - DNA, 201 bp, Homo sapiens
aaggtgagattctggggagctgaagtggtcgggggtggggcagagggaaaaggcctgggtaatggggattctttgattgggacgtttcgagtgtgtggtgrgctgttcagagtgtcatcacttaccatgactgacctgaatttgttcatgactattgtgttctgtagcctgagacagctgcctgtgtgggactgagatgca

SEQ ID NO: 24727 - DNA, 201 bp, Homo sapiens
cctcccagagtgctgggattacaggcgtgagccaccgcgcctggccgaaaaagacattttaagactgaaaagtggtatcaccaatgttagaaccaaaaaaytggacctgagggtgcatcacccgagggggttaagttaaactctgtccctgttccttctagagccccgtggagattcctgctgtgcagcaaagcctgggag

SEQ ID NO: 24728 - DNA, 201 bp, Homo sapiens
actcccattgggtgtcgggttctagagaagccaatcagcgtctccgcagtcccggttctaaagtccccagtcacccacccggactcacattctccccagasgccgagatgcgggtcatggcgccccgagccctcctcctgctgctctcgggaggcctggccctgaccgagacctgggcctgtgagtgcggggttgggaggg

SEQ ID NO: 24729 - DNA, 201 bp, Homo sapiens
atcacttgtaaaggtgagattctggggagctgaagtggtcgggggtggggcagagggaaaaggcctgggtaatggggattctttgattgggacgtttcgartgtgtggtgggctgttcagagtgtcatcacttaccatgactgacctgaatttgttcatgactattgtgttctgtagcctgagacagctgcctgtgtggga

SEQ ID NO: 24730 - DNA, 201 bp, Homo sapiens
gtccccaattcccactcccattgggtgtcgggttctagagaagccaatcagcgtctccgcagtcccggttctaaagtccccagtcacccacccggactcasattctccccagaggccgagatgcgggtcatggcgccccgagccctcctcctgctgctctcgggaggcctggccctgaccgagacctgggcctgtgagtgc

SEQ ID NO: 24731 - DNA, 201 bp, Homo sapiens
ggtcatgccagccttgtatcccaggaaggctgtgaggtggaccggcttggacgggtcatccttagggaagctcttcaccttcccacgatgcctgctgctgygcttccaaggcaggaagccgagggacccatgtctgggagtggagaactttctgtgagacatcacgccatcaaatcctgccggtagagcatatttgccaca

SEQ ID NO: 24732 - DNA, 201 bp, Homo sapiens
gaatggggggtcacatctcttatcagagaaagcagaagtccttctggagcccttcagccgggtcagggctgaggcttgggggtcagggcccctcaccttcycctcctttcccagagccatcttcccagcccaccatccccatcatgggcatcgttgctggcctggctgtcctggctgtcctagctgtcctaggagctgtga

SEQ ID NO: 24733 - DNA, 201 bp, Homo sapiens
gggctgccagagcccctcaccctgagctggggtaaggaggggaatggggggtcacatctcttatcagagaaagcagaagtccttctggagcccttcagccrggtcagggctgaggcttgggggtcagggcccctcaccttctcctcctttcccagagccatcttcccagcccaccatccccatcatgggcatcgttgctgg

SEQ ID NO: 24734 - DNA, 201 bp, Homo sapiens
aagtgaaggggaaggggctgggcgcagccttggggtctctccctggtttccacagacagatccttgtccaggactcaggcacacagtgtgacaaagatgcwtggtgtaggagaagagggatcaggacgaagtcccaggtcccgggcggggctctcagggtctcaggctccaagggccgtgtctgcattggggaggcgccgc

SEQ ID NO: 24735 - DNA, 201 bp, Homo sapiens; identical to SEQ ID NO: 5695

SEQ ID NO: 24736 - DNA, 201 bp, Homo sapiens
gcgaagacagtcttgcaagtccggaagccttgaggggtttccacgcagcccacaatgcccactggtggcctctccacaatggtcacagcctccaccacctscttcttgttcaccttggatcctggcctgtcgacttcccgcacgatgtgggtcatgccagccttgtatcccaggaaggctgtgaggtggaccggcttggac

SEQ ID NO: 24737 - DNA, 201 bp, Homo sapiens
agttgcatctgggtgtgggcaatgacgcagatgacttggcagtacttcttcatgctgctgaagtccttctccagctgcttcttgccatcctcatcctgccrtttcttgcagtacttggtaaaggccttcttcttagatttatgccagttcttatagaaacgtctcttgcattcatcactgatgtgctcagcgaagacagtc

SEQ ID NO: 24738 - DNA, 201 bp, Homo sapiens
tggtagcctttctgcccaccacgtaccacagagaagcccacacgagcaggatgccatgccccaatacaggccaccttgcacaggccttggtgggtcttgcrgggcagcttcttggtgtgccaacgactggtgacccttttgtagcctttgcccttggtcaccctgatgacgtcgatcatctcatcctgcccaaacacttgg

SEQ ID NO: 24739 - DNA, 201 bp, Homo sapiens
ccacatttggtgggggattttagctcatatctaaggtgttcaataaatgaaagcaaaataactgcagagaaaattacaaatagggtgaccaaggccttggyctggcctgaggcaacttagctagccccagggatgtgtgttctggtgtggagtaagatcagggagctaccagtgcaatctctgcctctacatcagcgggac

SEQ ID NO: 24740 - DNA, 201 bp, Homo sapiens
ggcatataggtttttatgtgaactcatgttttcatttctcttgggtatactgtatcataggaggggattgctgggtcatgtaataacttaatgttcacaaatttgagctactgctagcctgctttctaaaggggctatgtctcttaaatccccaccagcaaagtgtgagtattctagtatctccacattctcatcaacact

SEQ ID NO: 24741 - DNA, 201 bp, Homo sapiens
acatggcatataggtttttatgtgaactcatgttttcatttctcttgggtatactgtatcataggaggggattgctgggtcatgtaataacttaatgttcacaaatttgagctactgctagcctgctttctaaaggggctatgtctcttaaatccccaccagcaaagtgtgagtattctagtatctccacattctcatcaa

SEQ ID NO: 24742 - DNA, 201 bp, Homo sapiens
ttgtttagtttttattttgttttgttttgtttttttcaaaaaaccatcatgagatttgttaatcttttgaatggtttttgtgtctcaatttccttcagaayttaactcttcttaacatttcacagtccactttcagttaaaaatgtactagtacccataaatagagaaatcttgcaaccatttatcctctataaaatgtcc

SEQ ID NO: 24743 - DNA, 201 bp, Homo sapiens
gccacctgttccagggacaccatatttagggataactcctctttctgggcaggactgttctttgattacttttgtattcacaatagttctgaaatcgtagratgatgagactcaagactggctagggttttatttttgtttagtttttattttgttttgttttgtttttttcaaaaaaccatcatgagatttgttaatctt

SEQ ID NO: 24744 - DNA, 201 bp, Homo sapiens
cccgggaggcggagcttgcagtgctcctgctcccaggaggcagatgcccaggatgagctttaaggtggagagaggaatgtcattgctcatcctccaggttycaagtaagaaccttcctgcccagcccatctcgatctccctgaatcctcaacgctaatgaggactgtctccttctcacctccctagactgggctttttaac

SEQ ID NO: 24745 - DNA, 201 bp, Homo sapiens
acacataaatgccctcctttctcccactacattctcagtgtggatgtttgcttttactgccccaggtgagtggaccccagttcagtttggtaacacacctrccaccagctgaacaaagcccattccagggtgaggatctgttcctgccaagacccatttgctgcttcctggggctactggtatcagtctaacttgccagct

SEQ ID NO: 24746 - DNA, 201 bp, Homo sapiens
acccatcctgataggatgtgatcttcaagataaaacccagctgcaccctcaagagaccattccactgctctatcagctggcagcgtgtgtgatgcagtatrgggtagaaccaggagatctcatggtcgtgtgcccactaccagacagcgttcgctataaagtaggtcccttagtctggggcaatgttatgtggttccccta

SEQ ID NO: 24747 - DNA, 201 bp, Homo sapiens
atcacgccatcaaatcctgccggtagagcatatttgccacattttctttatccagtctaccattgatggacatttaggttgattccatgtctttgctattrtgaatagtgctgcaatgaacatatgcatacatgtaagacatgggctttctttttttaatttgctttgttttattttactttaggttccaggatacatgtg

SEQ ID NO: 24748 - DNA, 201 bp, Homo sapiens
cccctgcctttaaaaattcttgcttgtgagccatcaaaaagttgggtcttaagcgtgagctgcccaattctccttgtttggtgccctacacataaatgccytcctttctcccactacattctcagtgtggatgtttgcttttactgccccaggtgagtggaccccagttcagtttggtaacacacctaccaccagctgaac

SEQ ID NO: 24749 - DNA, 201 bp, Homo sapiens
tataaagtaggtcccttagtctggggcaatgttatgtggttcccctattagaagatcatacatatgtgagcccttagataacgtttctgagtgtggcactrtgggaagaaagaacaaactcataccgctaatacaaggcaagctaaatctgacagaacccctgcctttttcattgtgaaaaagtaagagtagaatcaattt

SEQ ID NO: 24750 - DNA, 201 bp, Homo sapiens
taggccccatcggttctcagctggatgagatgccaagagacaggatcaccgggcatcatcttagggtctctatacacaggctggaccatgactgaacaagrtcattacaaacccgggtcctggactgggccagatgatctgcagagctgagctgtgtttatgaaatcgaatccctggaaacaaaaatcaagagacgcccac

SEQ ID NO: 24751 - DNA, 201 bp, Homo sapiens
atacacaggctggaccatgactgaacaagatcattacaaacccgggtcctggactgggccagatgatctgcagagctgagctgtgtttatgaaatcgaatycctggaaacaaaaatcaagagacgcccactggaaaggctggtcttgcattctgtgtgaaagctaagatggcgttctctccaaatgtttttctctattact

SEQ ID NO: 24752 - DNA, 201 bp, Homo sapiens; identical to SEQ ID NO: 1564

SEQ ID NO: 24753 - DNA, 201 bp, Homo sapiens
agagctgagctgtgtttatgaaatcgaatccctggaaacaaaaatcaagagacgcccactggaaaggctggtcttgcattctgtgtgaaagctaagatggygttctctccaaatgtttttctctattacttttcaaacctcctgcatctgtaaagaagcaacaccactaaacctatctggtttttttttcattcgagtgtc

SEQ ID NO: 24754 - DNA, 201 bp, Homo sapiens
atgtttttctctattacttttcaaacctcctgcatctgtaaagaagcaacaccactaaacctatctggtttttttttcattcgagtgtcatactgttaggyaaatcttctgctttcactatttcttcaagcttgttttcatgcagaatcccacgaacttctggtaattacactttattgatttcttttccttcactcagtt

SEQ ID NO: 24755 - DNA, 201 bp, Homo sapiens; identical to SEQ ID NO: 5517

SEQ ID NO: 24756 - DNA, 201 bp, Homo sapiens
cactaaacctatctggtttttttttcattcgagtgtcatactgttaggcaaatcttctgctttcactatttcttcaagcttgttttcatgcagaatcccaygaacttctggtaattacactttattgatttcttttccttcactcagtttattttttagtgattttatttctcttgtatggataaattagtccatttaatt

SEQ ID NO: 24757 - DNA, 201 bp, Homo sapiens
agctgtggtggtgccttctggagaagagcagagatacacgtgccatatgcagcacgaggggctgccagagcccctcaccctgagctggggtaaggaggggratggggggtcacatctcttatcagagaaagcagaagtccttctggagcccttcagccgggtcagggctgaggcttgggggtcagggcccctcaccttctc

SEQ ID NO: 24758 - DNA, 201 bp, Homo sapiens; identical to SEQ ID NO: 5519

SEQ ID NO: 24759 - DNA, 201 bp, Homo sapiens
ttgcaatatctgttcccagcattaagctccttcttcctttgcaattcggtctttcttgagtggtcccatgaatgctttcttctcctccatggtctggaagyggccatggccaaacttggagggggtgtcaatgaacttaaggtcaatcttctccagagcccgctgctttgtctgcaccagcaaggacttgcggagggtgag

SEQ ID NO: 24760 - DNA, 201 bp, Homo sapiens; identical to SEQ ID NO: 5521

SEQ ID NO: 24761 - DNA, 201 bp, Homo sapiens
atggcggtgggcgtgtggaggagctcacccaccccataattcctcttgtcccacatctcctgcgggctctgaccaggtctttttttttgttctaccccagscagcaacagtgcccagggctctgatgagtctctcatcacttgtaaaggtgagattctggggagctgaagtggtcgggggtggggcagagggaaaaggcct

SEQ ID NO: 24762 - DNA, 201 bp, Homo sapiens
gggctctcagggtctcaggctccaagggccgtgtctgcattggggaggcgccgcgttggggattctccactcccctgagtttcacttctcccaacctgcgwcgggtccttcttcctgaatactcatgacgcgtccccaattcccactcccattgggtgtcgggttctagagaagccaatcagcgtctccgcagtcccggtt

SEQ ID NO: 24763 - DNA, 201 bp, Homo sapiens
ggatcctcaaaagaagacacaggatcagaaaaaaatatttgagaaaataatagttgaaagtttcccacatttggtgggggattttagctcatatctaaggygttcaataaatgaaagcaaaataactgcagagaaaattacaaatagggtgaccaaggccttggcctggcctgaggcaacttagctagccccagggatgtg

SEQ ID NO: 24764 - DNA, 201 bp, Homo sapiens
tctgcctgaagggattaccagtgacttgaaagtgtaaccaacaacaatcttgtcactattacgcaccagctaagcaatctgaacatacatgctgaagacayatttggtgagctatttaaggaggctaactacttccacattagatcaaattctcttagaatttgttgcctcatggtcaaagtcactcagctggattcagca

SEQ ID NO: 24765 - DNA, 201 bp, Homo sapiens
atttgccatcaaattgctcattggcctccataagcaaaggtaatctgttggagtttatttatcgttggaaggtaggttgtgacaataaccacgtcagccaygctgaagggagcccaagccttgggacccacccacagtgcatctcttccaccatagatactgctttcaagagcctgtttcatgagcactgggatggttaag

SEQ ID NO: 24766 - DNA, 201 bp, Homo sapiens
agtgtaaccaacaacaatcttgtcactattacgcaccagctaagcaatctgaacatacatgctgaagacatatttggtgagctatttaaggaggctaactrcttccacattagatcaaattctcttagaatttgttgcctcatggtcaaagtcactcagctggattcagcagtggaagaggtgtcaccacaggacatcaac

SEQ ID NO: 24767 - DNA, 201 bp, Homo sapiens
tctagcatcttctctgcagaggagaagccaggcactatatctcccaggatccccttccctgtatagttccagtttacattttccagtgagagagacttgcmtaagaaatggggccctggagagatggtgggacagacctgtacccatcagtggtggctgcaggtagaggagcaggcagatgtcaggttctcagtggcttcc

SEQ ID NO: 24768 - DNA, 201 bp, Homo sapiens
ccataagcaaaggtaatctgttggagtttatttatcgttggaaggtaggttgtgacaataaccacgtcagccatgctgaagggagcccaagccttgggacycacccacagtgcatctcttccaccatagatactgctttcaagagcctgtttcatgagcactgggatggttaaggacagaggctggctgatgtgtaccaaa

SEQ ID NO: 24769 - DNA, 201 bp, Homo sapiens
taattttcttgaatacaagtaaacattatttataaacttttaaatttctctgtttaatttttctctctctttttttttttaatgtagaggcctactttgckggcatctttgggtcctactcagtcataaaccaccctccccaccctagagtagccactcttgatttctaatacagatgagttctgccaggtctagttgaat

SEQ ID NO: 24770 - DNA, 201 bp, Homo sapiens
gaagtcttcagtatatgcttccctgacctccctactgcagcttccaggagctccaatggtgactggtattattatagtatcctgctgctgctataacaaaytaccacaactatgtggcttaaaacaacaccaatgtattctcttatagttctggaggtaagaagtcaaaaatgtgtcactatgggctaaaattaacatgtc

SEQ ID NO: 24771 - DNA, 201 bp, Homo sapiens
gatcagttccttcccattcttagccatccctgtgctttacaaaacttagcttcacaattatactcatctctctctgtgtgcacctctaagaaattactgayaaaacacttgagttttttgaaattacaaaaatatatacaagaaaatgtttatggggccattgattagcatggaaaagcataaactttcctgttttctgcc

SEQ ID NO: 24772 - DNA, 201 bp, Homo sapiens
gcttccaggagctccaatggtgactggtattattatagtatcctgctgctgctataacaaattaccacaactatgtggcttaaaacaacaccaatgtattmtcttatagttctggaggtaagaagtcaaaaatgtgtcactatgggctaaaattaacatgtcgtcagagctgcatttcttctgaggctctaaaggaaaatc

SEQ ID NO: 24773 - DNA, 201 bp, Homo sapiens
ccagaagtgggcagctgtggtggtgccttctggagaagagcagagatacacgtgccatatgcagcacgaggggctgccagagcccctcaccctgagctggrgtaaggaggggaatggggggtcacatctcttatcagagaaagcagaagtccttctggagcccttcagccgggtcagggctgaggcttgggggtcagggcc

SEQ ID NO: 24774 - DNA, 201 bp, Homo sapiens; identical to SEQ ID NO: 1593

SEQ ID NO: 24775 - DNA, 201 bp, Homo sapiens
atagtatcctgctgctgctataacaaattaccacaactatgtggcttaaaacaacaccaatgtattctcttatagttctggaggtaagaagtcaaaaatgkgtcactatgggctaaaattaacatgtcgtcagagctgcatttcttctgaggctctaaaggaaaatctgtttcctcaccctttccagcttcttggggctgc

SEQ ID NO: 24776 - DNA, 201 bp, Homo sapiens
ttaccacaactatgtggcttaaaacaacaccaatgtattctcttatagttctggaggtaagaagtcaaaaatgtgtcactatgggctaaaattaacatgtygtcagagctgcatttcttctgaggctctaaaggaaaatctgtttcctcaccctttccagcttcttggggctgcctgcattctttggcttgtggtctcttc

SEQ ID NO: 24777 - DNA, 201 bp, Homo sapiens
aaaattttctgtctgttgtctcaaagtctccaaattgtactgattcttcaacgtgcatggctgtaaattaggcaataatcttgctggggtgttggaaggaraagaaagggaatgattagacagcccttctgattcgggacagaatctgattcgggacactgtccctgatggctggccatcttgggctgtaatccagtttcc

SEQ ID NO: 24778 - DNA, 201 bp, Homo sapiens
catcttgggctgtaatccagtttccctcccacgtagacccggtcatttctgactccccaagaggttttcacagtattcatgtccacttccttcatcagtcrtcttcttgtcttatatctccatgtttacatttttcttctcttctaccactgtagttctgccttgattcttcagccattgccttccttttgcatgcatgtg

SEQ ID NO: 24779 - DNA, 201 bp, Homo sapiens
gggaagctcttcaccttcccacgatgcctgctgctgcgcttccaaggcaggaagccgagggacccatgtctgggagtggagaactttctgtgagacatcaygccatcaaatcctgccggtagagcatatttgccacattttctttatccagtctaccattgatggacatttaggttgattccatgtctttgctattgtgaa

SEQ ID NO: 24780 - DNA, 201 bp, Homo sapiens
tactagtcatcaaagaagtgcaagttaaaaccacaatgagaaaccatcacacatcacctagaatagataaagttaaaaagacattggataagtctaaataytgtcaagaatatggaaaaaataggaatgtctgatattgctggtaggaatgcaaaaaatgtggcagccaatttgtaaagtggtatggcagtttcttataca

SEQ ID NO: 24781 - DNA, 201 bp, Homo sapiens
agatcaacggacttccagtgcccttcttgagtcatactgaggtaaattactcagaccacgaactcacatttttaaataaataaaatagcagcatagttaakaatttatttatcccattactgggcatatacccaaaggattataaatcattctactataaagacacatgcacacatatgttcactgcagcactatttgcaa

SEQ ID NO: 24782 - DNA, 201 bp, Homo sapiens
ccactatggcacatgtgtacctatataaccaacctgtacattctgcacatatatcccagaacttaaaagtataattaaaaaaagaatttatttcatttgtrtagtccattaaattttttgtacattttttaaacctgcacttttcatagtttttgatacatccttgctccaataaatagcttgctaaaactactaaatctc

SEQ ID NO: 24783 - DNA, 201 bp, Homo sapiens
ttcaaggaagaatctatagaataaagaaaacaaaagcatatttctaaaggtaaaactaaatcataatattggatgataaaaataaaaataaaacaaagaaktgatgatcgtaaaagtcaggttgtgtttttatttgagggaagaaagagtttattgctgggctggagcaaatgatggggcttctggtttgccccacaaaca

SEQ ID NO: 24784 - DNA, 201 bp, Homo sapiens
ttcctgaaataccagagtgagtctgtttttctgaaaacagctcactaatgcccagaggagctcaaaaattttctgtctgttgtctcaaagtctccaaattktactgattcttcaacgtgcatggctgtaaattaggcaataatcttgctggggtgttggaaggagaagaaagggaatgattagacagcccttctgattcgg

SEQ ID NO: 24785 - DNA, 201 bp, Homo sapiens; identical to SEQ ID NO: 5609

SEQ ID NO: 24786 - DNA, 201 bp, Homo sapiens
ggctggagcaaatgatggggcttctggtttgccccacaaacatctatccctggtgattaatgggtgtttactttgtattaaaggacacaaattttagacakttttttcttttggagtcctatattttattttatgacacaaaggctaatgaaaaaataatttatagagtatggttactgttttgcacaaagcctcctcccc

SEQ ID NO: 24787 - DNA, 201 bp, Homo sapiens
ttatgtgaactcatgttttcatttctcttgggtatactgtatcataggaggggattgctgggtcatgtaataacttaatgttcacaaatttgagctactgmtagcctgctttctaaaggggctatgtctcttaaatccccaccagcaaagtgtgagtattctagtatctccacattctcatcaacactaattattatcttt

SEQ ID NO: 24788 - DNA, 201 bp, Homo sapiens
tatgtgaactcatgttttcatttctcttgggtatactgtatcataggaggggattgctgggtcatgtaataacttaatgttcacaaatttgagctactgckagcctgctttctaaaggggctatgtctcttaaatccccaccagcaaagtgtgagtattctagtatctccacattctcatcaacactaattattatctttt

SEQ ID NO: 24789 - DNA, 201 bp, Homo sapiens
ctgggtcatgtaataacttaatgttcacaaatttgagctactgctagcctgctttctaaaggggctatgtctcttaaatccccaccagcaaagtgtgagtrttctagtatctccacattctcatcaacactaattattatctttttaattatagccattctagtgggtgggaaatagtatctcatttttgggttgatgtgc

SEQ ID NO: 24790 - DNA, 201 bp, Homo sapiens
accgcggcggacaccgcggctcagatcacccagcgcaagtgggaggcggcccgtgtggcggagcaggagagagcctacctggagggcacgtgcgtggagtsgctccgcagatacctggagaacgggaaggacacgctggagcgcgcgggtaccaggggcagtggggagccttccccatctcctataggtcgccggggatgg

SEQ ID NO: 24791 - DNA, 201 bp, Homo sapiens
tacattctttagaacttcttgtactttactaggtgtgtttgtgttaaattgtttgtcttcaaaattcattgagatttaaattttattattatattttcatrcttaagtgttatgtgtttgtctcttcaaatttttctgaagattatttatagttttatagtcactaaatgtatttaacaatctgttctttaatcatagccc

SEQ ID NO: 24792 - DNA, 201 bp, Homo sapiens
agtgagtctgtttttctgaaaacagctcactaatgcccagaggagctcaaaaattttctgtctgttgtctcaaagtctccaaattgtactgattcttcaaygtgcatggctgtaaattaggcaataatcttgctggggtgttggaaggagaagaaagggaatgattagacagcccttctgattcgggacagaatctgattc

SEQ ID NO: 24793 - DNA, 201 bp, Homo sapiens
tctaatgttaagtctcacatttaggtctttgatacactgaggtaatttttatatgtggtgtgaagtagggatccagctttattcttttgcatagggatagmctgttgtttctgcactgtttgatgaaaagataatttcttcccctcactgaattatattagcactgttttataaaaccaattaaccatataagtgaagagt

SEQ ID NO: 24794 - DNA, 201 bp, Homo sapiens
ctgcaatggggaggcgcagcgttggggattccccactcccacgagtttcacttcttctcccaacctatgtcgggtccttcttccaggatactcgtgacgcrtccccatttcccactcccattgggtgtcgggtgtctagagaagccaatcagtgtcgccggggtcccagttctaaagtccccacgcacccacccggactca

SEQ ID NO: 24795 - DNA, 201 bp, Homo sapiens
aggtgaggtaaggtaaggcaaagggtgggaggcagggagtccagttcagggacggggattccaggaggagaagtgaaggggaaggggctgggcgcagcctkggggtctctccctggtttccacagacagatccttgtccaggactcaggcacacagtgtgacaaagatgcttggtgtaggagaagagggatcaggacgaag

SEQ ID NO: 24796 - DNA, 201 bp, Homo sapiens
aaggtgttcaataaatgaaagcaaaataactgcagagaaaattacaaatagggtgaccaaggccttggcctggcctgaggcaacttagctagccccagggrtgtgtgttctggtgtggagtaagatcagggagctaccagtgcaatctctgcctctacatcagcgggactgatcattttaattttgattgcagttactgct

SEQ ID NO: 24797 - DNA, 201 bp, Homo sapiens
actcaatttttgtattttgatcttgtagcctaccaatgtgctaaactaatttagtattagtggtttagtagttgctaagcttgtttttagtgaattctttygtatttctatataagattttatcatctgcaattgagatagttttacctcttgctttttaatctagatgacttttatttcatcttattgctcattgtagct

SEQ ID NO: 24798 - DNA, 201 bp, Homo sapiens
gtgagtttccctgtacaagagtccaaggggagaggtaagtgtcctttattttgctggatgtagtttaatattacctgaggtgaggtaaggtaaggcaaagrgtgggaggcagggagtccagttcagggacggggattccaggaggagaagtgaaggggaaggggctgggcgcagccttggggtctctccctggtttccaca

SEQ ID NO: 24799 - DNA, 201 bp, Homo sapiens
ctagagggaaaggtttaacaaataaggagaatccaatatttctgctttcattttcttggcgtggtatcctctgtgtgaatttgaatgctcagttgaatagytttattgccttagtacacacttgtcaaatgtaaagttggaaggacccttttcaggaagggtttcctgtgaacattcacttagtaaatgcttgtggatgat

SEQ ID NO: 24800 - DNA, 201 bp, Homo sapiens
gcagctgcatgtgggccctgggtgctaaagcaggcctgctcattgtgtgtcctggaagagctgtgttctaaaggaggccacaggagttcttagctccttaktgtgtgacagacagtgcttcagagggcaccgtgctccacttggtcttaattttgaaagtttacattgaggtgaaagtagatattgacagctgttcactct

SEQ ID NO: 24801 - DNA, 201 bp, Homo sapiens; identical to SEQ ID NO: 12633

SEQ ID NO: 24802 - DNA, 201 bp, Homo sapiens
gtgccttctggagaagagcagagatacacgtgccatatgcagcacgaggggctgccagagcccctcaccctgagctggggtaaggaggggaatggggggtsacatctcttatcagagaaagcagaagtccttctggagcccttcagccgggtcagggctgaggcttgggggtcagggcccctcaccttctcctcctttccc

SEQ ID NO: 24803 - DNA, 201 bp, Homo sapiens
tcgggggacggggctgaccgcggggccggggccagggtctcacaccctccagagcatgtacggctgcgacgtggggccggacgggcgcctcctccgcgggyataaccagtacgcctacgacggcaaggattacatcgccctgaacgaggacctgcgctcctggaccgcggcggacaccgcggctcagatcacccagcgcaa

SEQ ID NO: 24804 - DNA, 201 bp, Homo sapiens
cgcccccaggctcccactccatgaggtatttcgacaccgccgtgtcccggcccggccgcggagagccccgcttcatctcagtgggctacgtggacgacacscagttcgtgcggttcgacagcgacgccgcgagtccgagaggggagccgcgggcgccgtgggtggagcaggaggggccggagtattgggaccgggagacac

SEQ ID NO: 24805 - DNA, 201 bp, Homo sapiens; identical to SEQ ID NO: 1627

SEQ ID NO: 24806 - DNA, 201 bp, Homo sapiens
cagagccatcttcccagcccaccatccccatcatgggcatcgttgctggcctggctgtcctggctgtcctagctgtcctaggagctgtgatggctgttgtkatgtgtaggaggaagagctcaggtagggaaggggtgaggagtggggtctgggttttcttgtcccactgggagtttcaagccccaggtagaagtgtgcccc

SEQ ID NO: 24807 - DNA, 201 bp, Homo sapiens
ctcaccctgagatggggtaaggagggggatgaggggtcatatctcttctcagggaaagcaggagccagccttcagcagggtcagggcccctcatcttcccytcctttcccagagccgtcttcccagtccaccgtccccatcgtgggcattgttgctggcctggctgtcctagcagttgtggtcatcggagctgtggtcgct

SEQ ID NO: 24808 - DNA, 201 bp, Homo sapiens
cagcaacagtgcccagggctctgatgagtctctcatcacttgtaaaggtgagattctggggagctgaagtggtcgggggtggggcagagggaaaaggcctrggtaatggggattctttgattgggacgtttcgagtgtgtggtgggctgttcagagtgtcatcacttaccatgactgacctgaatttgttcatgactattg

SEQ ID NO: 24809 - DNA, 201 bp, Homo sapiens
agatcccaccagttgcaatatctgttcccagcattaagctccttcttcctttgcaattcggtctttcttgagtggtcccatgaatgctttcttctcctccrtggtctggaagcggccatggccaaacttggagggggtgtcaatgaacttaaggtcaatcttctccagagcccgctgctttgtctgcaccagcaaggactt

SEQ ID NO: 24810 - DNA, 201 bp, Homo sapiens
ctcaataattttaatatagaaattctagtgcatttttcaaaatatctcattatgttttcctcattaaactttattgagatataaatcacatactactcacmcatctaaagtatgcaattcaatggtttttcacatattcagagttttaaatctgcatatttaattttagaacattttcatcatcccaagataatccacggc

SEQ ID NO: 24811 - DNA, 201 bp, Homo sapiens
ttcccgcacgatgtgggtcatgccagccttgtatcccaggaaggctgtgaggtggaccggcttggacgggtcatccttagggaagctcttcaccttcccaygatgcctgctgctgcgcttccaaggcaggaagccgagggacccatgtctgggagtggagaactttctgtgagacatcacgccatcaaatcctgccggtag

SEQ ID NO: 24812 - DNA, 201 bp, Homo sapiens; identical to SEQ ID NO: 1632

SEQ ID NO: 24813 - DNA, 201 bp, Homo sapiens
gtgctgtgttcagattacggatgaatccatgagcagggcctttgccttatcctagaaacacgtggttatcttccctcatgttgttgctggcacatcacatrttgataagtacctctcaagattaccttgatagacccgtagctgtagaagagcacttagttctcacctctgcccttccccttattcttgcactgtggtcat

SEQ ID NO: 24814 - DNA, 201 bp, Homo sapiens
ccatggggtttattttcctggctaaggcaaactgttgggaaatgcaagaatgagagcttctattgtgtaattctggatgaagaataactgcttgtttagarcaaataaatgtcccaggctttgattatagttatgacttcaaaaatatgctaagaccatttacttactgaggaaatcttacctacttatagtatttcaaat

SEQ ID NO: 24815 - DNA, 201 bp, Homo sapiens
acatattaaactatgccttggggagcaatcagcaaaatgcacactatgggaagctctaccacacaatataaatttcaaggaagaatctatagaataaagamaacaaaagcatatttctaaaggtaaaactaaatcataatattggatgataaaaataaaaataaaacaaagaagtgatgatcgtaaaagtcaggttgtgtt

SEQ ID NO: 24816 - DNA, 201 bp, Homo sapiens
cttgccttagcatcctgaattgctgggattacaggcgtgagctgtcatgcccagcttgtaatgtactgacactatcaaggtttctttctccaagtgtggayacagcagcagacaccccttgtctcttgggtgaggacactgggtaaagtggaatagcaaggcaacaaagtcactgcagaaagcacccacgtggaagaggtc

SEQ ID NO: 24817 - DNA, 201 bp, Homo sapiens
tagatttatgccagttcttatagaaacgtctcttgcattcatcactgatgtgctcagcgaagacagtcttgcaagtccggaagccttgaggggtttccacrcagcccacaatgcccactggtggcctctccacaatggtcacagcctccaccacctccttcttgttcaccttggatcctggcctgtcgacttcccgcacga

SEQ ID NO: 24818 - DNA, 201 bp, Homo sapiens
attcatcactgatgtgctcagcgaagacagtcttgcaagtccggaagccttgaggggtttccacgcagcccacaatgcccactggtggcctctccacaatrgtcacagcctccaccacctccttcttgttcaccttggatcctggcctgtcgacttcccgcacgatgtgggtcatgccagccttgtatcccaggaaggctg

SEQ ID NO: 24819 - DNA, 201 bp, Homo sapiens
ggttctaaagtccccagtcacccacccggactcacattctccccagaggccgagatgcgggtcatggcgccccgagccctcctcctgctgctctcgggagscctggccctgaccgagacctgggcctgtgagtgcggggttgggagggaagcggcctctgcggagaggagcgaggggcccgcccggcgagggcgcaggacc

SEQ ID NO: 24820 - DNA, 201 bp, Homo sapiens
gtggtggtgccttctggagaagagcagagatacacgtgccatatgcagcacgaggggctgccagagcccctcaccctgagctggggtaaggaggggaatgrggggtcacatctcttatcagagaaagcagaagtccttctggagcccttcagccgggtcagggctgaggcttgggggtcagggcccctcaccttctcctcc

SEQ ID NO: 24821 - DNA, 201 bp, Homo sapiens
cggactcacattctccccagaggccgagatgcgggtcatggcgccccgagccctcctcctgctgctctcgggaggcctggccctgaccgagacctgggcckgtgagtgcggggttgggagggaagcggcctctgcggagaggagcgaggggcccgcccggcgagggcgcaggacccggggagccgcgcagggaggtgggtc

SEQ ID NO: 24822 - DNA, 201 bp, Homo sapiens
aactttgaggtgatgactacaggctcccggttgcaatagacagtaacaaaccctgcttctttgtattcaggagatgttctggactcacacagggaaactckggctagagaatgaggataactttaaatgcaacaacccagagtcacagatccatagtctgcgaaagtaaaacaggagctttgagaatttaattgtaatgca

SEQ ID NO: 24823 - DNA, 201 bp, Homo sapiens
tctaggcccagctgcagttagtctttcctagtctcagagattccctctctgcctgttaatttctctatccctgaaactgcccttgtactccagcccaagcrgcttcctagcccagtagtcctggatctgccacttgctaactagaaggtgtcatctgcagaaggtaagtaaggcatttatctccattcactttatatttag

SEQ ID NO: 24824 - DNA, 201 bp, Homo sapiens
agccctcgcaactttgaggtgatgactacaggctcccggttgcaatagacagtaacaaaccctgcttctttgtattcaggagatgttctggactcacacarggaaactctggctagagaatgaggataactttaaatgcaacaacccagagtcacagatccatagtctgcgaaagtaaaacaggagctttgagaatttaat

SEQ ID NO: 24825 - DNA, 201 bp, Homo sapiens
taggcccagctgcagttagtctttcctagtctcagagattccctctctgcctgttaatttctctatccctgaaactgcccttgtactccagcccaagcagyttcctagcccagtagtcctggatctgccacttgctaactagaaggtgtcatctgcagaaggtaagtaaggcatttatctccattcactttatatttagtt

SEQ ID NO: 24826 - DNA, 201 bp, Homo sapiens
aaaagtataaaacattctgagggacctgtaaactataaagctaaaatatcagcttctgcatgcaacatatatgtcaaattctatgtccaatactcttctcrtttttagaattaattctgcaaacttgaagattgagctttttatgaactgattggcatctgctatgctcaccagattattcccacttgactgagaggatgg

SEQ ID NO: 24827 - DNA, 201 bp, Homo sapiens
agcgcaagtgggaggcggcccgtgtggcggagcagctgagagcctacctggagggcctgtgcgtggagtggctccgcagatacctggagaacgggaaggasacgctgcagcgcgcgggtaccaggggcagtggggagccttccccatctcctataggtcgccggggatggcctcccacgagaagaggaggaaaatgggatc

SEQ ID NO: 24828 - DNA, 201 bp, Homo sapiens
ttaagctccttcttcctttgcaattcggtctttcttgagtggtcccatgaatgctttcttctcctccatggtctggaagcggccatggccaaacttggagkgggtgtcaatgaacttaaggtcaatcttctccagagcccgctgctttgtctgcaccagcaaggacttgcggagggtgagcacccacttcttggttcccac

SEQ ID NO: 24829 - DNA, 201 bp, Homo sapiens
tccatggtctggaagcggccatggccaaacttggagggggtgtcaatgaacttaaggtcaatcttctccagagcccgctgctttgtctgcaccagcaaggwcttgcggagggtgagcacccacttcttggttcccaccacacagcctttcagcatgacaaagtcattggtcacttcaccatagtggacgaagccacccaaa

SEQ ID NO: 24830 - DNA, 201 bp, Homo sapiens
gacatcacgccatcaaatcctgccggtagagcatatttgccacattttctttatccagtctaccattgatggacatttaggttgattccatgtctttgctrttgtgaatagtgctgcaatgaacatatgcatacatgtaagacatgggctttctttttttaatttgctttgttttattttactttaggttccaggatacat

SEQ ID NO: 24831 - DNA, 201 bp, Homo sapiens
ggtctggaagcggccatggccaaacttggagggggtgtcaatgaacttaaggtcaatcttctccagagcccgctgctttgtctgcaccagcaaggacttgyggagggtgagcacccacttcttggttcccaccacacagcctttcagcatgacaaagtcattggtcacttcaccatagtggacgaagccacccaaagggtt

SEQ ID NO: 24832 - DNA, 201 bp, Homo sapiens
caggcgtgagctgtcatgcccagcttgtaatgtactgacactatcaaggtttctttctccaagtgtggatacagcagcagacaccccttgtctcttgggtsaggacactgggtaaagtggaatagcaaggcaacaaagtcactgcagaaagcacccacgtggaagaggtccagcagggagagccacctgttccagggacac

SEQ ID NO: 24833 - DNA, 201 bp, Homo sapiens
aaggggtgaggagtggggtctgggttttcttgtcccactgggagtttcaagccccaggtagaagtgtgccccacctcgttactggaagcaccatccacacrtgggccatcccagcctgggaccctgtgtgctagcacttactctgttgtgaagcacatgacaatgaaggacagatgtatcaccttgatgattatggtgttg

SEQ ID NO: 24834 - DNA, 201 bp, Homo sapiens
tcaatccaactagcagtgactcctggactgatggcttcttcaggaacactgagagaatgtaaaatacaggaatcctgataatcctgcattctttgagcatscattataatcaagctgatgtttttatccatcatcattgtgtatagttcctttgctgtgattgctcctttctctttggtctcacatttttcattcttttca

SEQ ID NO: 24835 - DNA, 201 bp, Homo sapiens
gcccggcgagggcgcaggacccggggagccgcgcagggaggtgggtcgggcgggtctcagcccctcctcgcccccaggctcccactccatgaggtatttckacaccgccgtgtcccggcccggccgcggagagccccgcttcatctcagtgggctacgtggacgacacgcagttcgtgcggttcgacagcgacgccgcgag

SEQ ID NO: 24836 - DNA, 201 bp, Homo sapiens
cccggcgagggcgcaggacccggggagccgcgcagggaggtgggtcgggcgggtctcagcccctcctcgcccccaggctcccactccatgaggtatttcghcaccgccgtgtcccggcccggccgcggagagccccgcttcatctcagtgggctacgtggacgacacgcagttcgtgcggttcgacagcgacgccgcgagt

SEQ ID NO: 24837 - DNA, 201 bp, Homo sapiens
gcgagggcgcaggacccggggagccgcgcagggaggtgggtcgggcgggtctcagcccctcctcgcccccaggctcccactccatgaggtatttcgacacmgccgtgtcccggcccggccgcggagagccccgcttcatctcagtgggctacgtggacgacacgcagttcgtgcggttcgacagcgacgccgcgagtccga

SEQ ID NO: 24838 - DNA, 201 bp, Homo sapiens
cgagggcgcaggacccggggagccgcgcagggaggtgggtcgggcgggtctcagcccctcctcgcccccaggctcccactccatgaggtatttcgacacckccgtgtcccggcccggccgcggagagccccgcttcatctcagtgggctacgtggacgacacgcagttcgtgcggttcgacagcgacgccgcgagtccgag

SEQ ID NO: 24839 - DNA, 201 bp, Homo sapiens
acgcagcccacaatgcccactggtggcctctccacaatggtcacagcctccaccacctccttcttgttcaccttggatcctggcctgtcgacttcccgcaygatgtgggtcatgccagccttgtatcccaggaaggctgtgaggtggaccggcttggacgggtcatccttagggaagctcttcaccttcccacgatgcctg

SEQ ID NO: 24840 - DNA, 201 bp, Homo sapiens
agggcgcaggacccggggagccgcgcagggaggtgggtcgggcgggtctcagcccctcctcgcccccaggctcccactccatgaggtatttcgacaccgcygtgtcccggcccggccgcggagagccccgcttcatctcagtgggctacgtggacgacacgcagttcgtgcggttcgacagcgacgccgcgagtccgagag

SEQ ID NO: 24841 - DNA, 201 bp, Homo sapiens
cagcccacaatgcccactggtggcctctccacaatggtcacagcctccaccacctccttcttgttcaccttggatcctggcctgtcgacttcccgcacgaygtgggtcatgccagccttgtatcccaggaaggctgtgaggtggaccggcttggacgggtcatccttagggaagctcttcaccttcccacgatgcctgctg

SEQ ID NO: 24842 - DNA, 201 bp, Homo sapiens
gcatttaactaatgaaaccacagatataaccactggcaaaaaaatcaaacaaacatttctttaactgccctgtacttggtacattctcttcctcctgctarggaagtatctcctctcccttcacttcacagactggaattttccaaattcctagtctcaacaagacaaactgtattttgaaatcactgttttcccagaata

SEQ ID NO: 24843 - DNA, 201 bp, Homo sapiens
ttaccatgactccagaagatgccttcaaccaagactcataatctgactgtaagaaaccttcagataaggtattgggaacttctgtaaaattgtagctgggytgtgattagagaattttcacaatatcaacgaatcttacaaaagagctgctgatccaacaggtcctcagagatcctgtgtgggaaccagaaggtattctgt

SEQ ID NO: 24844 - DNA, 201 bp, Homo sapiens
accgcggcggacaccgcggctcagatcacccagcgcaagtgggaggcggcccgtgtggcggagcagctgagagcctacctggagggcctgtgcgtggagtsgctccgcagatacctggagaacgggaaggagacgctgcagcgcgcgggtaccaggggcagtggggagccttccccatctcctataggtcgccggggatgg

SEQ ID NO: 24845 - DNA, 201 bp, Homo sapiens
aagactcataatctgactgtaagaaaccttcagataaggtattgggaacttctgtaaaattgtagctgggctgtgattagagaattttcacaatatcaacraatcttacaaaagagctgctgatccaacaggtcctcagagatcctgtgtgggaaccagaaggtattctgtgaaaaacgacaataagaataaccataataa

SEQ ID NO: 24846 - DNA, 201 bp, Homo sapiens
tcccgcacgatgtgggtcatgccagccttgtatcccaggaaggctgtgaggtggaccggcttggacgggtcatccttagggaagctcttcaccttcccacratgcctgctgctgcgcttccaaggcaggaagccgagggacccatgtctgggagtggagaactttctgtgagacatcacgccatcaaatcctgccggtaga

SEQ ID NO: 24847 - DNA, 201 bp, Homo sapiens
taagctccttcttcctttgcaattcggtctttcttgagtggtcccatgaatgctttcttctcctccatggtctggaagcggccatggccaaacttggaggrggtgtcaatgaacttaaggtcaatcttctccagagcccgctgctttgtctgcaccagcaaggacttgcggagggtgagcacccacttcttggttcccacc

SEQ ID NO: 24848 - DNA, 201 bp, Homo sapiens; identical to SEQ ID NO: 5524

SEQ ID NO: 24849 - DNA, 201 bp, Homo sapiens
ctttcccagagccatcttcccagcccaccatccccatcatgggcatcgttgctggcctggctgtcctggctgtcctagctgtcctaggagctgtgatggcygttgtgatgtgtaggaggaagagctcaggtagggaaggggtgaggagtggggtctgggttttcttgtcccactgggagtttcaagccccaggtagaagtg

SEQ ID NO: 24850 - DNA, 201 bp, Homo sapiens; identical to SEQ ID NO: 1694

SEQ ID NO: 24851 - DNA, 201 bp, Homo sapiens
ctcctttcccagagccatcttcccagcccaccatccccatcatgggcatcgttgctggcctggctgtcctggctgtcctagctgtcctaggagctgtgatsgctgttgtgatgtgtaggaggaagagctcaggtagggaaggggtgaggagtggggtctgggttttcttgtcccactgggagtttcaagccccaggtagaa

SEQ ID NO: 24852 - DNA, 201 bp, Homo sapiens; identical to SEQ ID NO: 5584

SEQ ID NO: 24853 - DNA, 201 bp, Homo sapiens
gtggtggttgagtgaagggaaggggtgagggtgggaggcaaggattaaatagaaaggggcagaaagaaagtttttagggaaaagaaacggttctctacagygccacaactcagagagtaactgggtggtgggaactaaggggagaggagggtgtgagggaagaggacagagagaagggctggggaagcaggaggtgaggac

SEQ ID NO: 24854 - DNA, 201 bp, Homo sapiens; identical to SEQ ID NO: 5585

SEQ ID NO: 24855 - DNA, 201 bp, Homo sapiens; identical to SEQ ID NO: 5586

SEQ ID NO: 24856 - DNA, 201 bp, Homo sapiens
atgtgctcagcgaagacagtcttgcaagtccggaagccttgaggggtttccacgcagcccacaatgcccactggtggcctctccacaatggtcacagcctycaccacctccttcttgttcaccttggatcctggcctgtcgacttcccgcacgatgtgggtcatgccagccttgtatcccaggaaggctgtgaggtggacc

SEQ ID NO: 24857 - DNA, 201 bp, Homo sapiens
aggacccggggagccgcgcagggaggtgggtcgggcgggtctcagcccctcctcgcccccaggctcccactccatgaggtatttcgacaccgccgtgtccyggcccggccgcggagagccccgcttcatctcagtgggctacgtggacgacacgcagttcgtgcggttcgacagcgacgccgcgagtccgagaggggagcc

SEQ ID NO: 24858 - DNA, 201 bp, Homo sapiens
cgcgcagggaggtgggtcgggcgggtctcagcccctcctcgcccccaggctcccactccatgaggtatttcgacaccgccgtgtcccggcccggccgcggrgagccccgcttcatctcagtgggctacgtggacgacacgcagttcgtgcggttcgacagcgacgccgcgagtccgagaggggagccgcgggcgccgtggg

SEQ ID NO: 24859 - DNA, 201 bp, Homo sapiens
gaggtgggtcgggcgggtctcagcccctcctcgcccccaggctcccactccatgaggtatttcgacaccgccgtgtcccggcccggccgcggagagccccrcttcatctcagtgggctacgtggacgacacgcagttcgtgcggttcgacagcgacgccgcgagtccgagaggggagccgcgggcgccgtgggtggagcag

SEQ ID NO: 24860 - DNA, 201 bp, Homo sapiens
ggatggcgaggaccaaactcaggacaccgagcttgtggagaccaggccagcaggagatggaaccttccagaagtgggcagctgtggtggtgccttctggasaagagcagagatacacgtgccatatgcagcacgaggggctgccagagcccctcaccctgagctggggtaaggaggggaatggggggtcacatctcttatc

SEQ ID NO: 24861 - DNA, 201 bp, Homo sapiens
cgtccccaattcccactcccattgggtgtcgggttctagagaagccaatcagcgtctccgcagtcccggttctaaagtccccagtcacccacccggactcrcattctccccagaggccgagatgcgggtcatggcgccccgagccctcctcctgctgctctcgggaggcctggccctgaccgagacctgggcctgtgagtg

SEQ ID NO: 24862 - DNA, 201 bp, Homo sapiens
ttacttacaaggttggagaacgtgaagtactggacaatccaacaatagcttggaaagataccataaaaagacccgcagaatattcttttatatgcattatwctgaaatgtacaaaacaaaaccagaatgggacacattatgagtgagaagtttatcttgaaattttaatcagaatatgaagaaaagaaatccaacattaga

SEQ ID NO: 24863 - DNA, 201 bp, Homo sapiens
attcctcttgtcccacatctcctgcgggctctgaccaggtctttttttttgttctaccccaggcagcaacagtgcccagggctctgatgagtctctcatcrcttgtaaaggtgagattctggggagctgaagtggtcgggggtggggcagagggaaaaggcctgggtaatggggattctttgattgggacgtttcgagtgt

SEQ ID NO: 24864 - DNA, 201 bp, Homo sapiens
ctacattgtgttttattttttcactatccatttttgttagcatgagggtaggtatgtttacctaaatgtgccatgtgagtggttcaaatctcctccccaaygctccttatcacaaaccttaccatcttattcctttaaagtcactgactatctaaggaaactactagctactgctgtgcattgattaggacccaacagtaa

SEQ ID NO: 24865 - DNA, 201 bp, Homo sapiens
tcgggcgggtctcagcccctcctcgcccccaggctcccactccatgaggtatttcgacaccgccgtgtcccggcccggccgcggagagccccgcttcatckcagtgggctacgtggacgacacgcagttcgtgcggttcgacagcgacgccgcgagtccgagaggggagccgcgggcgccgtgggtggagcaggaggggcc

SEQ ID NO: 24866 - DNA, 201 bp, Homo sapiens
ccttatcacaaaccttaccatcttattcctttaaagtcactgactatctaaggaaactactagctactgctgtgcattgattaggacccaacagtaagacrtttctccttttggtaaactgcacttccagatggtctaattgaacatcttctcactggaagtatttttatttccattactcttaatgatgattcctgaaag

SEQ ID NO: 24867 - DNA, 201 bp, Homo sapiens; identical to SEQ ID NO: 5638

SEQ ID NO: 24868 - DNA, 201 bp, Homo sapiens
tgggctacgtggacgacacgcagttcgtgcggttcgacagcgacgccgcgagtccgagaggggagccgcgggcgccgtgggtggagcaggaggggccggartattgggaccgggagacacagaagtacaagcgccaggcacaggctgaccgagtgagcctgcggaacctgcgcggctactacaaccagagcgaggacggtg

SEQ ID NO: 24869 - DNA, 201 bp, Homo sapiens
cccacaatgcccactggtggcctctccacaatggtcacagcctccaccacctccttcttgttcaccttggatcctggcctgtcgacttcccgcacgatgtrggtcatgccagccttgtatcccaggaaggctgtgaggtggaccggcttggacgggtcatccttagggaagctcttcaccttcccacgatgcctgctgctg

SEQ ID NO: 24870 - DNA, 201 bp, Homo sapiens
gcgggggcgcaggacctgaggagccgcgccgggaggagggtcgggcgggtctcagcccctcctcgcccccaggctcccactccatgaggtatttctacacmgccatgtcccggcccggccgcggggagccccgcttcatctcagtgggctacgtggacgacacccagttcgtgaggttcgacagcgacgccgcgagtccga

SEQ ID NO: 24871 - DNA, 201 bp, Homo sapiens; identical to SEQ ID NO: 5598

SEQ ID NO: 24872 - DNA, 201 bp, Homo sapiens
cctcattactgggaagcagcatccacacaggggctaacgcagcctgggaccctgtgtgccagcacttactcttttgtgcagcacatgtgacaatgaaggayggatgtatcaccttgatggttgtggtgttggggtcctgattccagcattcatgagtcaggggaaggtccctgctaaggacagaccttaggagggcagttg

SEQ ID NO: 24873 - DNA, 201 bp, Homo sapiens
tagggaaggggtgaggggtggggtctgggttttcttgtcccactgggggtttcaagccccaggtagaagtgttccctgcctcattactgggaagcagcatscacacaggggctaacgcagcctgggaccctgtgtgccagcacttactcttttgtgcagcacatgtgacaatgaaggacggatgtatcaccttgatggttg

SEQ ID NO: 24874 - DNA, 201 bp, Homo sapiens
tcctcctttcccagagccatcttcccagcccaccatccccatcatgggcatcgttgctggcctggctgtcctggctgtcctagctgtcctaggagctgtgrtggctgttgtgatgtgtaggaggaagagctcaggtagggaaggggtgaggagtggggtctgggttttcttgtcccactgggagtttcaagccccaggtag

SEQ ID NO: 24875 - DNA, 201 bp, Homo sapiens
ttctcctcctttcccagagccatcttcccagcccaccatccccatcatgggcatcgttgctggcctggctgtcctggctgtcctagctgtcctaggagctrtgatggctgttgtgatgtgtaggaggaagagctcaggtagggaaggggtgaggagtggggtctgggttttcttgtcccactgggagtttcaagccccagg

SEQ ID NO: 24876 - DNA, 201 bp, Homo sapiens
ctgctagataaagtggctgtggcaagcaatgtgtggtagatcttgatggtctgtattctcatcagtgtttggaaaactcaataattttaatatagaaattytagtgcatttttcaaaatatctcattatgttttcctcattaaactttattgagatataaatcacatactactcacccatctaaagtatgcaattcaatgg

SEQ ID NO: 24877 - DNA, 201 bp, Homo sapiens
gccatcttcccagcccaccatccccatcatgggcatcgttgctggcctggctgtcctggctgtcctagctgtcctaggagctgtgatggctgttgtgatgygtaggaggaagagctcaggtagggaaggggtgaggagtggggtctgggttttcttgtcccactgggagtttcaagccccaggtagaagtgtgccccacct

SEQ ID NO: 24878 - DNA, 201 bp, Homo sapiens
atatagaaattctagtgcatttttcaaaatatctcattatgttttcctcattaaactttattgagatataaatcacatactactcacccatctaaagtatrcaattcaatggtttttcacatattcagagttttaaatctgcatatttaattttagaacattttcatcatcccaagataatccacggctttataatatgtc

SEQ ID NO: 24879 - DNA, 201 bp, Homo sapiens
tattgagatataaatcacatactactcacccatctaaagtatgcaattcaatggtttttcacatattcagagttttaaatctgcatatttaattttagaayattttcatcatcccaagataatccacggctttataatatgtctctctatacaatgaagtaaatccataaattttgagttttcacttcaggagtgtttttt

SEQ ID NO: 24880 - DNA, 201 bp, Homo sapiens
cccagagccatcttcccagcccaccatccccatcatgggcatcgttgctggcctggctgtcctggctgtcctagctgtcctaggagctgtgatggctgttrtgatgtgtaggaggaagagctcaggtagggaaggggtgaggagtggggtctgggttttcttgtcccactgggagtttcaagccccaggtagaagtgtgcc

SEQ ID NO: 24881 - DNA, 201 bp, Homo sapiens
ctttccaagtacctttaacaattttatttttaatagagatttcattcagtaatcagatttggagagcactgacaaattttgccacattgagacttataatycatgaacatgtaatgtttacttattaaatactcttaaataaagtattgctggttttacttgtgcatcttttagtagatttattccaaagatcttgaaata

SEQ ID NO: 24882 - DNA, 201 bp, Homo sapiens
ttcccagagccatcttcccagcccaccatccccatcatgggcatcgttgctggcctggctgtcctggctgtcctagctgtcctaggagctgtgatggctgytgtgatgtgtaggaggaagagctcaggtagggaaggggtgaggagtggggtctgggttttcttgtcccactgggagtttcaagccccaggtagaagtgtg

SEQ ID NO: 24883 - DNA, 201 bp, Homo sapiens
cttgggggtcagggcccctcaccttctcctcctttcccagagccatcttcccagcccaccatccccatcatgggcatcgttgctggcctggctgtcctggytgtcctagctgtcctaggagctgtgatggctgttgtgatgtgtaggaggaagagctcaggtagggaaggggtgaggagtggggtctgggttttcttgtcc

SEQ ID NO: 24884 - DNA, 201 bp, Homo sapiens; identical to SEQ ID NO: 5652

SEQ ID NO: 24885 - DNA, 201 bp, Homo sapiens
ctggagcccttcagccgggtcagggctgaggcttgggggtcagggcccctcaccttctcctcctttcccagagccatcttcccagcccaccatccccatcrtgggcatcgttgctggcctggctgtcctggctgtcctagctgtcctaggagctgtgatggctgttgtgatgtgtaggaggaagagctcaggtagggaagg

SEQ ID NO: 24886 - DNA, 201 bp, Homo sapiens
ggtccttcttcctgaatactcatgacgcgtccccaattcccactcccattgggtgtcgggttctagagaagccaatcagcgtctccgcagtcccggttctraagtccccagtcacccacccggactcacattctccccagaggccgagatgcgggtcatggcgccccgagccctcctcctgctgctctcgggaggcctggc

SEQ ID NO: 24887 - DNA, 201 bp, Homo sapiens
ttctccactcccctgagtttcacttctcccaacctgcgtcgggtccttcttcctgaatactcatgacgcgtccccaattcccactcccattgggtgtcggrttctagagaagccaatcagcgtctccgcagtcccggttctaaagtccccagtcacccacccggactcacattctccccagaggccgagatgcgggtcatg

SEQ ID NO: 24888 - DNA, 201 bp, Homo sapiens; identical to SEQ ID NO: 5658

SEQ ID NO: 24889 - DNA, 201 bp, Homo sapiens
tgggcgcagccttggggtctctccctggtttccacagacagatccttgtccaggactcaggcacacagtgtgacaaagatgcttggtgtaggagaagaggratcaggacgaagtcccaggtcccgggcggggctctcagggtctcaggctccaagggccgtgtctgcattggggaggcgccgcgttggggattctccactc

SEQ ID NO: 24890 - DNA, 201 bp, Homo sapiens
tggaatgtttctgtacttgtactagctcataggattttggattagagaaatacccttgcaggatatgaagtcatactttttcattggtgaaatcatctgtyctcattagagtttaataatatcatgcagttatttctcaaagagcttgtactccttagatttgctggaattcctcaagttaaaaagaccagggcctcaata

SEQ ID NO: 24891 - DNA, 201 bp, Homo sapiens; identical to SEQ ID NO: 5660

SEQ ID NO: 24892 - DNA, 201 bp, Homo sapiens; identical to SEQ ID NO: 5662

SEQ ID NO: 24893 - DNA, 201 bp, Homo sapiens
cacctatctctgcattgctacaaccccaatgtctattcatttcacggactcaggtgatcaccacaagcaaacctggattttttgttgttgttgttgttgtttttgagatgtggtcttgatatgtttccctggctggcctcaagtgttgctgaggctaaactctaactcctggactcaagatatccttctgcctcagctgct

SEQ ID NO: 24894 - DNA, 201 bp, Homo sapiens
ccacctatctctgcattgctacaaccccaatgtctattcatttcacggactcaggtgatcaccacaagcaaacctggattttttgttgttgttgttgttgtttttgagatgtggtcttgatatgtttccctggctggcctcaagtgttgctgaggctaaactctaactcctggactcaagatatccttctgcctcagctgc

SEQ ID NO: 24895 - DNA, 201 bp, Homo sapiens
tccacctatctctgcattgctacaaccccaatgtctattcatttcacggactcaggtgatcaccacaagcaaacctggattttttgttgttgttgttgttgtttttgagatgtggtcttgatatgtttccctggctggcctcaagtgttgctgaggctaaactctaactcctggactcaagatatccttctgcctcagctg

SEQ ID NO: 24896 - DNA, 201 bp, Homo sapiens
tactggtatcagtctaacttgccagctatgtattttcaaggccctggcataaaagaatctgccacatagccatatgctagctctcctttttttgttaaagraagcacttcttatgtgtattttttgcctgtgatgtgtggaatgcaagaggaatatgtcttgattccacctatctctgcattgctacaaccccaatgtcta

SEQ ID NO: 24897 - DNA, 201 bp, Homo sapiens
aattggattttagacatatagggagtgaaaaaataaccagcagacctaaactataataaatgtttcagtcctctaggcaaaaagaaaattaagggactagytggtacagcatttaatgatgaagagacagcttcatcgccccctcccaccgagacagagaacacagccctggggcctgggaattcctctccccaatccacc

SEQ ID NO: 24898 - DNA, 201 bp, Homo sapiens; identical to SEQ ID NO: 1637

SEQ ID NO: 24899 - DNA, 201 bp, Homo sapiens
ttctggagaagagcagagatacacgtgccatatgcagcacgaggggctgccagagcccctcaccctgagctggggtaaggaggggaatggggggtcacatstcttatcagagaaagcagaagtccttctggagcccttcagccgggtcagggctgaggcttgggggtcagggcccctcaccttctcctcctttcccagagc

SEQ ID NO: 24900 - DNA, 201 bp, Homo sapiens
ccttctggagaagagcagagatacacgtgccatatgcagcacgaggggctgccagagcccctcaccctgagctggggtaaggaggggaatggggggtcacrtctcttatcagagaaagcagaagtccttctggagcccttcagccgggtcagggctgaggcttgggggtcagggcccctcaccttctcctcctttcccaga

SEQ ID NO: 24901 - DNA, 201 bp, Homo sapiens; identical to SEQ ID NO: 12620

SEQ ID NO: 24902 - DNA, 201 bp, Homo sapiens
cttatcagagaaagcagaagtccttctggagcccttcagccgggtcagggctgaggcttgggggtcagggcccctcaccttctcctcctttcccagagccrtcttcccagcccaccatccccatcatgggcatcgttgctggcctggctgtcctggctgtcctagctgtcctaggagctgtgatggctgttgtgatgtgta

SEQ ID NO: 24903 - DNA, 201 bp, Homo sapiens
atctcttatcagagaaagcagaagtccttctggagcccttcagccgggtcagggctgaggcttgggggtcagggcccctcaccttctcctcctttcccagrgccatcttcccagcccaccatccccatcatgggcatcgttgctggcctggctgtcctggctgtcctagctgtcctaggagctgtgatggctgttgtgatg

SEQ ID NO: 24904 - DNA, 201 bp, Homo sapiens; identical to SEQ ID NO: 12623

SEQ ID NO: 24905 - DNA, 201 bp, Homo sapiens
gagaagagcagagatacacgtgccatatgcagcacgaggggctgccagagcccctcaccctgagctggggtaaggaggggaatggggggtcacatctcttmtcagagaaagcagaagtccttctggagcccttcagccgggtcagggctgaggcttgggggtcagggcccctcaccttctcctcctttcccagagccatct

SEQ ID NO: 24906 - DNA, 201 bp, Homo sapiens
aaagaatgaatcaaactttaaagagtcatctaaccaaattaattttagaaactcgcctaccatggacaaaatctcttcccattgctttactaagaatccacaaacttctcctcggagggatcttggcttgtctccttatgaaatgctttatgggttaccttatctaaacactactactgaccttcctatgatcgaaacaaa

SEQ ID NO: 24907 - DNA, 201 bp, Homo sapiens
aatccttatgctattattagtaaaattccttacaaccatgagtggttcacagtaatagatctaaaggatgccttctgggcttgcccactagcaaagatagmctttgaatgggaggaccctcactctggttgaaaataacagtatcgatggacagttttgccccagggatttacagaatctccaaatttgtttggtcaaata

SEQ ID NO: 24908 - DNA, 201 bp, Homo sapiens
aggccagcaggagatggaaccttccagaagtgggcagctgtggtggtgccttctggagaagagcagagatacacgtgccatatgcagcacgaggggctgcmagagcccctcaccctgagctggggtaaggaggggaatggggggtcacatctcttatcagagaaagcagaagtccttctggagcccttcagccgggtcagg

SEQ ID NO: 24909 - DNA, 201 bp, Homo sapiens; identical to SEQ ID NO: 1647

SEQ ID NO: 24910 - DNA, 201 bp, Homo sapiens
ctggtgtaacttggtcacaagaagaactttttattttgggagcaaaaggggaggggtttaaagcaaaagtcttagaagaaacaaaaattaaatatcagaamcactcagtaaatattaaacttctgttaatcctggaggcaggaacaaacctattaggaagagacttaatgctaaaattaaacctaggcctttgtgttaatc

SEQ ID NO: 24911 - DNA, 201 bp, Homo sapiens
acctcgagtcccaccaagagcccttgataaatttagaggtgggacccagacctttttaattgactcaggagctgctgattcctcagtttgttatcttcccctggtgtaacttggtcacaagaagaactttttattttgggagcaaaaggggaggggtttaaagcaaaagtcttagaagaaacaaaaattaaatatcagaac

SEQ ID NO: 24912 - DNA, 201 bp, Homo sapiens
caactgagcactgaattcaagagagaccaggaaaccttctgaatattgggacactttattcctgaatcctgaatcctggaagttggcttctggccagggargcaggtgtcattatatctgggctgcctctgtgaggcctcttttccctctgcctttcacatctttctacccctgttaaaatcccagaacagatagaaacat

SEQ ID NO: 24913 - DNA, 201 bp, Homo sapiens
ctgaatggaaaaaagaaaaagaaatcaccccacttatgatctttgaggaggaatggggggccaggggctctactctttttacctcgagtcccaccaagagyccttgataaatttagaggtgggacccagacctttttaattgactcaggagctgctgattcctcagtttgttatcttcccctggtgtaacttggtcacaag

SEQ ID NO: 24914 - DNA, 201 bp, Homo sapiens
cactaaactctgcatgggtgtgggccacttgggaatctggtgaaaaaccagaaagaaactagagggaggtctaccctccaaagagataaatgatcctggtragatctgcaagtcttcagtaacatggactgagtgcatttgccaacctgcacagagctcagtagaagaaagcaaaaatcttactggcttgagaggtgaaaa

SEQ ID NO: 24915 - DNA, 201 bp, Homo sapiens
ctgaagtggtcgggggtggggcagagggaaaaggcctgggtaatggggattctttgattgggacgtttcgagtgtgtggtgggctgttcagagtgtcatcrcttaccatgactgacctgaatttgttcatgactattgtgttctgtagcctgagacagctgcctgtgtgggactgagatgcaggatttcttcacacctctc

SEQ ID NO: 24916 - DNA, 201 bp, Homo sapiens
ttccctacacaagatccaagaggagaggtaaggagtgagaggcagggagtccagttcagggacagggattccaggaggagaagtgaaggggaaggggctgrgcgcagcctgggggtctctccctggtttccacagacagatccttgtccaggactcaggcagacagtgtgacaaagaggctggtgtaggagaagagggatc

SEQ ID NO: 24917 - DNA, 201 bp, Homo sapiens
cctgaatggaaaaaagaaaaagaaatcaccccacttatgatctttgaggaggaatggggggccaggggctctactctttttacctcgagtcccaccaagascccttgataaatttagaggtgggacccagacctttttaattgactcaggagctgctgattcctcagtttgttatcttcccctggtgtaacttggtcacaa

SEQ ID NO: 24918 - DNA, 201 bp, Homo sapiens
taaactctgcatgggtgtgggccacttgggaatctggtgaaaaaccagaaagaaactagagggaggtctaccctccaaagagataaatgatcctggtgagrtctgcaagtcttcagtaacatggactgagtgcatttgccaacctgcacagagctcagtagaagaaagcaaaaatcttactggcttgagaggtgaaaaggc

SEQ ID NO: 24919 - DNA, 201 bp, Homo sapiens; identical to SEQ ID NO: 1654

SEQ ID NO: 24920 - DNA, 201 bp, Homo sapiens
ccggagtattgggaccgggagacacagaagtacaagcgccaggcacaggctgaccgagtgagcctgcggaacctgcgcggctactacaaccagagcgaggmcggtgagtgaccccggcccggggcgcaggtcacgacccctccccatcccccacggacggcccgggtcgccccgagtctcccggtctgagatccaccccga

SEQ ID NO: 24921 - DNA, 201 bp, Homo sapiens
ggcttgaattacatttacattttaacacatggttttaaagggaagatccgtgtgaaaaagaaacaaaactcagaaaaaaaacccagaagttttcataccarttcccatagcaataacaatcccttttctgtcgttagagttcaccctcattctgatttcatagtaatcctgttcatgtctttctttaaagctttaccccat

SEQ ID NO: 24922 - DNA, 201 bp, Homo sapiens
agaaacaaagcaaccacaatgaagttgaatcacaaaatctgagtataaatgacccaaatacttggtcaacctctaaattacacagatgcaggacacacacycagaaacccctgctgaaaccacgtaagatactaagtggaaattctcaaacagaaaaaaaagaaaatgaaagtattctggaagaggtccacagaagttttg

SEQ ID NO: 24923 - DNA, 201 bp, Homo sapiens
gaacaagcctgtgactttgaatataaatctccagaatgtgctcaattctaaaatccaaaacacagattgaaataagattaaagaaaaaaatgaagagaacstcatgaacccatcagagaatataaagcaggtgaccagatatgcaagtggatcctcaaaagaagacacaggatcagaaaaaaatatttgagaaaataatag

SEQ ID NO: 24924 - DNA, 201 bp, Homo sapiens
aggctcccggttgcaatagacagtaacaaaccctgcttctttgtattcaggagatgttctggactcacacagggaaactctggctagagaatgaggataaytttaaatgcaacaacccagagtcacagatccatagtctgcgaaagtaaaacaggagctttgagaatttaattgtaatgcagttttgacacaggtctttca

SEQ ID NO: 24925 - DNA, 201 bp, Homo sapiens
gtgggaggcggcccgtgtggcggagcagctgagagcctacctggagggcctgtgcgtggagtggctccgcagatacctggagaacgggaaggagacgctgsagcgcgcgggtaccaggggcagtggggagccttccccatctcctataggtcgccggggatggcctcccacgagaagaggaggaaaatgggatcagcgcta

SEQ ID NO: 24926 - DNA, 201 bp, Homo sapiens
attgactgtggaaaagaatcagcgcaaggactgaaccctggacctccagttctaagggatctgatcagaccacagagcagactgcacagttctggccccaygtctagaggacgcttagacaaggaactcccgtgtgcaccaggatcacctggatgtggtgctgagatccaggaagtctggagtcgagcaagagattctgga

SEQ ID NO: 24927 - DNA, 201 bp, Homo sapiens
ccggcttggacgggtcatccttagggaagctcttcaccttcccacgatgcctgctgctgcgcttccaaggcaggaagccgagggacccatgtctgggagtrgagaactttctgtgagacatcacgccatcaaatcctgccggtagagcatatttgccacattttctttatccagtctaccattgatggacatttaggttga

SEQ ID NO: 24928 - DNA, 201 bp, Homo sapiens
ggggctgccagagcccctcaccctgagctggggtaaggaggggaatggggggtcacatctcttatcagagaaagcagaagtccttctggagcccttcagcygggtcagggctgaggcttgggggtcagggcccctcaccttctcctcctttcccagagccatcttcccagcccaccatccccatcatgggcatcgttgctg

SEQ ID NO: 24929 - DNA, 201 bp, Homo sapiens
cccagtcacccacccggactcacattctccccagaggccgagatgcgggtcatggcgccccgagccctcctcctgctgctctcgggaggcctggccctgaycgagacctgggcctgtgagtgcggggttgggagggaagcggcctctgcggagaggagcgaggggcccgcccggcgagggcgcaggacccggggagccgcg

SEQ ID NO: 24930 - DNA, 201 bp, Homo sapiens; identical to SEQ ID NO: 12648

SEQ ID NO: 24931 - DNA, 201 bp, Homo sapiens
caccgagcttgtggagaccaggccagcaggagatggaaccttccagaagtgggcagctgtggtggtgccttctggagaagagcagagatacacgtgccatrtgcagcacgaggggctgccagagcccctcaccctgagctggggtaaggaggggaatggggggtcacatctcttatcagagaaagcagaagtccttctgga

SEQ ID NO: 24932 - DNA, 201 bp, Homo sapiens; identical to SEQ ID NO: 1534

SEQ ID NO: 24933 - DNA, 201 bp, Homo sapiens
ctgaatcctggaagttggcttctggccagggaggcaggtgtcattatatctgggctgcctctgtgaggcctcttttccctctgcctttcacatctttctasccctgttaaaatcccagaacagatagaaacattctgccttcttagatgcctcttgctacaaatttcaatgccatttgattgaattaataaatgaaagcaa

SEQ ID NO: 24934 - DNA, 201 bp, Homo sapiens; identical to SEQ ID NO: 1536

SEQ ID NO: 24935 - DNA, 201 bp, Homo sapiens
gaccagcaggagatagaaccttccagaagtgggcagctgtggtggtgccttctggagaagagcagagatacacatgccatgtacagcatgaggggctgccraagcccctcaccctgagatggggtaaggagggggatgaggggtcatatctcttctcagggaaagcaggagccagccttcagcagggtcagggcccctcat

SEQ ID NO: 24936 - DNA, 201 bp, Homo sapiens
ggagctgaagtggtcgggggtggggcagagggaaaaggcctgggtaatggggattctttgattgggacgtttcgagtgtgtggtgggctgttcagagtgtsatcacttaccatgactgacctgaatttgttcatgactattgtgttctgtagcctgagacagctgcctgtgtgggactgagatgcaggatttcttcacacc

SEQ ID NO: 24937 - DNA, 201 bp, Homo sapiens
gtgagattctggggagctgaagtggtcgggggtggggcagagggaaaaggcctgggtaatggggattctttgattgggacgtttcgagtgtgtggtgggcygttcagagtgtcatcacttaccatgactgacctgaatttgttcatgactattgtgttctgtagcctgagacagctgcctgtgtgggactgagatgcagga

SEQ ID NO: 24938 - DNA, 201 bp, Homo sapiens
gctgtcctagctgtcctaggagctgtgatggctgttgtgatgtgtaggaggaagagctcaggtagggaaggggtgaggagtggggtctgggttttcttgtyccactgggagtttcaagccccaggtagaagtgtgccccacctcgttactggaagcaccatccacacatgggccatcccagcctgggaccctgtgtgctag

SEQ ID NO: 24939 - DNA, 201 bp, Homo sapiens
tgatgagtctctcatcacttgtaaaggtgagattctggggagctgaagtggtcgggggtggggcagagggaaaaggcctgggtaatggggattctttgatwgggacgtttcgagtgtgtggtgggctgttcagagtgtcatcacttaccatgactgacctgaatttgttcatgactattgtgttctgtagcctgagacagc

SEQ ID NO: 24940 - DNA, 201 bp, Homo sapiens
ggattacatcgccctgaacgaggacctgcgctcctggaccgccgcggacacggcggctcagatcacccagcgcaagtgggaggcggcccgtgaggcggagsagtggagagcctacctggagggcacgtgcgtggagtggctccgcagatacctggagaacgggaaggagacgctgcagcgcgcgggtaccaggggcagtgg

SEQ ID NO: 24941 - DNA, 201 bp, Homo sapiens
catacagtaaacaaataaacacattctatgttcttgtacttgaaccaaggcctaactcctttgttccctagtctgcctggatctgcctggacacgcccagrcatgtcacagcttgcagcctatgctctttccttatttggaaatattattgtcttcctggtttcccataagcgaccccctcctttccttggttccccattg

SEQ ID NO: 24942 - DNA, 201 bp, Homo sapiens
ttcttcccctcactgaattatattagcactgttttataaaaccaattaaccatataagtgaagagtattgctgggccctcaattttcttctgacttcattstttttaatgctgttgtaagttggatttttaaataacatttgtattaatgcattgatactctatagaagcacactcaatttttgtattttgatcttgtagc

SEQ ID NO: 24943 - DNA, 201 bp, Homo sapiens
tttatagcaataaatacccacctaagaaaagtagaaacattacaaattaacaatataacaatgaacctcatggaaccagaaaagcaagaaaaaaacatatmcaaaattagcagaaaagaaataataaagatcatagtagaaataaataaagacttttaaaaaccatgtaaatgatcaacaaagtgaaaagtttgttcttca

SEQ ID NO: 24944 - DNA, 201 bp, Homo sapiens
ctccccaagaggttttcacagtattcatgtccacttccttcatcagtcatcttcttgtcttatatctccatgtttacatttttcttctcttctaccactgyagttctgccttgattcttcagccattgccttccttttgcatgcatgtgcttcagccagttctctaggaagacattccagacagctcattatcacttgtta

SEQ ID NO: 24945 - DNA, 201 bp, Homo sapiens
ttgctggcctggctgtcctggctgtcctagctgtcctaggagctgtgatggctgttgtgatgtgtaggaggaagagctcaggtagggaaggggtgaggagyggggtctgggttttcttgtcccactgggagtttcaagccccaggtagaagtgtgccccacctcgttactggaagcaccatccacacatgggccatcccag

SEQ ID NO: 24946 - DNA, 201 bp, Homo sapiens
atcgttgctggcctggctgtcctggctgtcctagctgtcctaggagctgtgatggctgttgtgatgtgtaggaggaagagctcaggtagggaaggggtgargagtggggtctgggttttcttgtcccactgggagtttcaagccccaggtagaagtgtgccccacctcgttactggaagcaccatccacacatgggccatc

SEQ ID NO: 24947 - DNA, 201 bp, Homo sapiens; identical to SEQ ID NO: 5581

SEQ ID NO: 24948 - DNA, 201 bp, Homo sapiens
cgaagcccctcaccctgagatggggtaaggagggggatgaggggtcatatctcttctcagggaaagcaggagccagccttcagcagggtcagggcccctcrtcttcccctcctttcccagagccgtcttcccagtccaccgtccccatcgtgggcattgttgctggcctggctgtcctagcagttgtggtcatcggagctg

SEQ ID NO: 24949 - DNA, 201 bp, Homo sapiens
ctggagaagagcagagatacacatgccatgtacagcatgaggggctgccgaagcccctcaccctgagatggggtaaggagggggatgaggggtcatatctsttctcagggaaagcaggagccagccttcagcagggtcagggcccctcatcttcccctcctttcccagagccgtcttcccagtccaccgtccccatcgtgg

SEQ ID NO: 24950 - DNA, 201 bp, Homo sapiens
accgagagaacctgcgcaccgcgctccgctactacaaccagagcgaggccggtgagtgaccccggcccggggcgcaggtcacgactccccatcccccacgkacggcccgggtcgccccgagtctccgggtccgagatccgcccccgaggccgcgggacccgcccagaccctcgaccggcgagagccccaggcgcgtttacc

SEQ ID NO: 24951 - DNA, 201 bp, Homo sapiens
gtaaggagggggatgaggggtcatatctcttctcagggaaagcaggagccagccttcagcagggtcagggcccctcatcttcccctcctttcccagagccrtcttcccagtccaccgtccccatcgtgggcattgttgctggcctggctgtcctagcagttgtggtcatcggagctgtggtcgctgctgtgatgtgtagga

SEQ ID NO: 24952 - DNA, 201 bp, Homo sapiens
cgtggtggtgggcacctgttgtcccagctactcgggaggctgagccagaatggcgtgaacccgggaggcggagcttgcagtgctcctgctcccaggaggcrgatgcccaggatgagctttaaggtggagagaggaatgtcattgctcatcctccaggttccaagtaagaaccttcctgcccagcccatctcgatctccctg

SEQ ID NO: 24953 - DNA, 201 bp, Homo sapiens
ggggtcatatctcttctcagggaaagcaggagccagccttcagcagggtcagggcccctcatcttcccctcctttcccagagccgtcttcccagtccaccrtccccatcgtgggcattgttgctggcctggctgtcctagcagttgtggtcatcggagctgtggtcgctgctgtgatgtgtaggaggaagagctcaggtag

SEQ ID NO: 24954 - DNA, 201 bp, Homo sapiens
cagggctctgatgagtctctcatcacttgtaaaggtgagattctggggagctgaagtggtcgggggtggggcagagggaaaaggcctgggtaatggggatyctttgattgggacgtttcgagtgtgtggtgggctgttcagagtgtcatcacttaccatgactgacctgaatttgttcatgactattgtgttctgtagcct

SEQ ID NO: 24955 - DNA, 201 bp, Homo sapiens
ggtctttttttttgttctaccccaggcagcaacagtgcccagggctctgatgagtctctcatcacttgtaaaggtgagattctggggagctgaagtggtckggggtggggcagagggaaaaggcctgggtaatggggattctttgattgggacgtttcgagtgtgtggtgggctgttcagagtgtcatcacttaccatgac

SEQ ID NO: 24956 - DNA, 201 bp, Homo sapiens
cctgagctggggtaaggaggggaatggggggtcacatctcttatcagagaaagcagaagtccttctggagcccttcagccgggtcagggctgaggcttggrggtcagggcccctcaccttctcctcctttcccagagccatcttcccagcccaccatccccatcatgggcatcgttgctggcctggctgtcctggctgtcc

SEQ ID NO: 24957 - DNA, 201 bp, Homo sapiens; identical to SEQ ID NO: 5637

SEQ ID NO: 24958 - DNA, 201 bp, Homo sapiens
cccctcacagggcattttcttcccacaggtggaaaaggagggagctgctctcaggctgcgtgtaagtgatggcggtgggcgtgtggaggagctcacccacyccataattcctcttgtcccacatctcctgcgggctctgaccaggtctttttttttgttctaccccaggcagcaacagtgcccagggctctgatgagtctc

SEQ ID NO: 24959 - DNA, 201 bp, Homo sapiens
ttctggtttgccccacaaacatctatccctggtgattaatgggtgtttactttgtattaaaggacacaaattttagacatttttttcttttggagtcctakattttattttatgacacaaaggctaatgaaaaaataatttatagagtatggttactgttttgcacaaagcctcctccccatcttcttttctggacactga

SEQ ID NO: 24960 - DNA, 201 bp, Homo sapiens
gcaccatcaaacaagtccaagtgaaaaagaaaccaagcctgaatagaagctgatctccatagccaattaccaatttagaggcaatacagataatagaaatrcatattaaactatgccttggggagcaatcagcaaaatgcacactatgggaagctctaccacacaatataaatttcaaggaagaatctatagaataaagaa

SEQ ID NO: 24961 - DNA, 201 bp, Homo sapiens
ttaacagatttagccattgaatagcaatggcaattaacaacacaataaaagaaaaaactaatgtgaggttcttcctcttgatggaagaacacaatacagcrccatcaaacaagtccaagtgaaaaagaaaccaagcctgaatagaagctgatctccatagccaattaccaatttagaggcaatacagataatagaaataca

SEQ ID NO: 24962 - DNA, 201 bp, Homo sapiens; identical to SEQ ID NO: 1607

SEQ ID NO: 24963 - DNA, 201 bp, Homo sapiens
gggggtcacatctcttatcagagaaagcagaagtccttctggagcccttcagccgggtcagggctgaggcttgggggtcagggcccctcaccttctcctcytttcccagagccatcttcccagcccaccatccccatcatgggcatcgttgctggcctggctgtcctggctgtcctagctgtcctaggagctgtgatggct

SEQ ID NO: 24964 - DNA, 201 bp, Homo sapiens
agaggggagccgcgggcgccgtgggtggagcaggaggggccggagtattgggaccgggagacacagaagtacaagcgccaggcacaggctgaccgagtgarcctgcggaacctgcgcggctactacaaccagagcgaggacggtgagtgaccccggcccggggcgcaggtcacgacccctccccatcccccacggacggcc

SEQ ID NO: 24965 - DNA, 201 bp, Homo sapiens
aggggcagtggggagccttccccatctcctataggtcgccggggatggcctcccacgagaagaggaggaaaatgggatcagcgctagaatgtcgccctccsttgaatggagaatggcatgagttttcctgagtttcctctgagggccccctcttctctctagacaattaagggatgacgtctctgaggaaatggaggggaa

SEQ ID NO: 24966 - DNA, 201 bp, Homo sapiens
tgaagaaggaatgagagactgagactataataactcttttgcaacccatcatgaattaacagatttagccattgaatagcaatggcaattaacaacacaayaaaagaaaaaactaatgtgaggttcttcctcttgatggaagaacacaatacagcaccatcaaacaagtccaagtgaaaaagaaaccaagcctgaatagaa

SEQ ID NO: 24967 - DNA, 201 bp, Homo sapiens
tgtcccctcacagggcattttcttcccacaggtggaaaaggagggagctgctctcaggctgcgtgtaagtgatggcggtgggcgtgtggaggagctcaccyaccccataattcctcttgtcccacatctcctgcgggctctgaccaggtctttttttttgttctaccccaggcagcaacagtgcccagggctctgatgagt

SEQ ID NO: 24968 - DNA, 201 bp, Homo sapiens
acttagaaattattcagataataaatgaagaaggaatgagagactgagactataataactcttttgcaacccatcatgaattaacagatttagccattgartagcaatggcaattaacaacacaataaaagaaaaaactaatgtgaggttcttcctcttgatggaagaacacaatacagcaccatcaaacaagtccaagtg

SEQ ID NO: 24969 - DNA, 201 bp, Homo sapiens
tccctgtcccctcacagggcattttcttcccacaggtggaaaaggagggagctgctctcaggctgcgtgtaagtgatggcggtgggcgtgtggaggagctyacccaccccataattcctcttgtcccacatctcctgcgggctctgaccaggtctttttttttgttctaccccaggcagcaacagtgcccagggctctgat

SEQ ID NO: 24970 - DNA, 201 bp, Homo sapiens
atagtttggcacacacatacatgcatttctattggtttagaactaagagtgctattgctggatcataggtgagtagatgattggcttagtctctcaaaaascaagtttctagtagtaaacaaacagtagaggagggtgaatctcttacttagaaattattcagataataaatgaagaaggaatgagagactgagactataa

SEQ ID NO: 24971 - DNA, 201 bp, Homo sapiens
cgcatggccctgcctcctccctgtcccctcacagggcattttcttcccacaggtggaaaaggagggagctgctctcaggctgcgtgtaagtgatggcggtrggcgtgtggaggagctcacccaccccataattcctcttgtcccacatctcctgcgggctctgaccaggtctttttttttgttctaccccaggcagcaaca

SEQ ID NO: 24972 - DNA, 201 bp, Homo sapiens
gatcgcatggccctgcctcctccctgtcccctcacagggcattttcttcccacaggtggaaaaggagggagctgctctcaggctgcgtgtaagtgatggcrgtgggcgtgtggaggagctcacccaccccataattcctcttgtcccacatctcctgcgggctctgaccaggtctttttttttgttctaccccaggcagca

SEQ ID NO: 24973 - DNA, 201 bp, Homo sapiens
gaagaggagcatctaatcccagcatttgcaccagggaactctgcctgaagggattaccagtgacttgaaagtgtaaccaacaacaatcttgtcactattaygcaccagctaagcaatctgaacatacatgctgaagacatatttggtgagctatttaaggaggctaactacttccacattagatcaaattctcttagaatt

SEQ ID NO: 24974 - DNA, 201 bp, Homo sapiens
atctggtgaaaaaccagaaagaaactagagggaggtctaccctccaaagagataaatgatcctggtgagatctgcaagtcttcagtaacatggactgagtrcatttgccaacctgcacagagctcagtagaagaaagcaaaaatcttactggcttgagaggtgaaaaggcaggatttgaggctaacaaaacaattggaaat

SEQ ID NO: 24975 - DNA, 201 bp, Homo sapiens
ttgtggactgtgaccttctctcccaaaagtctctttcagggtagaacttctggttatggcaacatgaagagatagaccagcaagttttcctccaacagcaacatgaaaactgtactaaatactaaaaacaaacatttgaagtcactggaaaattaacaaaggcaagcaatatgtgataagagctttcttgtttaagactcc

SEQ ID NO: 24976 - DNA, 201 bp, Homo sapiens
attttgctatatgcaacagtttgtgaaaaccactagcctatatcaacagaatccctatcacaggcatactgcagaggaaagtgtctgaacacagctcagaragacggaaaagtgggaatgtatccattatgtgcaacctacttaacatctcctaaccacatctcccgggagggctgagaggatgccccccttaccaaggca

SEQ ID NO: 24977 - DNA, 201 bp, Homo sapiens
tagtgctgcaatgaacatatgcatacatgtaagacatgggctttctttttttaatttgctttgttttattttactttaggttccaggatacatgtgcagawcctgcaggtttgttacatacgtatagtctgccatggtggtttgctgcacctattgacccatcctctaagttcccgtcccttgccccccacactccccaaa

SEQ ID NO: 24978 - DNA, 201 bp, Homo sapiens
tcccgggagggctgagaggatgccccccttaccaaggcattaaggtgccacatgacacatacaggtataaaaactgctaggtctgctgagcagtcaccaaycttgagtcctggatattcagaaattcttatccagtagctacaccaaagccagctgatatgtcagagcccctcaaataagcagaaggctggtgcccttgag

SEQ ID NO: 24979 - DNA, 201 bp, Homo sapiens
cggggagccgcgcagggaggtgggtcgggcgggtctcagcccctcctcgcccccaggctcccactccatgaggtatttcgacaccgccgtgtcccggcccrgccgcggagagccccgcttcatctcagtgggctacgtggacgacacgcagttcgtgcggttcgacagcgacgccgcgagtccgagaggggagccgcgggc

SEQ ID NO: 24980 - DNA, 201 bp, Homo sapiens
ttcttatttagagtgtcatagctactttttctctttcatatttcaatataaggcttaaaattggcttactatgtgttgcaaaaatgcttgataaacatttrattgagatgtgtttgagttcttagagtactgtaggaaattaatgtcattattatattgaaccatccaagccaggatcctggtaaattgattcagttaatt

SEQ ID NO: 24981 - DNA, 201 bp, Homo sapiens
ccggggagccgcgcagggaggtgggtcgggcgggtctcagcccctcctcgcccccaggctcccactccatgaggtatttcgacaccgccgtgtcccggccyggccgcggagagccccgcttcatctcagtgggctacgtggacgacacgcagttcgtgcggttcgacagcgacgccgcgagtccgagaggggagccgcggg

SEQ ID NO: 24982 - DNA, 201 bp, Homo sapiens; identical to SEQ ID NO: 5683

SEQ ID NO: 24983 - DNA, 201 bp, Homo sapiens
catgttacccaggcttgtcttgaactcctgggctcaagcaatccacccaccttggcctcccaaagttgtggcattacagacatgagccactgcacccagcyctaatcttattttaattttagaaatctaacttgacagtttctggtgcctggatccatatttgtctcagaagattgaattgtggactgtgaccttctctcc

SEQ ID NO: 24984 - DNA, 201 bp, Homo sapiens
ttgtgttttttgtagagatgggtttttgtcatgttacccaggcttgtcttgaactcctgggctcaagcaatccacccaccttggcctcccaaagttgtggsattacagacatgagccactgcacccagctctaatcttattttaattttagaaatctaacttgacagtttctggtgcctggatccatatttgtctcagaag

SEQ ID NO: 24985 - DNA, 201 bp, Homo sapiens
tgccctgggtctgcagtcatagttctggaaacttctcttgggtccaagactaggaggttcccctaagatcgcatggccctgcctcctccctgtcccctcayagggcattttcttcccacaggtggaaaaggagggagctgctctcaggctgcgtgtaagtgatggcggtgggcgtgtggaggagctcacccaccccataat

SEQ ID NO: 24986 - DNA, 201 bp, Homo sapiens
cctcattagagtttaataatatcatgcagttatttctcaaagagcttgtactccttagatttgctggaattcctcaagttaaaaagaccagggcctcaatratgggaggtctcattgccaatagctacaaccggctgtagaatttattaaaaacatgtgagtgcattgtttggggaaagaatcaagaacaaaagcagtgct

SEQ ID NO: 24987 - DNA, 201 bp, Homo sapiens
ttcctgatcctgccctgggtctgcagtcatagttctggaaacttctcttgggtccaagactaggaggttcccctaagatcgcatggccctgcctcctcccwgtcccctcacagggcattttcttcccacaggtggaaaaggagggagctgctctcaggctgcgtgtaagtgatggcggtgggcgtgtggaggagctcaccc

SEQ ID NO: 24988 - DNA, 201 bp, Homo sapiens
gcggcctctgcggagaggagcgaggggcccgcccggcgagggcgcaggacccggggagccgcgcagggaggtgggtcgggcgggtctcagcccctcctcgyccccaggctcccactccatgaggtatttcgacaccgccgtgtcccggcccggccgcggagagccccgcttcatctcagtgggctacgtggacgacacgca

SEQ ID NO: 24989 - DNA, 201 bp, Homo sapiens
aacgtgcatggctgtaaattaggcaataatcttgctggggtgttggaaggagaagaaagggaatgattagacagcccttctgattcgggacagaatctgattcgggacactgtccctgatggctggccatcttgggctgtaatccagtttccctcccacgtagacccggtcatttctgactccccaagaggttttcacagt

SEQ ID NO: 24990 - DNA, 201 bp, Homo sapiens
caacgtgcatggctgtaaattaggcaataatcttgctggggtgttggaaggagaagaaagggaatgattagacagcccttctgattcgggacagaatctgattcgggacactgtccctgatggctggccatcttgggctgtaatccagtttccctcccacgtagacccggtcatttctgactccccaagaggttttcacag

SEQ ID NO: 24991 - DNA, 201 bp, Homo sapiens
tcttcaacgtgcatggctgtaaattaggcaataatcttgctggggtgttggaaggagaagaaagggaatgattagacagcccttctgattcgggacagaatctgattcgggacactgtccctgatggctggccatcttgggctgtaatccagtttccctcccacgtagacccggtcatttctgactccccaagaggttttc

SEQ ID NO: 24992 - DNA, 201 bp, Homo sapiens
ttcttcaacgtgcatggctgtaaattaggcaataatcttgctggggtgttggaaggagaagaaagggaatgattagacagcccttctgattcgggacagaatctgattcgggacactgtccctgatggctggccatcttgggctgtaatccagtttccctcccacgtagacccggtcatttctgactccccaagaggtttt

SEQ ID NO: 24993 - DNA, 201 bp, Homo sapiens
atctcttctcagggaaagcaggagccagccttcagcagggtcagggcccctcatcttcccctcctttcccagagccgtcttcccagtccaccgtccccatygtgggcattgttgctggcctggctgtcctagcagttgtggtcatcggagctgtggtcgctgctgtgatgtgtaggaggaagagctcaggtagggaagggg

SEQ ID NO: 24994 - DNA, 201 bp, Homo sapiens
attcttcaacgtgcatggctgtaaattaggcaataatcttgctggggtgttggaaggagaagaaagggaatgattagacagcccttctgattcgggacagaatctgattcgggacactgtccctgatggctggccatcttgggctgtaatccagtttccctcccacgtagacccggtcatttctgactccccaagaggttt

SEQ ID NO: 24995 - DNA, 201 bp, Homo sapiens
gtaggagaagagggatcaggacgaagtcccaggtcccgggcggggctctcagggtctcaggctccaagggccgtgtctgcattggggaggcgccgcgttgrggattctccactcccctgagtttcacttctcccaacctgcgtcgggtccttcttcctgaatactcatgacgcgtccccaattcccactcccattgggtgt

SEQ ID NO: 24996 - DNA, 201 bp, Homo sapiens
tgtgacaaagatgcttggtgtaggagaagagggatcaggacgaagtcccaggtcccgggcggggctctcagggtctcaggctccaagggccgtgtctgcaytggggaggcgccgcgttggggattctccactcccctgagtttcacttctcccaacctgcgtcgggtccttcttcctgaatactcatgacgcgtccccaat

SEQ ID NO: 24997 - DNA, 201 bp, Homo sapiens
gatgcatatatatttcagatagttagatctccttgttgaattgaaccctttaccattatgtaatgcccttctttgtctttttttatcttttttggtttaaygcctgttttgtcagaaacaatggttgcaaccctggctttttttctgctttccatttgcttggtaaattttcttccatctttttattttgagcctatgtgt

SEQ ID NO: 24998 - DNA, 201 bp, Homo sapiens
tcgcatggccctgcctcctccctgtcccctcacagggcattttcttcccacaggtggaaaaggagggagctgctctcaggctgcgtgtaagtgatggcggygggcgtgtggaggagctcacccaccccataattcctcttgtcccacatctcctgcgggctctgaccaggtctttttttttgttctaccccaggcagcaac

SEQ ID NO: 24999 - DNA, 201 bp, Homo sapiens
agtaagaagctcccaagtgagcggctccggtgccgggcgggacgtgggagggaggctgtgtccccgcggggaggcagggcgacggcgtccaggagagaggsgagcggggcggcgtcccaggcaccctgcgcctctcccgcccgcaatgtgcgggttcccggagcccaggcccgcaccccgggtacttgaaggccgccgggc

SEQ ID NO: 25000 - DNA, 201 bp, Homo sapiens; identical to SEQ ID NO: 1677

SEQ ID NO: 25001 - DNA, 201 bp, Homo sapiens
ctcccgcccgcaatgtgcgggttcccggagcccaggcccgcaccccgggtacttgaaggccgccgggctccgccttcaccacgtgggccctgagttcctcmgcggcgccttcgtgggcgacacgcgattcctgagcttccacagccgcggcgagaatcagagcgtgaagcgcgggtggagaagatggcacagggctgtggg

SEQ ID NO: 25002 - DNA, 201 bp, Homo sapiens
gattcttcaacgtgcatggctgtaaattaggcaataatcttgctggggtgttggaaggagaagaaagggaatgattagacagcccttctgattcgggacagaatctgattcgggacactgtccctgatggctggccatcttgggctgtaatccagtttccctcccacgtagacccggtcatttctgactccccaagaggtt

SEQ ID NO: 25003 - DNA, 201 bp, Homo sapiens
agcggcctctgcggagaggagcgaggggcccgcccggcgagggcgcaggacccggggagccgcgcagggaggtgggtcgggcgggtctcagcccctcctckcccccaggctcccactccatgaggtatttcgacaccgccgtgtcccggcccggccgcggagagccccgcttcatctcagtgggctacgtggacgacacgc

SEQ ID NO: 25004 - DNA, 201 bp, Homo sapiens
caagagcctcagcttaatcacatctgaaaatttccttttgccctattaggagacatttttataagttccagggattaggacacaggcatatttaggagacygttattctgcctgtcacatgacttcaccaatatttgctacccgtggtttccaaacattagtgtatgctcttatttctatttattcctgaaataccagagt

SEQ ID NO: 25005 - DNA, 201 bp, Homo sapiens
ataatcttcccatctcaagagcctcagcttaatcacatctgaaaatttccttttgccctattaggagacatttttataagttccagggattaggacacagrcatatttaggagactgttattctgcctgtcacatgacttcaccaatatttgctacccgtggtttccaaacattagtgtatgctcttatttctatttattc

SEQ ID NO: 25006 - DNA, 201 bp, Homo sapiens
ggagggaagcggcctctgcggagaggagcgaggggcccgcccggcgagggcgcaggacccggggagccgcgcagggaggtgggtcgggcgggtctcagccmctcctcgcccccaggctcccactccatgaggtatttcgacaccgccgtgtcccggcccggccgcggagagccccgcttcatctcagtgggctacgtggac

SEQ ID NO: 25007 - DNA, 201 bp, Homo sapiens
gagtccagttcagggacggggattccaggaggagaagtgaaggggaaggggctgggcgcagccttggggtctctccctggtttccacagacagatccttgkccaggactcaggcacacagtgtgacaaagatgcttggtgtaggagaagagggatcaggacgaagtcccaggtcccgggcggggctctcagggtctcaggc

SEQ ID NO: 25008 - DNA, 201 bp, Homo sapiens; identical to SEQ ID NO: 12705

SEQ ID NO: 25009 - DNA, 201 bp, Homo sapiens
gggcctgtgagtgcggggttgggagggaagcggcctctgcggagaggagcgaggggcccgcccggcgagggcgcaggacccggggagccgcgcagggaggwgggtcgggcgggtctcagcccctcctcgcccccaggctcccactccatgaggtatttcgacaccgccgtgtcccggcccggccgcggagagccccgcttc

SEQ ID NO: 25010 - DNA, 201 bp, Homo sapiens
ttccattgctttggggtgaagacttctgtagatatttatcaggtccatttgatgcagggctgagttcaggtcctgaatatcttcgttaattttctgtcttrataatctgtctaatattgtcagtggagtattaaaatctcttactattattgtgtgagattctaagtctctttcaaggtctctaggaacctactttatgaa

SEQ ID NO: 25011 - DNA, 201 bp, Homo sapiens
cgaaaacgggcagtgctggagcgctggtgaagagcattgggactgcatggagccctcgcaactttgaggtgatgactacaggctcccggttgcaatagacrgtaacaaaccctgcttctttgtattcaggagatgttctggactcacacagggaaactctggctagagaatgaggataactttaaatgcaacaacccagag

SEQ ID NO: 25012 - DNA, 201 bp, Homo sapiens
ctatgtgtaaccccatagggatcacaggggttcccatcaaccacagccagttacatccacaaaagccttgatccttgttagcagatgggagagggtggctyggaggattgaaatccctacttcataggactctggatacttacacagttgcttcctcctgtgcttctacatgaatctcagcactgtatttaggacaccgtc

SEQ ID NO: 25013 - DNA, 201 bp, Homo sapiens
ttatgatttcagttcttttgcatttgctgaggagtgttttacttccaattgtgtgatcgattttagagtaagtgccatgtgacaatgcaaaaaatgtataytccattgctttggggtgaagacttctgtagatatttatcaggtccatttgatgcagggctgagttcaggtcctgaatatcttcgttaattttctgtcttg

SEQ ID NO: 25014 - DNA, 201 bp, Homo sapiens
tagaagagcctggcagggggttctttgcatccggtatttaatacattttgtgtgactgccttaaaactaatgggctccttatgatttttttttaaaaaggkgttacaaaaatatcaagtgtccaaataaaatatgcacactgcttagatgtgcatagttcacgaaaacgggcagtgctggagcgctggtgaagagcattgg

SEQ ID NO: 25015 - DNA, 201 bp, Homo sapiens
aggattgccttggctattcaggctcttttttggttccaggtgaattttaaaatagttttttctagttctgtgaagaatgtcagtggtagtggccgggaacrgtggctcacgcctgtaatcccagcactttgggaggctgaggcaggggatcatgaggtcaggagatggagaccatcctggctaacggggtgaaaccccatc

SEQ ID NO: 25016 - DNA, 201 bp, Homo sapiens
tgctaggtctgctgagcagtcaccaatcttgagtcctggatattcagaaattcttatccagtagctacaccaaagccagctgatatgtcagagcccctcawataagcagaaggctggtgcccttgagaaaggaccctataattcactctgagataaattctttttacaggactttcccagaggaacatttagtcatttatc

SEQ ID NO: 25017 - DNA, 201 bp, Homo sapiens
ctttgatgtttcactcattgaggcctaggagaccctgacacatagtaactgcctaataaatgtttgctagataaatgtgaggttcaccatgagataccacrttatacatgcaagaatggcattaatttggctgggcgcggtggctcaagtctgtaatcccagcactttgggaggccaaagcaggcagatcacgagatcagg

SEQ ID NO: 25018 - DNA, 201 bp, Homo sapiens
gacacatacaggtataaaaactgctaggtctgctgagcagtcaccaatcttgagtcctggatattcagaaattcttatccagtagctacaccaaagccagytgatatgtcagagcccctcaaataagcagaaggctggtgcccttgagaaaggaccctataattcactctgagataaattctttttacaggactttcccag

SEQ ID NO: 25019 - DNA, 201 bp, Homo sapiens
tttttagtccccttgtggaatctttgatgtttcactcattgaggcctaggagaccctgacacatagtaactgcctaataaatgtttgctagataaatgtgrggttcaccatgagataccacgttatacatgcaagaatggcattaatttggctgggcgcggtggctcaagtctgtaatcccagcactttgggaggccaaag

SEQ ID NO: 25020 - DNA, 201 bp, Homo sapiens
gctgagaggatgccccccttaccaaggcattaaggtgccacatgacacatacaggtataaaaactgctaggtctgctgagcagtcaccaatcttgagtccyggatattcagaaattcttatccagtagctacaccaaagccagctgatatgtcagagcccctcaaataagcagaaggctggtgcccttgagaaaggaccct

SEQ ID NO: 25021 - DNA, 201 bp, Homo sapiens
tgtgaaaagtcaaggaattgggtttcaattcttacaacaataaaaaattaatgtaaagaaatatagctaaaagccactaggagaattaaaaccataagctraaaaatgtttacttgacacataagaaagtagcaaaggaggaacagaaacaaaaagatatgagacaaattgaaaacgtatagcaaaatggtagaccaaaat

SEQ ID NO: 25022 - DNA, 201 bp, Homo sapiens
cctcttcttcctcccaccctccaccttctgaaagtccccagtgcccagtgtgtgctattcccctctatgtctctatgcattctcatcatttagctcccacwtataagtgagaacatgcagtatttggttttctgtttctgcattagtttgctaaggataatggcttccagctccacccatgtccctgcaaaggacatgatc

SEQ ID NO: 25023 - DNA, 201 bp, Homo sapiens
atgaaccattctcacagtggtcccagtgggcccctgacctctctgtgattatttcctcagtgcttgtttgcataattgaaatagacctactcagcaacagscaaaatccacagatcagttcctttttttaacttttattttcagttcaggggtacaagtgcaggctgttttacaggtaaacttgtgttgtgggagtttggt

SEQ ID NO: 25024 - DNA, 201 bp, Homo sapiens
tacatgaaccattctcacagtggtcccagtgggcccctgacctctctgtgattatttcctcagtgcttgtttgcataattgaaatagacctactcagcaayagccaaaatccacagatcagttcctttttttaacttttattttcagttcaggggtacaagtgcaggctgttttacaggtaaacttgtgttgtgggagttt

SEQ ID NO: 25025 - DNA, 201 bp, Homo sapiens
gaaacaaacaacctgccaagattacattaggaagaatagaaaacctgaagccctaacatacatgaaccattctcacagtggtcccagtgggcccctgaccwctctgtgattatttcctcagtgcttgtttgcataattgaaatagacctactcagcaacagccaaaatccacagatcagttcctttttttaacttttattt

SEQ ID NO: 25026 - DNA, 201 bp, Homo sapiens
atggattaattaaataagtcaattcctggaatttgagagagcaaataaagacctgagaaccttccagaatctgcatgttcgctgtgctgagtctgttgcargtggggtgtggagaaggctgtggggggccgagtgtggacggggcctgtgcccatttggtgttgagtccatcatgggctttatgtggttagtcctcagctg

SEQ ID NO: 25027 - DNA, 201 bp, Homo sapiens; identical to SEQ ID NO: 12661

SEQ ID NO: 25028 - DNA, 201 bp, Homo sapiens; identical to SEQ ID NO: 5541

SEQ ID NO: 25029 - DNA, 201 bp, Homo sapiens
ctccatcttaaaaacaaacaaacaaacaatgaccacaccaacaacaactaaacaaaccaaaaacacatttgtatagttatcccacaaagagctcttgctatcagaagatacttcagttagtgaaaaatcagtgatcccacttgccggaattttggtatcctagaccttgaaaactgtatgttagaggaacttaaaaggctt

SEQ ID NO: 25030 - DNA, 201 bp, Homo sapiens
aaaaaaaaaagtgttcgaaaccaaaaaaaaaaaaaagtgaggggctgctgtcagggatggagaataggcatggaaaaggcaacaaaatggccaaaatctcraccccagtctcagtcaagagaagctattcattctggcagccatacaaagtctgcaggactctagaatgacagcctgtttgttaggattaaagcagaaatc

SEQ ID NO: 25031 - DNA, 201 bp, Homo sapiens
aaaaaaaaaaaaagtgaggggctgctgtcagggatggagaataggcatggaaaaggcaacaaaatggccaaaatctcaaccccagtctcagtcaagagaarctattcattctggcagccatacaaagtctgcaggactctagaatgacagcctgtttgttaggattaaagcagaaatccagaaataaaggcacatgtaagt

SEQ ID NO: 25032 - DNA, 201 bp, Homo sapiens
tttgtaattcacccctattttcagacgtggccacaaagttgctgtttaatataaccttggatggacgttagcctaactgaaatcttggattcaagatgacraatcacacatgaaagcttcacccaggtgctaaaggaagatgaacttccttattcttgttgatgcctttgatgccagtgaatactgcaaattttccttaat

SEQ ID NO: 25033 - DNA, 201 bp, Homo sapiens
ggacccatatcacacacactgcatgaaagttgcagctcaaaacagtgatgtaagtttgaagacaatggttcatgcctcacagtgacattgtttgagagccrtaacaatcatgatctatttttggtttttctcattatagaaaagttacaaagcagaatatgaagaagataaaggaaaatgctatttccctcagacaataac

SEQ ID NO: 25034 - DNA, 201 bp, Homo sapiens
gctgctcgggaggctgaggcaggagaatggcctgaacccgggaggcggagcttgcagtgagccgagatcgcgctactgcattccagcctgggcaacatagygagactccgtctcaaaaaaaaaaaaaaaagaacagaggaggtatatggtcaagtcgatccaaggctgggggtttattgaatgtgataaaaagacaagggg

SEQ ID NO: 25035 - DNA, 201 bp, Homo sapiens
attcttcaatcttctgatcattctatttgtaatttgtgctattttttcaaaactcttgtcaaaatagaatccctcaaaatttagtgttgttttcttgatayggaaggtcaggtcagaaagcttatttgtgccccatacaaaatctatggcactgctttttaaaaagcaattttgtcagattgcttatgttgaagttaaagt

SEQ ID NO: 25036 - DNA, 201 bp, Homo sapiens
agggttcttccttgcgatgccctaacatccttggacagttaagaaaatacaaaggactttccctctgctgagcctggaagggctaaaatagcctattttasgtcccattggcctatatccctgtggtgtttaccctccttatttcttggaatctattcccagaaaaagtacaaggaagatgctgagaagtccatgtcgtat

SEQ ID NO: 25037 - DNA, 201 bp, Homo sapiens
ttaattattaatagtgtcttctttactctaaatgtcccagtttggataatagattatatgatcactctatgtacaatgcatattctttggcatttgtgttyctactattccccaattcccaaattgattgatgtccaggaataatttggatgtttgcatttgctgttaggttaaataccgagaaaatttcgataaagaaaa

SEQ ID NO: 25038 - DNA, 201 bp, Homo sapiens
ccattgattggaataaagataagaccaagattcatgtgatgcctgatacaccagatattttacaagccaagcagaatcaaacactgtatagtcaggtaaakttatataaaaattaattttaagttttgtattgaaacttatgaacttataaaataatgtaacagtaaatactgatataaatgttgaagcaatggaagtttg

SEQ ID NO: 25039 - DNA, 201 bp, Homo sapiens
acgcagggaggggaacatgtttgacagagccacctcattcccttagggtcctaccatggtgacagatgtgataatagctgccaagtgtcctgcacacaggwtcagtaatgcagatggcctacccaagctctagatgtctcttctgatctcaataatgctgtcactaactttacaaaatgtaccacacaagaatttttgtat

SEQ ID NO: 25040 - DNA, 201 bp, Homo sapiens
cactaccacaccatacccgataatctggagcagcttcacctaaaagaggccacagaattacagagtatagtaagtggatcaagaccgatttttcctctggygcacattcatccacagtacaatgtgaaaaaaaatttcatagattccctccattgtttgagaaaatgcacaaagatataaggggttttgaatctggtaact

SEQ ID NO: 25041 - DNA, 201 bp, Homo sapiens
atataatttttaattatattttataattatacaaaaataatatagcatattgacactagatcgatttttagtcaaaggaattgctctgtgtaaaaactcawattttcttcacagtataaatacaagtacaattatgaaaaagggaaggggaaaatggttggtttccgcagtctcgaggatgatcccaaattagtccattcc

SEQ ID NO: 25042 - DNA, 201 bp, Homo sapiens
tttcttgcatcagcatttctctcagctggctcttgtcaatgattcttttgtgtccttgaattgaatccaaatcctaattatgccttgcagacagtaatggyacccatcccctcaacacctagacaacaacaaaaatgtactggatctgaaacataacaggaaactgttttgagtggcaatgagatgccatccaattgacag

SEQ ID NO: 25043 - DNA, 201 bp, Homo sapiens
agaaattccttaatatactcacatgtacatgcctgtcatgaactctaactgtgcattatttgggcaggttaagtatcgaatggatggtgatgttgctaagrctatatgtcacgtagatgaaaaagcaaaggatattgaacatgcaaagaaagtgtcgcagcaagtcagtaaggtaaggcaatgatatggatggctggggta

SEQ ID NO: 25044 - DNA, 201 bp, Homo sapiens
tcagccccagacccctgggctgaagcaatcctcctacctcagtctccctagtagctaggactacaggagcatgccaccatgactggctaattaaaaaaaaattgtaggatctcctaattattttttcatagaggtagggtcttgctatgttgcccaggatggtcgtaaactcctggccacaggtgatcctcccaccttggc

SEQ ID NO: 25045 - DNA, 201 bp, Homo sapiens
ctcacagggaacatttaatgacttggaggtcctgggaggagcatatttcaaaacaatctctccttggtcacccatcagttttactttctctcccatctctrttcttcatcttccctacctatccagcccatcccattctctcttattatcctgagaactccaaattcttctcccctctattacgctggagtaatttggctc

SEQ ID NO: 25046 - DNA, 201 bp, Homo sapiens
cgtccctaatgatgcattgaaatgctactcagattttagcacattagcaattctaaataacctattaccataaatattccacgttcaagctctttttttttcaaggtgaaatacctctctcatgctttattttctgcatgcagctgtttctctttgagcatgacaaacagtgatatggatggttaatcctgaagcttgttc

SEQ ID NO: 25047 - DNA, 201 bp, Homo sapiens
tgaaaaaagtaaaaacattatccttactaaatattacttactaaaaaactgcctcctcacatataaccccttcccccatttccttccttccttactctctrtgcctgttttaaatgtcctctgggtactttcttgtatctcacaggttttgtacaaagaaaatttggggaaaggaatcccaacacctatcactccagagat

SEQ ID NO: 25048 - DNA, 201 bp, Homo sapiens
taatgttttcccttcccttgagtgctgtatgttttggtgttaaagataagaaaaaggaagcataaagtgttttacatccttttttttttttttttttttttactaagaaatgagccaagtgtttcatctttatccctttcctcatgtgcttggcctaaacgagcctctccttctgttcaccctacagagcagggtgaggct

SEQ ID NO: 25049 - DNA, 201 bp, Homo sapiens
tttacaacctaatagagaccagtaacttttactttttctggtattttcttgaaaatatgtttaagtttgttatagattgtttttcaaacacagttatgttrcttgtaagaacattcagccactgaagcaccaacgaagcattctgctcaaaaacaaaaaaaaagacgccacagtggtagtttactcttctaaaataaatcc

SEQ ID NO: 25050 - DNA, 201 bp, Homo sapiens
ttaatgttttcccttcccttgagtgctgtatgttttggtgttaaagataagaaaaaggaagcataaagtgttttacatccttttttttttttttttttttttactaagaaatgagccaagtgtttcatctttatccctttcctcatgtgcttggcctaaacgagcctctccttctgttcaccctacagagcagggtgaggc

SEQ ID NO: 25051 - DNA, 201 bp, Homo sapiens
ctcaattcacgcctctggccgatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatatga

SEQ ID NO: 25052 - DNA, 201 bp, Homo sapiens
attaccctatagaaatccttatatatgtgtgcaaagatatacatacatacatacatacacacaagaatatgttttgcagtttagggtttctgaaaggagaygctaagatgaaaattggagtacagagtattttttagggatcctagtctttgggaagaaggactaggccggaggagaagttgaacagtgatgctggcatga

SEQ ID NO: 25053 - DNA, 201 bp, Homo sapiens
tattaattaatagcctgttctaatcctccagtctcaccctcaaggttcaacctgatagaatgatgggagctggagaggagagacagcatatttttgagggktgctgtgcaattgattccttctgcaattcagcagtgcctgggtagccccatgggttagaacagaatgttcgtgggagccttggctgagggcccatggctg

SEQ ID NO: 25054 - DNA, 201 bp, Homo sapiens
ttctatttggagaaatgtaatgttggtccttgtttacccatcattgatctcattctgactttgcttttgcagttcaagtacaaagaagcctatgaacacaycaaggcatatgggtatacacttggccccaaagatgttccatttgtccacgtccggagagtcaacaatgttaccagcgaggtacctgaatgctgattctcc

SEQ ID NO: 25055 - DNA, 201 bp, Homo sapiens
gctcaattcacgcctctggccgatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatatg

SEQ ID NO: 25056 - DNA, 201 bp, Homo sapiens
acatgacttcatgtatatttaaaaaggactatatgtctgttttaatttacacagaaaattttaggaggcaaatgctaccttcatgctgtaagataaggggaaaaaacatttttactttccatcttacatcctccctgctgtattgtttgaataagcaacttttccattaaaatttttttgggccaggtgcagtggctcatg

SEQ ID NO: 25057 - DNA, 201 bp, Homo sapiens
agctcaattcacgcctctggccgatcctccagatatagaatttgccaagaaagtaaccaatcaagtgagcaaggtaagtaaatagagctgggacattgccgcctcccttgaagactctgcttaataatttcaaccatcagagagggttactaaaggtgagactgaagataaaacacaaacactaggagtatttttacatat

SEQ ID NO: 25058 - DNA, 201 bp, Homo sapiens
  misc_feature (1)...(201): n = A,T,C or G, or insertion/deletion polymorphism (see Tables 1-2)
ctcgttgactctgcacatcactcaccttctcttaaaggtataccagaaagacattttctttttccttaaagggtattgtggggatgtaggcatatgccagngccttgagacccattagttatgtctgttaacacatttttatgagccatggagggagaattgctctaactcagcttgggctctagctcatggacccaggtt

SEQ ID NO: 25059 - DNA, 201 bp, Homo sapiens
gggcgggatcacctgaggtcacgagttcgagaccagcctggccaacgtggcgaaaccccatctctactaaaatacaaaattagccgggtgaggtggcgcaygcctgtggtcccaggtactcaggaggctgaggcaggagaattgcttgaacctgggaggcggaggttgcagtgagctgagatcacaccattgtactccagc

SEQ ID NO: 25060 - DNA, 201 bp, Homo sapiens
ccctttgaattatatttaaatggaattgggtcattgttattagtatatttgtaaatcctaaattcaagaacaactcttacaatctgaggatccttttgcarctatgtttggttctgcaactcttgcgtttaagcacagattttgattttcttttcaatatcttcacaatgtcacttaatttacaagtacttaaagagattt

SEQ ID NO: 25061 - DNA, 201 bp, Homo sapiens
tattatttcttattttagagactttatagagaagcttgggacaaagacaagactcagatccacatcatgcctgatacacctgacattgttctggctaaagmaaacttaatcaacacaagtgatgtaagttttcaaattcagcatgtgttttcagaaagctcattttaattgtttctaaatcagtgaaattgtctagaagtt

SEQ ID NO: 25062 - DNA, 201 bp, Homo sapiens
acacatgaaaaatatagttatcactagagagtggtttgattaggaagcaggtatattcaaatggtggaaatgtttcttttctttgaagggtagggatgcayaagaataattagctttttaaaaactaccaaaatgatatgggctccaaattaccatgttgtgttcactgagggagccagggaggctgatattctttgggct

SEQ ID NO: 25063 - DNA, 201 bp, Homo sapiens
tagacaatcaaaggattgagtcctttcctatgtgcttctgtttaaaatgtttttcaaaatatgcttttaatctgaatattttgttgatttataattcataycaaaaatttagaattttctaataattcaagtattaaaaatatagagtataatatgaacttttatttaggggcaaatgatttaattatgacaaattatgac

SEQ ID NO: 25064 - DNA, 201 bp, Homo sapiens
tcttttagttcaagtacaaagaaggctatcgtaagcagctcggccaccacattggtgcccgagctatacgtgatgaccccaagatgatgtggtccatgcaygtggccaagatccagagtgacagggagtacaagaaggactttgagaagtggaagaccaagttcagcagcccagtggacatgctgggggtggtgctggcca

SEQ ID NO: 25065 - DNA, 201 bp, Homo sapiens
agtacaagaaggactttgagaagtggaagaccaagttcagcagcccagtggacatgctgggggtggtgctggccaagaagtgccagaccttagtcagcgaygtggactacaagaactacctgcaccagtggacatgcctgcccgaccagagcgacgtcatccatgctcggcaggcctatgacctccagagcgatgtgagta

SEQ ID NO: 25066 - DNA, 201 bp, Homo sapiens
tacaacatgcttcctgatgccatgagctttgaattggccaaaaatatgatgcagattcaaagtgatgtacgtgaaaaccacatttgcagagcgtttactcyggataataagcaaccatgagtgaccataagcaatgacgttttgaaaatcctgaaagaaattcatctgcaatttcccaacatagtgtttcatttgttacct

SEQ ID NO: 25067 - DNA, 201 bp, Homo sapiens
aaccactttgtagtcaggacctctattctaaccccaataacaagatgctgttgtttttctattttattgtttagaaactgtacaaagctggctgggaagargaaaagaagaaaggatatgacctgaggcctgatgccattgcaataaaggctgcaagagcctctagagacattgccagtgatgtaagtgcttgcactgggc

SEQ ID NO: 25068 - DNA, 201 bp, Homo sapiens
tgtgacagaaccacaaaactccacatggttgtgcggtgggggcaagatggtatttggtgctttggtggtagagggttgccgtattcaacaatttttttctyattgtgtatttagtttacttggcccatctttttgttatttcatccattttctaatatccatttaacctcttttaccatggagttgtaaatctcttcctct

SEQ ID NO: 25069 - DNA, 201 bp, Homo sapiens
gcctgaacccgggaggcggagcttgcagtgagccgagatcgcgctactgcattccagcctgggcaacatagcgagactccgtctcaaaaaaaaaaaaaaaagaacagaggaggtatatggtcaagtcgatccaaggctgggggtttattgaatgtgataaaaagacaaggggttgggagttgaagatgctggttaagagaa

SEQ ID NO: 25070 - DNA, 201 bp, Homo sapiens
ctatgaaaagacaaaagcaaagagcataaattactgcgagacccccaaattcaagctcgatactgttctgcagaacttcagtagtgatgtaagcaatcctwctgtcactctttctgttaaaaaaagaacccattatttcaccaattaataaatgaagtatgttttgtcttgcagaaaaaatataaagattcctacttaaaa

SEQ ID NO: 25071 - DNA, 201 bp, Homo sapiens
gaccttcagtggctaaaaggcattggctggatgactagtggttctctcgaggatgagaaaaataaacgagccacccagattttgagtgaccatgtttaccrtcagcacccagatcaatttaagttttccagccttatggattccataccaatggttttggcaaaaaacaatgctattaccatgaatcatgtaagtcctatg

SEQ ID NO: 25072 - DNA, 201 bp, Homo sapiens
ataaagaaaacaaagcaatgttgaaatcttaacaagatgtttactctttcttcatagctccaataccagtgtgaccttaaaaacagtaaaggaaaaattayagttgttcaagacacgccagaaatactgcgtgtaaaagaaaatcagaagaatttcagctcggtatatttactatttattttgcatttaatgctaacctag

SEQ ID NO: 25073 - DNA, 201 bp, Homo sapiens
taagcattaagatcaattaaagctgagttgtactacatctggatttttagttttagtattcatatcttcctataagcttgaaatgcttcattacaagaaaygtttttccaaaagtattatatatttattatagaaaagttggaaaatatagaaaattatgacaaataaatgaaaaccttctgttatccaacagtcaaagca

SEQ ID NO: 25074 - DNA, 201 bp, Homo sapiens
aatgttgaaatcttaacaagatgtttactctttcttcatagctccaataccagtgtgaccttaaaaacagtaaaggaaaaattacagttgttcaagacacrccagaaatactgcgtgtaaaagaaaatcagaagaatttcagctcggtatatttactatttattttgcatttaatgctaacctagtcatttcactctcctc

SEQ ID NO: 25075 - DNA, 201 bp, Homo sapiens
cctggcccacagtgctgtccaataaatactggtagaatgggaacataaatgcatctaccagggcccctcccttatgacagagtaggtatttgtctcgtaawtggaaaacacaaatgatagccttccgttttaaaggagtctctgcttgatgaaatttatattatgtcagctaatgatatgtgcatgctgtctcctttgttt

SEQ ID NO: 25076 - DNA, 201 bp, Homo sapiens
gagactttcaaagatagatcttggccccagaaaccatcatttgccaacaacagaacttaaaagatgggcccctaagtcttcacaggactttctaattgtgyaattattaagagcccgactaagccgttcaatttaaagcatattaggcaaacgagactgggcttgggattaaaggactaacagcctgagagagagagagag

SEQ ID NO: 25077 - DNA, 201 bp, Homo sapiens
tgctgggggtggtgctggccaagaagtgccagaccttagtcagcgatgtggactacaagaactacctgcaccagtggacatgcctgcccgaccagagcgaygtcatccatgctcggcaggcctatgacctccagagcgatgtgagtactgagagtcataataacgtgcagaggtgggaaattatttaacaccccttggaga

SEQ ID NO: 25078 - DNA, 201 bp, Homo sapiens
ctcaagcatagcctaggtggacagtatggatgtaatttagttttgaagtcttcagtggaatcaaaaggaaagcccaatttattgtcaaaagtgacaaaatsctttttagcagcacccatagtgacctggattcccctctgtgttgcataatgcagtctaaagcatgatcatttctattttattaggcttcataatacagta

SEQ ID NO: 25079 - DNA, 201 bp, Homo sapiens
atatatatatatataattttgaaggctaattgtttgtataataagagatttcttataggtataggagggagggagattgcgtatttctcaccttatataastttttcatgaaggtttgtttaaaaaaattaaacaacttgcaattgcttaaaacctgtgtttgctgtggtgctatcagtgaggaaagagtatgtgagctaa

SEQ ID NO: 25080 - DNA, 201 bp, Homo sapiens
actctttgaagtgcagctttgactcgagcattttccaggttggaattagagtaccacagacttccattaagttggaaataaggatgaaatggaacataacrccagttagaaggaaagcaaaaatcgaagagctgttactatatctcaccaaagaaatatataaaataaccttaatgtctggagtaaggaagctggtcagaa

SEQ ID NO: 25081 - DNA, 201 bp, Homo sapiens
taattttatttctaccttgtatacaagagagatgactggcacataatcaaaacaataatatctgtgaacaccaaaataatttttctctctctctctctctyttttttttttttttgtagcgcttatatactgaagcctgggacaatgacaagaaaactattcatgtcatgcctgatacaccagaaatcatgttagccaaac

SEQ ID NO: 25082 - DNA, 201 bp, Homo sapiens
cccaaagatgttccatttgtccacgtccggagagtcaacaatgttaccagcgaggtacctgaatgctgattctccaagagacatattgagtttcaatagcyatggctttgtttgaaatgcattaagaattaatcttatttcagttgtaaacttacataccagcaaaaaatgaaaaaggtccttattgtcacattttgatac

SEQ ID NO: 25083 - DNA, 201 bp, Homo sapiens
cccctaaaacttctacttggttttcctagttttgcatgtgggggaggttattatcctccagaaacataagaataaatgagctcccttttaaaataacaacsctaaaatttctaaagctgaccaccaggtcttctcttgacattcctttcatgagaatgaacaacttcattgtctctagttggtcctcacataccatggttt

SEQ ID NO: 25084 - DNA, 201 bp, Homo sapiens
agacatcaccagtgatgtaagcatctcgtaggggtctttctggagtagtcttaccaagacgcaggcttgctttcagcagttaaaacaaccagtggtctttraacagccttttctgataagcacttctaaacaaagagtacaagttggaggtaagacagtgtgggagaaggatgccacaattctacagctatggaaacagta

SEQ ID NO: 25085 - DNA, 201 bp, Homo sapiens
  misc_feature (1)...(201): n = A,T,C or G, or insertion/deletion polymorphism (see Tables 1-2)
tccccctcactttgttatccagagccagttagtgtttaccccctcctggctctgggtctccctttgaatatccaaggacttattaaattctactatcattnatattaacatcctaccactactactaaaaattctaaaactaattaaatatccagctacttgtactctagtagcacaatgtaattggtagagattgtgaca

SEQ ID NO: 25086 - DNA, 201 bp, Homo sapiens
atgcccccatcaccagcctccagggctaggcagaagggatcttagcctgcagctacttttaaggggaaatttatcattaactcacttgagcagattatcaytttaatgtgatctgtgcctcctatgaaaggtgctgagcttagttaaatgacaattgtttttgctcctgcctgggaagacatccaggacacatgaaagccc

SEQ ID NO: 25087 - DNA, 201 bp, Homo sapiens
tgcccccatcaccagcctccagggctaggcagaagggatcttagcctgcagctacttttaaggggaaatttatcattaactcacttgagcagattatcacyttaatgtgatctgtgcctcctatgaaaggtgctgagcttagttaaatgacaattgtttttgctcctgcctgggaagacatccaggacacatgaaagccct

SEQ ID NO: 25088 - DNA, 201 bp, Homo sapiens
catgaattttgggaaagggggaaggggaagatgtagatttgttcattgcccagtcagtgcctctgaggacagtcccctgggctgtgcactgcacaaacctsggggtggggctgggggtaccattcacattgtttaatataaaatccatctttagtagtaacttctggcaatgaaaacatatttcagacaaatataaatcat

SEQ ID NO: 25089 - DNA, 201 bp, Homo sapiens
cttacaatgcactttataaatccaacttactattaatgtctattttagaaattgtataagcttggcctagaagaagccaagaggaaaggttatgacatgcrggtagatgccattcctatcaaggcagccaaggcctccagagatattgcaagtgaagtaagtatacttggaaagttatttgccttagctttggctcaaaga

SEQ ID NO: 25090 - DNA, 201 bp, Homo sapiens
caggcctatgacctccagagcgatgtgagtactgagagtcataataacgtgcagaggtgggaaattatttaacaccccttggagaaaatggcaatatatgrcacaagctcaccagcccctggaggaggcaaatagcattgcctttatcgacaggaattttaatcctttaacccttcagaccaaagaggaatattgtgtgat

SEQ ID NO: 25091 - DNA, 201 bp, Homo sapiens
tctacaaaatatacgtaaattagccaggcatggtggtgtacaacctgtagtcccacctacttgggaggctgaggtgggaagatcgatggagcctgggaggyggaggttgcagtgagctatgactgtgccttgcagtccagcctgggcaacagagtgaaaccctgtctcaaaacaaacaaacgaatatgtgttagttctatg

SEQ ID NO: 25092 - DNA, 201 bp, Homo sapiens
gtgaccttgaatgcctacagatatttgcacatgaatatgcaaatgcacaaagagtgtccttcctaaaaccacctctgtgaaatatgatccattaggaaatwattttctggtgccattaaattttctttctactttatttgtttgtttatgcatttttttctctttcagatcgcttacaaagccaaaggagaggaaattatt

SEQ ID NO: 25093 - DNA, 201 bp, Homo sapiens
aaagccaaaggagaggaaattattcacaattacaacctgccaccagacctgccccagttcatccaggctaaagttaatgcctacaatatcagtgaggtgcrtgggtggactcacgggctgatgcgtatgtccagactttactaacacagtctctaagttgtacttaaatgacatttttctttcagaatatgtacaaagcag

SEQ ID NO: 25094 - DNA, 201 bp, Homo sapiens
gttttcatgagggagagattagatctgaaaaacagagaggcttgtgagaaggtagaatccggtacagtcaaagaaccaaccttcctggatatatgtatgtsaatctgtttatcctagtcaaacgacctgctgggcataaagacattggagtatacaggaaagggctgcagtctaaataggggcccccatccctgccccaaa

SEQ ID NO: 25095 - DNA, 201 bp, Homo sapiens
gacctcaagccacagatcctctgctccttctgtctaggttttatacaagcagaactgggaagacaccaaggataagtacctgcttcctcctgatgcccctsaacttgtccaggccgttaagaacaccgccatgttcagcaaggtaagggtctgctccattgccacttctgtcttcctatgtcatcccatcatatatttcat

SEQ ID NO: 25096 - DNA, 201 bp, Homo sapiens
taagtggttacagaaaatgcataatttagtgcccagttttcaaagtagtaaaaatttttactattttggaaaagacaacataaatattcatggaattttcycccctgttccttgaatgttatatttgagagctagattgtttttatgagtttcccccaaatagcccacatgtggctgctatctaaaggatttacggtcatt

SEQ ID NO: 25097 - DNA, 201 bp, Homo sapiens
cagaactgggaagacaccaaggataagtacctgcttcctcctgatgcccctgaacttgtccaggccgttaagaacaccgccatgttcagcaaggtaagggyctgctccattgccacttctgtcttcctatgtcatcccatcatatatttcatgtaatacttggtgaactcttgatcatctggaatacaattccccaatctt

SEQ ID NO: 25098 - DNA, 201 bp, Homo sapiens
gtctctaagttgtacttaaatgacatttttctttcagaatatgtacaaagcagacttgaaagacttgagcaagaagggatatgacctgagaactgatgcgmttcccatcagagctgccaaagctgccaggcaggcggcgagtgacgtaagtccagctgtggtcatacatgggcaactagaaaatgtgggtgggtgggcttg

SEQ ID NO: 25099 - DNA, 201 bp, Homo sapiens
caagcaatctattcattaagtacaagtctactgcaggcctactatatttgaggcaccaaagctagatgcaacaaaatggttagatttttctcattggtaartttatttattaatgcattttaggcatgcactaagtggttacagaaaatgcataatttagtgcccagttttcaaagtagtaaaaatttttactattttgga

SEQ ID NO: 25100 - DNA, 201 bp, Homo sapiens
ctgatgcgattcccatcagagctgccaaagctgccaggcaggcggcgagtgacgtaagtccagctgtggtcatacatgggcaactagaaaatgtgggtggrtgggcttggggtctgacgatgacccaaaagtctccatgcatgcagtccccaattggaagcaaatctgattgaaaactatttaggaaataaagttccctaa

SEQ ID NO: 25101 - DNA, 201 bp, Homo sapiens
gcaggagaatcttttgaacccagggggcggaggttgcagtgagctgagattgcaccactgcactccagcttgggcaacaggagcaaaactccgtttcaaawaataataataataataataataataataataattttggccaggcacagtggctcatgcctgtaatcccagcactttaggaggtcatggcaggcagatggc

SEQ ID NO: 25102 - DNA, 201 bp, Homo sapiens
cttattcatctataaaatgaggagagtaataagaacttttctatctacctcacaagggagagttgtattcagttacatcaataaatatgaaaaattagtckgaactatagagctctatacaaatataatttttaattatattttataattatacaaaaataatatagcatattgacactagatcgatttttagtcaaagga

SEQ ID NO: 25103 - DNA, 201 bp, Homo sapiens
ttggctgagggcccatggctgtcatgatgcctctacttctgctggcctcacttagcacagatgcaccctgaattatcccaagccatttattggaaatgcaycttcacacacgcactactgaggtgtggtgatagtattgtcttccttctgctatgtttcactgcagaagatataacatcaccatgtgttcctttgaaaata

SEQ ID NO: 25104 - DNA, 201 bp, Homo sapiens
gattagtcagtagatgccctcgtcgtcccctactaaatgcctgtaatgatatttcctccaacgtagagactgtatcgggaattgtaccacaaactgaaagwcaagatccatacaactcccgatacccctgagatccgccaagtcaagaagacacaagaggctgtcagtgaggtgggtattttcttaggaaagacagggagt

SEQ ID NO: 25105 - DNA, 201 bp, Homo sapiens
gctctcaacatgaataaggtgagtcctagctgccttaagcttctccaagatgccagaagatgttattatactttaatgactaatggagtctaaattatctrtgaaggcgtggggtcgcatttttaccttttaaattacatgcttgaaatcctctaaataattttgattattccaagtttcaatcttgataactagtaataa

SEQ ID NO: 25106 - DNA, 201 bp, Homo sapiens
  misc_feature (1)...(201): n = A,T,C or G, or insertion/deletion polymorphism (see Tables 1-2)
ggtctcctttataatccaataaattaatagcattagaagactattacaaatttcccgtggatgttttagcatcagttatgctttgagattctcacagcctnagttggtaaagctgtagctgatcagtaccctattttaaatataccgttagatgccataaaacctaatgttgttaatggcatcatatgcaaagatggaaaa

SEQ ID NO: 25107 - DNA, 201 bp, Homo sapiens
ctattttcttaaggattttttctccttctattttaacacacaagacttgttggtattaaagataataagatgcttgttttatttaaaaaaataggaaaatkcctttgatgatttttaacactagaaaatcatgggtgattgtgctaaaaataactctttaaagcaaacaattaatagattttcctttttgcactatgtgaa

SEQ ID NO: 25108 - DNA, 201 bp, Homo sapiens
aattaatagattttcctttttgcactatgtgaaatgcattttattgcagatcttatacaaggctaaaggagaagatgtgaaacataaatacaccatgagtmctgatcttcctcagtttctccaggccaagtgcaatgcttacaatataagtgacgtaagtagggtctttgctgggatgtgaaattcggacctgacaataaa

SEQ ID NO: 25109 - DNA, 201 bp, Homo sapiens
gatgtgaaacataaatacaccatgagtcctgatcttcctcagtttctccaggccaagtgcaatgcttacaatataagtgacgtaagtagggtctttgctgkgatgtgaaattcggacctgacaataaaattatagactttaagagtaggatggtgccttgacaatttatttaggcccatttctcacaaatcccctactgga

SEQ ID NO: 25110 - DNA, 201 bp, Homo sapiens
acatgaataaggtgagtcctagctgccttaagcttctccaagatgccagaagatgttattatactttaatgactaatggagtctaaattatctatgaaggygtggggtcgcatttttaccttttaaattacatgcttgaaatcctctaaataattttgattattccaagtttcaatcttgataactagtaataagactcac

SEQ ID NO: 25111 - DNA, 201 bp, Homo sapiens
ctgattttaaaaactacttttatgatttaaaataatacatattaatcctactttttaaagacaacttaaattttgtgaaatttctttagcaaatttacccytttttcctttgggctacttctagcctaaccccataataacaaggttgctttaatccataaagttctaatatcaagaagtaacagattttcctataaaaca

SEQ ID NO: 25112 - DNA, 201 bp, Homo sapiens
ataataggttaatatatcactatatattaatgttcattgatatatcccatttatttctaacgctatatagtatttttggtagaatataatttatttgcttkccactattgccagaaacttgaattgtctccagttcctatccttttttaaattttaggatataagtcacttaataatctctgaattgttgatgtcaaacct

SEQ ID NO: 25113 - DNA, 201 bp, Homo sapiens
ttttatgatttaaaataatacatattaatcctactttttaaagacaacttaaattttgtgaaatttctttagcaaatttacccttttttcctttgggctayttctagcctaaccccataataacaaggttgctttaatccataaagttctaatatcaagaagtaacagattttcctataaaacatccttttgcttctctct

SEQ ID NO: 25114 - DNA, 201 bp, Homo sapiens
tattaatgttcattgatatatcccatttatttctaacgctatatagtatttttggtagaatataatttatttgctttccactattgccagaaacttgaatkgtctccagttcctatccttttttaaattttaggatataagtcacttaataatctctgaattgttgatgtcaaaccttttgctttaactctttgcctttct

SEQ ID NO: 25115 - DNA, 201 bp, Homo sapiens
aattttgtgaaatttctttagcaaatttacccttttttcctttgggctacttctagcctaaccccataataacaaggttgctttaatccataaagttctamtatcaagaagtaacagattttcctataaaacatccttttgcttctctctctccaaacttactctctatccactacccccaaggtctctttgttttagata

SEQ ID NO: 25116 - DNA, 201 bp, Homo sapiens
  misc_feature (1)...(201): n = A,T,C or G, or insertion/deletion polymorphism (see Tables 1-2)
gtctggaaaagaacaaaacaatcccagcagttgaggaatcacttacagatgctgacattctgtttgcttttctgtccaggtctgttataaacgggattggnatgacttaatagccaagggcaacaatgtgctgggcgatgctattcccatcactgcagccaaggcatcgagaaacattgccagtgatgtgagtacaaattt

SEQ ID NO: 25117 - DNA, 201 bp, Homo sapiens
cagctgcaaagatggcccaggatgtcgctaccaatgtcaactacaaacagccattgcatcattacacatacctacctgacgccatgagtcttgagcatacsaggaatgtcaatcaaattcagagtgatgtaagtatgtgtaacaacagacccagagatgtttgcacttaaaggatgatcacttctcgcttttattagactt

SEQ ID NO: 25118 - DNA, 201 bp, Homo sapiens
acttccatggaacatttgtgttttgtcttctgtgcatgtctgtcctgccacagaaattgaacagtggtggtgctttctcaattcacagaagaagtcaaaamagttttgcagttttgactcctaaatctttggtacctgctaccctcatgtcctcgaacaacttgcagcagttgatgaaataatagggagcaaatcaacatt

SEQ ID NO: 25119 - DNA, 201 bp, Homo sapiens
gatcagcaacacccatctctactaaagaatacaaaaattagctgggcatggtggcacacacctgtaatcccagctactcgggtggctgaggcacgagaatygcttgaacctgggaggcagtgagccgagattgtgccactgcactccagcctgggcgacagagtgagactgtctcaaaaaacaaaaaacaacaataaaaaa

SEQ ID NO: 25120 - DNA, 201 bp, Homo sapiens
taagtcattaaaaatattaaaaaatattaaatgcatctgtagcatatttaaaatccagatactagtccggtatccttaattcaatctaatttgagaatggrgtataaaaatgaagtttaattatttgtatcacactttttagggattttccttatgtttaagattttgtctttacacaggctcagcaatgaaaagtacact

SEQ ID NO: 25121 - DNA, 201 bp, Homo sapiens
tgcacctttccagggcagagagagtaaaggggcagaaaaggcctcagttaaaataactgagctttgtctatagaaagaaaaccttaggcataaggaagaaktgttctctatcaacaacattgattactgacttttttaaaagtaaaatgcaattttatagacacgtggtttattaatatgatacaaccaaaatttagaaag

SEQ ID NO: 25122 - DNA, 201 bp, Homo sapiens
attacattttatgggattccactggcaaactgaagtcacaatgtcttttctgttcgtggtgatttccagtgagtcagtgggactgagtagtattttagacwcttcagaggattgtcagataaaatactggcccattatttctgccaaaatattcatgcccactaattccatccctaccaattagatacatcagtaaatcac

SEQ ID NO: 25123 - DNA, 201 bp, Homo sapiens
gagatgagacgggtgagggagacccaacggcacatctcaacggtgagtcaggaattctttaggattggctggctgcctgtcagaatgtgtaaaaagggatwtagtcacaccatcatattttcataaagcaaattcatgacatttcaggtgaaatatcatgaagactttgagaaacacaagggttgcttcacaccagtggtg

SEQ ID NO: 25124 - DNA, 201 bp, Homo sapiens; identical to SEQ ID NO: 5828

SEQ ID NO: 25125 - DNA, 201 bp, Homo sapiens
cctgttctgactttgctgtcttgctgcgtactctaggcggaatacctcaaaggccaaaggagagggcacggcgctgcatcttatgacacccctatgatgargcatcttaagaaaattaatgtacacatcagtgatgtaagaaagactgagaccagcaagccattatttctgtcttcctctgattcttgtctactttcttgg

SEQ ID NO: 25126 - DNA, 201 bp, Homo sapiens
caggcagaatggggagtctgtattctctgttccttgcagtccgttgttatacatatcatcataaggtggcttatattgctcttcccagtgtggacaggcaytctttgcaggcagaggcaattcttattgaatctacagtgcttatctagaatcgtgcctgacacatagtagacactcaatgaaattttggatcagtgagca

SEQ ID NO: 25127 - DNA, 201 bp, Homo sapiens
  misc_feature (1)...(201): n = A,T,C or G, or insertion/deletion polymorphism (see Tables 1-2)
ggagaaggtcaagaaagcaggcgatgcattaaatgagaggaagtatcgacagcacccagataccgtcaagttcacaagtgtgcctgattccatgggcatgntgttggctcagcataacacaaagcagctaagtgatgtgagtgctttcctttcaaaatgatttgcccgtaaataaccacacgtgtctgagccgctcctccg

SEQ ID NO: 25128 - DNA, 201 bp, Homo sapiens
tagttggctttttatgccatttaccctaccttgaatatacatattattgtattaaaaaataggcagatagaaaggtagatagattagacagacagatagayagacagacacaaaaatatcttcatttcaggagggaaaaaatatctcaagtcaactattaatgactaaaacataattttcattaaaaataattcttgctat

SEQ ID NO: 25129 - DNA, 201 bp, Homo sapiens
atatgtttaagtttgttatagattgtttttcaaacacagttatgttacttgtaagaacattcagccactgaagcaccaacgaagcattctgctcaaaaacaaaaaaaaagacgccacagtggtagtttactcttctaaaataaatccaggctttcatatttagaagaaaactcttccctttgcctctctttacagaaactc

SEQ ID NO: 25130 - DNA, 201 bp, Homo sapiens
catctgctctaaatatcacactacatttactgtagccattaactatttttaagctttcttcttgagaggtgttctcactaatagtaatagattaaacatarcatttccccccaacttgcaatataattaatagtgattattacctcgtagtgactttcgggcatgactttgtatctcacaggtgttatacaaagagaacct

SEQ ID NO: 25131 - DNA, 201 bp, Homo sapiens
gcaagacaaaataaaataaattatagtgaggtaagatcatttgttttatttctttggtctggccacattgattgttgccgatgtaggaatgtgagaattaygaaattaatcctcatgtaagccagttagcttagttggctttttatgccatttaccctaccttgaatatacatattattgtattaaaaaataggcagatag

SEQ ID NO: 25132 - DNA, 201 bp, Homo sapiens
atgtaagtggatgttttggaaaagccatttcttattcaaagatgttgacaaatagaagcttttagagtttttcttgctagaaatttagttacccctataartctcaattccctttagtgattttcccctatacaaaattgtaaatggaaaaaaagaaaagcacaaaattctagacccattatacccatcaatcaatcaaaa

SEQ ID NO: 25133 - DNA, 201 bp, Homo sapiens
acgtgtctggcgtactaatcctggttcggtttttgactatgatccagcagaagacaacatccagtcccgaagcttacacatgattaatggtgtgttagctraaaaaggcttacaacataaacatcaccatttagtatgctagagtcaatgactttcatttgggctctgaagttccttccctccagagttttccattttctg

SEQ ID NO: 25134 - DNA, 201 bp, Homo sapiens
tatgtttaagtttgttatagattgtttttcaaacacagttatgttacttgtaagaacattcagccactgaagcaccaacgaagcattctgctcaaaaacaaaaaaaaagacgccacagtggtagtttactcttctaaaataaatccaggctttcatatttagaagaaaactcttccctttgcctctctttacagaaactct

SEQ ID NO: 25135 - DNA, 201 bp, Homo sapiens
gggcatcggatggatccctattggttccctggaggtggagaaggtcaagaaagcaggcgatgcattaaatgagaggaagtatcgacagcacccagataccrtcaagttcacaagtgtgcctgattccatgggcatgatgttggctcagcataacacaaagcagctaagtgatgtgagtgctttcctttcaaaatgatttgc

SEQ ID NO: 25136 - DNA, 201 bp, Homo sapiens
ttacactgtgtgtctcataattgaaacttttctcatcagtaaatgactgacagaataatttctcagggcagcattaagagaaatgttctgtttttttgcctttttttttttcatcttctgtgttctttttacctactaaaggcctctttagcactaacagcaaagtacatgcataagtcagtgtgatgcatcatcacaaaa

SEQ ID NO: 25137 - DNA, 201 bp, Homo sapiens
ataaagacgagtataacagcttcttgaagggcatcggatggatccctattggttccctggaggtggagaaggtcaagaaagcaggcgatgcattaaatgasaggaagtatcgacagcacccagataccgtcaagttcacaagtgtgcctgattccatgggcatgatgttggctcagcataacacaaagcagctaagtgatg

SEQ ID NO: 25138 - DNA, 201 bp, Homo sapiens
ctgagaggcataggatgggttcccattggctctgtagaggtcgagaaagtgaagagagctggagaaatcctgagtgacaggaagtatcgccagcctgcagrccagctcaaattcacatgcattaccgacactccggaaattgtcctagcaaagaataatgccctgacaatgagcaaggtgagtctccagctgttttctgtt

SEQ ID NO: 25139 - DNA, 201 bp, Homo sapiens
attcaatcctttggtggttgttaaaattcatgccttggttttcaagttattggaaaactccaagaacacttgttctgatcactggtttccctttcaggttyacgtgtctggcgtactaatcctggttcggtttttgactatgatccagcagaagacaacatccagtcccgaagcttacacatgattaatggtgtgttagct

SEQ ID NO: 25140 - DNA, 201 bp, Homo sapiens
agccaaagtcaacgccctcaacatgagtgatgtgagtatttggcccagtgctaatattgcgtatgcgggcctctcctttctggttctttgcaactcttgcyctgagaattgtagggggcgcaattcagtgtggaccctgagcctccacattaaacccttaaccatgcaacatgagcctagggggcggcaataaaattttgc

SEQ ID NO: 25141 - DNA, 201 bp, Homo sapiens
ataaaaactttattaataacaaaaattttattaagtaatacagtattgtcttggtttgcttattaattttaagcaaaaactctaataaaagggaataatayagattttatatcaaatttgagtaacttacgtgaaaagattccagaaatctttgccctaacatgaaagggttttggatcaaatccaaaagaaaatttaaaa

SEQ ID NO: 25142 - DNA, 201 bp, Homo sapiens
agaagacaacatccagtcccgaagcttacacatgattaatggtgtgttagctgaaaaaggcttacaacataaacatcaccatttagtatgctagagtcaakgactttcatttgggctctgaagttccttccctccagagttttccattttctgagctgcccatttggcataaaaataccttgttaactagtgagcaaaact

SEQ ID NO: 25143 - DNA, 201 bp, Homo sapiens
  misc_feature (1)...(201): n = A,T,C or G, or insertion/deletion polymorphism (see Tables 1-2)
gtcctttaggctgaaaacttaatgttaagagttaaggaggctcagagagtggaggttccttaatgttttcattaaaatgcatagtccttagatactactantaaaaaatatggacttctcccaattcagaaaacactagtttacttgatccagcaattagcagtaaaaatttcaggtaaagatgctcttcctgaaaaataa

SEQ ID NO: 25144 - DNA, 201 bp, Homo sapiens
aattttattgccctgaatcttggacagagttacagctgttgaagatctcagggcttcaggggttctacagcactgttatattttaactgtgtttttaaagscattacagatattttgaaatgtatagaagaatacatcgcagggaataagaatccaaaacaatccaaccactagaaaaacccactcttattcatgtaattt

SEQ ID NO: 25145 - DNA, 201 bp, Homo sapiens
tacactgtgtgtctcataattgaaacttttctcatcagtaaatgactgacagaataatttctcagggcagcattaagagaaatgttctgtttttttgcctttttttttttcatcttctgtgttctttttacctactaaaggcctctttagcactaacagcaaagtacatgcataagtcagtgtgatgcatcatcacaaaat

SEQ ID NO: 25146 - DNA, 201 bp, Homo sapiens
gccacaactgtatgctttgtggagcaggttctgtgtctgtttatctctgtgttcattgtgcttgataccaagcaggaaatcaatagaaaattgttgaaaawaaattgcatcaaacagccaggtgtgatgacatgcacctgtagtcccagctactcaggaagctgaggcaggaggatcccttgagctctgaagtttgaatcc

SEQ ID NO: 25147 - DNA, 201 bp, Homo sapiens
  misc_feature (1)...(201): n = A,T,C or G, or insertion/deletion polymorphism (see Tables 1-2)
gaccccctacattgcacacagtcagaaaatgcaggatctttttagcccagtaagtttcaaacaacttctgctaacctggcttgattattaagaaattactnatctcaactcactctgttttggatgctggctggatttgtttctcaaacctgtatgaaacaaaaacttattttgcaaattataggctcttgtgactgttga

SEQ ID NO: 25148 - DNA, 201 bp, Homo sapiens
attccattattccatttttaatgatctccagggcaggtctcaagatgagccattaaaaatattttgctaattgtttattttaaaatacaaaaaaaaacttygatgttacctagattcagactgaagttggcttttgcttaatttgttgtataaattcagtttatatcagacttctatgctagccaacttctgtttgccctt

SEQ ID NO: 25149 - DNA, 201 bp, Homo sapiens
ccgatgccttgaatgtggagcactccaggaatgccatgcagattcagagtgatgtatgtactggttaccaagttgttatccatttctaatgggtgggaggraaaaacaggagccacttactccatcccacacctggctgcactcactgtaattaaggattccctccagaactcagagttttaggatttcactcatttgaac

SEQ ID NO: 25150 - DNA, 201 bp, Homo sapiens
aacaaaacacaaaccctgcttctacctgtgttttctttttcaggccctctacaaggctgacttggagtggttgcgtggcattggctggatgccccaagggwctcctgaagtgttgagagtcaaaaacgcccagaatatcttttgtgacagtgtctatcggacgcctgtggtgaaccttaagtacacaagcattgttgacac

SEQ ID NO: 25151 - DNA, 201 bp, Homo sapiens; identical to SEQ ID NO: 5870

SEQ ID NO: 25152 - DNA, 201 bp, Homo sapiens
cagtggacctgcatgcccgaccagaacgatgtgattcaggccaagaaggcctacgaactgcagagcgatgtgagtgggctgcatttggggttgaactcttwtctcagtttgccatgacttccagagagtttatgacactaaccccttctgtcatcattttacgacttcatatcaccaagaatttaatattagtgagacctt

SEQ ID NO: 25153 - DNA, 201 bp, Homo sapiens
aacagaacagtcttataattcatgacattccgtgttcgattgtcaggtttttttctttttgttttgttttgttttgttttgttttgagacggagtctcgcrttgtcgcccgggctggagtgcaatggcgccatctcggctcactgcaacctccgcctcccgggttcaagcaattctcctgcctcagcctcccaagtagctg

SEQ ID NO: 25154 - DNA, 201 bp, Homo sapiens
atttttataattaatttcttctgaaagactgtagggagtaaaaagcagattattctccccctcccagcttctctttttctttttgattgtaagtaaatcayatagccaaagaaacacaagccctgactctttctgaaatgaaattttttttctcattgtaaagaatctgtacaaatctgacttcaccaattggatgaaagg

SEQ ID NO: 25155 - DNA, 201 bp, Homo sapiens
ggtcactaaagagagcataaacttcgaagccaaacacacttggttctaaccctggccttggctatgctggagaaagcaggattacatcacttagaaggctrttacagcatccacgtgtaagacggtgttttggaccaggagggtagcagggcaggtgataagaagtcttttgaaagcacagctgacttgatttgctgatgg

SEQ ID NO: 25156 - DNA, 201 bp, Homo sapiens
aggtgggaggttcatctgaaccctaggaagtcaaggctgcagtgagccgtgattgtgccactgtactccagcctaggcaacaggagtgagaccctgtttcaaaaaaaaaaaaaaaaaaaaggaagaaagaaatcttattttgatacttattcaaaacaagccatttcatgaatagaaatccaggccttctgattttttttt

SEQ ID NO: 25157 - DNA, 201 bp, Homo sapiens
attaactttattaagatattaatgagaatgacttccattttggaagaaatcaaacaccccatttgaatgctaaccaaactatacagcattttctttacaartgtatcaccattactgtaatcttgattaaacccacaatttaaaactgctgccgttatttagaaagcacaactttagcagaatatttgtatgtgattttat

SEQ ID NO: 25158 - DNA, 201 bp, Homo sapiens
  misc_feature (1)...(201): n = A,T,C or G, or insertion/deletion polymorphism (see Tables 1-2)
taaggatattgagatgtgtatacataggaaccctcattctctgttagtgaaacataaaatagtgtaaggattttgactggcaacttgacaatatctatcanttttcaaaatgtgcatatatcttctgcctcagtatttctatttctagaaatttaccttacagatacatttcatataagtatacaaaggtaatgtacaggg

SEQ ID NO: 25159 - DNA, 201 bp, Homo sapiens
gctctcaaaaaaccaagttggagtaaaggcaggttttaattcgtcttctaaaactgctttcttccccacttcccaaccccgatgttcaaagggacagagaygaagagaaagttctgaaaatggaactctgtctcttagtatctgtatagcaatagaagaaaagatctactccttattctttgcttcaactagctaatcatc

SEQ ID NO: 25160 - DNA, 201 bp, Homo sapiens
attgtgtacctttgccactggaaattgtccttagtgctagacttgattgattcaactagatgtcataaaaaaggaggtggctatttttagacatcccatcsctaccattttgttcccattacagcatctgggtctgaccagcaggtgataaacgaatagactgcctgccagaaagtattgaactgagatctctttgacctc

SEQ ID NO: 25161 - DNA, 201 bp, Homo sapiens
  misc_feature (1)...(201): n = A,T,C or G, or insertion/deletion polymorphism (see Tables 1-2)
gatcttggacatctgaaataaagttttactgttctctctactctaacttaaacttgaaaagaaagagagagaagcaaggatgcactatctaattagtggcncagctctaaaaaaagagtgagatttggcatacaagttaatgccaaccatttaaataatgttgcctcttttataagcgtatttctaagatggatttaccaa

SEQ ID NO: 25162 - DNA, 201 bp, Homo sapiens
aaggactatgatctgagagcagatgctatttccatcaaaagtgccaaggcctccagggacatcgccagtgacgtgagtaccttccatctaactctctgtgrtctccactgtgctgaacaacccagagggtggctggtgaaccacacactctatagtgatttccacatgtaccttccagtcctacttcctacctctcaagac

SEQ ID NO: 25163 - DNA, 201 bp, Homo sapiens
catattagcaccactctgtttaggacaatcacactattgaaagggactcacccatcactccagaagaaacttattacttactaatcaggagggtataggartaattgagatgtggatatactttgggatcttattatttccatgatgcaatccatttaaaaatgtattcacactcgagtttctgttttagtttattgttag

SEQ ID NO: 25164 - DNA, 201 bp, Homo sapiens
  misc_feature (1)...(201): n = A,T,C or G, or insertion/deletion polymorphism (see Tables 1-2)
ttgtgattggcatagggacaagcagttttactgtgtggagttataacttgtaggacaccatctctgccaccagggatggtgtctccagggcttcgtccctnatgatgcattgaaatgctactcagattttagcacattagcaattctaaataacctattaccataaatattccacgttcaagctctttttttttcaaggtg

SEQ ID NO: 25165 - DNA, 201 bp, Homo sapiens
acctactacgtagataggactgttgtgaggataattaccccattatgttgtcatcattattcttgtccacctaagcatttattagtgtaaatggcactccrgttcacattaattaactgactaagccaagggaatgaaaatctcttataatattgatgcgattcatttttttaaagttcattattctttgtctcctactac

SEQ ID NO: 25166 - DNA, 201 bp, Homo sapiens
gaaatcataaatacagatttaatttaggccagttcacagaagctacttaacatatttaaacaatgtcagcagaatagcttcttagtagactagctaacagyatataaaaaggtatgtaaagaggtgtatagtgaagaagaacatttattttaaaaatccaagatcagactaagaactcatttgaaattgaggatctgaatg

SEQ ID NO: 25167 - DNA, 201 bp, Homo sapiens
tgcccatagagtccctggaggtggagaaggcaaagaaagcaggagagattcttagtgagaagaagtatcgccagcaccccgagaagctgaagttcacttaygccatggacacaatggaacaggcacttaacaagagtaacaaactgaacatggacaaggtaaggactcacctgccagcctcgcccagggaaccctcatggt

SEQ ID NO: 25168 - DNA, 201 bp, Homo sapiens
gtactttgttctcttttaccattttcatcaccataatttcttctctgtccacagtacaaatacaagaaagcctatgaacaagccaaagggaaacacattgscttccggagcctggaagatgaccccaagctggtgcacttcatgcaagtggccaagatgcagtcagaccgggaatacaagaagggatatgagaaatccaag

SEQ ID NO: 25169 - DNA, 201 bp, Homo sapiens
tcttcagtgaggtattccaagattttaccctgacattcagtacatttcccaagaaagtgacaaaatgcacaagctaaaatatagtcatctaatatcagcartcttaaccatttcaattgctgtgatttaaactgagcatatatatttttcaaaatgtactgtcgctatcacattatgggaccacatccataatataatatc

SEQ ID NO: 25170 - DNA, 201 bp, Homo sapiens
atggatgtgtcatcctgaccagaacgatgttattcaggcaagaaaggcctatgacctacagagtgatgtaagtgatttttgtttcttcattatctagaaaygcatggtacactctgagaatgatgagcaacatcccagatccacaagtgcttgaaatttgaggccatcgatatttaatttgttcccaaagggaattgaggc

SEQ ID NO: 25171 - DNA, 201 bp, Homo sapiens
aaggcctatgacctacagagtgatgtaagtgatttttgtttcttcattatctagaaacgcatggtacactctgagaatgatgagcaacatcccagatccayaagtgcttgaaatttgaggccatcgatatttaatttgttcccaaagggaattgaggctggatatgaagaaagatcaggagcagtgatggattgattggtt

SEQ ID NO: 25172 - DNA, 201 bp, Homo sapiens
ccccggtggacatgctcagtgtggtggcagccaagaagtctcaggaagtggccaccaatgccaactacaggaacgtgatccatacctacaacatgcttccygatgccatgagctttgaattggccaaaaatatgatgcagattcaaagtgatgtacgtgaaaaccacatttgcagagcgtttactctggataataagcaac

SEQ ID NO: 25173 - DNA, 201 bp, Homo sapiens
tggatggctccctctgggctccctggaagcagagaaaaacaagaaagccatggagattattagtgaaaagaagtaccgccagcacccagacactttgaagyattccacactcatggactcgatgaacatggttttggcccagaataatgcaaaaattatgaacgaagtaagtctttcaataatgcagtgtttcatatgcat

SEQ ID NO: 25174 - DNA, 201 bp, Homo sapiens
gcctgaacattttctatttaccaatgcatatgacactgactgtgcacatgtaaagaagctacatattatttcagctataatgctttattttttaaaaattycccttggtgttaatctatagaaaatgtcagaaaataccagtcactgccctgcccccaactgttcgctgtgagttggttagcctgacttctcatgtatggc

SEQ ID NO: 25175 - DNA, 201 bp, Homo sapiens
gagtttgccttgttttgttctttagtatatttccatttctccatagtctagagttaagaggaggttatgtaaaatagggacattgtcacaggccagctctkgggggtggctgagctggagaaagttgctaggagcagagcaaccatctctcaggaaggcgtatggcattcttattaaactgcagtccaggtgtgccatcgt

SEQ ID NO: 25176 - DNA, 201 bp, Homo sapiens
  misc_feature (1)...(201): n = A,T,C or G, or insertion/deletion polymorphism (see Tables 1-2)
gcttaaactttcctagaagagtagttatcaagtgtcctagaagactctagaagccccatataagtgttggttacactgttataaaattcaaatgcatctcngtctgttgagtagtgctgatgaatataaatctcatgagttaaaagcaaccaaaccctctgtgaaaaccagcagtttcaagcataaggaatggtccaacat

SEQ ID NO: 25177 - DNA, 201 bp, Homo sapiens
acaaaaaatagccaggcatagtggtggctcacctgtaatcccagctacttgggtggctgaggcacaagaatcgtttgaacctaggaggcagaggttgcagygagctgagatcgtgccacttcactccagcttgggtgacagagcgagactctgtcaaaaaaaaaaaagtatatatatatatacttttatatatatatttta

SEQ ID NO: 25178 - DNA, 201 bp, Homo sapiens
tgaatataaatctcatgagttaaaagcaaccaaaccctctgtgaaaaccagcagtttcaagcataaggaatggtccaacatgggcttgttttcttcctctyggcagatcaagtataaagctcacatgttgaaaacaaggaatgactacaagcttgtcacagatacaccagtctacgtgcaggctgtcaaaagtgggaaaca

SEQ ID NO: 25179 - DNA, 201 bp, Homo sapiens
taaattagaaccagctatggtagaataagaagcaagcaggctctggagttagagttgtggagtgcagtctcacctctaccacacattatctataaggcttrtgaaaagcacttaatccatctgagcctcccattctgatgcataaaatggggacgtaaggaagcacccactatgacgcctgacacaaagcaggcagggcag

SEQ ID NO: 25180 - DNA, 201 bp, Homo sapiens
agaggtgaaacttggttacctatcttctctgcatttcccaaattcttgctagatgccatacagccaactgggcatatgtttggaagcacagaggaattagwgtttttttttttttttttttttttggagacagggtctcctctgtctcccaggctggagtgcaacggtgcaatcacagctcactgcaatctcaaattcctg

SEQ ID NO: 25181 - DNA, 201 bp, Homo sapiens
aggtgaaacttggttacctatcttctctgcatttcccaaattcttgctagatgccatacagccaactgggcatatgtttggaagcacagaggaattagtgkttttttttttttttttttttttggagacagggtctcctctgtctcccaggctggagtgcaacggtgcaatcacagctcactgcaatctcaaattcctggg

SEQ ID NO: 25182 - DNA, 201 bp, Homo sapiens
cagacccctgggctgaagcaatcctcctacctcagtctccctagtagctaggactacaggagcatgccaccatgactggctaattaaaaaaaaattgtagratctcctaattattttttcatagaggtagggtcttgctatgttgcccaggatggtcgtaaactcctggccacaggtgatcctcccaccttggccccacaa

SEQ ID NO: 25183 - DNA, 201 bp, Homo sapiens
  misc_feature (1)...(201): n = A,T,C or G, or insertion/deletion polymorphism (see Tables 1-2)
ttttttcctaatctcaatcattttctatatcctcgatatttcctcccctcttccttatgtaaaatattttattcttgattagtcagtagatgccctcgtcntcccctactaaatgcctgtaatgatatttcctccaacgtagagactgtatcgggaattgtaccacaaactgaaagacaagatccatacaactcccgatac

SEQ ID NO: 25184 - DNA, 201 bp, Homo sapiens
  misc_feature (1)...(201): n = A,T,C or G, or insertion/deletion polymorphism (see Tables 1-2)
gtgggctgcattgctgaaataaaggagagggacatttcaaaatacacctactgctgggaattgtgggctctaaatatgtgctgtgagaatgagcagttganttactatgagctagttcacaaatctagaaaagcatgaaccatagatcatgttgctgtaaatgtgaacccaaagaaacttctaaaagcttggcttagcaac

SEQ ID NO: 25185 - DNA, 201 bp, Homo sapiens
tgttgtctctaaacttatttcaaaattttctttctctttaattcctgctatcaggagccccgagcatggcagtgccattggagaagtcttcagtggctccytgctctgctgcccattcagtacaattcagactacttagtttcattttcatctggcattgaggctcctgatatattgcagttatttgtgaatagatctgat

SEQ ID NO: 25186 - DNA, 201 bp, Homo sapiens
ttggaaaactccaagaacacttgttctgatcactggtttccctttcaggtttacgtgtctggcgtactaatcctggttcggtttttgactatgatccagcagaagacaacatccagtcccgaagcttacacatgattaatggtgtgttagctgaaaaaggcttacaacataaacatcaccatttagtatgctagagtcaat

SEQ ID NO: 25187 - DNA, 201 bp, Homo sapiens
tgaagtgcttcctggctccttacattgtgttagcacttgtaagtgctattaataaacaatgacaaataatgaccaaaaaaaaaaaaaaaaaaaaaaaaaargaaggcaggtagagtcacagagaaaagttgaaacaaaatcagacacatctgcccctctgaaaataagaaaaagcagggcatgctatcagtaaaaatgact

SEQ ID NO: 25188 - DNA, 201 bp, Homo sapiens
tacctgccatgttggggtagataacctgtggtggtagacctgtcttaattgtctccgtttctttacagatcaaatataagaaaaatgcccttgaaaactaycctaactttagaagtgtggtggatcctccagagattgttttagccaagattaattctgtcaatcaaagtgatgtaagtttgctttgtgcatgctgaagtg

SEQ ID NO: 25189 - DNA, 201 bp, Homo sapiens
catgcataagtcagtgtgatgcatcatcacaaaatctgggttctaatcctcagtggcctcagcaggttgctcagctctctgggtctcagcttattcatctrtaaaatgaggagagtaataagaacttttctatctacctcacaagggagagttgtattcagttacatcaataaatatgaaaaattagtctgaactatagag

SEQ ID NO: 25190 - DNA, 201 bp, Homo sapiens
tgtttgtataaaagaaaacttgtttttgattcctttgcttggtactaatgtggttttaaagtattgtgcttcttattgacacaagacatttagacctgaawatgtcacaaataccgattcactgagctgaaattcttgattctcattaaaaatcagactgtctgcatgtgtctatttattactggcctataccagtcatgt

SEQ ID NO: 25191 - DNA, 201 bp, Homo sapiens
tgacttctaattatattctcacacacgaatcataacaaattattttagtggcagaattacatcttaatttttcttttttttctgtgtgtataaatatacasacattctttgcaggcaaagataatttttattgaatctgcggtacttatctagaattgtgcctgacacatagtagatactcaatgaaattttggatcattg

SEQ ID NO: 25192 - DNA, 201 bp, Homo sapiens
  misc_feature (1)...(201): n = A,T,C or G, or insertion/deletion polymorphism (see Tables 1-2)
ttaattctgtcaatcaaagtgatgtaagtttgctttgtgcatgctgaagtgcacagactggggagtaaattgtctatcattgggtggattagcttaacttnagataattgcttgtaaaaaaattgggaggtggtaaattctaagatcatctttggggggtatgtcttaaaagtcactagcaggtggtgaattgtattcact

SEQ ID NO: 25193 - DNA, 201 bp, Homo sapiens
ctcacacacgaatcataacaaattattttagtggcagaattacatcttaatttttcttttttttctgtgtgtataaatatacacacattctttgcaggcaragataatttttattgaatctgcggtacttatctagaattgtgcctgacacatagtagatactcaatgaaattttggatcattgagcatataaaacccatg

SEQ ID NO: 25194 - DNA, 201 bp, Homo sapiens
tttatagtaataaaagatttggttttctctccttaggtaaaatataaagaaacatttaataaagcaaagggcaaatatacgttttcaccagatacaccacrtatctcccactccaaagacatgggaaaactctacagtactgtaagttctcttttatgtaataaccactcaatttctaatttgaagctcttgttgcattca

SEQ ID NO: 25195 - DNA, 201 bp, Homo sapiens
gaaagaagttgaaagaaaacttttgttgccatgtatttctttgttctagatactgtataaaggggcgtgggagggcaccaaggcctatggctacaccctgratgagcgctacattcccattgttggagccaagcatgctgatctggtgaacagtgaggtcagtatgaccttttcctctcctaagtttgagagtctttactg

SEQ ID NO: 25196 - DNA, 201 bp, Homo sapiens
tgctctgtcttttcacagaatctatataaatctgaccttgagtggctgagaggcataggatggagtcccttgggttctttagaggcagaaaagaacaagcrggcttcggaaatcatcagtgagaagaaatatcgtcagcctccagacagaaacaagttcaccagcattcctgatgccatggatatagttctggcaaagaca

SEQ ID NO: 25197 - DNA, 201 bp, Homo sapiens
  misc_feature (1)...(201): n = A,T,C or G, or insertion/deletion polymorphism (see Tables 1-2)
acaggcaacttggctgagaaaagaagaatgaaggccattggctagagactggaaaaggcttaattaatgacaggaggtcttgagtctgtttgcaggtgaanagaggggattgggaaaacaggaagggtggaagatacagaggagatggagacagttgctggaatagggtactagaagggacaactgcaaatgggaccaaga

SEQ ID NO: 25198 - DNA, 201 bp, Homo sapiens
tgagtacatacttacttgttcactgctaggaaactcttgggttttaatctcattgactgaaggcatttatttgaatttgatgaaaaatcaactctgttcarcccctcatgattcttctagaactctctccttattaatatgtctctgggtggtttctcctattaaagctgatatgacagccaatataaagtgggattattt

SEQ ID NO: 25199 - DNA, 201 bp, Homo sapiens
  misc_feature (1)...(201): n = A,T,C or G, or insertion/deletion polymorphism (see Tables 1-2)
gattgaagatagtaagtagattcaacagcatgtaaaaggtctgaatatttaatgttttcatctaatgtgtctcttgttcaattatcactacaactgttgcngggagatgaggattaccgtgcagctctatgaatattgtatatattcatggcgcctcttgactttgatgctgaattgctaggttatttccagcacatctga

SEQ ID NO: 25200 - DNA, 201 bp, Homo sapiens
tccctcctatccaaacccacatataccaaaacttgctaggtatgtctccagcaatgacaatatacagttctatatatttttaaaaggcagaatgattgctrtattcatcagttcattcattcatcaaatattgtctatgtgcctgacactaggaatgagatgatggatgataaacagtttttgcccttaaggggtccttaa

SEQ ID NO: 25201 - DNA, 201 bp, Homo sapiens
tgagctggtagggaaaggcttctcttccatcagcagttatcaagatgttctgaactcaagatttgctgatttggggaaaggaaaacctgaatgaatagggktccaactggtcctttcagcacaagcacagaaacaaaaattatatggcaggctgggcacagtggctcacacctgtaatcccagcactttgaaaggctgagg

SEQ ID NO: 25202 - DNA, 201 bp, Homo sapiens
  misc_feature (1)...(201): n = A,T,C or G, or insertion/deletion polymorphism (see Tables 1-2)
taccaactggagcctaaattttttttaaaaaactaatctttcagtgacatattgttacacagcatgaggataccaggcccaggccctctaaaaccatgganattcttccatcacatagaattgggaagatttccattgatttcaccagaagagatttgattgagtcaagcaggcagtgttaggcccactgtggacaataaa

SEQ ID NO: 25203 - DNA, 201 bp, Homo sapiens
gtgcctggcagaaaataaatacctagtgtttgatcatttttggtaaaaattaaacccgaatttagtttgaaattaaaagtactcgattctgaagatgattrggctggactggcagaactagagagattgaagaatcatttcacccggaggcctttaaaaattttagcctctatttcgggaccacagggtcccaacagatga

SEQ ID NO: 25204 - DNA, 201 bp, Homo sapiens
  misc_feature (1)...(201): n = A,T,C or G, or insertion/deletion polymorphism (see Tables 1-2)
atccctgcagcaaagcgatgtaagacaggagagacacagacgattgtaactgcatactgcacctgagaaatacaatgaataattatttataataaccactntcatgagtgttaacccttgctcgtttgagatccgagaaggagaggaggatggttgggggagcgataggcgagctcagaacccaaacctgcccatggagcc

SEQ ID NO: 25205 - DNA, 201 bp, Homo sapiens
  misc_feature (1)...(201): n = A,T,C or G, or insertion/deletion polymorphism (see Tables 1-2)
tccaattctggcaattatggcaaatgtgggttttgctacaggacatgtaatctagccatatcagatattactaacctattaataacagaaggaaacattgntgattaggagtggcctctcctattattaaactgctacccaattttagaaaggtaaaactacctctttgggcctcagtaatctctgcctgctctatcctta

SEQ ID NO: 25206 - DNA, 201 bp, Homo sapiens
  misc_feature (1)...(201): n = A,T,C or G, or insertion/deletion polymorphism (see Tables 1-2)
caggttctccgaagattgccaggtggttctagtgttgggttgcaggacacaaatgacagagaagaactagaatatgggtcttatctaagtcccagactgangccaaaatggggagcatggattttcctggagatttcacagttcttcaagtaaaccaactctgttcccagcttcctctactcataaaagtaattctggctc

SEQ ID NO: 25207 - DNA, 201 bp, Homo sapiens
agacttaaattgctgttggttttgctagttaggagtgctaaaatgctccaaatcaagtacattaaatcacatctctgaatttagcctgaagccttttccattttttttttttttgttttgcattagaaagaggtgattactttttataccttggaataatataaaaatgagcaaggccagtgatcatatatttgaatgcct

SEQ ID NO: 25208 - DNA, 201 bp, Homo sapiens
gctagagaaagcaaatatggcaaaaatgttaataaattggatagttggtattcattgtagcattcttgcaacttttctgtaagtttgaagttttgcaaaakgtggaaagtatacattttaaaatattaaaacatacattaaaatatttgactaagtgtgataatataaagatttcattttttaaataaagaaaaagaaata

SEQ ID NO: 25209 - DNA, 201 bp, Homo sapiens
aagtgtgataatataaagatttcattttttaaataaagaaaaagaaatagtcatattcatcctagtagttactatgatgcatgtctgaaagtattaaaacraaactttaccaaacatggctgggtgcagtggctcatgcctgaaatcccagcaatttgggaggctgaggcaggagggatcacttgagttcaagagtttgag

SEQ ID NO: 25210 - DNA, 201 bp, Homo sapiens
agctatttgacaaatgcactttagaataaacaaccattactgaaagactaccaaaggcatggtagacaagctgtttttgcctgctttctgtgcttatatcrtaattattgatgctgtctttattaacttatggataaaagataaaactatattccactaactatgagagccactttgattcacagcaagaggagatgggta

SEQ ID NO: 25211 - DNA, 201 bp, Homo sapiens
attctcaatgtttaacccactttacagcttaaatacaaagagacatatgagaagcagaaaggtcactacctggctggaaaagtgatcggtgaattccctgrtgtggttcactgtctggatttccaaaagatgaggagtgcggtaagtaaatgtccactttaacacgggatttgtgccccataagtgtgctgccgtgtctgc

SEQ ID NO: 25212 - DNA, 201 bp, Homo sapiens
ttccctggtgtggttcactgtctggatttccaaaagatgaggagtgcggtaagtaaatgtccactttaacacgggatttgtgccccataagtgtgctgccrtgtctgcctgtttataacttgccctttggttcaggttagctgggaaatggagtagcgtagggtccttcctgagattttcctcacccctccaagtcagcct

SEQ ID NO: 25213 - DNA, 201 bp, Homo sapiens
tttttctagcaaaaatacaaagaagactatgaaaataaaatcaaaggcaaatggagtgagacaccttgctttgaagttgcaaatgccagaatgaatgctgrtaacattagcacagttaagtgggaagggatggctggttggtcatcctgggagggagacccctttccttagtgacttctagctacttgctctacctgaatg

SEQ ID NO: 25214 - DNA, 201 bp, Homo sapiens
agttctgggaatttacaaaattactaaatttttaagatacagtcatataccgcatgatgtttttggtcaacagcagaccacctgtatgacagtggtcccayaagattataatggagctaccctatgcaggtgtaccattttaaaacctttaataccatatttttactgtaccttttctatgcttagaggtatcaagataca

SEQ ID NO: 25215 - DNA, 201 bp, Homo sapiens
agaaaattttatttatacaacaggcttgaggatcttttgagactgtcaggttttttaacaagtcagtcaatatgtaaactagttttcatttttataccaatttattggctgcattaaatatatggccagtcaggacccacatagagttgtttacttataaataaagctccatgtgttatccattcaatctagaccccaggt

SEQ ID NO: 25216 - DNA, 201 bp, Homo sapiens
tggtgtaacacagtcaaaagtaaaatctaacaccctttcaaaaggacaatgttaattagaattttatttgtatttattgtggctgtttaatgtattctttrtgtttgcagcttttaagtttttttttttttatgtttagatgtttatttatttttccataagtttgggaggtacaggtggtatttggttactaagttcttt

SEQ ID NO: 25217 - DNA, 201 bp, Homo sapiens
actaagttctttagtggtgacttgtgagattttggtgcacccatcacccaagcagtatacactgcaccatatttgtagtgttttattccctcgcctcactyccactctttcctgcaagtccccaaagttcactgtatcattcttatgcctttgcatcctcatagcttagttcccacatatcagtgagaacatacaatgttt

SEQ ID NO: 25218 - DNA, 201 bp, Homo sapiens
aatttttacacagattgcatttaggcaaaattgcccagtggtgcataagcctattagatactgtggaaaatagacaatgccacatattgaacctctatacytgaccatctctacaacaacttgaacttaatgacaaggaccaaattgccatattgcatagatttggcctgttaaatatttgttagaccgtaagacaaacgc

SEQ ID NO: 25219 - DNA, 201 bp, Homo sapiens
tggtaaaacattaatataatcatttaacttaataaaaaaagtgttcagtattatattcctgcttttacaaatgtaacattctcagtgtctaagcatccacwtttatactgctttggcaaatttgatctgaacctaaagcttaaacaaatgtattttgcaaagatccgactattatcctcgtttcttattctaaccttttct

SEQ ID NO: 25220 - DNA, 201 bp, Homo sapiens
agatggagagagtcaaacacaatcaagaaaatattagctcggtacttgggcaagaaaagaaaaaaactacttactgattttaaaaactatttcatgatttmaaataatacatattaatcctattttctaaagacaaattttgtgaacttctttctttagcaaatttatccttttttcctttgggctacttctagcctaaca

SEQ ID NO: 25221 - DNA, 201 bp, Homo sapiens
acctctcaacaaatgaaatgttactcatggttgtttttctggatgctttctcatcgcacaggtgttatacaaagaaaacatgggcaagggaactcctttasctgtcactcccgagatggagcgagtcaaacacaatcaagaaaatattagctcggtacttggcgagaaaagaaaaaaactacttactgattttaaaaacta

SEQ ID NO: 25222 - DNA, 201 bp, Homo sapiens
cgtgccattgcactccagcctgggtgacagagcaagactcctctgtctcaaaaacaaaacaaaacaaaacaaaaaaaaacaaacagctgatgtattaggarcagcctcaaccttctcagtgtgattgaagctcatgcctgtaactcctgtttggatcatctctcaggggcttgacattgagagactagcggtaaaatgatg

SEQ ID NO: 25223 - DNA, 201 bp, Homo sapiens
atactctgaaatggatgccttctttggatatattttggggttttagtgtctggaggactttgatttctatattagcatattggtttatgaagtctggacayaacctaaggaaaataatcacttgttttaaaggacagttctttcaaattccctacaatgtcagatttagagccaaataccatcgaatatgttgatgctgta

SEQ ID NO: 25224 - DNA, 201 bp, Homo sapiens
  misc_feature (1)...(201): n = A,T,C or G, or insertion/deletion polymorphism (see Tables 1-2)
gctccacccccacgtctacccaggcacattccagccctgtgacttggactgctttcatttcctcaaggtggccaggccatttccagcctcaggtcccgaangctcttcctctgcccctctctccaagtttgagtgtaaatgttacctctgcagagtggctttactgaccatccttgtttctttgctacaatgattccattg

SEQ ID NO: 25225 - DNA, 201 bp, Homo sapiens
aatctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaa

SEQ ID NO: 25226 - DNA, 201 bp, Homo sapiens
atctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaag

SEQ ID NO: 25227 - DNA, 201 bp, Homo sapiens
tctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaagt

SEQ ID NO: 25228 - DNA, 201 bp, Homo sapiens
actaaagtcttgttttctactattgttgctgggagcattgttggattctgaattccacaacagcaaatggaacttcatttcagaaagagtgtattgaaagraatatgtctagcaaagatggtcaaaagcataataggcttttaatagaggaataaaagggaaagtaagaaatcagataacctgatagctccagcccctccc

SEQ ID NO: 25229 - DNA, 201 bp, Homo sapiens
ctacgtctcattggtgtacctgaaagtgatggggagaatggaaccaagttggaaaacactctgcaggatattatccaggagaacttccccaatctagcaaagcaggccaacgttcagattcaggaaatacagagaacgccacaaagatactccttgagaagagcaactccaagacacataattgtcagattcaccaaagtt

SEQ ID NO: 25230 - DNA, 201 bp, Homo sapiens
agcaaggggagggggcgttagtaccctctttctccattctctatccctatcgcccaactttctggttgggtaaattgacagtacattggaagatttttttwaaaggcatttattaaggacctaagaatggcttgctgaagatatttttaaaagttaatcattatttcttaatttgctgtcttatttgtcaattcatgagtt

SEQ ID NO: 25231 - DNA, 201 bp, Homo sapiens
gccccttcagttgacccaagcgtccctcaccagctcctatccatctctatctgctggaaaggctttgaggtttcagatttaggacagcaccactcattcayggtctctcctgcatcaggttctttattctgatagtttccggaaacaaatacaaggcaaagctgcctatgtattggatacccccgagatgagacgggtgag

SEQ ID NO: 25232 - DNA, 201 bp, Homo sapiens
tggtgttgtacacctgtagtaccagctgttcagggggctgaagtgggaggatagcttgagcctagaaagttgaagctgcagtgagccgtgattgtaccacygcccttcagcctgagcaacagagaccccatctcaaaaaaaaaaaaaaaggatattatgtagagacagtcctcaaaggatttatactccagttttctgatc

SEQ ID NO: 25233 - DNA, 201 bp, Homo sapiens
gggctgaagtgggaggatagcttgagcctagaaagttgaagctgcagtgagccgtgattgtaccactgcccttcagcctgagcaacagagaccccatctcaaaaaaaaaaaaaaaggatattatgtagagacagtcctcaaaggatttatactccagttttctgatcaagacacagaagtaaatccatggttgcattctga

SEQ ID NO: 25234 - DNA, 201 bp, Homo sapiens
cagcttacaaacatgcaaaaaccacagagctcccacaacaacgatcatcttcagttgctacccaacagacaacggtatcttccatcccatctcatccatckactgctggagtaagtgaataacaactcacttaaataaattattcttaatttttgatatgtgcaaacatgattataagtattaggtattacggtttttttt

SEQ ID NO: 25235 - DNA, 201 bp, Homo sapiens
taaacatttgctgggcatagtgaatcatgcctataatgccagcactttgggacgctgatgcaggaggattgcttgagctcaggagtttgagaccagcctakgcaacatagtgagacttcatctctactaaaaaccaaaaaattagccaggtgtggtggtgcatctatagccccagctactgaggaagttgaggtgggagga

SEQ ID NO: 25236 - DNA, 201 bp, Homo sapiens
cactgtactccagcctggatgacagagggagaccctgtctcaaaaatcaagaatgtatagatgtatgcaatgtgcccacatatatacatgccttatcttasatctcccctattaatatatatagaaatggtaagccaaatcatcttcacagttcaccagactacttcacaactcttagtttaaaaccctggatctcattca

SEQ ID NO: 25237 - DNA, 201 bp, Homo sapiens
ctgtcttttttatcatcaccattctggcatgtgtgaaggggtatctcattgtggttttaataatttgcattttccagatgactaattttgagcatcctttygtgtgctttttggctatttgtctatcttttttggagaaatgtctattcatatcctttgcctcttttggtgggggaaggcattgagttgtaggagttcgtc

SEQ ID NO: 25238 - DNA, 201 bp, Homo sapiens
aattttgagcatccttttgtgtgctttttggctatttgtctatcttttttggagaaatgtctattcatatcctttgcctcttttggtgggggaaggcattragttgtaggagttcgtcatatgttctggatattaattgcctatcagatacatgacttgcaagtatttcctattttgtgggttccttttactttgttgatg

SEQ ID NO: 25239 - DNA, 201 bp, Homo sapiens
gatttgcatttctctaatgaccagtgatgatgagcattttttcatatatttgttggccgcataaatgtcttcttttgagaagtgtctgttcatatccttcrcctactttttgatggggttgtttgtttttttcttgtaaatttgtttaagttctttgtagattctggatagtagcccattgtcagatggatagattgcaga

SEQ ID NO: 25240 - DNA, 201 bp, Homo sapiens
ctggtgccattaaattttctttctactttatttgtttgtttatgcatttttttctctttcagatcgcttacaaagccaaaggagaggaaattattcacaawtacaacctgccaccagacctgccccagttcatccaggctaaagttaatgcctacaatatcagtgaggtgcgtgggtggactcacgggctgatgcgtatgt

SEQ ID NO: 25241 - DNA, 201 bp, Homo sapiens
aatcatgaaaaactcttccttttcgcttcaaaataaatttcaaggattttgacgtattaatcttcagtggaaaacaagattgtttttctctttttgatttrccaaacagaaaaaatatcgccaacatccagacaccctcaagtttacctcgattgaagatgctccaattacagtacagtctaaaattaaccaggcccagag

SEQ ID NO: 25242 - DNA, 201 bp, Homo sapiens
tcttgattttccattctacttaaaatgcccagagtaaaaaacaacagtttgaattttgtatctaaaacgtaaatttttggtaccacctatggtcagacaayaagagtagcattttaatagcgtcaagtaactgtgcctcaactaggaccaattccaaataataaccgccctcttatgcaaattaacgagtgcaactgtttt

SEQ ID NO: 25243 - DNA, 201 bp, Homo sapiens
  misc_feature (1)...(201): n = A,T,C or G, or insertion/deletion polymorphism (see Tables 1-2)
gtaagcaaacgacccttgtggttctataagagcatgcccttcaaggttaggaagaactgatctggcttgcaccctatcactgtttccctctgggaaatatntcaaccttgctaagtttagagtcctcctctgtaaaatggaaataaatcaaaaacattgtttggaggatgtaaatgcatgcaaaatacttagcatggtgcc

SEQ ID NO: 25244 - DNA, 201 bp, Homo sapiens
  misc_feature (1)...(201): n = A,T,C or G, or insertion/deletion polymorphism (see Tables 1-2)
tttgaagttgagtgaggtttttgcacttcttagaggtatctgcattgtcctatgtatgtaagcaaacgacccttgtggttctataagagcatgcccttcanggttaggaagaactgatctggcttgcaccctatcactgtttccctctgggaaatatgtcaaccttgctaagtttagagtcctcctctgtaaaatggaaat

SEQ ID NO: 25245 - DNA, 201 bp, Homo sapiens
tgcacatctgtacttgccagcttgggtcaccgtctctaacacatatgtgaccatgggaaactaggatgagtttagagttttctgaaaggcagtgggtcaamatttttctgtcaaagtaattggtgagtggatacaatgaagctgggaatttgacccaactagcaccttgtctaaccattccagaaaaccagacaatgaagg

SEQ ID NO: 25246 - DNA, 201 bp, Homo sapiens
gtatgtggtcacagtcactatcaatcactcttcttattggcttaggtgggcaatggactctgccttggaattacttcttgcatagttctcaatcttgtgcrtttttgcctttggctccaaaattaaacagcctcatccgttctttacactcccttccttacacctaacgtcaccttttaaaaaatttaaataaagttctgt

SEQ ID NO: 25247 - DNA, 201 bp, Homo sapiens
cagctacttttaaggggaaatttatcattaactcacttgagcagattatcactttaatgtgatctgtgcctcctatgaaaggtgctgagcttagttaaatracaattgtttttgctcctgcctgggaagacatccaggacacatgaaagccctgctcagcttacacatgccagacatttgaaagacaatatgacatgaatc

SEQ ID NO: 25248 - DNA, 201 bp, Homo sapiens
aatctctgcctcccaggttcaagcaattctcctgcctcagcctcccaagtagctgggattacagacatgtgccatcacgcccggctaatttttgtattttyagtagagacggggttttaccacattggccaggctggtgttgaactcctggccttgagtgatctgcccaccttggcttcccaaagtgctgtgatgacaggt

SEQ ID NO: 25249 - DNA, 201 bp, Homo sapiens
taaaagcagtgaaggcatctgcagagaacataacatgcccatgaaacagaaatgatggtgataacttggtttatgtctagctggtctacagagctgcaggsaagaagcagaagtcaatctttacttcagttcctgatactcctgatcttttaagagccaagcgagggcagaagcttcagagtcaggtaagctcagaggttc

SEQ ID NO: 25250 - DNA, 201 bp, Homo sapiens
atttatgcagtttctctgctgcttttaagagttactatgagtattttgtttataaaatgtcaagctgccatttttctaaagagaaaattgatttgtggaartatgtcatattcataatagagacgggggcaaaaataacccatagagttactttatcattttatttcactcctacaggtaaaatacaaagaagactatgaa

SEQ ID NO: 25251 - DNA, 201 bp, Homo sapiens
  misc_feature (1)...(201): n = A,T,C or G, or insertion/deletion polymorphism (see Tables 1-2)
ttataggaagtatctattgtaacttttgaatggaagtttaaaaatgaattatacatatgaagacaaattttctaagaaacttgaaaacaattgttccctanaaatacgttaggcacttttgttgttggccagtagagtcctttggagactcaaatattacctcattgatatcatagctccttgttttaatcaagctctggt

SEQ ID NO: 25252 - DNA, 201 bp, Homo sapiens
caggaaagcagctaaagacaataagcacagctgttccaataaaactttatttctggatactgaaattttaatttaatatgttttcatgtgtcacaaaatgyccttcttttgacttttttcaccattaaaaaatgtaaaaaccagtctcagctcacagatagtacaaaaaacaggtggcatgctagtttaccaatctgtgct

SEQ ID NO: 25253 - DNA, 201 bp, Homo sapiens
aaagggcagcaccctgggtgcaggagtcattccctctgaaggatgtttctcctctgagccagggaaggggtgggagacgcagggatgaatatggagaagayaagtgtgtagcgtttcttcactctatgaaagaggaagctgagagtaaggtggggttgattgtgggcttaaggacagtgttggggttttagactggcccct

SEQ ID NO: 25254 - DNA, 201 bp, Homo sapiens
gaaattaagccaggcttgtttgtggaatttgtgtaaatacatttcaaaatctgtcttttgtatcccaattgatttgatgtccatgaaagcttttggtatargcactaggtagatattattgggataagatacagttagacttggttaaagtataaagatgattgggaccttgggattattcaactgctttacttgataaat

SEQ ID NO: 25255 - DNA, 201 bp, Homo sapiens
caggatgtcatacttaataaacatttatcctattcaaatgttgcttttaccctaaggacttaaccagccatgaaatatcctgttgtcctatgcctaaaatraagtcttcagtttgtatttttttttttttttttttgagacagggtctcactctctcacccaggctggagtgcagtgatacaatcttggcttattggctta

SEQ ID NO: 25256 - DNA, 201 bp, Homo sapiens
atctgatttgtctgaaacttcttggcaggatgtcatacttaataaacatttatcctattcaaatgttgcttttaccctaaggacttaaccagccatgaaawatcctgttgtcctatgcctaaaataaagtcttcagtttgtatttttttttttttttttttgagacagggtctcactctctcacccaggctggagtgcagt

SEQ ID NO: 25257 - DNA, 201 bp, Homo sapiens
  misc_feature (1)...(201): n = A,T,C or G, or insertion/deletion polymorphism (see Tables 1-2)
aaatgcattgctgatacagagataaatatttattggctatttgtgtcaacagaatatgtacaagtctgatctccagtggatgagaggcattggctgggtgnccattggctctttggatgtggaaaaatgcaaaagggcaactgaaattttgagtgataaaatctatcgccagcctccagacagattcaaatttaccagtgt

SEQ ID NO: 25258 - DNA, 201 bp, Homo sapiens
  misc_feature (1)...(201): n = A,T,C or G, or insertion/deletion polymorphism (see Tables 1-2)
tactcaatttggacttagtaagccagttcagactgattgggatttacttctaatggaatctatggtctgatcttgccatgaaccaaaattatacacaccantttgatggtgtctccaacttttgaggtctaatttttaacgccaccctcttcatatcacctgcaagtttagtggacatctttttctatttcactttctatg

SEQ ID NO: 25259 - DNA, 201 bp, Homo sapiens
ttagcattgcctaatccatggagttgcaggttttcttctgtggcattcagcatcctaggcataagaacagaggaagttggccaggcgcggtggctcacgcytgtaatcccagcactttgggaggccaaggcaggcagaccatgaggtcaggagatcaagcccagcctggctagcatggtgaaaccccgtctctactaaaaa

SEQ ID NO: 25260 - DNA, 201 bp, Homo sapiens
agagaacccacagcttaggcagctgaaggcagcaggagatgccctaagtgacgtaagtatatttttgtcaaagtgtttttaaaccttagctgcaaaagagrtgaaaattttctcctttaatgactaaatgaatatataactttgcaaatacattaaggttatggagtggtaggttcattggaactatgtaaccacagaaag

SEQ ID NO: 25261 - DNA, 201 bp, Homo sapiens
tttcttctattattcagtatctgtatgttgaacttgccaccaaagagagaccccatcatcacgctggaaaccagaccacagccttgaagcatgctaaagaygtgaaggacatggtcagtgaggtaagatgggaattcagcactgaggcactgggtaaaaagaaaaatactttgttaaaaccttcccctgctacctctgatc

SEQ ID NO: 25262 - DNA, 201 bp, Homo sapiens
tacttgtgttgggctctacaactcaccatatacatatacatatattttttagcaacctccctcttctgaaattctccagaaagaagccatatttacattamctttgggtaagacttacagctgtctttgtgttttttataacagataaaatacaaggagaactacatgagccagttgggtatctggaggtccattcctgat

SEQ ID NO: 25263 - DNA, 201 bp, Homo sapiens
cccgtctctactaaaaatacaacaaattagccgggcacggtggcgggtgcctgtagtcccagctgctcgggaggctgaggcaggagaatggcctgaacccrggaggcggagcttgcagtgagccgagatcgcgctactgcattccagcctgggcaacatagcgagactccgtctcaaaaaaaaaaaaaaaagaacagagga

SEQ ID NO: 25264 - DNA, 201 bp, Homo sapiens
aataattttggccaggcacagtggctcatgcctgtaatcccagcactttaggaggtcatggcaggcagatggcttgagcctggagttcaagaccagcctgrgcaacatggtgaaaccctgtctgaacaaaaatacaaaaataaataaattagccaggcatagtggcatgcacctgtggtcccagctacttgggaggttgag

SEQ ID NO: 25265 - DNA, 201 bp, Homo sapiens
taaataaattagccaggcatagtggcatgcacctgtggtcccagctacttgggaggttgaggtgaaaagattacctcagcccagggaggtcaaggatgcartgaactgtgatggtgccactgcactacagtctgggtgacacagtgagaccctgtctcaaaaataaaataaaaataatttggtttttcatattttaaatgt

SEQ ID NO: 25266 - DNA, 201 bp, Homo sapiens
  misc_feature (1)...(201): n = A,T,C or G, or insertion/deletion polymorphism (see Tables 1-2)
aaagcataatcgtttttaaaatacatccctgtcttttatttcatcaggttgcctacaaaaaaggtctcgctgaacagcaagctcaattcacgcctctggcngatcctccagatatagaatttgccaagaaagtaaccaatcaagtgagcaaggtaagtaaatagagctgggacattgccgcctcccttgaagactctgctt

SEQ ID NO: 25267 - DNA, 201 bp, Homo sapiens
  misc_feature (1)...(201): n = A,T,C or G, or insertion/deletion polymorphism (see Tables 1-2)
tcaagtgccatatcccccctgatactcctgcttttatccagcacaaagtcaatgcctataacttgagtgatgtaagttccttatgccctgtaccatgtgangtactgacaacctgtgcttttatgtttgaactgctttgttgcaattcaatgaatagattaatgttaaaaatgagaagaactgttaacatttgtatcatgt

SEQ ID NO: 25268 - DNA, 201 bp, Homo sapiens
gggagtttaacttaatgccctttgaattatatttaaatggaattgggtcattgttattagtatatttgtaaatcctaaattcaagaacaactcttacaatrtgaggatccttttgcatctatgtttggttctgcaactcttgcgtttaagcacagattttgattttcttttcaatatcttcacaatgtcacttaatttaca

SEQ ID NO: 25269 - DNA, 201 bp, Homo sapiens
gaggctgaggcagaagaattgcttgaatctgggaggtggaggttgcagtgagccgagatcgcaccactgcactccagcctgggtgacagagtaagactccrtctcggagggaaacaaaaaaaggaaattattagtagtagtatcatctgctcactccatttcacttttgctatcagacacaaatttatagtaaacatttcc

SEQ ID NO: 25270 - DNA, 201 bp, Homo sapiens
taaaacatattggaacttgggaggctgaggcagaagaattgcttgaatctgggaggtggaggttgcagtgagccgagatcgcaccactgcactccagcctrggtgacagagtaagactccgtctcggagggaaacaaaaaaaggaaattattagtagtagtatcatctgctcactccatttcacttttgctatcagacaca

SEQ ID NO: 25271 - DNA, 201 bp, Homo sapiens
atgtgcccttgggtcagtctcgtaacctctgggggcctccgagtacatgtgtataaaacatattggaacttgggaggctgaggcagaagaattgcttgaayctgggaggtggaggttgcagtgagccgagatcgcaccactgcactccagcctgggtgacagagtaagactccgtctcggagggaaacaaaaaaaggaaat

SEQ ID NO: 25272 - DNA, 201 bp, Homo sapiens
  misc_feature (1)...(201): n = A,T,C or G, or insertion/deletion polymorphism (see Tables 1-2)
aaagaagaagaaaaaacatgacataggctgggcgctgtggctcacacctgtaatctcagcactttggggaggctgaggtgggtggatcacaaggtccagantttcaagatcagcctgaccaacatggtgaaaccctgtctttactaaaaacacaaaaattagcctggcgtggtggcatgtgcctgtaatcccagctacaca

SEQ ID NO: 25273 - DNA, 201 bp, Homo sapiens
ttttggatcaaatccaaaagaaaatttaaaagttgcatagtgggactagcaacatgaaaattgtgaagtaattttattatttttgtttctttccacagccraagtacagagaggtttgggacaaggataaaacttcaatacacataatgccagatactccagaaattaatctcgctagagcaaatgctcttaatgtgagca

SEQ ID NO: 25274 - DNA, 201 bp, Homo sapiens
ccaacgtgatgaatgaaaccccatctctactaaaaatacaaaaaatagccaggcatagtggtggctcacctgtaatcccagctacttgggtggctgaggcmcaagaatcgtttgaacctaggaggcagaggttgcagtgagctgagatcgtgccacttcactccagcttgggtgacagagcgagactctgtcaaaaaaaaa

SEQ ID NO: 25275 - DNA, 201 bp, Homo sapiens
aaaataataaaaacaaaagaaaggagattgtcaagcccagacctttggactccagacaccattacatgttccaggacaatggtgcatagaatgattctcayctatgctcttctttaactgctctcaagtccttgggcttcaaaactgtgcccctgtggtattaattccacctgagccattgaaggtattggcaaatttgaa

SEQ ID NO: 25276 - DNA, 201 bp, Homo sapiens
aaaatcaccaaatccaagaaggacctggactttatatcaagaaataaatggtagtatgaatacaggtcttaattgtatcagattaaagaaaactgtgaaartattctttctatagaatttagatagcaatagaggcttatatccagtaaaatattggcagcccatggacaggatgtaggcacagacatgcttttttaattg

SEQ ID NO: 25277 - DNA, 201 bp, Homo sapiens
ttggcagcccatggacaggatgtaggcacagacatgcttttttaattgatacagtgtttagaaattttgaattaagttgccaagattttaaaatccaaaawtttttgtgtacaaatgtcggatttcccatttctcttggaaattcagaggacacagctctgaattatcccttagtaacaataaccagaatggaatcaagga

SEQ ID NO: 25278 - DNA, 201 bp, Homo sapiens
ttggggtagataacctgtggtggtagacctgtcttaattgtctccgtttctttacagatcaaatataagaaaaatgcccttgaaaactatcctaactttasaagtgtggtggatcctccagagattgttttagccaagattaattctgtcaatcaaagtgatgtaagtttgctttgtgcatgctgaagtgcacagactggg

SEQ ID NO: 25279 - DNA, 201 bp, Homo sapiens
catctgaaatacagattttaatcattgaaatgatggatgctaacaattgcttggacaacatgatgctttcttaacaagtaacttgcccccttgcctctcatttttttttttttagattaaataccggaaagactggaatgccaccaaatcaaagtacaccctcacagaaacccccctgctgcacactgcccaggaggctgc

SEQ ID NO: 25280 - DNA, 201 bp, Homo sapiens
  misc_feature (1)...(201): n = A,T,C or G, or insertion/deletion polymorphism (see Tables 1-2)
tgaaagccttgtagaaactgaaatccaaggattgtgttttcttagcagcagacttttcagttattaaaaacaaagatattcctaagcacagttttaatctngcactccttttagtaagaaaaacaaagccattaccacaagagaatatttttaaattacataatctttaaaatgaattgcttgtagtagcagtaaaagtac

SEQ ID NO: 25281 - DNA, 201 bp, Homo sapiens
atagtgctgggattacaggtgtgagttatcatgcccagcctgaacattttctatttaccaatgcatatgacactgactgtgcacatgtaaagaagctacayattatttcagctataatgctttattttttaaaaatttcccttggtgttaatctatagaaaatgtcagaaaataccagtcactgccctgcccccaactgtt

SEQ ID NO: 25282 - DNA, 201 bp, Homo sapiens
tagctccagcttgagaagaaatatttaaaatatgcatgatttcctagacaataaaaagggcccatttattttatattaagataaggtatttagttacccaytagtctttaaaggtcgtgacatgcatatcacttttgccaattcctttgctgaatttttttgtccagaatctttataagcaagactgggagaagagcaaag

SEQ ID NO: 25283 - DNA, 201 bp, Homo sapiens
tgatggaatttatattcctcttctcgccagctgaaatacaaagctgaacatgtgaagcaaaaaggtcattatgttggtgtcccgacgatgagagatgatcytaagctggtttggtttgagcatgcaggccagattcagaatgagagactatacaaagaggactatcacaaaacaaaggccaaaatcaatatacctgctgat

SEQ ID NO: 25284 - DNA, 201 bp, Homo sapiens
caattctacagctatggaaacagtaataagaggaccacctggggaagacagaattgccatcattcttgatcactcagtgaccaccattctacattcaacayggaatcattccaactcctcactccctaactccctgtgtggcctccatcccaggtcatgttgagtattttcctctcactcatccctactctgacctcatta

SEQ ID NO: 25285 - DNA, 201 bp, Homo sapiens
aatgagaaaagactagaattgtggagggctgcatgaagttagatgtttcattttctttgatttctctttttggaaatcattctaagttgggggaaaaagayatcactcagctgctaaacacagattaaaggatacctagccatttttcttcttataaagaatttgccccctttttttcagcttacaaacatgcaaaaacca

SEQ ID NO: 25286 - DNA, 201 bp, Homo sapiens
tgttgatgcttgcacattctcttttgttcaacttaagtttgtggagtcagtcatgagagatcttacaaatagatgtgtgttaactgttgcaaatccaacayataatatttccccttttccatccccacgaatagaaaatcttccgtgccatgtatgactatatggctgctgatgcagatgaggtgtccttcaaggatggag

SEQ ID NO: 25287 - DNA, 201 bp, Homo sapiens
ttatccagcacaaagtcaatgcctataacttgagtgatgtaagttccttatgccctgtaccatgtgatgtactgacaacctgtgcttttatgtttgaactrctttgttgcaattcaatgaatagattaatgttaaaaatgagaagaactgttaacatttgtatcatgttgctatgcctctgccagtataactgaattcacc

SEQ ID NO: 25288 - DNA, 201 bp, Homo sapiens
  misc_feature (1)...(201): n = A,T,C or G, or insertion/deletion polymorphism (see Tables 1-2)
agcatgacatgatgtctttctgctttttgatctttcagatcctttataaattggaatacaacaaggccaaacccagaggctacaccacaatccacgacacncccatgttgctgcatgtccgcaaggttaaagatgaagtcagtgatgtaagtactagaatggtttagcagtccctctcatcttggcctccttctaatgaga

SEQ ID NO: 25289 - DNA, 201 bp, Homo sapiens
tcctcccacagctgaaatacaaagaagtataccaaagaaataaatccaactgcaccattgagccagatgctgttcatatcaaagcagccaaggacgcctayaaagtcaacaccaatgtaagttccagaaacttccccaagcatggtgggggatttaccagcttctgtaggacacatggcctctttttacatctcttcaggc

SEQ ID NO: 25290 - DNA, 201 bp, Homo sapiens
aggactccctgtgtgtttaatcaaatgcccagcttcctcctgtgctgtcacccttcccttttcttctgcctttcttctatcacagtttgaatataagctgraccgggagttcctcaagggttgcaagctttctgtcactgatgacaaaaacacggtgctcgccctcaggaatactttaatagaaagtgatgtaagtaccta

SEQ ID NO: 25291 - DNA, 201 bp, Homo sapiens
aaatatagagtataatatgaacttttatttaggggcaaatgatttaattatgacaaattatgacaaattgtgataaatgatttaattatgacaaatttgtcacttgcactttcagaatttgtacaagtcagaccttcagtggctaaaaggcattggctggatgactagtggttctctcgaggatgagaaaaataaacgagc

SEQ ID NO: 25292 - DNA, 201 bp, Homo sapiens
ggtattcctgatgggttggctgcaatggtgatagatacaaaatgcaaaaatagaagaattttctatccttcctgaatttgggaaaggtgttttttttttttcctttattaactcaaggtcacaatgtcatccatgtaaatctctgtaatgagtcatctaaaattaaccaggaaggttttgtgcttgcaacatgattcatgg

SEQ ID NO: 25293 - DNA, 201 bp, Homo sapiens
ctattaccatgaatcatgtaagtcctatgtttgtttgaggaggttattaattttttttgtttatggaaacactgaagtctgtttgtataaaagaaaacttrtttttgattcctttgcttggtactaatgtggttttaaagtattgtgcttcttattgacacaagacatttagacctgaaaatgtcacaaataccgattcac

SEQ ID NO: 25294 - DNA, 201 bp, Homo sapiens
cctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaattctatta

SEQ ID NO: 25295 - DNA, 201 bp, Homo sapiens
acctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaattctatt

SEQ ID NO: 25296 - DNA, 201 bp, Homo sapiens
ctggtcacagacacgcccctctatgtgactgctgttcagagtggcattaatgccagtgaggtgcgtcttcctgtactcctcttccagggacaaactatttyttgtctttatgtattttctaacaacagaggtgaataacctattgttgcttgtctacaggtaaaatataaagaaaattatcatcagattaaggacaaatac

SEQ ID NO: 25297 - DNA, 201 bp, Homo sapiens
cagtgaggtgcgtcttcctgtactcctcttccagggacaaactatttcttgtctttatgtattttctaacaacagaggtgaataacctattgttgcttgtytacaggtaaaatataaagaaaattatcatcagattaaggacaaatacacaacagttctagaaacagtggattatgacagaaccagaaacctgaagaatct

SEQ ID NO: 25298 - DNA, 201 bp, Homo sapiens
ttccagcacatgctgaaaggtaaatttgatgcagcaataaacagtgataattggtaactaccagacacaatgttagtaataataccatttttcccagaccaaaaaaaaaaagttaattgagctttcctcttagcaacttgttttgtcattttagtttaccatgaaatcaatatgtgaaatgaggaggttaagctccaatta

SEQ ID NO: 25299 - DNA, 201 bp, Homo sapiens
tagaaatttcatgtttgctacatctcccccaactgcatctctcccagtccaagctcagcgccggagccgggagcagtcacgatctgccagtgcactaagcrtcagtgggggtgaggagaagtctgagcattcagaagcaccagaccaccacctttcgacttacagcgacgggggtgtctttgcagtctcaacaggtacaag

SEQ ID NO: 25300 - DNA, 201 bp, Homo sapiens
ggtgtggcagctagcaaggtatgaggaaatcatcccatttatcttgatggtttgagtgtgggtaaatttcttataactttggctcttgtatataattagtwaaaaaggggaggagtggttcttgggggaactaccagggctgagaccagtggatgtgaggcatttgaaaaagagtagaattgaaacaacaagaacaacaac

SEQ ID NO: 25301 - DNA, 201 bp, Homo sapiens
agaattgaaacaacaagaacaacaacaaaagtactttggaattataatggggctactaaaaatgttttgccatgtatgagcattaataacatctaattacyatcttcaatatttcctaatttattatttgcctgaggaaccaaactgtacatttatcaatttgatttagtgtcttctcactggaagggccttttgctgttt

SEQ ID NO: 25302 - DNA, 201 bp, Homo sapiens
cgtttgggatacaccccaaatcctccatgccaagaaatcatacgaccttcagagtcaggtgagccaccttcctagaaggactggttctccatgggtcatcrgaatccatggtggtgtcagtgggctgatgggcaggcaaagaaagttgctgtaacagtgtaggctctaactgaccaaagcccctcctctcccaatcaaagc

SEQ ID NO: 25303 - DNA, 201 bp, Homo sapiens
cacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaattctat

SEQ ID NO: 25304 - DNA, 201 bp, Homo sapiens
cctcactcagggccatcttccatggtacagtccccagggacaccagggaaggatggagaagagctgcttccatcagggctcaggtatgggtcctgaattayggcctgtcctgtgaggggcgccagcagtcaagcagggcagcagcagtgcaagggccattagatccaggtgacagtcctcgatttatactgcaccagcaga

SEQ ID NO: 25305 - DNA, 201 bp, Homo sapiens
aagcacctctacattatgaggaaattattgtatgctttcactgatacaattataatttggaaagtttttagcagaagtgaaaaacttattctctctagggmtaatactttctctctagggataaaaaaatagaaactaacaaaaatggaagagctattaactcacaggcaaataataaattgatttggctttggtgaattc

SEQ ID NO: 25306 - DNA, 201 bp, Homo sapiens
tgttctactggtttgagggtgtaataaaaatatgtaggatatccagcagagctaaagaaatgccccttttcctgcccctgaagctgaaatacaaagagaarcatgtcaaggaaagaggaacctgccatgccgtacctgacacgcctcagatcctgctggcgaagactgtcagcaacctggtgtctgaggtaacccccagcc

SEQ ID NO: 25307 - DNA, 201 bp, Homo sapiens
taagcacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaatt

SEQ ID NO: 25308 - DNA, 201 bp, Homo sapiens
acttggcacagggctcatacacaacactaccagagacccgggacactgttcacgtcaaggaagtgaccaagcatgtcagtgatgtaagtgatcaaccaccsgtctcttggcagcaacaatgccacttgactgtagaatctggtgaaataatgtcagttgccttttgcttcctttatgtagcttcactcttaccatcaatat

SEQ ID NO: 25309 - DNA, 201 bp, Homo sapiens
ataagcacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaat

SEQ ID NO: 25310 - DNA, 201 bp, Homo sapiens
tgctggagccaccagaggtgaaacatgctatggaagtggccaagaagcaaagtgatgtaagttttccctctcaacactcttgggggcccatttgaagcagkggaacccagattggtgcattctcttgttccagtgtgtggtcactctaattcctctgtggtagtttcaaaaagttagtggcgagaattggtttgggtttaa

SEQ ID NO: 25311 - DNA, 201 bp, Homo sapiens
tataagcacctctacattatgaggaaattattgtatgctttcactgatacaattataatttggaaagtttttagcagaagtgaaaaacttattctctctagggataatactttctctctagggataaaaaaatagaaactaacaaaaatggaagagctattaactcacaggcaaataataaattgatttggctttggtgaa

SEQ ID NO: 25312 - DNA, 201 bp, Homo sapiens
atactcacataatcacattgtgatgattaaaatcacagaattaatttccactggtctgctagtctacagaatttattcaattttatcactaatatcctttmtaagaaaagaaaatattttctctggctcaggatttaatccaagaccacaggttgcattacttgctatgtctttagtctcctttactctggactagttcct

SEQ ID NO: 25313 - DNA, 201 bp, Homo sapiens
catgtataagcacctctacattatgaggaaattattgtatgctttcactgatacaattataatttggaaagtttttagcagaagtgaaaaacttattctcwctagggataatactttctctctagggataaaaaaatagaaactaacaaaaatggaagagctattaactcacaggcaaataataaattgatttggctttgg

SEQ ID NO: 25314 - DNA, 201 bp, Homo sapiens
acatactcacataatcacattgtgatgattaaaatcacagaattaatttccactggtctgctagtctacagaatttattcaattttatcactaatatcctytataagaaaagaaaatattttctctggctcaggatttaatccaagaccacaggttgcattacttgctatgtctttagtctcctttactctggactagttc

SEQ ID NO: 25315 - DNA, 201 bp, Homo sapiens
tcatgtataagcacctctacattatgaggaaattattgtatgctttcactgatacaattataatttggaaagtttttagcagaagtgaaaaacttattctmtctagggataatactttctctctagggataaaaaaatagaaactaacaaaaatggaagagctattaactcacaggcaaataataaattgatttggctttg

SEQ ID NO: 25316 - DNA, 201 bp, Homo sapiens
gtatttcccaagaataagaacatactcacataatcacattgtgatgattaaaatcacagaattaatttccactggtctgctagtctacagaatttattcarttttatcactaatatcctttataagaaaagaaaatattttctctggctcaggatttaatccaagaccacaggttgcattacttgctatgtctttagtctc

SEQ ID NO: 25317 - DNA, 201 bp, Homo sapiens
ctgagtggggaaatctgctttctaaatctctctaaaccaatttatttacacatctcttcgattaactctgagattattttctttccatggactcaagtctsgggaaaaaaaaaatgaagtaaaaagagtttgctccctccctctcacgagtgcctcccttccaattttagagtagctctaaaacccttcatctaagacaaa

SEQ ID NO: 25318 - DNA, 201 bp, Homo sapiens
catcttcaacttattttcttcaccagctctgacaccagtatctagcacataataggtactcaataaatattcattgaaaaaatacataaaatatagcaggrtggagtaattatatgcaaagaagggaaagattactcaacactgctcagctaaaagcctaactttgaacattacagaatactgaagtatgtgccctgaaat

SEQ ID NO: 25319 - DNA, 201 bp, Homo sapiens
tctagaaacagtggattatgacagaaccagaaacctgaagaatctttacagcagtgtgagttgagttttttttcccccttatatatgagccacctttcccmcttctgggacagtaagagaataaatgggatggacactctttccctaaaggcttttctatggttttttcctggaccttcaatcttactttacctcataaaa

SEQ ID NO: 25320 - DNA, 201 bp, Homo sapiens
  misc_feature (1)...(201): n = A,T,C or G, or insertion/deletion polymorphism (see Tables 1-2)
tcgctattatcataatcatcacattcatcattatcaatgatttttacatagattactatctgaaaagaaaatatatgatttaacataaatatttataacgnttttttctgcagatcagaacttctttaagcaaattcatttgtccaaaccacacaactgaatacttcatcctaacaattctattttttaaaatgtgacaaa

SEQ ID NO: 25321 - DNA, 201 bp, Homo sapiens
attaaagcagaaatccagaaataaaggcacatgtaagttggcacaagcagctacagctgatgacagacctgtatgttaccatttttgatgacttttgtttytcttcacagctacaatatacagcagcaggtaaagaaaatctacaaaactataatctggtcacagacacgcccctctatgtgactgctgttcagagtggca

SEQ ID NO: 25322 - DNA, 201 bp, Homo sapiens
tgccttccagcaccttgtccctgacacacgccaagaaccagaagcatctggccagccatgtaagtaaagcaaaaacatgacagctttcccaccctccctcycctcccctgctctccactccaagaatctttcaggctgattcatacgttgtccagaagtacccctagcactcccgtgggcatgtccaggaaataattccaa

SEQ ID NO: 25323 - DNA, 201 bp, Homo sapiens
  misc_feature (1)...(201): n = A,T,C or G, or insertion/deletion polymorphism (see Tables 1-2)
acgatctcggctcactgtaatctctgcctcccaggttcaagcaattctcctgcctcagcctcccaagtagctgggattacagacatgtgccatcacgcccngctaatttttgtatttttagtagagacggggttttaccacattggccaggctggtgttgaactcctggccttgagtgatctgcccaccttggcttcccaa

SEQ ID NO: 25324 - DNA, 201 bp, Homo sapiens
aaggaatataaatcattctattataaatatatatgaacacatatattcattgcagcactattcacaatagcaaagacaaggaatcaacaacgatagattgkataaagaaaatgtggtacagatagaccatggaatactgtgcagccataaaatggaatcagatcatgtcctttgcagggacatggatggagctggaagcca

SEQ ID NO: 25325 - DNA, 201 bp, Homo sapiens
ggtacatgtgcatgtatatattcacccaatgccctgaactgattaaggtagtttgcaaaaatatatatataggaaaatgaaaagaagtaaagaaattaatktaagggcaaagtaagaaaaactacataaggcataaactcaaaagcaaagcattttattttaagaaatttatagaatattgatcttattttaaagacttta

SEQ ID NO: 25326 - DNA, 201 bp, Homo sapiens
ggtcatcagaatccatggtggtgtcagtgggctgatgggcaggcaaagaaagttgctgtaacagtgtaggctctaactgaccaaagcccctcctctcccartcaaagctcttctagtgtcctgctctggggctggatcttcccagtctgagtctctcctttggtttaaggcaatgcacatttataataaaagcttatctgg

SEQ ID NO: 25327 - DNA, 201 bp, Homo sapiens
aggtcgaggcgggcagatcacttgagctcaggaaatcgaaaccaccctggccaacatggtgaaaccccgtctctactaaaaatacaaaaattagccaggcrtggtggcagacgcctgtaatcccagctacttgggagactgaggcaggagaatcacttgaagctgggaggtggaggtttgcagtgagctgagatcgcaccg

SEQ ID NO: 25328 - DNA, 201 bp, Homo sapiens
taaccattaatctactttgttttatggattttgctagtctggacatttcatataatctggcttctgtcactgaatattaggtttccaaggttcatggataytgtagcatgtatcagtacttcactgcttttcatggccgaataatattccactgaatgcatatatcacatatatcacattttgtttatctgctcattggtt

SEQ ID NO: 25329 - DNA, 201 bp, Homo sapiens
tgttcacacgtccagcagttttgctgaattcttgaattcatttcaatgatgtttctagatgttccatgggctttgctagcaaacactgccagtttgcccascactttgccagcgtaaggcctgtgcccccagatatattcccagccttttggggaggagcggggagcccctgcaggctgtgcttctcagcctttgggtcat

SEQ ID NO: 25330 - DNA, 201 bp, Homo sapiens
aagacagcagcgctgaagcttgaggccgagggcgaggccatggaagatgcagccgcgccaggggacgaccgaggcggcacacagggtataccttgactcgygctcccaagtgcaccctgtcccttagggtagtgaggcaaaagaactaatttacatatgcttgtagagcagtgttacaattagtcaaattctgtactagaa

SEQ ID NO: 25331 - DNA, 201 bp, Homo sapiens
cctttgggtcattgcccgccgagctttacatttgtttacatttctttttaatgctaatggtatcatgtgtggtctgtaagtgtctatatgtgtagttttartaagtcttaactttttataaaccagcagcctcctggccggggatagccaatagccccagcccactgaaagcctggtgagcagaaagggaagagaaacaag

SEQ ID NO: 25332 - DNA, 201 bp, Homo sapiens
cctgaacggctcctgctcctgctggacaagcccacagagggcccagcttccaacaggtgagccttcatgccccaccactactttttatttgatttgatttkatttttagacggagtttcactcttgttgcccaggctggagtgcaatggcgcaatctcgagtcactgcaacctctgccttctgagttcaagtgattctcct

SEQ ID NO: 25333 - DNA, 201 bp, Homo sapiens
gcctcctaaagtgcagaaattacaggcatgagccaccacatctggacccagcctctacttgttactgcaatatgcaatttggagcgacttaactgctcacraggaaatgtctcgtgtcacacggcattttaagtagatacttagagcacttgagctcaccacagtagcaacaggaggtggttgtgaaagattccagtagtg

SEQ ID NO: 25334 - DNA, 201 bp, Homo sapiens
aacatggtgaaaccctgtctctactaaaaatacaaaacttagccgggcgtggtggcgtgtgcctgtaatccgagttactcgggaggctgaggcaggagaaytgcttgagcccgggtagcagaggttgcagtgagtgagccaagatcgtgctactgcactccagcctgagtgacaaagcaagactccgtgtcaaaaaaaaaa

SEQ ID NO: 25335 - DNA, 201 bp, Homo sapiens; identical to SEQ ID NO: 6161

SEQ ID NO: 25336 - DNA, 201 bp, Homo sapiens
aaattagctgggtgtggtggcgcatgcctgtaatcccagctattcgggaggctgaggcagcagaattgcttgaacctgggaggcagaggttgcggtgactsgagatcgtgccattgcactccagcctgggcaacaagagtgaaactccatttcaaaagaagaattagataaataaataaataaaataagtaaaaataaaaa

SEQ ID NO: 25337 - DNA, 201 bp, Homo sapiens; identical to SEQ ID NO: 6162

SEQ ID NO: 25338 - DNA, 201 bp, Homo sapiens
  misc_feature (1)...(201): n = A,T,C or G, or insertion/deletion polymorphism (see Tables 1-2)
cgcagggcacagggatcggcaccagccggtgacgtgtccctcacgctgctgcctgtgattggtggtcccgatccggggcgtggccccaagggaggcacttngccctactggggatgcgcgcgcagacccacggcctctgctccgcccccagctggcctgtaattggcgcagtcggcccaaggggcggctgttcaggcgcgg

SEQ ID NO: 25339 - DNA, 201 bp, Homo sapiens; identical to SEQ ID NO: 6165

SEQ ID NO: 25340 - DNA, 201 bp, Homo sapiens; identical to SEQ ID NO: 6164
  misc_feature (1)...(201): n = A,T,C or G, or insertion/deletion polymorphism (see Tables 1-2)

SEQ ID NO: 25341 - DNA, 201 bp, Homo sapiens
gacagttcctgttgagaataaccacggtttccatgaaaagacagcagcgctgaagcttgaggccgagggcgaggccatggaagatgcagccgcgccagggracgaccgaggcggcacacagggtataccttgactcgcgctcccaagtgcaccctgtcccttagggtagtgaggcaaaagaactaatttacatatgcttgt

SEQ ID NO: 25342 - DNA, 201 bp, Homo sapiens
ggtgcaatcttggctcactgcaacctctgcctcccaggttcaagccattctcctgcctcagcctcctgagtagctgggattacagtcccccaccaccatgyccagctaatttttgtatttttagtagagacggggtttcaccatgttggccaggatggtctcaatctcctgacctcatgatcagcctgcctcggcctccca

SEQ ID NO: 25343 - DNA, 201 bp, Homo sapiens
taaactagatgattgctttcagcatcctgtgcacagggcagattcatagttcaggaattaaagcagtaagtgttgtacaggtcagccgctgcatacgcatyctttcccctggacagcgtttccttctctggttaactgaaaacacatgtgggctgctttactcttctagaagacattttatgaagggttttttgtttgttt

SEQ ID NO: 25344 - DNA, 201 bp, Homo sapiens
attctccagcctcagcctccaaagtagctgggattacaggcgtgtggcaccacccccggctaatttttgtatttttagtagagacagggttttaccatgtwggccaggctggtctcgaactcctgaccttaggtgatccacctgcctcggcctcccaaagtgctgggattacaggcatgagccaccgtgcctagcgtgtgg

SEQ ID NO: 25345 - DNA, 201 bp, Homo sapiens
  misc_feature (1)...(201): n = A,T,C or G, or insertion/deletion polymorphism (see Tables 1-2)
acctgcctctgcctcccaaagtgctgggatttcaggcgtgagccactgcgcccagctatgttaccattttcttgagcacgaaacttgataagatgcaatgngctttaggtgggtcgtggcaaacatgaaaaggcaagcttccgttttagaatccatggctcttcttgaagacttctctaaagtgcatgatccctaacaagc

SEQ ID NO: 25346 - DNA, 201 bp, Homo sapiens
ctctgaagtctgttacaccagagctctggctgctgagaccagtgcatgcttccagggtggcactgctgcctgtgatttcttgctacttctctgttttttttggatccctagagatatcctttacttgattatatggtcatttgaaattatgcctgtaaccttttacccagaattactacatgatttggagcccaagggttt

SEQ ID NO: 25347 - DNA, 201 bp, Homo sapiens
tgagaggctgaagtaggagaatcacctgagcctgagaaagtcaaggatgcagtgagccgagatagagccactgcactccagcctgggtgacagagtgagamcctgtctccaataaataaataaatcaataaatatcatacatatgtgtttcctattggtttttttttttctggaaaaccctatctatcacactggccaaat

SEQ ID NO: 25348 - DNA, 201 bp, Homo sapiens
cgccactgcactccaacccgagtaacagagtgagactctgtctcaaaaaaaaaaaaaaaaagaaaaatgggcaagaagttaccctttttttttttttttttacaaactggcaagacgacataagcattgtcttatggtccttcagttaaaaaaaaaattgtgtaaaaacaaaaatggacaaagacccattaatttcatggt

SEQ ID NO: 25349 - DNA, 201 bp, Homo sapiens
cactacaagtcccttaaaaactttatgggcttctcaagaatctgattcaggtgctctccatgcccaagaagccactcccactagtctttttttttttttttagacggagtctcgctctgtcgcccaggctgaagtgcaacctccacctcccgggttcacgccattctcctgcctcagcctcctgagtagctgggactacag

SEQ ID NO: 25350 - DNA, 201 bp, Homo sapiens
taaaatattatcatcttattcagaaagcgtatgcacaaaattttaaattttatttttagcaaaaaataggcgattttgctagtgtacatgggatccttttwaaattttgtgtttgttgttggtgtctagaaatacaattgacttttgtaaattgttcacacgtccagcagttttgctgaattcttgaattcatttcaatga

SEQ ID NO: 25351 - DNA, 201 bp, Homo sapiens
gccacagaattccaagaagcaaagtccaccaaaaagtaagattttgatggtagtcataagggaaagagaatgcaaaaagaaaatagattagtcagccttcraagcacgacagtgagttttactagctacgtaatttatgcttcttccttttcagcagtgtccagattatacaagacacaagatctataacagattttagac

SEQ ID NO: 25352 - DNA, 201 bp, Homo sapiens
agttcgagaccagcttgaccaacatggtgaaaccctgtctctactaaaaatacaaaaaaattagctgggcatggtggcacacgcctgtaatcccagctackcgggaggttgaatcagaagaatctcttgaacccaggaggcggaggtttcagtgagccaagatcgcgccactgcactccagcctgggcagcagggcgagac

SEQ ID NO: 25353 - DNA, 201 bp, Homo sapiens
cagctactcgggaggttgaatcagaagaatctcttgaacccaggaggcggaggtttcagtgagccaagatcgcgccactgcactccagcctgggcagcagrgcgagactccgtctcaaaaaaaagaagtttaactgacccttgggagacacaagggggagcctctagtagttcaggtagaactttgtgtgatctacaaaga

SEQ ID NO: 25354 - DNA, 201 bp, Homo sapiens; identical to SEQ ID NO: 6160

SEQ ID NO: 25355 - DNA, 201 bp, Homo sapiens
agcttgaccaacatggtgaaaccctgtctctactaaaaatacaaaaaaattagctgggcatggtggcacacgcctgtaatcccagctactcgggaggttgratcagaagaatctcttgaacccaggaggcggaggtttcagtgagccaagatcgcgccactgcactccagcctgggcagcagggcgagactccgtctcaaa

SEQ ID NO: 25356 - DNA, 201 bp, Homo sapiens
tgagccaagatggcgccactgcacgccagcctgggctacagagcaagactccgtctcaaaaaaaaaaaaaaaatttaaacaaaaaaaaaatcttttggcayttttttttctccctttagggacaaaggatcccttctcatgattatcctaagatctaaggttattctttttgcctcccagggtggatggtggcagatgccc

SEQ ID NO: 25357 - DNA, 201 bp, Homo sapiens
  misc_feature (1)...(201): n = A,T,C or G, or insertion/deletion polymorphism (see Tables 1-2)
gcgaatggggctctgggcacgcggcggaaggcagagaagaggcagagaaagaagctaataactaattacaccgactccacaattacgactaacgttggggncgaactctttgctaaataaacatttaggtgaaacaaagcttccatttccaatcggcctaactctggtattagcgttggcaggggccatgcaggaggggca

SEQ ID NO: 25358 - DNA, 201 bp, Homo sapiens
agcgttggcaggggccatgcaggaggggcagtgagcagtggtggccgcgttgccgacagagggtgagggagctgggcgcgtggtgtgggcgccgaggtccsgagctgaagagctttaaaacctctcaaaacacagaactatcaatcaagtaggaccagactgtgcccccagggaaggtcgcagatttaaggctgcgaggac

SEQ ID NO: 25359 - DNA, 201 bp, Homo sapiens
  misc_feature (1)...(201): n = A,T,C or G, or insertion/deletion polymorphism (see Tables 1-2)
gtgcgaagcgttcgggtggacatgcaagccggcccagcgcagacgcctgagaggggtgcccagcagcccccgcaggtctccgccgcgcccccgccacagcncccaggcgcccgcagggcacagggatcggcaccagccggtgacgtgtccctcacgctgctgcctgtgattggtggtcccgatccggggcgtggccccaag

SEQ ID NO: 25360 - DNA, 201 bp, Homo sapiens
cagacgcctgagaggggtgcccagcagcccccgcaggtctccgccgcgcccccgccacagcgcccaggcgcccgcagggcacagggatcggcaccagccgstgacgtgtccctcacgctgctgcctgtgattggtggtcccgatccggggcgtggccccaagggaggcacttagccctactggggatgcgcgcgcagaccc

SEQ ID NO: 25361 - DNA, 201 bp, Homo sapiens
aatcgtggaagatcagataccaccaagcaatttggagacagttcctgttgagaataaccacggtttccatgaaaagacagcagcgctgaagcttgaggccragggcgaggccatggaagatgcagccgcgccaggggacgaccgaggcggcacacagggtataccttgactcgcgctcccaagtgcaccctgtcccttagg

SEQ ID NO: 25362 - DNA, 201 bp, Homo sapiens
tgggcatgatggcgggcgcctgtaatcccagctacttgggaggctatggcagtaaaatcgcttgaacctgggaggcagaagttgcagtgagccaagaccaygcccttgcactccagcctgggcaacaagagcgaaagtcatctcaaaaaaaaaaaaaagaaaaaaatcaagaattgaaggccacagtagtactgggggaga

SEQ ID NO: 25363 - DNA, 201 bp, Homo sapiens
gagattgaagttatgtggccataattcaaggattgctggcaacaccagaagccaagagaaagatgaggaagaattctcccctagacctttcagaaggagcrtggcccagccaacaccctgacttcagacttctggcctccagaactgtgagaataaattcttactgttgtaatccacctgatatgtggtaatgtgtacatt

SEQ ID NO: 25364 - DNA, 201 bp, Homo sapiens
tagctggagagacgtaggacctgatgatggctactagatgcctggtaaatgatccttcaagaagtgaatgaaccgggggccgtggctcacatgaagtcagmagttcgagagcagcctgaccaatatggtgaaaccccgtttctactaaaagtacaaaaatttgttgggcgtggtggcgtgcgactgtagccccaactactt

SEQ ID NO: 25365 - DNA, 201 bp, Homo sapiens
atctctactaaaaatacaagaagagccaagcgcggtagctcacacctgtaatgccagtactttgagaagccaaggtgggtggataacctgaggccaggaaytcgagaccaacctgatcaacatggtgaaaccccgtctctactaaatacaaaaacttggccgggcatggtgatgcatgcctgtaatcccagctacttgggt

SEQ ID NO: 25366 - DNA, 201 bp, Homo sapiens
  misc_feature (1)...(201): n = A,T,C or G, or insertion/deletion polymorphism (see Tables 1-2)
caggtgtgagccactgtgtccagcctacctggcatgtttttgacattctctaaatgtttactgatgaacaattagttgaatttcattgctaacattatccnctcctttggtgaattttagtctgtgtctgcaatcctacatcatagacttatgaatttggattaaatggattttaaaatatcatggcagagccaaagagcc

SEQ ID NO: 25367 - DNA, 201 bp, Homo sapiens
tgctgggattacaggcatgagccaccgtgcctagcgtgtggaggcttttaaagggcaacagtatttattcctatgatgttaccatttttttttttttttttggagatggaatctcactctgtcacccaggctgcagtacagtggcgcaatcttggctcactgccggctccacctcccacgtacaaacgattctcctgcctc

SEQ ID NO: 25368 - DNA, 201 bp, Homo sapiens
aagggtcttttctaatgtgattaagttaaggattgcaaaatgagagcatcctggatttgggtggaccctaaatcgaatgttatgtgtactgagaagagaarggagaagacagaggagaatgccagatgaagacagaaacagagattgaagttatgtggccataattcaaggattgctggcaacaccagaagccaagagaaa

SEQ ID NO: 25369 - DNA, 201 bp, Homo sapiens
gtgctgggattacaggcatgagccaccgtgcctagcgtgtggaggcttttaaagggcaacagtatttattcctatgatgttaccatttttttttttttttttggagatggaatctcactctgtcacccaggctgcagtacagtggcgcaatcttggctcactgccggctccacctcccacgtacaaacgattctcctgcct

SEQ ID NO: 25370 - DNA, 201 bp, Homo sapiens
cctgattcaagcaattctcctgcctcagcctcccaagtaactgggattacaggcatgcaccaccacgcctggctaattttttgtttttttgttttgtttttgcgataaagtctcactctgtcgccaggctagagtgcagtggcacgatctcggctcactgcaacctccgcctcctgggttcaagccattctcctgccccat

SEQ ID NO: 25371 - DNA, 201 bp, Homo sapiens
ggcctcctgagtagctgggactacaggcgcccaccaccatgcccagctaattttttacatttttagtagaggtggggtttcaccatgttagccgggatggkcttgatctcctgaccttgtgatccgcccgccttggcctcccagagtgctggaattacaggcgtgagccaccgtgcccggtcctaaatctttaatcattat

SEQ ID NO: 25372 - DNA, 201 bp, Homo sapiens
attagtcagccttcgaagcacgacagtgagttttactagctacgtaatttatgcttcttccttttcagcagtgtccagattatacaagacacaagatctayaacagattttagaccaaacatttcagtcatgtcgtagtctttgactgaatatttagccctgaaatggtttttcctgtattttctaaatgccaaaccccaa

SEQ ID NO: 25373 - DNA, 201 bp, Homo sapiens
accattctcctgcctcggcctcctgagtagctgggactacaggcgcccaccaccatgcccagctaattttttacatttttagtagaggtggggtttcaccrtgttagccgggatggtcttgatctcctgaccttgtgatccgcccgccttggcctcccagagtgctggaattacaggcgtgagccaccgtgcccggtccta

SEQ ID NO: 25374 - DNA, 201 bp, Homo sapiens
  misc_feature (1)...(201): n = A,T,C or G, or insertion/deletion polymorphism (see Tables 1-2)
actggaagatgttttcaggccctacaagaataagaagtcttaaccaggcccgagttctgcttcctgggagtatctccccaggctgtatctcagcacagctnttgcctctgccctcttgggtgtccctccttttccagcaccttcttggccatgttgaagaatgtgccctttgagaaactttctcaacctccttcctgtcat

SEQ ID NO: 25375 - DNA, 201 bp, Homo sapiens
gcattattcttaaggccatattttattagcgccactctgaatttgatctttggcccaggttatgacttactttgagaacttgttaccaactattgggtctrataatactttccccagcttcaacccaaagtgtgctctaaattctgctggccagtttgtttgtttgtttgtttttaaccacactcttttctataagtgtct

SEQ ID NO: 25376 - DNA, 201 bp, Homo sapiens
acattatactgatatgatctttttcaagtcccagagttcagtagttgcctttttctctgcccatcttactgaagggcaacaattttacaaatccttcaccrtgacatagagttgttcaccatttgtccacctcccgtagttttcctcaccattgttccagtgttcactaccagtttccccactgcttttccagacttctag

SEQ ID NO: 25377 - DNA, 201 bp, Homo sapiens
tggcatgcacctgtaatcccagctactcagaaggctgaggcaggagaatcactagaacccaggaggtggaggttacagtgagccaagatcacccattgcaytccagcctgggcaacaagggtgaaactccatctcagaaaaaagaaaaaaaaaacttatggattgttgtgttgtatttctagtcctgtcctgagcaaaagg

SEQ ID NO: 25378 - DNA, 201 bp, Homo sapiens
tctcagaaaaaagaaaaaaaaaacttatggattgttgtgttgtatttctagtcctgtcctgagcaaaaggtattaggaacctgagaatccttccattagcrcaatagaaaaatgggcaaaaaggccaggcacggtgactcacacctgtaatcccagcactttgggaggccaaggtaggagaatcaattgaggtcagaagtt

SEQ ID NO: 25379 - DNA, 201 bp, Homo sapiens
tatttctagtcctgtcctgagcaaaaggtattaggaacctgagaatccttccattagcacaatagaaaaatgggcaaaaaggccaggcacggtgactcacrcctgtaatcccagcactttgggaggccaaggtaggagaatcaattgaggtcagaagtttgagaccagcctggccaacatggggaaaccccatctctacta

SEQ ID NO: 25380 - DNA, 201 bp, Homo sapiens
cattagcaaattgtgagcccacagaccttttttcactctaaactgttctgtccacattttggcagctggtggtgctttgttcactacaagtcccttaaaarctttatgggcttctcaagaatctgattcaggtgctctccatgcccaagaagccactcccactagtctttttttttttttttagacggagtctcgctctgt

SEQ ID NO: 25381 - DNA, 201 bp, Homo sapiens
ttagcacaatagaaaaatgggcaaaaaggccaggcacggtgactcacacctgtaatcccagcactttgggaggccaaggtaggagaatcaattgaggtcaraagtttgagaccagcctggccaacatggggaaaccccatctctactaaaaatacaaaaatcaggctgggcgcagtggctaacgcctgtaatcccagcact

SEQ ID NO: 25382 - DNA, 201 bp, Homo sapiens
gtccagattatacaagacacaagatctataacagattttagaccaaacatttcagtcatgtcgtagtctttgactgaatatttagccctgaaatggttttycctgtattttctaaatgccaaaccccaacctgaagtgagtgatgccttggtaaaggctctgtggcatttagatggccccggcacagtgagcttgccagaa

SEQ ID NO: 25383 - DNA, 201 bp, Homo sapiens
atcatagacttatgaatttggattaaatggattttaaaatatcatggcagagccaaagagccccctttttagatacatgcgtctgtgtgtgagtggaaacrgagtgcttcattctgtggccatctgggttgtggtttggggaggggaacactgacctgggagcgagccttgggctctcatggagctcctgcctctgtcctt

SEQ ID NO: 25384 - DNA, 201 bp, Homo sapiens
cattctcctgcctcggcctcctgagtagctgggactacaggcgcccaccaccatgcccagctaattttttacatttttagtagaggtggggtttcaccatkttagccgggatggtcttgatctcctgaccttgtgatccgcccgccttggcctcccagagtgctggaattacaggcgtgagccaccgtgcccggtcctaaa

SEQ ID NO: 25385 - DNA, 201 bp, Homo sapiens
ccttgcatttacttgatagcagactcctctttgataaaggcctttgataaaggcctcattccgccagtttatcttgccacctcaatgaatcgctagctgtrtcaggaatccctacacaatccatttaaatgactgtggcagggcctcttcccctgtggaagctgaaggtggcacgtccatctccgatgaaatgcgaatggg

SEQ ID NO: 25386 - DNA, 201 bp, Homo sapiens
ctgcctcggcctcctgagtagctgggactacaggcgcccaccaccatgcccagctaattttttacatttttagtagaggtggggtttcaccatgttagccrggatggtcttgatctcctgaccttgtgatccgcccgccttggcctcccagagtgctggaattacaggcgtgagccaccgtgcccggtcctaaatctttaa

SEQ ID NO: 25387 - DNA, 201 bp, Homo sapiens
ggggtttcaccatgttagccgggatggtcttgatctcctgaccttgtgatccgcccgccttggcctcccagagtgctggaattacaggcgtgagccaccgygcccggtcctaaatctttaatcattatatggggttgtagaatagtaattgagtttggtcttattttcatcaatatactatttcctcagtttgaatgtttg

SEQ ID NO: 25388 - DNA, 201 bp, Homo sapiens
gggtttcaccatgttagccgggatggtcttgatctcctgaccttgtgatccgcccgccttggcctcccagagtgctggaattacaggcgtgagccaccgtrcccggtcctaaatctttaatcattatatggggttgtagaatagtaattgagtttggtcttattttcatcaatatactatttcctcagtttgaatgtttga

SEQ ID NO: 25389 - DNA, 201 bp, Homo sapiens
ggcagatgcccttgcatttacttgatagcagactcctctttgataaaggcctttgataaaggcctcattccgccagtttatcttgccacctcaatgaatcrctagctgtgtcaggaatccctacacaatccatttaaatgactgtggcagggcctcttcccctgtggaagctgaaggtggcacgtccatctccgatgaaat

SEQ ID NO: 25390 - DNA, 201 bp, Homo sapiens
tgctgggattacaggcgtgagccactgcacccagccaattttttgtattttttagtagagacagggtttctgcatgttggccaggctggttttgaactccygacctcagatgatcctcctgcctcaacctcccaaagttgctgggattacaggcatgagccaccgcacctggccatgtatctcataatttttaaaagaatt

SEQ ID NO: 25391 - DNA, 201 bp, Homo sapiens
ttgcacttacatgtagtggtaatatgtaatattcatatgcacggtacctacatgcacacaatcccagcactttggttgtttttcttttttttttttttttyctgagacagtctcactctgttgtccaggctggagtgcagtggcgtgatctcagctcactgcaacctccacctcctgagtctaagcaattctcctgcctca

SEQ ID NO: 25392 - DNA, 201 bp, Homo sapiens
ccgcacctggccatgtatctcataatttttaaaagaattcctgtacaggctgggcgtgggggttcacgcctataatcccagaactttgggaagctgaggcrggaggatcagttgagttcagcagtttgagacaagcctgagcaacatagtgaaaacctatctctagaaaaaactttaaaaagtagctgggtatggtagcgt

SEQ ID NO: 25393 - DNA, 201 bp, Homo sapiens
actccatctcaaaaaaaaattacccaggcgtggtggcacacaactgtagtaccagctactcgggaggctgaggcaggaagatcacttgagcccaggaggcrgaggtttcactgagccgagatttgcaccactgcactccagcctgggtgactgagctagactccatctcaaaaaaaaaaaaaagaaaacgaaattttacgt

SEQ ID NO: 25394 - DNA, 201 bp, Homo sapiens
gcgtgaacccgggaggcggagcttgcaatgagccaagatggcgccactgcacgccagcctgggctacagagcaagactccgtctcaaaaaaaaaaaaaaaatttaaacaaaaaaaaaatcttttggcatttttttttctccctttagggacaaaggatcccttctcatgattatcctaagatctaaggttattctttttgc

SEQ ID NO: 25395 - DNA, 201 bp, Homo sapiens
ggcgtgaacccgggaggcggagcttgcaatgagccaagatggcgccactgcacgccagcctgggctacagagcaagactccgtctcaaaaaaaaaaaaaaaatttaaacaaaaaaaaaatcttttggcatttttttttctccctttagggacaaaggatcccttctcatgattatcctaagatctaaggttattctttttg

SEQ ID NO: 25396 - DNA, 201 bp, Homo sapiens
tccagcctgggcaacagagcaagactctgtctcaaaaaaaaaaatttaggccaggcacagtggctcacacctgtaatcccagggctttgggaggccgagaygggtggatcacgaggtcaggagatggagaccatcctggctaacacggtgaaaccctgtctctactaaaaattacaaaaatttagccgggcgtggtggcgg

SEQ ID NO: 25397 - DNA, 201 bp, Homo sapiens
actctgggcagagagttaactggaggaacagcctctgctgtcggaaaaatctagtctactattttctagctgattggaaaatacaataatgtatttgtctggcctctgctttttttattttaatgcagcaccttatatttgcttcttgcacttggccctgtcctttctctttggccaaacacagtttaggccacagttacc

SEQ ID NO: 25398 - DNA, 201 bp, Homo sapiens
gactctgggcagagagttaactggaggaacagcctctgctgtcggaaaaatctagtctactattttctagctgattggaaaatacaataatgtatttgtctggcctctgctttttttattttaatgcagcaccttatatttgcttcttgcacttggccctgtcctttctctttggccaaacacagtttaggccacagttac

SEQ ID NO: 25399 - DNA, 201 bp, Homo sapiens
agactctgggcagagagttaactggaggaacagcctctgctgtcggaaaaatctagtctactattttctagctgattggaaaatacaataatgtatttgtctggcctctgctttttttattttaatgcagcaccttatatttgcttcttgcacttggccctgtcctttctctttggccaaacacagtttaggccacagtta

SEQ ID NO: 25400 - DNA, 201 bp, Homo sapiens
cccaagtgcaccctgtcccttagggtagtgaggcaaaagaactaatttacatatgcttgtagagcagtgttacaattagtcaaattctgtactagaaatayggcctgtaacgctgtctcagccaggcagaaaagtatgtcttaattatggacaatccacatctttatatttagaatccctaaaatatttaacgttcttttt

SEQ ID NO: 25401 - DNA, 201 bp, Homo sapiens
aagactctgggcagagagttaactggaggaacagcctctgctgtcggaaaaatctagtctactattttctagctgattggaaaatacaataatgtatttgtctggcctctgctttttttattttaatgcagcaccttatatttgcttcttgcacttggccctgtcctttctctttggccaaacacagtttaggccacagtt

SEQ ID NO: 25402 - DNA, 201 bp, Homo sapiens
ctatagtaactaaaatagtacgttctgctttgaaggtgtccctacaccacaccgaagatactcaccttgtggagattggaaggatgccagctctttaaatyagacatcgtttttgcttaacgtaacttaaaaatgaaaaacagagcttttgatattaattgaaatagtgagaaaataaatgtatttaggttatttttttgt

SEQ ID NO: 25403 - DNA, 201 bp, Homo sapiens
gttgttttgttaaataacattcctctttatgccgtttcccagatgtagtggaaccaaaggagaggggcaagctcctagccacccagacagcagctgaattrtctaaaaacttatcttcacccagttcttacccgccagctgtgaataagggcaggaaggtagctagtcccagtcccagtggcagcgtgctattcacagatg

SEQ ID NO: 25404 - DNA, 201 bp, Homo sapiens
atttttattttcctctttggcccaaacaccttggagttaaatgttcagagtatggatccaagtgatcctgttgtaatccagttatcctaaaaagaagttcrgccaggcacggtggctcacgactgtaaatcccagcactttaggaggccgaggtgggggatcacaaggtcaagagttcgagaccagcttgaccaacatggt

SEQ ID NO: 25405 - DNA, 201 bp, Homo sapiens
ctgtgcccagccacttaattcacctcttatacgatagcatggtataaaaggaaaaatccaattatttggaacttctagttctgtttgggttaatttttatktttgttttaagtgctttacattcttccttgttttttagggagacattagagaagcaagtattttctctctggaggcagaagatgtttcagcatcgagaaa

SEQ ID NO: 25406 - DNA, 201 bp, Homo sapiens
gtttccagctcatcttctaaccttaggggagtagcacttaagttatttctctgttgcagagatggctgagcgattccatcatgtcactgtgctccagatayacttctgtgactggcagcaggcctgggagcggagggagagcttgtacgctcaccatgcccaggtggagaaactggccaggaagatggccctgcggcgcgc

SEQ ID NO: 25407 - DNA, 201 bp, Homo sapiens
agcaagaccctgtctctacaaataataaaaaataagctgagcatggtggcacatacctgtggtcccagctacttgggaggctatggtgagaggactgcttsagcatgggaggttgaggctgcagtgagccgtgatggtgccgcagtacttcagcctggataataacatgagaccctgggtgacagcgtgagaaagaaaaaa

SEQ ID NO: 25408 - DNA, 201 bp, Homo sapiens
cagtttatggttttttggctgtctgctttccttccctttctctttgtgttgctttctccctcatctaagcttattcacctcttttatttttttcagagacrgggtctcactctgttgcccaggctggagtggagtggcgtgatcatagttcaccacagcctcaaactcctgggctcaggcgatccccccacctcagcctcc

SEQ ID NO: 25409 - DNA, 201 bp, Homo sapiens
acggtagctgctttctcctctgtctgcagtgcctggccctgcggggagcggagcggcagaagctgatgcgagcagacctgcaccaccagcacagcgtgctscacagggcgctgcaggcatgggtggtaggaactgctgcttccctcctgatcttgctgtggggacaggggaggtttctggagactttgttttccttccttg

SEQ ID NO: 25410 - DNA, 201 bp, Homo sapiens
cagggtgcgggcagcagaattccacatggcccagctcctgcgttgggcctggagccagtggagggaggtaaggctttggtgcgaggtgccacccgtgtatyacttttggacaggtgggctgtgtgtcagcaggactcacaggcaacatatgggccacaccacctacctctgagctgaaggaggagaacaggcagcatagaa

SEQ ID NO: 25411 - DNA, 201 bp, Homo sapiens
ggtatgcgcctgtagtcccagctactccagaggctgaggcaggagaatcgcttgaacccaggaggcggaggttgcagtgagcattgcaaccactgtgctcyagcctgggcgacagagtgagactccatcttaaaaaaaaaaaaaaaaaaaacattgaaaatgccacagttgccggatgcagtataatcctgcattacaggc

SEQ ID NO: 25412 - DNA, 201 bp, Homo sapiens
atgctgattgtatgttagaagtacattgactctaagagaaagcctaacaatggctgaaacaaattgagatttgttttttctgttttttgtttttttttttwaaattaactttttttttacctttagagacagggtctcactatgttttccaggctggtcttgaactcctgcactcaagcgatcctccctgctctgcctccc

SEQ ID NO: 25413 - DNA, 201 bp, Homo sapiens
gaacctaggaggcggagcttgcagtgagccaagatcgcgccactgcactccagcctgggcgacaaagcgagactccatctcaaaaaaaaaaaaaaaagaaraaaaactatgagtgggttaggaggagtgacatgttagtaacctgcagaaccatgaaaagaaatttaaagtgattgacaggccagtgtggtggctcatgct

SEQ ID NO: 25414 - DNA, 201 bp, Homo sapiens
gaggtgggcgatcacttgaggtcagtagttcaagaccagcctggccaacatggtgaaaccctgactctactaagaatataaaagccagttgtggtggcggrcacctgtaatccccactatttgggaggctgaggcaggagaatcgcttgaacccgggagccgagatcgcaccacagagtgagactctgtctcaaaaaaaaa

SEQ ID NO: 25415 - DNA, 201 bp, Homo sapiens
agaagcctcccttctctctctatcctggtgtcatctgccttccccgcacccatgcatctgcagcggggcattacgtcgctggaaagagaacaccatggccsgagtggatgaagccaaaaaaacctttcaagcaagtactcattacagaaggaccatatgttccaaggtgaggtataaggaggcaagctggtcacccaggag

SEQ ID NO: 25416 - DNA, 201 bp, Homo sapiens
agcatgatttgctatgttttctcctagtctgtgacttgtcttttcattctcttaacagtatcttttgcagaggaaaagtttttaattttgatgaagtccawtctatttttttttaatggattatgtttttttttttttttttttttttttttttttgcgagagtcccactgttgcccaggttggagtgcagtggtgtgagg

SEQ ID NO: 25417 - DNA, 201 bp, Homo sapiens
ctagtctgtgacttgtcttttcattctcttaacagtatcttttgcagaggaaaagtttttaattttgatgaagtccattctatttttttttaatggattatgtttttttttttttttttttttttttttttttgcgagagtcccactgttgcccaggttggagtgcagtggtgtgaggataacccattgcagcctggaact

SEQ ID NO: 25418 - DNA, 201 bp, Homo sapiens
tgaactgggaaatcaaaaaattcatgtgactggctttatttatgtggtctgcagctgaactctcagtatctctgaggtctgcctgtactagtcccagttcygccacttgttagctgggaaccttgagccctccagctgtaaaatgaagttgataaccacttgctgaggtagttatattaaagtaggtagttcatgaaaagt

SEQ ID NO: 25419 - DNA, 201 bp, Homo sapiens
tggcagacatgctgctgtgtgcagaagaagctgcccagtttgagatggcagaagagcaccacaggcacagccagctggtaagagccctgcatcctggcacrggtccgcttggcagccttgcttgggtatccactcttgggggaccctgacccctatcaccttcattaaatgcagtcagctatgggtgagttttggtcatga

SEQ ID NO: 25420 - DNA, 201 bp, Homo sapiens
gtaccttatctatagatgttattttgattatagtctatacatttttgattgtgtggtactctcaacattttgttaaaacataacattgataagaaaaaatygattctggatgggtccactgtctgtctgtagttggcacattcctcatgcctatgtgggtttttgccggatgctctgatttcctcccatgtccccacgata

SEQ ID NO: 25421 - DNA, 201 bp, Homo sapiens
tttcttggactgttttttttttttttttttttgagatggagtttcgctcttgttgcccaggctggagtacagtggtgcgatcttggctcactgcaacctcygcctcctaggtacaagtgattctcttgtttcagcctcccaagtagctcggattacaggcattcgccaccatgccaattttttttttttttttttaagtag

SEQ ID NO: 25422 - DNA, 201 bp, Homo sapiens
catgtcgtggacccccagcgtttggccatgaaaccagaaagttcaggatatctaggggatttcacacatatttcctaaattccagagctactgtgctttcrgtggtctaattaggttttacaagaaagttgcaacattttaggcaatccacagtccaaaatcagaggttgacaaattttatattagatatcaggttcttat

SEQ ID NO: 25423 - DNA, 201 bp, Homo sapiens
cctctatatagtcactacctggatatagtaattgttaatatttgctatgtttgcctcattgttttttgctgaataatttcaaagtaaattatagacatcaygacactttgcacctaaatatttcagcatgcgtcactcagagacattttcttatgtaacgacaatgtcattatcatccctaagaaaagtaacagtgattcc

SEQ ID NO: 25424 - DNA, 201 bp, Homo sapiens
atttggatagtttctgtttgtctccagttatgcaaatgcatgtgattttgatgttgagttttttggatactgtttatatggttttgtttcccaattagatkcagaagtaataatacatagaaatgtgaacattagtacactttttaacttaagtttattgagtttataccaaagtaagtcaagcactgtgctagacactgg

SEQ ID NO: 25425 - DNA, 201 bp, Homo sapiens
tgcagccggaggtcagcccagcagagactgcagctggagagggcagtgcaacaccaccaccggcagctgctgctggaggggctggcccggtggaagacgcwccatctgcagtgtgtcaggaagagggtgaggctgacggtggcaactctccaagttctgcctgcctggcaaggggtgtccaggccaggagaccatttctca

SEQ ID NO: 25426 - DNA, 201 bp, Homo sapiens
gtaagaagctattacaaaattccaggtgagattttccacaaagatgataagaagacggtggttggattctcaatgtctttaaaagatgtaactgacatctytaaaagatgtatggatgagatacgaagttttagcgtccaagatgacttccaagttttggcctaagcagttggaacaatggagtgccatttactgaaatag

SEQ ID NO: 25427 - DNA, 201 bp, Homo sapiens
  misc_feature (1)...(201): n = A,T,C or G, or insertion/deletion polymorphism (see Tables 1-2)
acagtaccaggccctgtgtgcaggggcaggctagacactgagctggcacggccagtgcctgggaagcccagctcctgcagctgggagcctggtcttccccnacccctgcagggcaggcagtgacaaggacttggtgtccccctccctggcttcctcctagcttccttgctcagcatctacccttctttcctttgcaggtgt

SEQ ID NO: 25428 - DNA, 201 bp, Homo sapiens
tttttcatttgtttttctttttttgccctaacattacaacaaatatttaccctttctgttgccttttttctttcttctcacatctccaggtttctatctgkgataattttccttctcctatcagaacgtcccagggtattctctttcgggtaggtctgctagtgagaaattctctcatattttgtctaattccatcttcac

SEQ ID NO: 25429 - DNA, 201 bp, Homo sapiens
tagtctgtgacttgtcttttcattctcttaacagtatcttttgcagaggaaaagtttttaattttgatgaagtccattctatttttttttaatggattatgtttttttttttttttttttttttttttttttgcgagagtcccactgttgcccaggttggagtgcagtggtgtgaggataacccattgcagcctggaactc

SEQ ID NO: 25430 - DNA, 201 bp, Homo sapiens
gtctgtgacttgtcttttcattctcttaacagtatcttttgcagaggaaaagtttttaattttgatgaagtccattctatttttttttaatggattatgtttttttttttttttttttttttttttttttgcgagagtcccactgttgcccaggttggagtgcagtggtgtgaggataacccattgcagcctggaactcct

SEQ ID NO: 25431 - DNA, 201 bp, Homo sapiens
gagaaccgcttgaacaaacaaggcagacgttgcagtgagtcgagattgtgccactccactgcaccctgggcaacagagtgagactctgtctcgaaaaaatwaaaaaaatggcttccgcgggaggcctacacaccgccagttgtgttcctgctatgtctctagtgatccctgaaaagttccagcgtattttgcgaatactca

SEQ ID NO: 25432 - DNA, 201 bp, Homo sapiens
atcggcctcccaaagtactggtattacaggcgtgagccaccacatccggccgcttggagccaggttttaacctaagcagccagaaagctgcatcatcatcttttatatatatatatatatatgttttgagacagagtattgctcgctctgtcacccagactggagtgcagtggcgcgatcttgcctcactgcaacctctgc

SEQ ID NO: 25433 - DNA, 201 bp, Homo sapiens
tgcattcctgtaatcccagctacatgggaggctgaagcaggagaatcggttgaacccgggaagtggaggttgcagtgagcctagattgcaccactgcattscagcctgggcaacagagcgagactgtctcggaaaaaaaaaaaaagaaaaagaaaaaatgaaaactaggcaaggtgcagtggtgcctgtctgtagtcccag

SEQ ID NO: 25434 - DNA, 201 bp, Homo sapiens
gcctcccaaagtactggtattacaggcgtgagccaccacatccggccgcttggagccaggttttaacctaagcagccagaaagctgcatcatcatcttttatatatatatatatatatgttttgagacagagtattgctcgctctgtcacccagactggagtgcagtggcgcgatcttgcctcactgcaacctctgcctcc

SEQ ID NO: 25435 - DNA, 201 bp, Homo sapiens
ggctatggtgagaggactgcttgagcatgggaggttgaggctgcagtgagccgtgatggtgccgcagtacttcagcctggataataacatgagaccctggrtgacagcgtgagaaagaaaaaaggccaggcatggtggctcatgcctgtaatcgtaacactttgggaggctgaggtgggaggatcacctgagcctgaggag

SEQ ID NO: 25436 - DNA, 201 bp, Homo sapiens
ctagttttcttccctttctaagagccactttgagaggccataaactcattctactgatgctactgttgctcagaacatgtttagaattccccttttcttgtttgttgttgtttgtttttttgttttgagacagtctcactcttttgcccaggctggagtgcagtggcacgatcttggctcactgcaacccctgcctcccgg

SEQ ID NO: 25437 - DNA, 201 bp, Homo sapiens
ccccatcgtctcagcccaaaagcttcttaagctgataaccaacctcagcaaagcctcaggatacagatcaatgtgcaaaaattgcagacattcctgtacamcaacaacaggcaagcagagaaccaaatcatgaatgaattcctattcacagttgccacaaaaataataaaatacctaggaatacagctaacaagggaagtg

SEQ ID NO: 25438 - DNA, 201 bp, Homo sapiens
ataaacaaggcaccatttatctgcttacttactgatggactgttgacttcctctgctttttagaattacgaacagtactaccaagagcattctttttctattttttttttttttttgagactccgtgcagtggcacaatctcagctcactgcaatctccgcctcccaggttcaagcaattcttctgcctcagcttcccatg

SEQ ID NO: 25439 - DNA, 201 bp, Homo sapiens
actgtaaatatcaatatggactctctctctctctatatatatatgtgtgtgtgtgtgtgtgtgtgtgtgtgtgtgtgtgtgtgtatatatatatatatatttttttttttttaccataaatgcatttctggtctggcgcgatggctcccagcactttgggaggcagaggcaggtggatcacccgaggtcaggagttcgaga

SEQ ID NO: 25440 - DNA, 201 bp, Homo sapiens
gggaggccaaggtgggcagatcacttgaggtcaggagtttgagaccagcctggccaacatggtggaatcttgtctctactgaaaaatacaaaaattagttsggtgtggtggcaggtacctgtaatcccagctacttgagaggttgaggcaggagaatcgcttgagcccaggaggtggaggttgcagtgagctgagatcgtg

SEQ ID NO: 25441 - DNA, 201 bp, Homo sapiens
taaaaaaaaaagtaatttaaatataatattttaagtcagagacctagcccacattcatctagtgttgaattaaggagagcaggagactaggagctggcatrtagttcagaaatgtggctcctgagaggctgcaaatcattttctctcttttttattctctttttcttgtagttagaaggggaagataaaagactttgattc

SEQ ID NO: 25442 - DNA, 201 bp, Homo sapiens
tgacgcggcccttcctggcagaggccccgacagcactggtcccacacagccccctgcctggggccctgtcaagcgcccctggcccgaagcagcccccgacrgcaagcacaggcccggagctgctgctgctgcctctttcctccttcatgccctgcggggcggctgcaccagccagggtacgtcctccaccaccaggcctgg

SEQ ID NO: 25443 - DNA, 201 bp, Homo sapiens
ctaagtgggaggatcacctgagtccgggaaattgaggctgtagtgagctatgattgtaccactgccctctagcctgggcaatggagcaagaacctatctcaaaaaaaaaaaaaaaaaaaattagctgggcatggtggtgcatgcctgtggtcccagctgctcaggaggctgaggcaggaagattgcttaagcccaggaggt

SEQ ID NO: 25444 - DNA, 201 bp, Homo sapiens
gttggatttggtttgctactattttttgaggatttttatgtctgtagtcacgaggtctattggtcttttatttttctttttggtaatatctttgtctttgktatgatggcgatactggtctcaatgaatttggaagtgttcctctattttctggaagagtttatggagcattgttttgatatttatttatttatttattta

SEQ ID NO: 25445 - DNA, 201 bp, Homo sapiens
tcccccaaaaacttaaccaggtagggctatggactatgaggaggaacccatagagggtgccctcactgggtgggggctgcagcactgagctctgccatctmcccacaggaggacgggcagggtgcgggcagcagaattccacatggcccagctcctgcgttgggcctggagccagtggagggaggtaaggctttggtgcga

SEQ ID NO: 25446 - DNA, 201 bp, Homo sapiens
aaaatttttaattactcatttaattttttttacttgttagagatctattaggtttctatttattgtttttgtttgttttttgagatggagtctcactcttktcacccagactggagtacggtggtgtgatctcagctcactgcaacctctgcctccctggttcaagcaattctcctgcctcagcctcccgagtagctgaga

SEQ ID NO: 25447 - DNA, 201 bp, Homo sapiens
aattattttagattccacatataagtgagaacaggtcatatttgtctttgtgtgtttggagtatttcacttaatataatgttctccatttccgaaattcaygttgtcgaaaacgacagaatttcttcctttttttttttttttgagacggagtctcactctgtcgccaggctggagtgcagtggcacaatctcagctcact

SEQ ID NO: 25448 - DNA, 201 bp, Homo sapiens
ctgacagtgtttactacatggtccgcagagtactctttaggcctgctttatttcatcttctcaagcaaattaacgatggccttaatatgaagctctgtggsctctaactctggcatagtttctgttttttttttttttttttttttgagatggagttctgctctgtcgctcaggttggagtgcatggcgcgatctccgctc

SEQ ID NO: 25449 - DNA, 201 bp, Homo sapiens
cggtggcaactctccaagttctgcctgcctggcaaggggtgtccaggccaggagaccatttctcaggaaggggtctttcctgacagcactccatgcagccrgtatgagtggtgggtggtttggggtcctgtaagacaaagctgcaggagcctttctgggcgtttggtggagcctagcgagtagccagccccagaatccagt

SEQ ID NO: 25450 - DNA, 201 bp, Homo sapiens
aaagatgataagaagacggtggttggattctcaatgtctttaaaagatgtaactgacatctctaaaagatgtatggatgagatacgaagttttagcgtccmagatgacttccaagttttggcctaagcagttggaacaatggagtgccatttactgaaataggaaagactgcaggagaagcaggtttgtgggaagagatta

SEQ ID NO: 25451 - DNA, 201 bp, Homo sapiens
aattttatattagatatcaggttcttattgccgtctctcctagaatgaaactagtaagcccatggggtgcctttaactcacaggaagtaactgtaccgcartttacctgccttaaaacaaagttttaaaaacttgaaacctgaaggtgttcttccttttgtttcagaatagcactgctgtgcaaatgtatcgaattgtggc

SEQ ID NO: 25452 - DNA, 201 bp, Homo sapiens
taagtgggaggatcacctgagtccgggaaattgaggctgtagtgagctatgattgtaccactgccctctagcctgggcaatggagcaagaacctatctcaaaaaaaaaaaaaaaaaaaattagctgggcatggtggtgcatgcctgtggtcccagctgctcaggaggctgaggcaggaagattgcttaagcccaggaggtt

SEQ ID NO: 25453 - DNA, 201 bp, Homo sapiens
taatatttgtattttttttttttgagacggagtctagctctgttgcccaggctggagtttagtggcgcaatctcggctcagtgcaagctctgcctcccagsttcatgccattctcctgcctcagcctcccaagtacctgggactacaggcgcctgccaccacgcccggctaattttttgtatttttagtagagagggggtt

SEQ ID NO: 25454 - DNA, 201 bp, Homo sapiens
aggtacatttgggaaattcaggagttcttagtaggcagatggtatgtaaagttactagagtgagcggggtgcggtggctcatgcctgtaaatcccaacactttgggaggctgaggcgggaggattgcttgagcccaagagttcaagaccagcctgggcaacatagagagaccccatctgtttttttaaaaaaagctactag

SEQ ID NO: 25455 - DNA, 201 bp, Homo sapiens
aaaattgtagacacaaagtttatcttaaagtgtatatctcctaaaaaggatggtctcccacataaccataatatcattattatattccaagaaatttaatrttgatataatatataacatgcagttcatattaaaactgtatattgttgctattttcatttccatagtctaattaaaggtcacccattgcttttagttgtt

SEQ ID NO: 25456 - DNA, 201 bp, Homo sapiens
attaaggaggaaaatacatcatccttgagtcacatttatttctctttgggcttttatttatatatctgtatctatatctatctagctatctgtagatagattttttttttttttttgagatggagtttcgctcttgtcacccaggctggagtgcagtggcgcaatctcggctcactgcaacctccgtctcctgggttcagg

SEQ ID NO: 25457 - DNA, 201 bp, Homo sapiens
tgtggcaccagcaggcagcagcacgtcaccaggagcaggagtggcaaacagtggcctgtgcccaccaccgccacgggcggctcaagaaagctttctgcctytggagggaaagtgcccaagggctcagaacagagtgagtggccagttctgccttacaagcctttccatcacaggccagctttgcttgttctagcagcacca

SEQ ID NO: 25458 - DNA, 201 bp, Homo sapiens
gaggcataggttgcagtgagccgagatcccgccactgcactccagcctgggcaacagagcgagactccaactcaaagaaaaaaaaaaaaaaacttagtgcgtgtgtgtgtgtgtgtgtgtgtgtgtgtgtgtgtggccttgaacccctgctctctgccagtagtggggttcagcttgtcttaaagatgtttccagctcatc

SEQ ID NO: 25459 - DNA, 201 bp, Homo sapiens
aggggagtagcacttaagttatttctctgttgcagagatggctgagcgattccatcatgtcactgtgctccagatacacttctgtgactggcagcaggccygggagcggagggagagcttgtacgctcaccatgcccaggtggagaaactggccaggaagatggccctgcggcgcgcctttactcactggaaacactgtat

SEQ ID NO: 25460 - DNA, 201 bp, Homo sapiens
ggattttctctttttgaagtacatattcaagtcttattcctgtttttctcatgagttgtatattgagtatttgtactaattaatatataggaggttttctrtttttgaatatgaatcttttgtatgttttatgtgtgataaatatcttctccctctgctctcttcatcatttgatgaattaagatgttttaaattttaagc

SEQ ID NO: 25461 - DNA, 201 bp, Homo sapiens
aggcataggttgcagtgagccgagatcccgccactgcactccagcctgggcaacagagcgagactccaactcaaagaaaaaaaaaaaaaaacttagtgcgtgtgtgtgtgtgtgtgtgtgtgtgtgtgtgtgtggccttgaacccctgctctctgccagtagtggggttcagcttgtcttaaagatgtttccagctcatct

SEQ ID NO: 25462 - DNA, 201 bp, Homo sapiens
tataattaatatgtgttctctcaggtttaaggaatctatttcttccctgatgtcatgaagatattctggtttttgttttttggagacagggtctcgcactrtcacactggctggattgcagtggcacaatcagggtcactgcagcctcaacctcccaggcttgaggagtcctcccatctcagcctcccaaatagatggcac

SEQ ID NO: 25463 - DNA, 201 bp, Homo sapiens
tgcactccagcctgggcaacagagcgagactccaactcaaagaaaaaaaaaaaaaaacttagtgcgtgtgtgtgtgtgtgtgtgtgtgtgtgtgtgtgtgsccttgaacccctgctctctgccagtagtggggttcagcttgtcttaaagatgtttccagctcatcttctaaccttaggggagtagcacttaagttatttc

SEQ ID NO: 25464 - DNA, 201 bp, Homo sapiens
tgatgaggggtaatagctttacctttaaatcttttggtgcctttgatgtcacttcaagtatctctgcagtgaggtatccaaggatggctgcactgttcacrgtggcagtcacgcccctacacatccatgactggtcgtcctacatttgaggtgtctgtctatgaatatggcccacccggaactgtaaggaggctctctgtg

SEQ ID NO: 25465 - DNA, 201 bp, Homo sapiens
ggtagtagaatgttcagatgaaaaggatattcaggaacctgcagacataaaatctgtcattgagtgttttcatttctccacttgtgcctcacaatatgacrctatcaagattcttccagaaaaagtctaaacgtggtccaagaaagaaggaactactcttttttgctattctttttttccccccagattttctggtgaatt

SEQ ID NO: 25466 - DNA, 201 bp, Homo sapiens
tgtgatatggtgtcataacattacaggaggggtttgaacagagtgctgagagtacacagctactcactctgtttacattggagaaggttcaggcatttgcyggccattttaggcaggaagaataatatgaacaaaagaattattatgtacttcctgtacctcatttttgaagtttttaatctcttcactgacaatttatgt

SEQ ID NO: 25467 - DNA, 201 bp, Homo sapiens
tgaggcaggagaattgcttgaacttgggagatggaggttgccgtgagctgagatcgcatcattgcactccagcctgggtgacagggcgagacgccgtctcaaaaaaaaaaaaaaaaaagaaaaaggccgggcctggtggctcatgtctgtaatcccagcactttgggagtccaaggcgggcggatcacgaggtcaggagat

SEQ ID NO: 25468 - DNA, 201 bp, Homo sapiens
atctataagataatacacatttcgtacattatgttacagtcaaaaaacattctgagtagtgcatggaaatatcaatcattaaaatttgattctgagcagamgtgagtattattttcctgagctttgaagttatatcatccaggttggctggctctcgtgtcttctacttttgatcatggttgctttcagacttttaccttc

SEQ ID NO: 25469 - DNA, 201 bp, Homo sapiens
aaaaacttacttgcaaggccactgagcgaggaggtaggagaacaggtctcaaaccggcctccccaaagataagccttagggatatttgtgggttagggaaktggggtggtttaaggtgtggggaaaggtgattggcagtggggaaaatgcagtaacattcattgcacacaagtgtagtcagggttcatggcatgtcatagg

SEQ ID NO: 25470 - DNA, 201 bp, Homo sapiens
tcatgcgagttgcctgcttcagcctcccaagtagctgagaccataggcatgcgccaccacgcctggctaatttttgtatttttagtagagatgggggtctygccatgttggccaggccggtctcggactgccctcaagtgatccacccaccttggcctcccaaagtgctgggattatagacatgacactgcatccagctga

SEQ ID NO: 25471 - DNA, 201 bp, Homo sapiens
gtggcctgtaaattctttcctggcttctgtgcctctctcctacttgatttattctgttctctccttcctgtcctgcctcaggccatccttcacgcagagcracagcttctgtataggtcttggttcatgtggcaccagcaggcagcagcacgtcaccaggagcaggagtggcaaacagtggcctgtgcccaccaccgccac

SEQ ID NO: 25472 - DNA, 201 bp, Homo sapiens
ggaattgagcatggtggctcatgcctataatcccagcactttgggaggctgaggccagtggaccacccgagctcaggagttcgagaccagcctggccatcrtggcaaaaccccatctttactaaaagtacaaaaattagctgggcatggtggcacacgcctgtagtcccagctactctggaggctgaggcaggagaatcct

SEQ ID NO: 25473 - DNA, 201 bp, Homo sapiens
tgagattactttgaatctatagatcagagtgggaaaaactgacatctgtattgtactgagttctccattttgcctataaaattattagatttactcctatrtttgatatttgtgatgccatttgaaaatagtatataaatatatataactattttttccttattgctagtttatagaaatatagagttgaccctcatttat

SEQ ID NO: 25474 - DNA, 201 bp, Homo sapiens
  misc_feature (1)...(201): n = A,T,C or G, or insertion/deletion polymorphism (see Tables 1-2)
tgaccaacatggagaaaaccctctctattaataatacaaaaattagccaggcgtggtggcgcaagcatgtaatcccagttactcaggagagtgaagcacgnaaattggcatgaacccgggaagtgaaggttgcagtgaaccgagatggcaccgctacactccagcctgtgcaacagagcgagactctgcctcaaacgaaca

SEQ ID NO: 25475 - DNA, 201 bp, Homo sapiens
cttgctgaccttggcctcgcctttcctgactttcagtctccctataaaattggagatcccacagagatctcagacccccctgcagcccctggtcagcccargggaacagaccccatgtttctttccagcaacactgcccactcagcgaggaagcagccgcgacgcccacacttcctgttggagcctgcgcagagccagagg

SEQ ID NO: 25476 - DNA, 201 bp, Homo sapiens
  misc_feature (1)...(201): n = A,T,C or G, or insertion/deletion polymorphism (see Tables 1-2)
cacggaaattggcatgaacccgggaagtgaaggttgcagtgaaccgagatggcaccgctacactccagcctgtgcaacagagcgagactctgcctcaaacnaacaaaagtgaccatagccagggaataaactgatgggcccatattgtgatagctgactgctgcagataagggatagggacagcagctgtggccagtgggt

SEQ ID NO: 25477 - DNA, 201 bp, Homo sapiens
cagcccagtcactatagagactgtcctgctttggggcctttcagtgtccactgtgtgttctgaggatctcactccctgtcgcacactgaccatgtttaacyagtttctcagttgggggcttcacacctgcacatgtgagcttcaatggcacctgaagccctgggaagttgtaggccaaaatttgatcataggtgctttttt

SEQ ID NO: 25478 - DNA, 201 bp, Homo sapiens
  misc_feature (1)...(201): n = A,T,C or G, or insertion/deletion polymorphism (see Tables 1-2)
tctcccgggcgcctcccaagctccagctggggaacaaggaatgcactccaaaccccagccttttagggggtcctgctgagggccaggtcggggatgatccngggttcctagtcgctaatatcatggtcttggcttttccacttcactcacgggttcgccttcatgtcttaagcccctgctgtgtgcagggcaggaccttgg

SEQ ID NO: 25479 - DNA, 201 bp, Homo sapiens
  misc_feature (1)...(201): n = A,T,C or G, or insertion/deletion polymorphism (see Tables 1-2)
taggtgggagggtcacttgaaccttgaaggtcaaggccacagtgagccgtgattatgccactgcactccagcctgggcgatggagtgagaccctgtctctnaaaagtaaataaataaaataaatgcctccatccctcatatggagtcccatagagcacccatcccgctcttcagacagggtggaataagcaagaactccct

SEQ ID NO: 25480 - DNA, 201 bp, Homo sapiens
  misc_feature (1)...(201): n = A,T,C or G, or insertion/deletion polymorphism (see Tables 1-2)
gaaattgtttaaattggcccatagagaaattgaccaagtggttaagttggtttaatagagtttgctccaggacaaaactgaatcagctttggtttggttcngactgtagcgtgtgtgttaatgagcatgtttcaacacacatcctggggacaaaaccctggggtcagccatcccacacggctgcattactgcgccacgaat

SEQ ID NO: 25481 - DNA, 201 bp, Homo sapiens
acagtgcctacctcttggggttgtcgtggagatcaagtgagatgacaggtagagagatacacacttaggacagagcccaggcatcagcatgcagcactaaygtgggtgcctcccacttgtgatctgccgccttccctgcctgcctcagtgggcctggagggctcctcatcttggcatctgtgccctgctctcaaccctgtt

SEQ ID NO: 25482 - DNA, 201 bp, Homo sapiens
ttgggaaacagagttctttgactggaagaaggaactgggggtggggactggtttggggtgaagtgtcaagagtgttttgaaccaggctcttgatgtcaaayttgagagaaagcaaacgttgagtctgaccttcaaggaagaggtcagggccagagattgagaagaatcttcagcacaggccgaaggtaaccccagagccac

SEQ ID NO: 25483 - DNA, 201 bp, Homo sapiens
aaaggtcctctgtgccctcctgcttctctttgtacctccagttctctatttcacactcccttccagctcagatgtcacctcctcccccaggccagtccacstccacccctaccccagaggcatagctttatcagaacattcatcttatagttgttcactggcttctctttccccacaggctgtgaagtcctttagagtaca

SEQ ID NO: 25484 - DNA, 201 bp, Homo sapiens
ttttctttggccatactaataggtgtatacaggcatttaattgtgggtttttaaaaattggtgttacatgagtatactgcataatgatggagatttgactrtccactacccaaatagtgaacgttgtacatgataggtaatttttcaacccttgggcctcttccaccctcccttcccctcgtttggagtccccagtgtcta

SEQ ID NO: 25485 - DNA, 201 bp, Homo sapiens
caacatggtgaaaccccatgtctactaaaaatacaaaaattagcggggcgtggtggtgcatgcttataatcccagctactccggaggctgaggcacaagartcactttaacccaggaggcagaggctacagtgagttgagatggcgccactgcactccagccttggatgacagagcgagactccatctcaaaataaatatc

SEQ ID NO: 25486 - DNA, 201 bp, Homo sapiens
atctcctgacctcgtgatccgcccacctcggcctcccaaagtgctgggattacaggcttgagccactgcgcccagccttttttttttttttcagatggagyctcactttgtcacccaggatggagtgcagagtggcgtgatctcggctcactgcagcctctgcctcctgggttcaagcaattatcttgcctcagactactg

SEQ ID NO: 25487 - DNA, 201 bp, Homo sapiens
agccagatatgtaacaatgagctgcattatcatgggacagatttcactctatgttgtctgtagttgtccactggtgtcctgaatggtaatatattaataaytcacttcctgcctgaaagttgggtattgaacaaagtatggataataggagaggctttgcagctgcacttacttgggtttgaatccctcttccaacctgta

SEQ ID NO: 25488 - DNA, 201 bp, Homo sapiens
gtgattccctggatgcataagaagataagtgataatgtgagatagcttgaggttttgcagtgagtgctgcaagtgagcctggtctaagagaaatctttgtaggttagagtgaccaggaaaagtgagtgtttctgtaaagcacaggttgtaaactcttatttccccatgactcttttcctagagcaaattcgaaaattagta

SEQ ID NO: 25489 - DNA, 201 bp, Homo sapiens
cgggcagcagaattccacatggcccagctcctgcgttgggcctggagccagtggagggaggtaaggctttggtgcgaggtgccacccgtgtatgacttttsgacaggtgggctgtgtgtcagcaggactcacaggcaacatatgggccacaccacctacctctgagctgaaggaggagaacaggcagcatagaaagtgtta

SEQ ID NO: 25490 - DNA, 201 bp, Homo sapiens
aggtgtaagccaccgtaccaggccataacatatcttttaacaaatcaaactgtgtaggtcaaacagagcatgtctgtggtgtctaaagcaggatctgaccrtaggaaccataagtttccaaccattaatgggcagatctgggactttttctcaattgttttgttttatttttttccccagcagtgaatctagagatggtac

SEQ ID NO: 25491 - DNA, 201 bp, Homo sapiens
ttgcctctccaggagccaccgtcacagacctggggtggacccggaagccaggaggtatagtgactcttgctgtgctccttgcctgcccataggtcctggtscagtggcgggaagctgtgtcagtgcagatgtattaccgacagcaggaggactgtgccatctgggaggcccagaaggtgctggacaggggtaagtggggcc

SEQ ID NO: 25492 - DNA, 201 bp, Homo sapiens
agaaacagcagtatactctgatttcctcgttgctgttttcctacagcaaatcagaaaataattggggcagaaaagaaacttaagactgaaaagaaaacctrtcttccttttctttatagttttgattgtcttagagtgttcttttaggcaagccactagctttttttgtcaatcataaatggctaaggcctgtactaaaac

SEQ ID NO: 25493 - DNA, 201 bp, Homo sapiens
gaatcactttaacccaggaggcagaggctacagtgagttgagatggcgccactgcactccagccttggatgacagagcgagactccatctcaaaataaatmtctctctctctctctatctatctgtctatccatctggagggctttgaatgctagtttgaggttagccagaactctggcttccttagtacgaagtccaggg

SEQ ID NO: 25494 - DNA, 201 bp, Homo sapiens
gtccctaccctgcataggtaaccagtattctgatttccgtcatcataggttagttttgcatggtttttttcttgtcgcccaggctggagtgcagtggcgckgtctcagctcactgcaagctctgcctcccaggttcatgccattctcctgcctcagcctcccgagtagctgggactacagacgcctgccaccacgcccagc

SEQ ID NO: 25495 - DNA, 201 bp, Homo sapiens
cctgtaggtggtctcggtctagccatggaggggtgtggggagccctcagtgtgtgctgtccagaaagaccccatctccaccatggctctctacccggctcrgtgctgcttaggaaggcccaagtcgtcagactcacctgtgcacagaggctctgcttcctatgggggggacgataaagttgagcaaaactctaaaaacccg

SEQ ID NO: 25496 - DNA, 201 bp, Homo sapiens
  misc_feature (1)...(201): n = A,T,C or G, or insertion/deletion polymorphism (see Tables 1-2)
gtggtagatgcacctctgaggcctgcctaaacagggggaagtgtgggcccaagagcagcctcagtcttccttgtcccctacagacttaccagggcagggtncgaagcatcctccgggaggtggcagccagggagagccagcacaacaggcagctgctgcggtgagtctcccgggcgcctcccaagctccagctggggaaca

SEQ ID NO: 25497 - DNA, 201 bp, Homo sapiens
actggctagccatattcaaatattgaagctggaccccttctttacaccatatataaaaactaactcaagatgggttaaagacttaaatttaaaacccaaarctataaaaaccctggaagaaaatctaggcaataccattcaagacataggcacaggcaaagatttcatgatgaagatgccagaagcaattgcaacagaatc

SEQ ID NO: 25498 - DNA, 201 bp, Homo sapiens
tgaacctgggaggcagagcttgcagtgagctgagatagcaccactgcactccagcccgggcaacagagcgagactctgtctaaaaaaaaaaaaaaaaaaawatatatatatatatatatatatatatataatcagtgggccgggcatgatggctcacgcctataatcccaggattttgggaggccgaggcaggaggatcac

SEQ ID NO: 25499 - DNA, 201 bp, Homo sapiens
aacctgggaggcagagcttgcagtgagctgagatagcaccactgcactccagcccgggcaacagagcgagactctgtctaaaaaaaaaaaaaaaaaaatatatatatatatatatatatatatatataatcagtgggccgggcatgatggctcacgcctataatcccaggattttgggaggccgaggcaggaggatcactt

SEQ ID NO: 25500 - DNA, 201 bp, Homo sapiens
tatagatgaggccagagaggttaatttacactcacacagatgatgtataaaatggaggcaaagcaggaagccacccccaactcagaccccagcccacggtrgctgctttctcctctgtctgcagtgcctggccctgcggggagcggagcggcagaagctgatgcgagcagacctgcaccaccagcacagcgtgctgcacag

SEQ ID NO: 25501 - DNA, 201 bp, Homo sapiens
gtctgcaccttcaccattatgtagtcactggtggaaatcccacaaaacagcaaactctgacttggatctgccttaggctgtctgcggacctggtttcagcrctggtgggactgcagccggaggtcagcccagcagagactgcagctggagagggcagtgcaacaccaccaccggcagctgctgctggaggggctggcccgg

SEQ ID NO: 25502 - DNA, 201 bp, Homo sapiens
gtctcgatctcctgaccttgtgatccacccgcctcagcctcccaaagtgctgggattacaggtgtgagccaccacgcccggctgtactttttcatgagacrgcaagaatatgtgatttgggaagagatgttagctccaacatcatcatatatatatatgattttttttttgccgtagattttactatgagcagcgattact

SEQ ID NO: 25503 - DNA, 201 bp, Homo sapiens
tcgtccctttgtggctgctgttcttagaaaataactgcttacaaggctgacccttggctggtgtctggaaacttagatttcagaagggttcccaccattcyctaactgatgaatagttaactggacctacactgttgtgtgttcatgcaatgttgtttatgctgaatactagcactccctctaggagtctggaattttggt

SEQ ID NO: 25504 - DNA, 201 bp, Homo sapiens
tccctaccctgcataggtaaccagtattctgatttccgtcatcataggttagttttgcatggtttttttcttgtcgcccaggctggagtgcagtggcgctrtctcagctcactgcaagctctgcctcccaggttcatgccattctcctgcctcagcctcccgagtagctgggactacagacgcctgccaccacgcccagct

SEQ ID NO: 25505 - DNA, 201 bp, Homo sapiens
  misc_feature (1)...(201): n = A,T,C or G, or insertion/deletion polymorphism (see Tables 1-2)
gacctgggacaacctcagtaaaattttgggtatttccctctgttcagctgtctcctttctagtaccctgaccccaaattccagcccctctggcagtcatgnactccagtctttgcctcctcagctcactgagactgagggaggctctgcttagcctcccttcccctcactgtttagaaggtgcccccaggcagaaagtctg

SEQ ID NO: 25506 - DNA, 201 bp, Homo sapiens
tcgcaaactcctggcctcaagcaatccacctgcctcggcctcctaaagtgctgggattacagacatgagccaccatgcccggccccaataggaggctttgrttgtgtttctattgtaagtctattcacttccattgtaagtccattataaaacaatggtttgtttacttgatgccaacatatattgtctctactttcttgg

SEQ ID NO: 25507 - DNA, 201 bp, Homo sapiens
gcgtgcaaggcagttacttcctggaccgtgtgtgagaagcaaatggcaacagcttggccttgcctctccaggagccaccgtcacagacctggggtggaccyggaagccaggaggtatagtgactcttgctgtgctccttgcctgcccataggtcctggtccagtggcgggaagctgtgtcagtgcagatgtattaccgaca

SEQ ID NO: 25508 - DNA, 201 bp, Homo sapiens
aatgcattggcatgatcttggctcactgcaacctctgcctcctgggttcaagcgattctcctgcctcagcctcctgagtagctggaattacaggcacctgycactacacccagctaattttgtgtttttagtagagacagggttttgccatgttggccaggctggtctcaaattcctgatctcaggtgattctcccgcctg

SEQ ID NO: 25509 - DNA, 201 bp, Homo sapiens
tgagggtcttgttagttgagcaggctggtcttgaactcctggtctcaagcagtcctcctgccttggcctcccaaagtgctcaccacaacctccgcctcccrggttcaagtgattcttctgcctcagcctcccgagtagctgggattacaggcatgtgtcaccacgcctggctaattttttgtatttttagtagagacaggg

SEQ ID NO: 25510 - DNA, 201 bp, Homo sapiens
ggcaggctagacactgagctggcacggccagtgcctgggaagcccagctcctgcagctgggagcctggtcttcccccacccctgcagggcaggcagtgacraggacttggtgtccccctccctggcttcctcctagcttccttgctcagcatctacccttctttcctttgcaggtgtcagcacagcgggctactcctaggg

SEQ ID NO: 25511 - DNA, 201 bp, Homo sapiens
ggacccagcctggcaggcagtgggtatctccacccctcaggtcctgtcggcggcaagcgagcagcctgcgcaggtggctggagctgaacagagaggagccrgggcctgaggaccaggaagtagagcagcaggtgcagaaagagctggaacaggtgaggccccaggccatccccaggtgtccctggggacgccccgggctgt

SEQ ID NO: 25512 - DNA, 201 bp, Homo sapiens
tgcccttctatgcgttagtgtggcagattcagaaaggcctgctggggtggaggtcctgctgtaaaccatttgttcctgactttgggtttttggctgatcakatgggagatagaatgagcatatttgcattggttcttggccaccatagtctgaagtatgtgcctggtcgctcactgccttggtcctacaggcatcaatatg

SEQ ID NO: 25513 - DNA, 201 bp, Homo sapiens
agttgtagcaacctgccgggtccacgcatgggcgggtcatactccacgggttccggtttccactccctgtgaaccaaaagccagagaggcccacgcacgastccggaagtgagggagggaggactttcgtacgcagccgcctcccagctggaacctcatctttagtgctcggccgcgggcggcgtaactcggggttccgcc

SEQ ID NO: 25514 - DNA, 201 bp, Homo sapiens
  misc_feature (1)...(201): n = A,T,C or G, or insertion/deletion polymorphism (see Tables 1-2)
cttgtgtcttcctgtacatttgaatgttcatctgtatcatttcccttcagcctaaagatgatcttttagtgtttttatactaaggtcaactggggttgaangatctcagcttttgtgtctggtctctgccctctggctgggccagagctccgtctttcaaccctgtccagcttctgctgtctctgttcccctcttggccct

SEQ ID NO: 25515 - DNA, 201 bp, Homo sapiens
tatccatctggagggctttgaatgctagtttgaggttagccagaactctggcttccttagtacgaagtccagggagatggttttaggtggtggccacgggraatagaggctgatgaaaggacatctcttgtctcttctggcttctgcagacagagcagctttgcctttacctagtcatgtattgtgggctggtataagatt

SEQ ID NO: 25516 - DNA, 201 bp, Homo sapiens
gccacgggcggctcaagaaagctttctgcctctggagggaaagtgcccaagggctcagaacagagtgagtggccagttctgccttacaagcctttccatcmcaggccagctttgcttgttctagcagcaccatgagctccaagtgcctgtctggaggactgcattaccccagactctggttgtaagttctggaagttcaac

SEQ ID NO: 25517 - DNA, 201 bp, Homo sapiens
  misc_feature (1)...(201): n = A,T,C or G, or insertion/deletion polymorphism (see Tables 1-2)
tcccaagctccagctggggaacaaggaatgcactccaaaccccagccttttagggggtcctgctgagggccaggtcggggatgatcctgggttcctagtcnctaatatcatggtcttggcttttccacttcactcacgggttcgccttcatgtcttaagcccctgctgtgtgcagggcaggaccttggaaagcagctgtta

SEQ ID NO: 25518 - DNA, 201 bp, Homo sapiens
aggaggcagaggctacagtgagttgagatggcgccactgcactccagccttggatgacagagcgagactccatctcaaaataaatatctctctctctctcyatctatctgtctatccatctggagggctttgaatgctagtttgaggttagccagaactctggcttccttagtacgaagtccagggagatggttttaggtg

SEQ ID NO: 25519 - DNA, 201 bp, Homo sapiens
acccgagctcaggagttcgagaccagcctggccatcgtggcaaaaccccatctttactaaaagtacaaaaattagctgggcatggtggcacacgcctgtaktcccagctactctggaggctgaggcaggagaatcctttgaacctaggaggcggagcttgcagtgagccaagatcgcgccactgcactccagcctgggcga

SEQ ID NO: 25520 - DNA, 201 bp, Homo sapiens
ccgtaccaggccataacatatcttttaacaaatcaaactgtgtaggtcaaacagagcatgtctgtggtgtctaaagcaggatctgaccgtaggaaccatargtttccaaccattaatgggcagatctgggactttttctcaattgttttgttttatttttttccccagcagtgaatctagagatggtactatgaaggagag

SEQ ID NO: 25521 - DNA, 201 bp, Homo sapiens
tccctgcctctccctcaggccttagccctgccttgggtggagggagggcacctggtctgtgggggagctctaagcagggagacctgggcctcacctcctgycctccctggaggtgtgggccacgtggctggcctttgtactggaaaggaggagaaagaaggcgcggctgcagtgggcgctccaggcctaccaggggcagct

SEQ ID NO: 25522 - DNA, 201 bp, Homo sapiens
catcaggtcctgcaaaggtctgtatcattaatcagtgtcatcagtgtcctcagaagacactagcagagtccagggtgatgcgttcagccacaagcacaaaractgctttttctaaagagcaggatgaggtgaatgtgggaacggaaagcagttgtcacgaaggctgtgtggctctgctgggggagaggcatccacagtctg

SEQ ID NO: 25523 - DNA, 201 bp, Homo sapiens
aggaaccataagtttccaaccattaatgggcagatctgggactttttctcaattgttttgttttatttttttccccagcagtgaatctagagatggtactrtgaaggagaggactagagctgagggtctgaggccccacactaactgctcctctctttcctgagtggctttttactgatggattccatctttgatttgctg

SEQ ID NO: 25524 - DNA, 201 bp, Homo sapiens
agactgcaccactgcactccagcctgggcgacagagcaagactccgtctaaaaaaaaaaaaaaatcattaaaaggagtttgaaaaagttgagtcaggccgmcatggataactgagagactcaagacccgagtggaggaagtaactgcagatatgatagaaaaatcaagcaaactggaattagaaggggagcctaaaaatgt

SEQ ID NO: 25525 - DNA, 201 bp, Homo sapiens
agaaatttaaagtgattgacaggccagtgtggtggctcatgcttgtaatcccagcactttgggaggccaaggtcagcagattgtctgagctcaggagtgcragaccagcatgggcaacatggcgaaaacccgtctctactgaaatacaaaaaattagctcgtttgggtggcgtgtgcctggagtcacagctactcaagaga

SEQ ID NO: 25526 - DNA, 201 bp, Homo sapiens
ccagagtgcagtgacacattcacggctcactacagccttgacctctggggctcaagcgatcctcccacgtaagcctctggaatagctgacaccacaggtgygtgcctccatacttggctaactaaaaaaatttagggggggctggatgtggtgattcaggcatataatcccagcattttgggaggccgaggcaggcagatc

SEQ ID NO: 25527 - DNA, 201 bp, Homo sapiens
aatggcacctgaagccctgggaagttgtaggccaaaatttgatcataggtgcttttttctgagactgcaagttctttggcagctcttcagagagggtcttkgctcccccaaaaacttaaccaggtagggctatggactatgaggaggaacccatagagggtgccctcactgggtgggggctgcagcactgagctctgccat

SEQ ID NO: 25528 - DNA, 201 bp, Homo sapiens
cctcagtcttccttgtcccctacagacttaccagggcagggtgcgaagcatcctccgggaggtggcagccagggagagccagcacaacaggcagctgctgyggtgagtctcccgggcgcctcccaagctccagctggggaacaaggaatgcactccaaaccccagccttttagggggtcctgctgagggccaggtcgggga

SEQ ID NO: 25529 - DNA, 201 bp, Homo sapiens; identical to SEQ ID NO: 6177

SEQ ID NO: 25530 - DNA, 201 bp, Homo sapiens
cggatgtggtggcgggcacccataatcccagctactggggaggctgaggcaggagaatcacttgaacccgggaggcggagcttgcagtgagccaagattgygccattgcactccagcctgggcgacagagtgatgagactccatatcaaaaaaatatatatatattttgtgacgccatagctgccataggtagtgattcct

SEQ ID NO: 25531 - DNA, 201 bp, Homo sapiens
ctggtttttgttttttggagacagggtctcgcactgtcacactggctggattgcagtggcacaatcagggtcactgcagcctcaacctcccaggcttgagkagtcctcccatctcagcctcccaaatagatggcactacaggcatgtgccaccacacccagcgaatttttgtattttttgtagagatgggctttcatcgca

SEQ ID NO: 25532 - DNA, 201 bp, Homo sapiens
ggctgaggcaggagaatcgcttgaacccaggaggcggaggttgcagtgagcattgcaaccactgtgctccagcctgggcgacagagtgagactccatcttaaaaaaaaaaaaaaaaaaaacattgaaaatgccacagttgccggatgcagtataatcctgcattacaggctcatgcctgtaatcctagcactttgggtggc

SEQ ID NO: 25533 - DNA, 201 bp, Homo sapiens
gaggttgaggcaggagaatcgcttgagcccaggaggtggaggttgcagtgagctgagatcgtgccactgcactccagcctgggtgaaagagcaagacttcktctcaaaaaaattaaaaaaaaaagtaatttaaatataatattttaagtcagagacctagcccacattcatctagtgttgaattaaggagagcaggagact

SEQ ID NO: 25534 - DNA, 201 bp, Homo sapiens
cgcttgaacccaggaggcggaggttgcagtgagcattgcaaccactgtgctccagcctgggcgacagagtgagactccatcttaaaaaaaaaaaaaaaaamaacattgaaaatgccacagttgccggatgcagtataatcctgcattacaggctcatgcctgtaatcctagcactttgggtggctgaggtgggcgatcact

SEQ ID NO: 25535 - DNA, 201 bp, Homo sapiens
actcctagccttaagcaatccacccaccttggcctcccgtagtgctgggatgataggcatgagtcactgcctggccaaaagtttttttattttaaactttyaattaattaattttgagactgggttatgacactggctaatttttgtatttttggtagagatggggtttcacctgttgcccagggtggtcttgaactcctg

SEQ ID NO: 25536 - DNA, 201 bp, Homo sapiens
gttccatgtctctcactttatatcaaaagctagaaatgacgaagctagaaatgcctatgctctgtaaatgcaacaacaaacccaggatgaccacacatctmtttactgaatgtctttacatcatatttacagtgtggtttactgaatattttaagcctactatcgagacctactgttcagaaaaaaggattcctttcaaga

SEQ ID NO: 25537 - DNA, 201 bp, Homo sapiens
tgagacagtttcatctcatcacccacggtggaatgcattggcatgatcttggctcactgcaacctctgcctcctgggttcaagcgattctcctgcctcagyctcctgagtagctggaattacaggcacctgccactacacccagctaattttgtgtttttagtagagacagggttttgccatgttggccaggctggtctca

SEQ ID NO: 25538 - DNA, 201 bp, Homo sapiens
tctcctccctctcggtcctccttgtagcctgagaggcaacaatattgaaattaggccaattaatagccccacagtggcccctaagtgttcagtgaaaggargagttccatgtctctcactttatatcaaaagctagaaatgacgaagctagaaatgcctatgctctgtaaatgcaacaacaaacccaggatgaccacacat

SEQ ID NO: 25539 - DNA, 201 bp, Homo sapiens
tttttaaattaaggtatgtacattagttttttagacaatgctattgcacacttaactacaagtgtagacataacttttttttttttttgagacggagtgtwgctctgttgcccaggctggagtgcagtggcgtgatcttggctcactgcaagttctgcctcctgggttcacgccattctcctccctcagcctcccgagtag

SEQ ID NO: 25540 - DNA, 201 bp, Homo sapiens
atttattttcttataatcttttatctcattttgagattgtaaacaaggtttttttttttcttttttgtggacaaatcttctggcatacttgtgtttatatrtgtgttattctgctccttatcttctttcctcatataacttcaaatgcttttttttttttttcctgagaccgcatctcaccctgttgcccaggctggagtg

SEQ ID NO: 25541 - DNA, 201 bp, Homo sapiens
tcagtatcttctcaggaggtagtctgagtaaatcaagtcacatcattctgtcaaacttccagtggcttcctgctgaaagtaaaagcccagagtccttactrtggtctataagaccaaccaactttttgtgtcacctattgagtttgtttttcatttctgctgtcatatttttaatttccgagagcttgttcttgttctctg

SEQ ID NO: 25542 - DNA, 201 bp, Homo sapiens
ttcacagaattagaaaaaactactttaaaattcatatggaacaaaaaagcatgaatagccaggacaatcctaagcaaaaagaacaaagctgcaggcatcaygctacccaacttcaaactatactgcgaggttacagtaacaaaaacagaatggtactggcacaaaaacagaaacatagactaacggaacagaatagagaac

SEQ ID NO: 25543 - DNA, 201 bp, Homo sapiens
tgaattgtttgaaccagtttatactcttgctggcagtgtatgaacatgttcattgacttaccaacactatactaatctggtaggtatgtctcattgttcgtgtgtgtgtgtgtgtgtgtgtttcttttttctttttcttttttttgggacaggatctcattcttttacccaggctggagtacagtggcatgatcatggctc

SEQ ID NO: 25544 - DNA, 201 bp, Homo sapiens
gaattgtttgaaccagtttatactcttgctggcagtgtatgaacatgttcattgacttaccaacactatactaatctggtaggtatgtctcattgttcgtgtgtgtgtgtgtgtgtgtgtttcttttttctttttcttttttttgggacaggatctcattcttttacccaggctggagtacagtggcatgatcatggctca

SEQ ID NO: 25545 - DNA, 201 bp, Homo sapiens
aattgtttgaaccagtttatactcttgctggcagtgtatgaacatgttcattgacttaccaacactatactaatctggtaggtatgtctcattgttcgtgtgtgtgtgtgtgtgtgtgtttcttttttctttttcttttttttgggacaggatctcattcttttacccaggctggagtacagtggcatgatcatggctcac

SEQ ID NO: 25546 - DNA, 201 bp, Homo sapiens
tcatgcaatcctccttcctcagcctcccagctcatgcaatcctccttcctcagcctcccaagtagctgggactacaaatatgcatcactgtgcctggctckgtgtgtgtgtgtgtgtgtgtgtagacagggtcttgcttggttgcccacgctggtcttgaactccagagctcaagtgatcctcctgcctcaccctcccaaa

SEQ ID NO: 25547 - DNA, 201 bp, Homo sapiens
tattttgaagaaatgccatttactttttttggctcctcaggtattacctgtacaacctgatgttccagacgtggaagacctatgtgcgtcagcagcaggaratgaggaacaagtacattagagccgaggttcatggtgagaaaaagaagtccatgtctgaagaagatgcccacatttactttgcagaaggtcataggaagg

SEQ ID NO: 25548 - DNA, 201 bp, Homo sapiens
agagaggagccggggcctgaggaccaggaagtagagcagcaggtgcagaaagagctggaacaggtgaggccccaggccatccccaggtgtccctggggacrccccgggctgtgctccctctcagccctgcctgtccctccatggccccaggtggaaatgcagatccagctgctggcagaggagctccaggctcagcgccag

SEQ ID NO: 25549 - DNA, 201 bp, Homo sapiens
ctggtcccacacagccccctgcctggggccctgtcaagcgcccctggcccgaagcagcccccgacggcaagcacaggcccggagctgctgctgctgcctcyttcctccttcatgccctgcggggcggctgcaccagccagggtacgtcctccaccaccaggcctgggcactggggctctcactctggtctgacttctggtg

SEQ ID NO: 25550 - DNA, 201 bp, Homo sapiens
gaattgacttacactattatggaggctgagaagttccatgacctgccatctgcaagctggagactcaggagagtgggtagtgcaattccagtctgtgtccraaggcctgggaaccaaggggcctcgaggtgtaaatcccagttgaagggcaggagaagatgagatgagatctgcccacgcaggcaggcaggaagcaaaagg

SEQ ID NO: 25551 - DNA, 201 bp, Homo sapiens
  misc_feature (1)...(201): n = A,T,C or G, or insertion/deletion polymorphism (see Tables 1-2)
attcttaggtgtagagtccctgactcaggagtaggggaagaagtaggaatgattcacagaagcctcccttctctctctatcctggtgtcatctgccttccncgcacccatgcatctgcagcggggcattacgtcgctggaaagagaacaccatggcccgagtggatgaagccaaaaaaacctttcaagcaagtactcatta

SEQ ID NO: 25552 - DNA, 201 bp, Homo sapiens
ttgccatacatagtttcagacctggaagatggttgtaaagaggacagggttgattaactcataagtcccagggcctggaaagtgacaggacactggagtasagtggcctaatgcagtgtgagatctcaaagcacctattggtaaagaactgggcttaagttagatactcttcttgattgaataaaatggtcacagaaccac

SEQ ID NO: 25553 - DNA, 201 bp, Homo sapiens
acagatgccagaaaaatccacactgcccctgcccgaaccatgttcctgctgcgtcccctgcccattctgttggtgacaggcggcgggtatgcagggtaccrgcagtatgagaagtacagggagcgagagctggagaagctgggattggagattccacccaaacttgctggtcactgggaggtaggaatgaggtggaactgc

SEQ ID NO: 25554 - DNA, 201 bp, Homo sapiens
gtaaagaccctctctccagccaactaagggcaccttctaaggtactcagggttagaacttcaacataagagttttgggggagttttcagcaatttaacgcrtaacagatatttagcctctgtcttttcttgtgcttattggccaatgtatttttcctttggacaaaggtctattcaaatcctttgcacattttgattgatt

SEQ ID NO: 25555 - DNA, 201 bp, Homo sapiens
ttgatttgcatttccctgattactaataatgttgtattagtttgctagggctgctgtaacaaagcaacacaaactgggttgcttgaacagcagacatttgyctcatgattctagggctaaatgtctgagatcaaggtgtcagggttgcttcctttggagggctgtgagggagaatctgttccatgcctcttgcctagcttc

SEQ ID NO: 25556 - DNA, 201 bp, Homo sapiens
caggaggtcgaggctgcagtgagctgtgatttcaccactgcattccagcctgggtgacagagtgagaccctgtctcaaaaaacaaacaaacaaacaaacaaacttataaccaggatgccatggagacagactagtgagagtgaatgctggtcatagatgattgatatgaccatctcagtgtatgtcagctgaatatcaact

SEQ ID NO: 25557 - DNA, 201 bp, Homo sapiens; identical to SEQ ID NO: 6227

SEQ ID NO: 25558 - DNA, 201 bp, Homo sapiens
ccaggaggtcgaggctgcagtgagctgtgatttcaccactgcattccagcctgggtgacagagtgagaccctgtctcaaaaaacaaacaaacaaacaaacaaacttataaccaggatgccatggagacagactagtgagagtgaatgctggtcatagatgattgatatgaccatctcagtgtatgtcagctgaatatcaac

SEQ ID NO: 25559 - DNA, 201 bp, Homo sapiens
gtgagaccctgtctcaaaaaaaaaaaaaaaagaaaaagaaaaaatagtgcaactggccaggtgtggtggcttatgtctgtaatctcaacactttgggaggstgaggcaggagaattgcttgagcccaagagttcgagaccaacctgagcaacatagtgagacctcctctccgcaaaaaatggctgggtgcacatctgtggt

SEQ ID NO: 25560 - DNA, 201 bp, Homo sapiens
gagctgggtattttgtgtgtgtgttggtggggggtcaaggccaggaggggtgaggagagagccagagcaggtaagatgccaggttctcaccagggcacctstcgtggcttcccgctcatctcattcctcagatgctactttgtaacctgaattgaaaatgggtcaggtcctggcaagggaggggccaaactgcagaccggc

SEQ ID NO: 25561 - DNA, 201 bp, Homo sapiens
agactacctgtgacttgccaatgcctttccctgctctcagggcagaggtagaggaaggcagccaggattgcagtgaccaggttgtcatcagccacaaagcsctctgagttctcatgttgcaggtgactggcccttaggccatgtagtgacattaaagtcctattggtcacaaccctaaactcctctccacagaatgtcttt

SEQ ID NO: 25562 - DNA, 201 bp, Homo sapiens
ttgtgcccaggaggtcgaggctgcagtgagctgtgatttcaccactgcattccagcctgggtgacagagtgagaccctgtctcaaaaaacaaacaaacaarcaaacaaacttataaccaggatgccatggagacagactagtgagagtgaatgctggtcatagatgattgatatgaccatctcagtgtatgtcagctgaat

SEQ ID NO: 25563 - DNA, 201 bp, Homo sapiens; identical to SEQ ID NO: 6228

SEQ ID NO: 25564 - DNA, 201 bp, Homo sapiens
aaccctaaactcctctccacagaatgtctttgaggcttagaagggagggaaggtgtcagtgcttcctccattctggatacccttcttgcaagctcctcatycagggcctgaggctcccacctcgtgtcacctcaagacagccagagaggatgaaatctttggcttgggcttccagggctgtcataggcagagggcaagcca

SEQ ID NO: 25565 - DNA, 201 bp, Homo sapiens
gggtggggacactgccttactgctctggtatggatccccaaaacagcatgtcctgacaaaggtgttcccctaccccctatacggtcctatcagccattgtytcctattcacagggccggtcactccgcgcaagtttgggttcctgttttagaactgccacctaagcccctcttatttcatctttcctgtggtggaaacccc

SEQ ID NO: 25566 - DNA, 201 bp, Homo sapiens
ctcacgcgacgatctttctctcaggctgcccgccgtgagggcagtggttatacagaaaatagcttagagcatttggagtgtcggaaaatggattaaaatgkagctgtgattcagagtcggctgcctggtgtcatttcaaagagctaagatttgagagatgcgccatacttgtgtgtttcctacagggttcattttgtcagc

SEQ ID NO: 25567 - DNA, 201 bp, Homo sapiens
ggcacataacctcacacctacgcacacaccacctatacgcataacacactcacacctacacaccccctacacacaccctcacacctacacaccccacacaycctcgcacctatacacgcacccctccatgcacatacccttgcacctgcacacgtatcctccatgcacacacacttccacctacatgcacctacccctcac

SEQ ID NO: 25568 - DNA, 201 bp, Homo sapiens
gaccccaaacatttctaatattaaccattgaaatgtgagctatacatgcatttatgaatgattaataaaaagttagataattatttacctaattactccakttcagggttgcaggtggtcccctatccgatgggcagctcagggcacaaggcggaaaccagtcctggatgggatgtcttcccatggcagggtgcacccaca

SEQ ID NO: 25569 - DNA, 201 bp, Homo sapiens
agtttttcccacatcctctccaatgcttgtcatcttcctttttttttttttttttttggagatggagtcttgctctgtcacccaggctggagagcagtggygcaatctcagctcactgcaacctccgccttctgggttcaagtgattctacggcctcagccacctgagtaactggtattacagttactcggctcactgcaa

SEQ ID NO: 25570 - DNA, 201 bp, Homo sapiens; identical to SEQ ID NO: 6229

SEQ ID NO: 25571 - DNA, 201 bp, Homo sapiens
tgggcagctcagggcacaaggcggaaaccagtcctggatgggatgtcttcccatggcagggtgcacccacacccacactcactcagactgggaccatttasacacaccagtgagcctaatgtgcatggctttgggatgtggaggaaactagggtactcagagaacacccatgcagacatggggagaacgtgcacactccac

SEQ ID NO: 25572 - DNA, 201 bp, Homo sapiens
cagagcttgcagtgagccgagatcgtgccactgcactccagactgggagagagagtgagactccatctcaaaaacaaaaaaaaacaaaacccagaaattakctgggcgtggtggcgggtgcctgtaatcccagctacttgggaggctgaggcaggagaatcgcttgaacccggaaggtggttttattgttttgaggcatgg

SEQ ID NO: 25573 - DNA, 201 bp, Homo sapiens
ggaccttttaaaaatacaccggggtgcgatgggagagaaagtaggcacccgggagctgcgtggatgcagccagctctgagcctgagcctgagcggggttcrccactggttcgcctgccgtctgctctgctgctatcagctgagatgctgctttgttccttggtttgctcagcaactgggagagaggactcagcttctcttg

SEQ ID NO: 25574 - DNA, 201 bp, Homo sapiens
  misc_feature (1)...(201): n = A,T,C or G, or insertion/deletion polymorphism (see Tables 1-2)
tcttctgagtccagctgtctctctttggagttaatgagattgaggctccgagagagggagggatttgctcaagttcacctagccagtttgtagcagagccnggacccccatcaaggtaccccctcacgcgacgatctttctctcaggctgcccgccgtgagggcagtggttatacagaaaatagcttagagcatttggagt

SEQ ID NO: 25575 - DNA, 201 bp, Homo sapiens
tactttaaataattttcttcatgaaacaaagtttttttcttttttttttgagacggagtctcactctgtcacccaggctggaatgcagtggcatgatctcrgctcactgcaagctccacccttgggttcaagcgattctcctgcctcagcctcccaagtagctgggattacaggtgcctattactgcgccagctaattttt

SEQ ID NO: 25576 - DNA, 201 bp, Homo sapiens
ggaaggtcagagttcacatccagcggcctcgcagtagaggtggcggcaaggggactggtggtcagcccccgaggctggaggagcctggcctggggggcctragcaccctgagtcggagagcccgcttcaggtatctttggttccaaccatgaggagggcccagcagggggaggctgccagcgagcctcagacctcatgcct

SEQ ID NO: 25577 - DNA, 201 bp, Homo sapiens
gagttcaagaccagcctggcccacatggtgaaaccttgtctctactaaaaatacaaaaattagccaggcgtggcggcaggcacctgtaatccctgctactygggaggctgaggtgggagaattgcttgaacccaggaggcagaggttgcagtgagccgagatcgtgccattgtactccagcctggttgacagagcgagact

SEQ ID NO: 25578 - DNA, 201 bp, Homo sapiens
catgggctctgcatcctagtagtgaagcagggaggcctgtgtgctctaggctggggcggtcggaccttgtttctggctgcccttgttcgctggtctacatyagttttggagtcagggcattctgtttgtcagggttttgcgtgcctggagggcagaaggttggggtgggagcagccttgtagcttcaagatgggatgcggg

SEQ ID NO: 25579 - DNA, 201 bp, Homo sapiens
tcagcctcccaaagtgttgggattacaggcatgagtcaccgtgccaggcctaaaagcactttttctttttctttttctattttttttttttttttttttttgagatggagtcttgctctgtcacccaggctgaatgcagtggcaatctcagctcactgcaacctctgcttcctaggttcaagcgattctcccacctcagcc

SEQ ID NO: 25580 - DNA, 201 bp, Homo sapiens
gtggcggggacagggccagatttcatgttgaccctggggatgctgtgaatttctcctgcaggagagacatcattgaattttttcaactgtatcagtagcayagtatttttgtatgaaaagtgggagacttctgaacagtaattcatttaattgcaaagcattttgaaataaaaaaaatcaaacttaaaactgtgttctgtt

SEQ ID NO: 25581 - DNA, 201 bp, Homo sapiens
  misc_feature (1)...(201): n = A,T,C or G, or insertion/deletion polymorphism (see Tables 1-2)
tgagctggggagaaagtcagccccttgcccccaccctcgcccccgggggaagtgcatggcccgcagtcaggccactggacacaggatttggggccctggangtttctgctgaggcttcaagaggggtggtcctggcgttccaggcgcttcccatcagacagcaggagccagttctcagggtccttggctgaacacacaagc

SEQ ID NO: 25582 - DNA, 201 bp, Homo sapiens
ctcagcctcccaaagtgttgggattacaggcatgagtcaccgtgccaggcctaaaagcactttttctttttctttttctattttttttttttttttttttttgagatggagtcttgctctgtcacccaggctgaatgcagtggcaatctcagctcactgcaacctctgcttcctaggttcaagcgattctcccacctcagc

SEQ ID NO: 25583 - DNA, 201 bp, Homo sapiens
ggggagcagcagtgcaggaaaggccttactcagctgggcttgcaggtatgctcactcctgtctgagcgctgcttccttgtttctagcctccgtttagaatwaaaaaaaaatgtatagtacagtattccaattcatcaaaaggaataaagacagatcagcctgtctggtctaccaccattcagcctaagcataaggcagaac

SEQ ID NO: 25584 - DNA, 201 bp, Homo sapiens
tgaccatctcagtgtatgtcagctgaatatcaactcttaataataacagtctaactaggtgccaggccctgagctaaggttttgcatgattgtcttctaaygaggtgagttttgtttttgcaggtggagaaactgaggcttaagattagttaagaaatttcctaaggtcacacagctgctaagaagtggcagcgctgagat

SEQ ID NO: 25585 - DNA, 201 bp, Homo sapiens
gcttgagccaggaggtagaggttgcagtgagttgagattgtgccactgcactccagccggggtgacagagcaagactctgtctcaaaaaaaaaaaaaaaaagtagcttgaaatcgtgttctggaaagctgcttgctgagctgctcaggttgaagacccagagtgttccttttagttccatttagccccgtcgcgtggagtg

SEQ ID NO: 25586 - DNA, 201 bp, Homo sapiens
tgctggtcatagatgattgatatgaccatctcagtgtatgtcagctgaatatcaactcttaataataacagtctaactaggtgccaggccctgagctaagrttttgcatgattgtcttctaatgaggtgagttttgtttttgcaggtggagaaactgaggcttaagattagttaagaaatttcctaaggtcacacagctgc

SEQ ID NO: 25587 - DNA, 201 bp, Homo sapiens
cgggtttcaccattgttggccaggctgttcttgaactcttgacctcaggtgatctgcccacctcagcctcccaaagctgggattacaggtgtgagccaccrcacctggccacaattcctaagtttcaaatgtctccctgttctgagtagcataatgaactctctctctcccacctaggatatgaatcctccctctgtccat

SEQ ID NO: 25588 - DNA, 201 bp, Homo sapiens
ggtggcagcctcctgggtcctgcccagagcctggccactgacctggctgtgcatggacctgtgccctgcaggttgcacttcccccagctggccctgaggcrgaggctggggcagctgagctgcatgtccagacccgctctgaaactgcgctcctggcccttgaccgtcctctactacctcctgcccttcggcgccctcaga

SEQ ID NO: 25589 - DNA, 201 bp, Homo sapiens
atgccatggagacagactagtgagagtgaatgctggtcatagatgattgatatgaccatctcagtgtatgtcagctgaatatcaactcttaataataacartctaactaggtgccaggccctgagctaaggttttgcatgattgtcttctaatgaggtgagttttgtttttgcaggtggagaaactgaggcttaagattag

SEQ ID NO: 25590 - DNA, 201 bp, Homo sapiens
cttggtggcctgggccccactgacccccagcctatcaccacaggacctgcacacaaacagcccaaggcacagcaagggctcctacaatgacttcagcttcstgacgcacaccaatagagagggcgtccccatgcgtaagggcgagcacctgggcgagttcaacctgggctccaccatcgtgctcatcttcgaggcccccaa

SEQ ID NO: 25591 - DNA, 201 bp, Homo sapiens
ggaggtcgaggctgcagtgagctgtgatttcaccactgcattccagcctgggtgacagagtgagaccctgtctcaaaaaacaaacaaacaaacaaacaaacttataaccaggatgccatggagacagactagtgagagtgaatgctggtcatagatgattgatatgaccatctcagtgtatgtcagctgaatatcaactct

SEQ ID NO: 25592 - DNA, 201 bp, Homo sapiens
gcggcattccctgcctctgcaggctccctgatgtcagtgaaccctggcatggctcgctggatcaaagagctcttctgccataacgagcgggtggtcctgaygggggactggaaacatggcttcttctcactgacagctgtgggggccaccaacgtgggctccattcgcatctactttgaccgggtaagcaggatctaggcc

SEQ ID NO: 25593 - DNA, 201 bp, Homo sapiens
acttggtggcctgggccccactgacccccagcctatcaccacaggacctgcacacaaacagcccaaggcacagcaagggctcctacaatgacttcagcttygtgacgcacaccaatagagagggcgtccccatgcgtaagggcgagcacctgggcgagttcaacctgggctccaccatcgtgctcatcttcgaggccccca

SEQ ID NO: 25594 - DNA, 201 bp, Homo sapiens
aggaggtcgaggctgcagtgagctgtgatttcaccactgcattccagcctgggtgacagagtgagaccctgtctcaaaaaacaaacaaacaaacaaacaaacttataaccaggatgccatggagacagactagtgagagtgaatgctggtcatagatgattgatatgaccatctcagtgtatgtcagctgaatatcaactc

SEQ ID NO: 25595 - DNA, 201 bp, Homo sapiens; identical to SEQ ID NO: 6233

SEQ ID NO: 25596 - DNA, 201 bp, Homo sapiens
ggggcccagtcagctcagcatttggagtgacatcggggcaacaggccatgagtccctttgggtcttggctgccatggggtggacacaccgggctctggacrgggagtagcggcattccctgcctctgcaggctccctgatgtcagtgaaccctggcatggctcgctggatcaaagagctcttctgccataacgagcgggtg

SEQ ID NO: 25597 - DNA, 201 bp, Homo sapiens
gcccagtcagctcagcatttggagtgacatcggggcaacaggccatgagtccctttgggtcttggctgccatggggtggacacaccgggctctggacgggragtagcggcattccctgcctctgcaggctccctgatgtcagtgaaccctggcatggctcgctggatcaaagagctcttctgccataacgagcgggtggtc

SEQ ID NO: 25598 - DNA, 201 bp, Homo sapiens
caaccagcctcgcagaggcagaggccctggagcagtgacagcacaggagatctgctggctcgggggaaggggaggaaagaggaaaacaaagggagtgatcragtgagcctcgccccgccctccctgcgccggcccatgatgtgtcagtcagaggcgcggcaaggaccagagctccgcgcggcgaaatggtgagatgctgcc

SEQ ID NO: 25599 - DNA, 201 bp, Homo sapiens
ggtaaagggggtcacctactccctggagtcgttcctgggcccgcgtatgtgcacagaggacctgcccttcccaccaggtgggtcactgcacaggcggggcyaggcagccctgctgctgtgtggctggaccgggagggaggggaatgctggggaaggaactgaggctggcatgtggggcctccctgagaatccatgtgcaga

SEQ ID NO: 25600 - DNA, 201 bp, Homo sapiens
atactgagataacttggggatgtgacccaagtctgaacacaaaatttatttattttattttatttgttttgtttttcttttctttttttttttttttagayggagtctcactctgttgcccaggctggaaggcaatggcgcaatcttggctcactgcaacctccgcctccccggttcaagcgtctcccacctcagccttcc

SEQ ID NO: 25601 - DNA, 201 bp, Homo sapiens
tatatactgagataacttggggatgtgacccaagtctgaacacaaaatttatttattttattttatttgttttgtttttcttttctttttttttttttttrgatggagtctcactctgttgcccaggctggaaggcaatggcgcaatcttggctcactgcaacctccgcctccccggttcaagcgtctcccacctcagcct

SEQ ID NO: 25602 - DNA, 201 bp, Homo sapiens; identical to SEQ ID NO: 6293

SEQ ID NO: 25603 - DNA, 201 bp, Homo sapiens
catcaatgctattcagtggcaggaggaggaagttcaaaagagggaatgtggaggcatctgtggtactcagagccagcatgccagagctcaccaaaaccatytacccttcccaggcctagttaaattggtcagcggtcaggactcattgtcactgtcctggagaaacttccacctcaggctccttaaggaccagctgtggga

SEQ ID NO: 25604 - DNA, 201 bp, Homo sapiens
tctacgatgttaaagaaaggaaaaaggtaagaaagcaaagaaaaatccatccctaaggcacatatattgttcatgattctttgcatgtatgtttttaaatcttcttcgcagcaagaacctatcagatttgaaagcaaatgatctttgatgagtccagttctgttgcctttgcaatttttcaagcagtggtctgagaatgta

SEQ ID NO: 25605 - DNA, 201 bp, Homo sapiens
accatcaatgctattcagtggcaggaggaggaagttcaaaagagggaatgtggaggcatctgtggtactcagagccagcatgccagagctcaccaaaaccrtctacccttcccaggcctagttaaattggtcagcggtcaggactcattgtcactgtcctggagaaacttccacctcaggctccttaaggaccagctgtgg

SEQ ID NO: 25606 - DNA, 201 bp, Homo sapiens
accttgagatctttgaaagttctcctacctccaaaactcagacaagtcctctctcttgccaagtgcctaaagcaaggatatgtttatagaggcagctggggcatctggccaatttatttcccagcagacctgctgcttcccctgattccaatactttcttccccaacccaaaccaaggcgtctggcaatgttaaaaacatc

SEQ ID NO: 25607 - DNA, 201 bp, Homo sapiens
ctcagcaactccccagtaatggagttaggaagggccagacattcatccccatcaaaacccagccttcttctgactgtcccactacaaatctaaggaaaagyaattgaacttttcttttgttgccatctgaaaagccccattccttagaattgaataatacagattctatcctttaaatttttttatttcaatggctttagg

SEQ ID NO: 25608 - DNA, 201 bp, Homo sapiens
cagtatgccatgatcataccactgtactccagcctgggcaacagagtgagatcctgtctcaaaaattgaaaaaaaaaaaaaaaaaggtttaatgtgtagargggaaaaggctaaatggaaatgtgttaaagtcttaacggtgatcttccttggagcaatgatatagtgggtggttgctattcttttctttatacttttatg

SEQ ID NO: 25609 - DNA, 201 bp, Homo sapiens
caggcggaaaagatgaacatcagcctggctttcttcttgtatgaccttctctccctcatggatcggggctttgtgtttaacctcatcagacattattgcarccaggtgagtgtcccccccacccccacccccgagcgagccacttggttccttctcatataatgtgatgttcgttgccatggcacgctgtcttcttcatta

SEQ ID NO: 25610 - DNA, 201 bp, Homo sapiens
tggaggtgctggcctggttggaatagagaaagaatgaaatagcacatggggttatgtataaaacaaacccatttaaatacatttttaacaagcttggatgygcatgtaaagcttcctcagtttgagagttctttgcactgtgaaataggctcatgactgaagggcatcttacatggtagaggtctcaatttgtcacagagt

SEQ ID NO: 25611 - DNA, 201 bp, Homo sapiens
gcactgtgaaataggctcatgactgaagggcatcttacatggtagaggtctcaatttgtcacagagttcagaccttaccaactgtaatgtgcttttaatgwaaacagtgaccaagacctctcgtgtgtttttaatgtttagtcattttgtgactcctagaagaggacagcaatagcaaatccagagtaggatggacacttc

SEQ ID NO: 25612 - DNA, 201 bp, Homo sapiens
ataatcattctgtatttaaggaaacaagcatctcctgcataaatattaataatcactgagatttgtaggataggttaactgctaaaacaagcagaacccartctcagtggtttaaagcagtagttctcaaacttgagcatgcatcacaatctcctggaggacttgttaaaacacagattgctggacctcacccacagagtt

SEQ ID NO: 25613 - DNA, 201 bp, Homo sapiens
ataatcactgagatttgtaggataggttaactgctaaaacaagcagaacccaatctcagtggtttaaagcagtagttctcaaacttgagcatgcatcacartctcctggaggacttgttaaaacacagattgctggacctcacccacagagtttctgattcagcaagtccaggtggggcctgagaatttgcatttctaaca

SEQ ID NO: 25614 - DNA, 201 bp, Homo sapiens
tgggcacccttctcctaattaaggagagttccctcagtgacctggtgcaaagaagctgctgtggagaaaggaacaaaatctctgggctagagtttcctaaygatgttcatgttgctctagagatgcatagttacgtgttcccaagtccagcctcttacaagctgaagcgtgggctgtggttttcaagtttcatcctccttt

SEQ ID NO: 25615 - DNA, 201 bp, Homo sapiens
ccttctcctaattaaggagagttccctcagtgacctggtgcaaagaagctgctgtggagaaaggaacaaaatctctgggctagagtttcctaatgatgttyatgttgctctagagatgcatagttacgtgttcccaagtccagcctcttacaagctgaagcgtgggctgtggttttcaagtttcatcctcctttttttttt

SEQ ID NO: 25616 - DNA, 201 bp, Homo sapiens
tatgtctacccacagaggctgaactttgtaaacaaactagcatcagcccggaacattacaataaagatccagtttatgtgtggagaagatgctagcaatgygatgccggtaaggagggaaacgaacatttgcctcaaatcagggtgggctgctcacccctgtcacttcacacaagtccgggactcatcagtgtacaaagtc

SEQ ID NO: 25617 - DNA, 201 bp, Homo sapiens
ccactgcattccagcctgggcgacagagtgacactctgtttcaaaataaaataaaataaaaaataaaaaaggaacaaagtattaggcataataatcatcaycagagagtgattttatgaaagacaaaaacaaggtggcaagaagagagaataaagttacataaagatagcatttaagaacaaccacaggctgggcatggtg

SEQ ID NO: 25618 - DNA, 201 bp, Homo sapiens
catgttggccaggctgatctcaaactcctgatctcaggtgattcacctgtatttggttcccaaagtgttgggattacaggcgtgagccactgtgcccggcygtaaaatcattgtaaaaacaaaacaacaaattcaggtgtctgatttcatgtgcccccagcctcttaggtttggaacattatctagttagtacagtgtttt

SEQ ID NO: 25619 - DNA, 201 bp, Homo sapiens
gtaatgccatcattgttgcttctttccctttaaatatatagtaaatggtgttaaactatttagcacatccaggcagacattatttggtaagaggggcttcwttcttttttgtttatattcccaggccgaacatcagggtctttactgtattttaggtagcatcatctagttcaggtgttgcatataatacggctttaaggg

SEQ ID NO: 25620 - DNA, 201 bp, Homo sapiens
ccctcttggttaaatctgtgtgagtatgtaccaagtttataatatggatgttgggtttatcgtttagtatctagaacagtagtggtaagtagaattttttytgatgggtcaactccagttgaatgatggtcactgtctgatatgggagctatgattatgactaggctaggtaaaaagagtgctaaatttgacaaatgatgt

SEQ ID NO: 25621 - DNA, 201 bp, Homo sapiens
ggccacatagtttgagaaaacacaaagcagagagcctagcactttagaagtcttgcagatgttaaatttcccatcttaaagagtttacaatccagttaaaraaacaacttggcattcaaagaaatgggttcaaattcctattttgctacatttgctgtgtatggtagcaagtttagtctgtcagtctaattggacaatgat

SEQ ID NO: 25622 - DNA, 201 bp, Homo sapiens
atgtaaggggaatcatgaagtaactgtctttttgtgactggcttcttttactcataatgtcctcaggttcatctatattgtagtatgtatcagaatctccytccttttatggctaaataatattccattgtatatatgtagcatattttgttatggcctcatatatgtatctgttcatggacaagtgggttacttccacct

SEQ ID NO: 25623 - DNA, 201 bp, Homo sapiens
actggatcaggcttcccaggaacagcaacagagagcccagcaatttgtgtgttctcagtgtggaatgaatgaatgaatgaatgaatgaatgaatgaatgadccaaccattccttcacagtcttgcactatcagtgaatcttatgctttattgaacataaaaatcacctggaattgctgacttaaaatacagttttccaggc

SEQ ID NO: 25624 - DNA, 201 bp, Homo sapiens
tccctaactgtgtagactttggcaagttccttattccctgggaaccttgctttcctggtgtgttaaatgcagataatatctgcattacgctgtagttgtgdaaagagactgatgtgtggaaagcacttattataacacaattttaagtctttaataaatgtcaattctctttttctttctcggaaccacagaggacttact

SEQ ID NO: 25625 - DNA, 201 bp, Homo sapiens
tatggtctgagatagaagtcaagggaagagttgtataaaggtgaaaaacaaaattgaatgacacaaagatacggagaaagaggaaggccaagagagaccakcagatgcggaaagaaggaggcctcccagagttctctctggacagagggctgatggaaaacgaaagaggcagtgagaataaggaagaaaggcacttggatg

SEQ ID NO: 25626 - DNA, 201 bp, Homo sapiens
aatctcaagtctactccattgcttaaatccatcttctgattcacatagctcattatctttatggaataatgcattaactcttctaggctttttgcttgtcyaaatggacatttgcatatttcaacggtccagaaagtgtatcaaactgccaagtgatgcctaatggccctttatgtctctcctagtttggagacttactct

SEQ ID NO: 25627 - DNA, 201 bp, Homo sapiens; identical to SEQ ID NO: 6321

SEQ ID NO: 25628 - DNA, 201 bp, Homo sapiens
aggtgtggttgcatgcacctgtagccccagctattcaagaggctgagacaagagcatcgcttgagcccaggaggatcacagctgtgatcatgccactgcaytccagcctgggtgagagagtgaaaccttgtctcaaaaaacagacaaaaaaaaaaaaaaaaaagcaaaaacaaggcatgaagtatatcagggatctcccta

SEQ ID NO: 25629 - DNA, 201 bp, Homo sapiens
gtgactgaaaaaaaccacttttgtccacatttggggaaagataagattatactaaatgcctggcacatacactggaccttcagttacctagaaaactttcwaaataactttgccataacaagtggcaaattattaaggtcatgggctgtcttctcaaaattacttagataacatgattctctggccagtatgagaccctta

SEQ ID NO: 25630 - DNA, 201 bp, Homo sapiens
aatcattatttttatctggcttgggctctgggttactggccatgcaggcagatcttcccttccaaaaggaaacgttattattctcttgtattcgtttcttyaaaaacatgcagatttaacaaaacatattacttagcactcttactgatttagaaatatgatgacccttaggaaatgcatctccttaaaagaaattccagg

SEQ ID NO: 25631 - DNA, 201 bp, Homo sapiens
tcacttcatggaaaaattagcttccttccaatttgttctacaagctcctgactatgagcttcaggagaatgggggcagtgtttatcgccaccttatctccyagctgctaccatatagaaggtactcaacaataagtaaacgattgctgattagcaggaatactggtcagtttctagctcaagtgttacgtgcttatgtttt

SEQ ID NO: 25632 - DNA, 201 bp, Homo sapiens
ggaatactggtcagtttctagctcaagtgttacgtgcttatgttttcagtgtggtgcatctctcagtgggattcgccttctcttcatgctgtggcaatggsagggggttttgaacttctttgatgagaagagagacttcctgcttggagtcctccctgaagcagatattcattgagtagcctcatgctgcttcctttgaaa

SEQ ID NO: 25633 - DNA, 201 bp, Homo sapiens
tggtgcatctctcagtgggattcgccttctcttcatgctgtggcaatgggagggggttttgaacttctttgatgagaagagagacttcctgcttggagtcstccctgaagcagatattcattgagtagcctcatgctgcttcctttgaaaccccataaatgcccctttatcatgggtattgttaaatactttgtgcctaac

SEQ ID NO: 25634 - DNA, 201 bp, Homo sapiens
cattcattcctatcaacagccagttagcaaagcaagaagctgcacatcccaatgcttttgagtttctttccaagtctgttaaatccagagaattagccctrataggaattacaagggagacaattacagataatttattcggttcagtcattcattttgtggaaggttttagtccctaacccaactttcacagagaccata

SEQ ID NO: 25635 - DNA, 201 bp, Homo sapiens
atatgatgacccttaggaaatgcatctccttaaaagaaattccaggcaaactcatttaacctttctggatgttagtttcctgaccttcaaaaaatgggatrttggaccaaattatcttgaagtttccttccagctgtgtgctcggtggggagtgctggcagtgtggggcaggacactgaatatctgtggtggtgatgtttg

SEQ ID NO: 25636 - DNA, 201 bp, Homo sapiens
agaaaactggtcaccgatgatgacttttttttttttttttttttttttttgaggcagtgtcttactttatctcccaggctggagtgctggagtgcaatcayggccccctacaaccttgaactcctgggcttgaatgatcctcccccttcagcctcttgagcagctggtactacaggcacatgccaccatgcttggctagtt

SEQ ID NO: 25637 - DNA, 201 bp, Homo sapiens
tactactgttatgatttacacagtccctttcatccagctacttcaaagcaccttcacaaactctggctcattattccttcaaacacagcattcaagaaagrttgataggcgccttttaattaattcaaagatgatgaagctgagcattacagaatataaggggattcttccaaaagtatctgcactgcagaggggcatgat

SEQ ID NO: 25638 - DNA, 201 bp, Homo sapiens
gtggtggctcacacctgtaatcccagcactttgggaggccaaggcgggcagatcatgaggtcagaagattgagaccatcctggctaacacggtgaaacccygtctctgctaaaaatacaaaaaattagccgggcatggtggcacgtgcctgtattcccagcttctcaggaggctgaggcaggagaatagcttgaacctggg

SEQ ID NO: 25639 - DNA, 201 bp, Homo sapiens
ctgcctgctggcttcctacgtgcactacgtcttccgcctgccagaggtgcaaagggatgtgcccaagtcaggtagagttgccctgagtgtgggactctggygggcggggcaacaccacctccaccccactgcagtgtaatccaaaataaaacatcctatgctgggtgcaggggctcacatctgcaaccccagcactctagg

SEQ ID NO: 25640 - DNA, 201 bp, Homo sapiens
cggagatttaaaatgcaaagaactggacagaaattactgccaaaaagagtactggtcaatatctactcactgtttagttgcatttgattattgcgagctarataaattatcagaattatatgctgtaataaataccactttattatttacatcatctgtttcagtggctgccaattctcttaaatgaacgtcttcaaactg

SEQ ID NO: 25641 - DNA, 201 bp, Homo sapiens
tgcaatgaaaaaatgggcatccaaagaatatttactgttttagtttatttagcatatttctttttcgtcatctcacccgtgatctgaatcattcattcctwcactgcttggtgtagaaattttcaaaagggttgcaaattttcaagtagacctgcccatatcacctgtggtggggtttctctttccctaaatgcttttgta

SEQ ID NO: 25642 - DNA, 201 bp, Homo sapiens
gaagcgagtcactaggtctagcccacactcaaagggagaggatttcacagagcaagaatatcaggaagcagaatcattggttatttcattagaagctgctrgcacagttcttaatgaagctacaaaacattgaactgggaggaatatgggggtaggagggtgacagggagggcaggttaattttgtggatgctgaggacaa

SEQ ID NO: 25643 - DNA, 201 bp, Homo sapiens
caagggcatcctatcctgcggccgccagaggggtatgtgcggagatcacaggcaatgaggttgtaatgagctgttaagctccctgccgtccctttaactggtgattacagtaaaaagagccacataaagtacgttttcatctctcacttcagcccccgagagcctctgaggtcttgtttatccaattatcagacttgctgt

SEQ ID NO: 25644 - DNA, 201 bp, Homo sapiens
gctagtggtttgcctaggaacacatttgcaccaactcctggcttattttccatgtgacccaacagctggtactagagacaccagctgctttctggtgggggcagaatgaaaacagcatgggctgaggccaaggcccagcaaggtcttcaagggcatcctatcctgcggccgccagaggggtatgtgcggagatcacaggca

SEQ ID NO: 25645 - DNA, 201 bp, Homo sapiens
aaacactcggtgttcactgtcagctatgattatatatgaagtgctttcgagaaccaatgtatagcataacttaggccaaaagaaacactgtgcctaaacastcagccaaggagtgttgagtttgcctggatttctggaaaattgtctccgttccctagttcactgtatttgggtaaacaaaacatggcctcggagagcctt

SEQ ID NO: 25646 - DNA, 201 bp, Homo sapiens
tatatattatggcatattcagaatatgcaataccatgcacccattaaaatcatgtttattaagaatagtcacattagggaaatggtcataactgaacaacrtttagtggcataaaaaaagataaagctttgtacatacagtatgatgaaaatgtttaatgtggctgggcatagtgacttgtgcctgtaattccagcactgt

SEQ ID NO: 25647 - DNA, 201 bp, Homo sapiens
ggctgggcatagtgacttgtgcctgtaattccagcactgtgggaggccaaggcaggagtatcactgaaggccaggagttcaagaccagcctgggcaccatrgtgagaccctgtctctacaaaaaatttaaaaattagccaggtggtcatgatgcatgcctactattctagctactagggaggctgaggctggaggatcact

SEQ ID NO: 25648 - DNA, 201 bp, Homo sapiens
cacccttggtgagggctttcttgctggcggggcctctctgtagagtcctgaggtggagcacggtgagcagctgagcatgctagctcaggtctctcttcctsttcttataaagccaccagttcccctcccatgatgcagattaatccattaatctgtgaatggattaatccagtcatgagggcagagtcctcatgattcaat

SEQ ID NO: 25649 - DNA, 201 bp, Homo sapiens
cctgtcaagctcttcttagagtgcctggaatacagtaagtgctcaatgaatgttagctattttaactgagagaagggttaggttttgttccttgtgatacmaactatcctatttgaactatcttggccaatccattcattatgctatgacaacagtctggctgggccatctccttcccggtggatctcagggtttcttggc

SEQ ID NO: 25650 - DNA, 201 bp, Homo sapiens
tctcagggtttcttggcctggctattcatgtgcaagtttccactttcactactgcttgatgtgcaagtttccagggctccctgcttgctcagagagggtgwccattccagatggtactctttgttagctcagtaaacatcaagactatttaaaaaaataaaaaacttcctagacttgtcaacggtatagagacagaaagta

SEQ ID NO: 25651 - DNA, 201 bp, Homo sapiens
gcagttcctatttcttaattgaagaaatccagatttcttctcattccaagagtctgtcaggtaactttcactgttgatgttgctatttccatgccaatcartaatcctgatcatagctgtatcccttaaggaaatcaaataactgaaaatgaagatctgtggggcagataaattcaggaatatttcttcgtttatagagga

SEQ ID NO: 25652 - DNA, 201 bp, Homo sapiens
taattgaagaaatccagatttcttctcattccaagagtctgtcaggtaactttcactgttgatgttgctatttccatgccaatcagtaatcctgatcatasctgtatcccttaaggaaatcaaataactgaaaatgaagatctgtggggcagataaattcaggaatatttcttcgtttatagaggattcacctcatgaatt

SEQ ID NO: 25653 - DNA, 201 bp, Homo sapiens
ccaaagtgctgggattacaggcgtgaactgctgcacctggctgacgtgctattactcttacagcatctggacaatccctaacagtctgaaagctctataawgttgcaggtagtccaaaggccctatcccttattctagaacacaggctttatagcacaggctttggcaagtctgtaacagtctgaactcctccactgtatt

SEQ ID NO: 25654 - DNA, 201 bp, Homo sapiens
ctgaaaatgaagatctgtggggcagataaattcaggaatatttcttcgtttatagaggattcacctcatgaatttgaaatatggcttgacttataaaaagytgatctacctggagcttgtagctaacacctctgtcgggccaaacaataaatgcttacactgagaaagccaggtttgggatttcaaattaatgtgccctta

SEQ ID NO: 25655 - DNA, 201 bp, Homo sapiens
tgctgggattacaggcgtgaactgctgcacctggctgacgtgctattactcttacagcatctggacaatccctaacagtctgaaagctctataatgttgcrggtagtccaaaggccctatcccttattctagaacacaggctttatagcacaggctttggcaagtctgtaacagtctgaactcctccactgtattccacat

SEQ ID NO: 25656 - DNA, 201 bp, Homo sapiens
tgagtgccagtggtaaccagagtcacacattttaggattttggtattgatgagggtttcagctgaatattacttgagttgaactccagttatctttacctstcttaaaggagcagctgccatagtgcctcaggtaaagttggcttgggataggctggcattgccttccagtccccagcctcaccttcctcccacctcttca

SEQ ID NO: 25657 - DNA, 201 bp, Homo sapiens
gcaattccattcctccatttgatacagattaagatttctgaaaaagaccatcctcctaaaccctcatggactctgcagataatatgaggccagaaaatgartaattcccaactcttgctatctcgttactggccagtgtgtctggcttcgctgagtgtgtgccttctgaagcgtaccctataattattcagcaggtatagt

SEQ ID NO: 25658 - DNA, 201 bp, Homo sapiens
ggttgggcattcataaaataaatccttgctctaacgatagagaccaacttctagagccagaagtgctcatcccaggaatgaccaggggctcccaaaccagyggctcgggccctctgcagtgccatgtgcagcctctgtgggttagaggcatggagctagagcagggtcctctgaaccagagccaggcaggacactctgaga

SEQ ID NO: 25659 - DNA, 201 bp, Homo sapiens
acatgtctagtataatggctaaaatgaaaaatactaacaacaccaagtattgttgaacatatggaaaaactggaacactgattatgggagtatacaaccaygttgtaaaacactttaactggtcatttacccaagaggaatgaaagaatgtatccatataaagatttgaacacaaatgtttacagcaactttatttgtaat

SEQ ID NO: 25660 - DNA, 201 bp, Homo sapiens
ctgagctgatgaaaaggattatccgaatccaagcttggcgttccttgctctgtgtccagattaagaaaatgctagtggtttgcctaggaacacatttgcascaactcctggcttattttccatgtgacccaacagctggtactagagacaccagctgctttctggtgggggcagaatgaaaacagcatgggctgaggccaa

SEQ ID NO: 25661 - DNA, 201 bp, Homo sapiens
tgacctggtacactttacaaaaacaagttagagtgggtcatcaccaaaaataaacaaataaagagttatggattcatcattgatctctacataaagttttyccctttgcatttataaaaggcaaagtagaaaggtattaggtgagatcatgaggtgatgtaatattttgatagtttttccctaatactctgtgtatgcttt

SEQ ID NO: 25662 - DNA, 201 bp, Homo sapiens
cacagtgcaatatagatggattgcaaaatgattctgttgaatggaagaagccagaccaaaaaaagagatatattgtatgattctatttatgtaaaattctmgaaaatgcaaaggatctacagtgacagaaagcaaattagtagttaccaggagacggagggtaaaaattaagaaggggcatgaagaaacttttttattgta

SEQ ID NO: 25663 - DNA, 201 bp, Homo sapiens
cacagcctcttcaggagacattaattaatttagttcatataatcaacactggaaccaaggaaaaattatttatacttttagaaattctcatgttcttatayttctttggagattgaattgactccaaagagactattttgtgattaagaatatttttgtggccgggcacggtggctcacgcctgtaatcccagcactttgg

SEQ ID NO: 25664 - DNA, 201 bp, Homo sapiens
taaaagcatccaagaatgcatctcagaaaaagccttagatttcttttatgtggtcaactccaggaactactcactcttgagatagatgtgtgttttcagascttatccatgccatgcacaatgatctaaccctttgatagctgcatcattcaaagtcagtttttctacatgcaacaaatttttaaaccttgatttttattt

SEQ ID NO: 25665 - DNA, 201 bp, Homo sapiens
tttcacttaggataatgtttccaaggttcatttatgttgtggtgtatataggtactcttttcctttttattgctgagtaattttccattgtgtggatatasaactttttgttaagtcattcatcagttgatggacgtttggattttttccattttttggcctttatgaataaggctgctacgaacattcatgtgtaagttt

SEQ ID NO: 25666 - DNA, 201 bp, Homo sapiens
actagagatattttattttgaagttcttcaaatgatatgaagcaattcttttccacgtggaatgattcactattttcattttaaggacaaaccattcgttygtatttgacagttttgaagtgacaggtttaattgccttctgtataattgattctgtagggagagaaaataggagtgctattaggtattgggttaggctca

SEQ ID NO: 25667 - DNA, 201 bp, Homo sapiens
gtcaagatatagaacacttcttttatcctaaagcgttccccagcgcgcttttacaatctcctctccccaggccacaccctccaactcacgcaatctctgaytcacttctgtcaccataattttgctctatctggagcttcatatcctgttacagtatgtacaaaccttctttttttgagacagggtgtcagtctgtcaccc

SEQ ID NO: 25668 - DNA, 201 bp, Homo sapiens
gccgtaggttttcgttgcattattttggctaattgaaaaataagaccaagtgcgttctgaccttcgtttctcttacctttatttttacaaccaccatttcmatggcccacttgctgatacaaatgattgtttaattttaaaaagcatttaattgaagtcaagttatttagaacctaatcatttacacgtctttgttgttgc

SEQ ID NO: 25669 - DNA, 201 bp, Homo sapiens
agttcatttgagattgaatgcagattgagaagagatttagaattgaactccagggcactgcatagcaggaggaaaacctagtaaaagtggtatctgtaaamtagaggaacgaactgtcacaatttgcctggtactgaggattttctcagtacatgagactttaagagactgggacaccctgagacaattggttgccttcca

SEQ ID NO: 25670 - DNA, 201 bp, Homo sapiens
aaaatagcctttctggaataagacttaccttattagtattgtactctacagactcataaatgtcaagtaagatttattgaactcaaggcattttttttttwaaatctgtcttttattctgaactcagaaagaacaccttggaagtattgtaaacttcctaaggagttgttaggaagctttttagaattttttggagttttc

SEQ ID NO: 25671 - DNA, 201 bp, Homo sapiens
atagaaattttaaagatgaactagataaatctatataaattctagtattttcttcttccactgcaatagattgtcttgtgtaccctcggagtgcctccatrcctctcttcgtctctgcagactgctattttcaagaattagttctccttcaaatccacagatgaaaactttaaagttgtacatattttacctaagcaaaac

SEQ ID NO: 25672 - DNA, 201 bp, Homo sapiens
agggcacgtttgagtccattcctggattttttttctaccaacttcttgatggtcattcttctacaatagagaaggcaaacacacgtgtctactaaagttasgcaggtaaggtcattgagtgaaatgacctacattaagaaaaatagcgcttaagtcagtggtgtgctggagtcgactgtactaactcgtgagatctgacag

SEQ ID NO: 25673 - DNA, 201 bp, Homo sapiens
tgtatattgtattaaaatgttcttttctgatcttctctaagttaaaaaaaaaaaaaaagaaacaaagttgagtaaacaagctgagcaaactttgtgttgaractttaatatgtccgaggaaaagaatcttgcattaagtccaatacagagagtctgataatttggtggagcagagagcctcatctgaggtggctttccgtg

SEQ ID NO: 25674 - DNA, 201 bp, Homo sapiens
ttgaaactttaatatgtccgaggaaaagaatcttgcattaagtccaatacagagagtctgataatttggtggagcagagagcctcatctgaggtggctttycgtgaacagcatctctgaggtgtcacctgctaccacattcactgtccaccctgggctttgcccctcaagcaccagggctcaggtctcttgttttgcctgt

SEQ ID NO: 25675 - DNA, 201 bp, Homo sapiens
tgaaactttaatatgtccgaggaaaagaatcttgcattaagtccaatacagagagtctgataatttggtggagcagagagcctcatctgaggtggctttcygtgaacagcatctctgaggtgtcacctgctaccacattcactgtccaccctgggctttgcccctcaagcaccagggctcaggtctcttgttttgcctgtt

SEQ ID NO: 25676 - DNA, 201 bp, Homo sapiens
gaggcagaggattcttgagcccagaaattcgaggttagccttgtgccactgctctccaaatcaagcaacagagtgagaccctatctctaaaaaaaaaaaaataatttagaaaataaaattatactgagaaatacaaacagctattcacacaggaatggagagttcttctttacagtattcaggaggtatacacttatttcc

SEQ ID NO: 25677 - DNA, 201 bp, Homo sapiens
aacaagcatatcagttggaacatgatttctctgatggataattagctgttttcaggactcctcctattcagctgaatgttctcagaccagaagtctgatcwggcctaacggggatgtgctcccatatcgcagcggagtcttaaggagtactacccaccttctcttctgcgggggaaaaggaatggcgtagcatgcatgcag

SEQ ID NO: 25678 - DNA, 201 bp, Homo sapiens
gatggataattagctgttttcaggactcctcctattcagctgaatgttctcagaccagaagtctgatcaggcctaacggggatgtgctcccatatcgcagyggagtcttaaggagtactacccaccttctcttctgcgggggaaaaggaatggcgtagcatgcatgcaggacctgaccggaaggaatgtctgcgagttatg

SEQ ID NO: 25679 - DNA, 201 bp, Homo sapiens
aatggcgtagcatgcatgcaggacctgaccggaaggaatgtctgcgagttatgatttagtgactagaacttctaaggaaagaaatgaaccagaaataactscaaacgaagtggttaggaagaggggcaggacatggggagtatccttgaaagggacttaatttcatccaaggaaataggttcccagtttaagcccagttag

SEQ ID NO: 25680 - DNA, 201 bp, Homo sapiens
gaaagaaatgaaccagaaataactccaaacgaagtggttaggaagaggggcaggacatggggagtatccttgaaagggacttaatttcatccaaggaaatwggttcccagtttaagcccagttagctctgtattcagagtggatcttctcagtgctaggtgaaggaagggtggttgtgcatcagagtaagtgtccagcccc

SEQ ID NO: 25681 - DNA, 201 bp, Homo sapiens
tatatgcctttacagtatcatacagaattgtttcactgccctaaaaatcctctgtgttccacctgttcatcctccctccctggcaaccactttcctttttyactgtctccataattccaccttgttcttcaatgtctttttgtggcttgatagctcattttttttattgctgaataatctttcattgcatggctgtaccat

SEQ ID NO: 25682 - DNA, 201 bp, Homo sapiens
gccactgccctccagcctgggcaacagagtgagactctttcaaaaaacaaaaacaaaaaactctgtcctaagtatcagatgatgcggaagcccagtccttrgttttactaggcttagcaagcagtcgcttatggaacagaagcttttataaacaaaccatgtagttaggaagggcagtggcagcccaggcaaaatctagtc

SEQ ID NO: 25683 - DNA, 201 bp, Homo sapiens
atctgcagcgttccaggtggtggatgatctgtcatcctgcatcctggagtaaagatgattaaagcagagctgcagctgccctctgaaggcctttgtttttrtaaaccactgagatttttgaattgtttgttatctcaccataacctagcccaccctaacacagatgaacataaaatacagaacatttctattgggcggctt

SEQ ID NO: 25684 - DNA, 201 bp, Homo sapiens
tggtctcgataataaatcaggaacacaatccccacattcctaatgccttgctccaaaactcagcaatcctcctatttgtaagaatgaaaaaattcaggagrgaaccaattgcctaaggttatgacagcaaagctaccgttccagtataatattcagccactagaggacacaattcactcactttctagattcagacacacg

SEQ ID NO: 25685 - DNA, 201 bp, Homo sapiens
tgaggcaccctgtttctacatgagttgccctggttggtggaggcagaagcaatggagaagtggtgatgaaattaagtcaaagttaggcttgcatttgactstgatcttgaatagtttgtctagattagagggagcacctaaaatccaaaaagccttttgtctttgatttctatacttttgttagttttacaaattattatt

SEQ ID NO: 25686 - DNA, 201 bp, Homo sapiens
agtcaaagttaggcttgcatttgactctgatcttgaatagtttgtctagattagagggagcacctaaaatccaaaaagccttttgtctttgatttctatasttttgttagttttacaaattattatttaaaatcagtcctttgaagtggcttcttctcttctgacgggacagctttgggaaactgtttagtcttatttctt

SEQ ID NO: 25687 - DNA, 201 bp, Homo sapiens
ggaagaatcaatattattaaaacagccatagtgcccaaagagatttttagattcactgctattcctatcttaattagcaacatcattttttcacagaattwaaaaaaaaaaacctattccaaaattcatgtggaaccaaaaaacctgaatagccaaagcaatcttaagcaaaaagaacaaagccggtggcatcacactgtg

SEQ ID NO: 25688 - DNA, 201 bp, Homo sapiens; identical to SEQ ID NO: 6326

SEQ ID NO: 25689 - DNA, 201 bp, Homo sapiens
agtgttttattctgtccttgggacagaggtttgattcaaaatgttttttcggaaactagccttgaacacctaattttattaatattctttttacactccawccctcctggaaaaggactggaccccaattcccaccattgcttttttgggacccattatcttccttagcttcctatgcatctacagggtagtctgggcttc

SEQ ID NO: 25690 - DNA, 201 bp, Homo sapiens
tctgttccacgcagccactcagaaatacaggctggcagtggctcctccatcttcagtatgttctctccccaaattactcttgtcactgccattgctgcccytgaagaagagaaaagaaggatggaggaggcctggaagtttgatacattgcttctgctaacaattcactggagagaattgagtcacatgatcacccctcat

SEQ ID NO: 25691 - DNA, 201 bp, Homo sapiens
aggagaattgcttgaacccgggaggtcgcagtgagccgagatcacaccactgcactccagcctgggcaacagagcaagactccatctcaaaaaaaaaaaaagtcctatgtatacttcttcacatcaatttaggcaggctttatttgttaacttttgttggtagccaacatgcatttaaactacttattattgtcctaatct

SEQ ID NO: 25692 - DNA, 201 bp, Homo sapiens
gctgtggtggcttgcacctgtagtcccagctacttggaaggctgagatgggaggatcactcgaacccaggaagttgaagctgctgtgagcagtgattgcgmcactgcactgcagcctgagtgacagagcgagactctatttcaaaaaaaaaggaacaaacccaataattttgggcataacgaccagagcacaatgagctac

SEQ ID NO: 25693 - DNA, 201 bp, Homo sapiens
tttttattatatacataatacatgtttattgtttaaaatagaaaatacacataagcaatgggaagaaaataaaaatcacacataatcccaccatagaaagwtaactactattaacacttgctgcatttgctgagtatctactgtcacccttttaatatgcctttatgatttgttaaataaaattgtatgctattctttata

SEQ ID NO: 25694 - DNA, 201 bp, Homo sapiens
taaaaaaaaaaaaaaggtaatcatacctcactgcagccttgaactcctgggcggggttcaagcagtcttcctacctaaacctcccaagtagctaagactgyaggtgcacgccaccatgcctggctaagttttgcttttttttttttttttaagagactgagtctcattgtgttgcccaggctagtcttgaactcccggcct

SEQ ID NO: 25695 - DNA, 201 bp, Homo sapiens
taagggtacaccaaaaagtaagaagaatgggaaactacttaaccagcacatggggtgcagaagcgagagcaattgtgttttctttttttttttttttttttgagatggagtcttgctctgttgcccaggatggagtgcagtggtgagatctcggctcactgcaacctctgccacctgggttcaagtgattctcctgcctca

SEQ ID NO: 25696 - DNA, 201 bp, Homo sapiens
tcatgccactgccctccagcctgggcaacagagtgagactctttcaaaaaacaaaaacaaaaaactctgtcctaagtatcagatgatgcggaagcccagtmcttggttttactaggcttagcaagcagtcgcttatggaacagaagcttttataaacaaaccatgtagttaggaagggcagtggcagcccaggcaaaatct

SEQ ID NO: 25697 - DNA, 201 bp, Homo sapiens
agaccagcctggacaatatggtgaaaccctatctctactaaaaatacaaaaataaccagatgtagtggcggacgcctgtagtcccatctgctagggaggcygacgcaggagaattgcttgaacctgggaggcggaggttgcagtgagctgagatggcgccattgcactcaagcctaggtgtcgcagcaagactcggtcttt

SEQ ID NO: 25698 - DNA, 201 bp, Homo sapiens
tctaacaaaatggaagacagaaaagaaagcaagcatcatttgtgtacaatagccaaagaacaatagccaaataaatttgatggtctcaaaagttaagcatyttttgaagagaaaatttgattttagggccaggtggggtagctcatgcctgtaatcgcagcactttgggaggcagaggcgggtggatcacctgaggtcagg

SEQ ID NO: 25699 - DNA, 201 bp, Homo sapiens
ttattttttaaatctcattggtgatttccttggatctgtcatacatttacttctccaattatgtctagtctattatttaacctttaacctttccattgagktttttgtcttttagcaactgcattttttttttttttttttttttttttttgggggagacaaggtctggttctgtcacccaggctggagtgcagtggcatg

SEQ ID NO: 25700 - DNA, 201 bp, Homo sapiens
aaaatttgcagtctagcttctcacacttggtaaaaaactctactgtagttgaccagttctgaggagtagaaacatctgtcttgagaatatggtacccatargcacaaggcacaagaaaggcctttcttgtgtagaaaggcaccagggatgggtaagaactacaaaatgacttttcttggtcaactatttcagtggaattta

SEQ ID NO: 25701 - DNA, 201 bp, Homo sapiens
taaataacgtgattttcttctttggtgtgtaccgtaccgtgcaggagacagggaaaacaccaggtttaacggtccacaagccagataaccatgatgagttytaaagattttctctgtctttaatgttcttcagttttgtcatgagaagactggatatagctctgttgttgttcattagaggatttatatctctcttcaact

SEQ ID NO: 25702 - DNA, 201 bp, Homo sapiens
agagggagcacctaaaatccaaaaagccttttgtctttgatttctatacttttgttagttttacaaattattatttaaaatcagtcctttgaagtggcttsttctcttctgacgggacagctttgggaaactgtttagtcttatttcttttgctattgggaagttgtgggggacgctattttgcagctttttcatcctcag

SEQ ID NO: 25703 - DNA, 201 bp, Homo sapiens
taaaatccaaaaagccttttgtctttgatttctatacttttgttagttttacaaattattatttaaaatcagtcctttgaagtggcttcttctcttctgaygggacagctttgggaaactgtttagtcttatttcttttgctattgggaagttgtgggggacgctattttgcagctttttcatcctcagttctgacctcct

SEQ ID NO: 25704 - DNA, 201 bp, Homo sapiens
agctctccttaatggatgtcctgtggtttcaggcctcagacaggctgcccttgggccctcagcagaagtcgggaatcgtcttatacttccagatcgtcttwtactcaggcaaaatatgagatgctgtgtcagggtttcccaagggaagaaactgagtgggaggtgcaggtaaaccccacagtacaaaataaaacagagctg

SEQ ID NO: 25705 - DNA, 201 bp, Homo sapiens
tcataaggataaaattagaggagctcaacataacggctcattttaatgatttctaaggggtttccatgcccaggctaataactgtacatttagcaataagmaaatctcaaagcctatttcttatctttccctagaattacagcttttaagcccaagctggtcgttccttttataccactccactcacttgataggggtgac

SEQ ID NO: 25706 - DNA, 201 bp, Homo sapiens
attttaatgatttctaaggggtttccatgcccaggctaataactgtacatttagcaataagcaaatctcaaagcctatttcttatctttccctagaattayagcttttaagcccaagctggtcgttccttttataccactccactcacttgataggggtgacatgggctgagctttctctcctatcagggctcaaagacaa

SEQ ID NO: 25707 - DNA, 201 bp, Homo sapiens
gggctgagctttctctcctatcagggctcaaagacaagtttagcagcgtttctaaacttctgtcaatcagctcacaggacacagaccagtttcgttatccyattaacagatttacatttctgttctctggaagtgtcagttaatgtccttaaaggtaatatacacaaatgtacacaatagtctctgaatttttctcagaag

SEQ ID NO: 25708 - DNA, 201 bp, Homo sapiens
atgccacaaagctgtgattacagctgcccattggcaaatcaggtactagtttttgttaatcacattgcagtcttccttcactgtttcttcccctggtcccrgaattaaggctgggctccatttgacaagttatcttctgtgcaggtagagcagcaggctgtgttagctcacagcatctactcagtaggcatggaaatatcc

SEQ ID NO: 25709 - DNA, 201 bp, Homo sapiens
aacagatttacatttctgttctctggaagtgtcagttaatgtccttaaaggtaatatacacaaatgtacacaatagtctctgaatttttctcagaagacamactcagaaaccttagaattctgattcattctctttggctcagacttggatgaatttgcttctcagagtagggacatgaaaattattcttaatttatactt

SEQ ID NO: 25710 - DNA, 201 bp, Homo sapiens
ctctttatgtccaaagtctgtctacttagagcaacaggatggtgatgatgctttctggttaaagatgtcatggcaacagtcttccctagacagctctctakcaatagccagtggcatgtaaaccctgcatttttgcactgtatccagtgtttgcaactcccttgtagaactttccctgaagtcagcaagaaccctgtgaga

SEQ ID NO: 25711 - DNA, 201 bp, Homo sapiens
tttacatttctgttctctggaagtgtcagttaatgtccttaaaggtaatatacacaaatgtacacaatagtctctgaatttttctcagaagacacactcaraaaccttagaattctgattcattctctttggctcagacttggatgaatttgcttctcagagtagggacatgaaaattattcttaatttatacttcatgta

SEQ ID NO: 25712 - DNA, 201 bp, Homo sapiens
cactgactttgccatccaccacttactgcctagaacatctaagacacatgcttcaggaacgaacaagctattaaattggggggaataaaagaaaagaaaaraagtgttggtgaataataatagcctttgtttcacagcctaatttttgtggttcttatttagcatttccatgaggagcttgcccttcagatggtggtcagc

SEQ ID NO: 25713 - DNA, 201 bp, Homo sapiens
actcagaaaccttagaattctgattcattctctttggctcagacttggatgaatttgcttctcagagtagggacatgaaaattattcttaatttatacttmatgtaatctgtttcttctttctccctccgccgccctccaatagctcttctgagcttgtttgttcttcccctaactcccattgttgaaaacatggcctccc

SEQ ID NO: 25714 - DNA, 201 bp, Homo sapiens
agcgggagggtaagagacagaaagcaagacagaggccagggtctttcacagcctaatctcaagagcagtacctcatcacttttgtcctattttgacaaacrtcgtattgacttttgtcactacatcagaagcgagtcactaggtctagcccacactcaaagggagaggatttcacagagcaagaatatcaggaagcagaat

SEQ ID NO: 25715 - DNA, 201 bp, Homo sapiens
ccctattaatgtatttgtctagtctgatttatttttataagcactttatttgttaaagatattaacccttgtctaccatgtattaaaaatgtcttccccartatgccttttgtcttttaaagttgtttttaattttcaacattcagaattatttatgtcattaaatctatattaatatttttccttatgtttaattttggc

SEQ ID NO: 25716 - DNA, 201 bp, Homo sapiens
tttccaggaatctccttgtgctcctcaagttcggctcatcgcaaacttggagttctgttttctcatgcccttctttcattttcttcttttaagagacaggrtcttgctctgtctccaagattggagtgcagtggtacgattctagctcactgcagcctcaaactgctgggcttaagtgatcctcccaactcagcctcccaa

SEQ ID NO: 25717 - DNA, 201 bp, Homo sapiens
atcttgggaataattaacagggtccggtttttctgttcgtttccttgcaccagatgaagagtaggataaacttgggagaagccaaagtgatgtttttgtaytgtggctttgaatgatttcaaggtcccttggttaacctattctcagcaaaagaaatagaagatggtcccaagatggtaagagcagagtgtttggttgata

SEQ ID NO: 25718 - DNA, 201 bp, Homo sapiens
cattttcaggtatattagataagctttacaccaagataaattagatatgcttattggtttaatttgtgctaatatatatttaattgaaaaatcaaaaaaawttttttaaattgactgaagttgtattccaaaacatgcaaaatttagtttaaaatagattggatacacttttaaattttaaacaaggtagagggtttagtg

SEQ ID NO: 25719 - DNA, 201 bp, Homo sapiens
aaggaaaataaattgttctacaaaaacgacacatgcactcgtatgttcctcacagcacaattcacaatagcaaagacatggaatcaacctagatgcccatygacagtggactagataaagaaaatttggtacatatacaccatgaaataccacacagccataacaaagaacaaaatcatgggggtttttttgcagcaacat

SEQ ID NO: 25720 - DNA, 201 bp, Homo sapiens
gagccactgctcctggccaacccagcactcttaattgtacaaaatgcagctctatgagaccagaacatcctgttggcctgatgatagtcaatttgatgtayccaaatgttactgataatttgatcctttctctactggtgaacaggtcatctttggaaagtccagcgggcctgaatttctgcaggaagtgtacacagctgt

SEQ ID NO: 25721 - DNA, 201 bp, Homo sapiens
cattaaaacaggacaggaaggaagtcctggctgtccagcaaaaggtctttagtggctatatcaagagaagcttttacagaagggtgagggtggtagcctgygaacattggattaggagtgagagggactgaaggaagtagaaactccagctcaggggaaggggagagaatgagcttgaggaaggccctctgatgaagggaa

SEQ ID NO: 25722 - DNA, 201 bp, Homo sapiens
tgtaagaggcatgtgttggctgtttaccatgatctccaccactccctggtgccttatgccccatctacttctctccaaaagattgcctcctaccccaaccrggatttgttaagaagtctctaattccaaggcctaatccggtggcttttcatccaccctatccctcttcaattccttcttaaactcagtaagtaactctgt

SEQ ID NO: 25723 - DNA, 201 bp, Homo sapiens
cagggattactagagaagggaggatggaagcaggtgtgggttgaaaaactgcctattgagtaccatggtcactatgtgggtgacgtcagtatcatgcatayatcaaacctaagtgacatgcaatttacccatgtaatgaatttgcacatgtatcccttgaacctaaaataaaagttggaaaaaaataaaagataagatatc

SEQ ID NO: 25724 - DNA, 201 bp, Homo sapiens
tcctgagagggttgatggcttgccctatgttgtttttccctctatgaattctttatttttttcatggtaaagctttactttcagaacagttttagagttayggaattatatactctatacccagtctctcctttattaacattttacattcaaatggtacttttggcacaattagtgaaccaatattcatggaatattatt

SEQ ID NO: 25725 - DNA, 201 bp, Homo sapiens
gcctttctaggtgtaactcattgccaaggtcgggagcaaagcaaaccatgtaggaaacctcatcatgctgggtagttaataagtatgccctagcacacgtkttcacagagaaaacataatacgcttcatttgtaatatttaagtattacatctaaagttacaatgtttaaaaatttatatatacccttgttggatacaaag

SEQ ID NO: 25726 - DNA, 201 bp, Homo sapiens
tatgttgtttttccctctatgaattctttatttttttcatggtaaagctttactttcagaacagttttagagttatggaattatatactctatacccagtstctcctttattaacattttacattcaaatggtacttttggcacaattagtgaaccaatattcatggaatattattcattaagttcatctttattcacacc

SEQ ID NO: 25727 - DNA, 201 bp, Homo sapiens
gatcccattctgaatgccatattacattttgcagtcttgcctccataggctcctcttgctggaaacaatttcttagactttctttgttcttcatgaccttracagttttgaggagtgatggtcaagtattttgtagattgtctctcattaggaattttttaaagattatgatattattcacataccataaaattcaccctt

SEQ ID NO: 25728 - DNA, 201 bp, Homo sapiens
ctggaaaagggccccagtagggagtgcctttctcactcaccaatcaccaaggctagaagatagtctgcagattctttcagatgccacaaagctgtgattasagctgcccattggcaaatcaggtactagtttttgttaatcacattgcagtcttccttcactgtttcttcccctggtcccggaattaaggctgggctccat

SEQ ID NO: 25729 - DNA, 201 bp, Homo sapiens
aaagctgtgattacagctgcccattggcaaatcaggtactagtttttgttaatcacattgcagtcttccttcactgtttcttcccctggtcccggaattamggctgggctccatttgacaagttatcttctgtgcaggtagagcagcaggctgtgttagctcacagcatctactcagtaggcatggaaatatccactgaat

SEQ ID NO: 25730 - DNA, 201 bp, Homo sapiens
ggttaaagatgtcatggcaacagtcttccctagacagctctctagcaatagccagtggcatgtaaaccctgcatttttgcactgtatccagtgtttgcaaytcccttgtagaactttccctgaagtcagcaagaaccctgtgagaatcaggatttgtctagaaatttagcatttacctaatcaatgattctctagacatgt

SEQ ID NO: 25731 - DNA, 201 bp, Homo sapiens
ctggggcatctggccaatttatttcccagcagacctgctgcttcccctgattccaatactttcttccccaacccaaaccaaggcgtctggcaatgttaaawacatcaagaatgataaaacaagcattttaatgaagattattgatgtattcattggctgtttctttaaatgggtagagaactaataaaggatctaccccaa

SEQ ID NO: 25732 - DNA, 201 bp, Homo sapiens
aatttatttcccagcagacctgctgcttcccctgattccaatactttcttccccaacccaaaccaaggcgtctggcaatgttaaaaacatcaagaatgatmaaacaagcattttaatgaagattattgatgtattcattggctgtttctttaaatgggtagagaactaataaaggatctaccccaaataaccaaaaatatc

SEQ ID NO: 25733 - DNA, 201 bp, Homo sapiens
gctaattaaggtggtggctgcagctcacaagtcttggggcaagagcattaacaatgagacatgagctccatgctctggcaggaaagggactgggccataaracccattcccctcttgtttcttgaggcatgagaagtatcaaaaccgtcaccccatgccctttatatcctgcttctatttacacatcccacccaccatcat

SEQ ID NO: 25734 - DNA, 201 bp, Homo sapiens
caccagcagaaattggaagcgttctggtatttatatgtgtttttctcagctggcagatttgttttaggaaactatttgcaaagcctgggaaaaatgtgctytctctgtctgttaaaggaacatgcaggttggttggtgctggttctccatctgacagttctgtctggtggcctcaaaaaaaaagaaaaatacagcatagtc

SEQ ID NO: 25735 - DNA, 201 bp, Homo sapiens
ggacacagtagctggcaagctgctgacagtctggaaagaggccattggttggaagtatggtattgtgagaattatgtatttggttgtaggatggccaaackcagcagacaggagccaaatacagcagtgagttctgaaagccttagtgctgggatggttagcctgcccagaatcaggattggcattgcccaaaacaaagag

SEQ ID NO: 25736 - DNA, 201 bp, Homo sapiens
aggcaggagaatcacttgaacccgagaggtggaggttgcagtgggccgagatcacagcattccactccagcctgggaagaatatttttgtgtggggagtcrttatattatgtccttagaccaggaggtccaattgaggcagaaatttttgaagtaaaaccattttttttgaaggaaacacatatttaaatatcaaagaaca

SEQ ID NO: 25737 - DNA, 201 bp, Homo sapiens
tttggttgtaggatggccaaactcagcagacaggagccaaatacagcagtgagttctgaaagccttagtgctgggatggttagcctgcccagaatcaggaytggcattgcccaaaacaaagaggccttatcttcttaagtcctttgttaggagcatagtgagagagaggcttttttcggacaaaaatgggtccagttccca

SEQ ID NO: 25738 - DNA, 201 bp, Homo sapiens
tgcttggtctgagctttcgaaaagtgcagtgaggatgtcagcctaggctgccgtcacctcaagggtcccctgggggtggatccacttccaagctcactcawgtggctgttggcaggatgcagttgctcacgggttgttaggctgagggcctcggttcctcactaagccagaggcttccttaagttccttaacatgttttct

SEQ ID NO: 25739 - DNA, 201 bp, Homo sapiens
aaaatacttaaagtgagaatgagaaaaactgatgtctacatatcatgaaatggttaaaaagtttaacgtgcattgtcttctccattagaacttcttttackaatttttttctcaaaatctggctcagaaatcttgttttaaaagctccctaaacattcctaggcagaattagtaacgccttcctctttgctaacaaggaac

SEQ ID NO: 25740 - DNA, 201 bp, Homo sapiens
tcgaaaagtgcagtgaggatgtcagcctaggctgccgtcacctcaagggtcccctgggggtggatccacttccaagctcactcaagtggctgttggcaggrtgcagttgctcacgggttgttaggctgagggcctcggttcctcactaagccagaggcttccttaagttccttaacatgttttctcatggggggcagctca

SEQ ID NO: 25741 - DNA, 201 bp, Homo sapiens
ggtggtttttctatagttcaggaaatcaaacaaaatggtgtgtgacctggaggtactagaaaaacaatagcaaaccaactccaaagccagcagaagaaaasaaataaccaaaatcagagctgaaaaaaattaaaacgtgaaaatccatacaaaagatcaatgaaaccaaaagtttgtgattcaaaaaaaaaacaaggttga

SEQ ID NO: 25742 - DNA, 201 bp, Homo sapiens
cttcatcaccagtaatttcccaggaacccaagaaactcaggtttccttccatcatagttgtgatttcaccagtgaatgcgacctggctcacagtgcagttrataacacagctctgacccttttagctggacagttcattattaaatctcaagtctactccattgcttaaatccatcttctgattcacatagctcattatct

SEQ ID NO: 25743 - DNA, 201 bp, Homo sapiens
ctgcacaggctgatctctggctcctttagcccctcatggttcctgttgtttcattttcagagggacccttgtaaggactatagtcctctcttcagctgacyttcaggtccccagtcagaaccaagggaaccgactctgtcccttctcatagcacctgaaaaccccgggaaacgaggggaatgctttgctctcagctactga

SEQ ID NO: 25744 - DNA, 201 bp, Homo sapiens
gaaaatacagatgataatatggcaagtatctaaaggtctccacttaacagaattaacatctgttaacattttgtcacttttgctttagttgttttttttttaattaaaaaagagaacattacagataaatgtgaagtccctgttattctgttgcccatttctgttctccctgctgctccctgagagtactaacacaaaggt

SEQ ID NO: 25745 - DNA, 201 bp, Homo sapiens
tcgaactcctgggctcagtgtttctcccatctcagcctttggagtagccagcagtataggtggtgtaccaccacacccatctaactttaaaaaaaaaaaaattgtaaagacagagtctcacttttttgcccaggctggtctcatactcctggctcaagcaatcctcctgcgttggcctcccgaagtgctgggactgcaggt

SEQ ID NO: 25746 - DNA, 201 bp, Homo sapiens
ttgttctgatgcaacatcatacaaagggcagtacttttgtcttctgttttattttgagagaaaggaaagaaaaggcagaaatttgcctgagagccattaawatagacatcatgttatcaggtattttttccccataaggcttttactaagtactatttcttggaggtcagcacagcttaaacatggaataaaaatagttgg

SEQ ID NO: 25747 - DNA, 201 bp, Homo sapiens
tttcaacagatatggttctggggttgtaggaattttcaatttgagaacaaattgaatcttaccctttgtcaggagaaatagcctttgacatgtgttaggggcaagggaaatctcaaacttgcttaattttaaaaatgaatatttggttgtggataatttaagctttggtgatatttctaattattttttgtgtgtttctag

SEQ ID NO: 25748 - DNA, 201 bp, Homo sapiens
ttgggaggcagaggcaggaggatagcttgaagccaagagttcgaggccagcctaggcaacatagtgagaactcatctctacaacaaagttaaaaagaaaaattagccaggcatggtggcacatgcctttagtcccagctacttgcgaggctgaggcagaaggatcacttgaactcaggagttggaggctgcagtgagccat

SEQ ID NO: 25749 - DNA, 201 bp, Homo sapiens
gccgtcacctcaagggtcccctgggggtggatccacttccaagctcactcaagtggctgttggcaggatgcagttgctcacgggttgttaggctgagggcstcggttcctcactaagccagaggcttccttaagttccttaacatgttttctcatggggggcagctcacagtgtagcaattggcttcgtcaaaacaagcaa

SEQ ID NO: 25750 - DNA, 201 bp, Homo sapiens
catggggctctagctggtgaacatatttctgagccatccctatacagaaaccacaagacaaataagaaaaagtaaatccagatcacttagacccttcaaascacatcctgggttccaaggacagtggctgcgagttaggaaagatacatttatccagtggaccttttgactgtcttgtcaatcttaagaaaaaaatgtaga

SEQ ID NO: 25751 - DNA, 201 bp, Homo sapiens
atcgcaccactgcactccagcctgggtgacagagtgagactctgtctcattaaaaaaaaaaaaatcatgaacaactctgcatgtaaatcaatacagagctrcattataatttacataggctgtataaaatcctgttgattagatgtaaaatgatttattaaattaattttctattattgggcatgaagataggttccaggc

SEQ ID NO: 25752 - DNA, 201 bp, Homo sapiens
tggtttgggtcccttcccaccttcccttgcttcatcactttccttaagcctctaagcatccagatcttccccaaagcagtgcttcctagtcagtgattacyctatcctctttttattccttttcttcatgcacaccttcagtccataaatccaagctttttgtaaggagggagggtgagtaaaccaattcatactaaggtg

SEQ ID NO: 25753 - DNA, 201 bp, Homo sapiens
tgtttcagaaggaaatctgctaacatgggcatcttacttgaaaaaaaatttcagttggttcaacaaagtatggtttagaaatcattttcaatcaggatcgrggagagaatttttttttttcttaaagcagttaggtttccccagcagatttcgaatgcttggatatttgtgattcttttctatgggaatctgatctggata

SEQ ID NO: 25754 - DNA, 201 bp, Homo sapiens
catttattgtagagtttttaaacaatttgataccattttttttttctggcgtcttaactgcatttgctgtttgtgaggggtgtagaggtccctgatgttcrgagtacagtaccagcgtttatgtgaaatattgcagcctggcctgtggaggacaggggttactaaggggcaagctgctgcttgcgataacacccccagtgc

SEQ ID NO: 25755 - DNA, 201 bp, Homo sapiens
cttgaccaacatgaaattttatcattccagcctatttctgctagcttaatatgtgtgtagggcctcactagagatattttattttgaagttcttcaaatgwtatgaagcaattcttttccacgtggaatgattcactattttcattttaaggacaaaccattcgtttgtatttgacagttttgaagtgacaggtttaattg

SEQ ID NO: 25756 - DNA, 201 bp, Homo sapiens
aacaggaataaacacaaataatggcatgaggccgtggccacagaatgacaagacaggacacagcaaatgttttgggtttttttcacatttatgaaccttcycattctatttatttatttatttacttacttatttcttgagacagggtctcattctgtcacccaggctggagtgcagtggcatgatcatagctcactgcag

SEQ ID NO: 25757 - DNA, 201 bp, Homo sapiens
tcaagaccatacaaccagcaatggcagagctgggattgcaaactgctccaaagactgtgctcttaattgggccgattgttattttgatgcatatgtatcccaagaatttcctttaaagcaagaggggaattaatttttaaaaaatcatcattttggtagcagcattggcaaagtgttctgtttctgattagtgtttaatat

SEQ ID NO: 25758 - DNA, 201 bp, Homo sapiens
acaatttgggaggcagaggcaggaggatagcttgaagccaagagttcgaggccagcctaggcaacatagtgagaactcatctctacaacaaagttaaaaaraaaaattagccaggcatggtggcacatgcctttagtcccagctacttgcgaggctgaggcagaaggatcacttgaactcaggagttggaggctgcagtga

SEQ ID NO: 25759 - DNA, 201 bp, Homo sapiens
ctttctctccataccagcttttactcttttttttttttttttgagatggagtttagctcttgtcacccaggctggagtgcaatggcaccatctcggctcaycgcaacctctgcctcctagttcaagcaattctcctgtagttcaagcaattctcctgcctcagcctcccgagtagctgggattacaggcatgcaccatcac

SEQ ID NO: 25760 - DNA, 201 bp, Homo sapiens
gatgcaacatcatacaaagggcagtacttttgtcttctgttttattttgagagaaaggaaagaaaaggcagaaatttgcctgagagccattaaaatagacrtcatgttatcaggtattttttccccataaggcttttactaagtactatttcttggaggtcagcacagcttaaacatggaataaaaatagttggactaata

SEQ ID NO: 25761 - DNA, 201 bp, Homo sapiens
gacgttaaggaagtttagctaacaggctttaaccctttctctccataccagcttttactcttttttttttttttttgagatggagtttagctcttgtcacscaggctggagtgcaatggcaccatctcggctcaccgcaacctctgcctcctagttcaagcaattctcctgtagttcaagcaattctcctgcctcagcctc

SEQ ID NO: 25762 - DNA, 201 bp, Homo sapiens
gagctccagccctcctgtactcacttcctcacacagcacagcagcactcttgctggttctgctgcttatcttgaagaggttaggttactttttgtttctasttattacttcgaaaccacttctgccttagaaattttgtaaccttccgctcagtttccggtaaccgccattttgtctcctgtaacaatttacgcgccgtgt

SEQ ID NO: 25763 - DNA, 201 bp, Homo sapiens
cttattaattgggattcatggaggaatttaccctacggagtgaatacaccctgcggagtatgactctgacctctcttaggctggaaatgctgcctaattgrggaataaatttcttaggtaaaaactaattcttttatcctgattggattttctgtaataatccttaaaaattaagaaactgtctcattgaaaacagtaagt

SEQ ID NO: 25764 - DNA, 201 bp, Homo sapiens
tggagattttagacccagatactgagtcacgtaaggcacccaggaggagtggccatgtggagaatgcggagagagttcgaggacctctcagcggcacggtrgcaacctctttatcaggtccccatccatcccagtgacttgactggtcagcatggcctgaatttgcaaattgcatgttaacaaaagcaaaatagtttcaaa

SEQ ID NO: 25765 - DNA, 201 bp, Homo sapiens
catagtaccaagtgctcaggagattttcattcggttattcctcatggcaaactttgttggaacagcatggtatctccacattggcaggtgtgagaataagkcacagtgaggttgataaattttccaaaagtcacacacagccagcagtaaagccaagactggagattttagacccagatactgagtcacgtaaggcaccca

SEQ ID NO: 25766 - DNA, 201 bp, Homo sapiens
aaaattagctgatcatggttgtgcatatctgtaatcccagcaactgggaggcagaagcaagagaactgcttgaacctgggagacagaggttgcagtgagcygagatggtgccacagcactccagcctgggtgacagagtgagactctgtctcaaaaaaaaaaaaaaaaaagaaattgcaatatggactgtggtttaaatga

SEQ ID NO: 25767 - DNA, 201 bp, Homo sapiens
caacatttcctgctcaatatataatatagctaaaatttacaggagcagaagataactgctggaaactatagaactgtttctggaaaaactgtgctccctcragaaacactgaaactcaagataggaggaacatttctcccacgttctccttactgtagtttcaggaacagaaaagactttagttcgcgtcaagaaccttgt

SEQ ID NO: 25768 - DNA, 201 bp, Homo sapiens
agtaggttaattcatatgtaagttttcagaaggatctccctaatttaaagtgaggcataataatgttattaaatataataacattattaaatataataacrctatcttctacttaccacagaatcagagaaagaataattaactgttataggaattattttccatatgcttttgttccaattatattcagacatacatata

SEQ ID NO: 25769 - DNA, 201 bp, Homo sapiens
gagggagactccatctcaaagagaaacaaacaacaacaacaacaaaacctgcaaatttgagctgcctagcagccaagcaataaagggaatcacaatgaacrataagattcatatatctgccaatttaaaaacaaaccagttctcttgggtcagtgcttctcaaacttgaatgtacatttgagacacctggtgcattgttaa

SEQ ID NO: 25770 - DNA, 201 bp, Homo sapiens
gaggaacttctctgtaatctgaatagcatcttatatgacacagtgaaaatgagggaatttcaggaagatcctgagatgcttatggatctcatgtacaggtragctttcctgacacactcaagggacaccatttgggggtcgaggatttgtcactgtggagttcttactaatgtaatgatcacagctaacatggatatagtg

SEQ ID NO: 25771 - DNA, 201 bp, Homo sapiens
acaaaacctgcaaatttgagctgcctagcagccaagcaataaagggaatcacaatgaacgataagattcatatatctgccaatttaaaaacaaaccagttstcttgggtcagtgcttctcaaacttgaatgtacatttgagacacctggtgcattgttaaaatgtaggttctgatctagcaggtccatggtgcatttctaa

SEQ ID NO: 25772 - DNA, 201 bp, Homo sapiens
taaacaaaaatgttggagatagagatagtatgaggattcaggcagatttctggatctcaagggccaacacacatccaggtctcataaacacctgggctggygaagatgaaaactacagagtcaggtctagatgactccgccatccctagtctctgctgccctctgatccaacccttcccatggcttccccttgcatttcaa

SEQ ID NO: 25773 - DNA, 201 bp, Homo sapiens
tcaaactaatttaaacaaaaatgttggagatagagatagtatgaggattcaggcagatttctggatctcaagggccaacacacatccaggtctcataaacwcctgggctggcgaagatgaaaactacagagtcaggtctagatgactccgccatccctagtctctgctgccctctgatccaacccttcccatggcttcccc

SEQ ID NO: 25774 - DNA, 201 bp, Homo sapiens
taatcagaagatgttactgacattagtaggcatttgaagttcactctgatgggatcagtctatttacaacaaattgctatagagagtaaaaagcgccaacmttttcctgtagtttttgaatgacagcatctttgttcatgcagttggctttgctgcatttccacttcatcaattttttggctctgtctttgcaaaaaaaaa

SEQ ID NO: 25775 - DNA, 201 bp, Homo sapiens
gaaatgactctagtggtagaaattttaggagccctggcaagctggcagaggggaacggggataagacaacattctgtggctgagttacctgccagggtctmtagatcaagccatagtctctccctgtttttgtactgcaggctcccctggacctccactgttggttttataattaagaataaatgattacaagaggttcta

SEQ ID NO: 25776 - DNA, 201 bp, Homo sapiens
ggattctgtctttatcacatgactgattggtcctccatgttctccttggcagatgtgggtatcagtgacacaatgttttttactcaaaacatggtttagcytaccagtaccaggaatggccgatgcatacgcattctcattgtgaaggtttatttgcacctccactcttcttaaccaggctattttcacagaagaaataac

SEQ ID NO: 25777 - DNA, 201 bp, Homo sapiens
taactccagctcctagcctgctctatggtagggtcttaattaagtgagaatgaatgaatgaatgttttcttttattcccttagtctgagaaccctatttcyggagtctgttttgccctctcgggcaatgttgcatcctcattctcagaatctttttcctctcctctacatcaaatcgttcctctctcatttcatcttgacc

SEQ ID NO: 25778 - DNA, 201 bp, Homo sapiens
aggtgttcaaagggtccagtcgcttaaacaggtggccagtgtgctttctgctataactccttgctccttgagctcagctccaagctgtagaaggccatggragagcacattgatgtcatcttgggaataattaacagggtccggtttttctgttcgtttccttgcaccagatgaagagtaggataaacttgggagaagcca

SEQ ID NO: 25779 - DNA, 201 bp, Homo sapiens
aacagtctatttggagtgctcagtctcaaaacagttaggaggcagtacaagacaagtgatacataagtgcaaactgtgtggtaaggagctaaatgctgtgkaaggttagaggaagagaggtcgtgatcaataaacaatctggtggccaggaaagcctgcagggagggatgacactaaaggctggggtaggattccgctagg

SEQ ID NO: 25780 - DNA, 201 bp, Homo sapiens
agatgaagagtaggataaacttgggagaagccaaagtgatgtttttgtattgtggctttgaatgatttcaaggtcccttggttaacctattctcagcaaargaaatagaagatggtcccaagatggtaagagcagagtgtttggttgataatttgatctaaaagtgaccagactccacaagttaacccccagagctgctca

SEQ ID NO: 25781 - DNA, 201 bp, Homo sapiens
aaagaatttggagtttccaaaatagtttgtaatcaagaaaagccatctgaggaggccctggagggaaaatcgctgatgattatcaaatgtccagttctcartgcggtggtatatgtgactgaaaaaaaccacttttgtccacatttggggaaagataagattatactaaatgcctggcacatacactggaccttcagttac

SEQ ID NO: 25782 - DNA, 201 bp, Homo sapiens
aacccgctgctcaggtatttcctgtcaacaaacatggttaccaggttactgggctcttctgcccagggcatgctgtcagttttacaaactagaataaacgrtagacgcatagaaagtttgagtaggaggaactttaccatctgagtcagtgattttttttttcaaacttatttgtagctgtagaaattggtgttcaaatga

SEQ ID NO: 25783 - DNA, 201 bp, Homo sapiens
tgctatcctcttcctctttgactgtcatcctgaaaatgtgttcagtgttaagaggatttgataacaatgtctgggtatctccataacttagtccaaatctrgtaccactgttaggaaaataatgtaagccatattgatcacccacgtcttattcatttgaaggataatatagttattactaattattgcgtgttaggtaac

SEQ ID NO: 25784 - DNA, 201 bp, Homo sapiens
agaagagtacaaaacaaaaggcaaaacttcatcatgtttaaataacgtgattttcttctttggtgtgtaccgtaccgtgcaggagacagggaaaacaccasgtttaacggtccacaagccagataaccatgatgagttctaaagattttctctgtctttaatgttcttcagttttgtcatgagaagactggatatagctct

SEQ ID NO: 25785 - DNA, 201 bp, Homo sapiens
aggtttgaaattactgtgctgactttagtgactgagaagtatcagtctcttattgggtaggggacatggggaaatgtcatgtttgacttgacatcacaaaygatgttttcattgcagttgcagatactcgcagataccgcaccagtggctcggatgaagaacaagaaggagccggtgccattaaccagaatgtggctctgg

SEQ ID NO: 25786 - DNA, 201 bp, Homo sapiens
tacaaaacaaaaggcaaaacttcatcatgtttaaataacgtgattttcttctttggtgtgtaccgtaccgtgcaggagacagggaaaacaccaggtttaayggtccacaagccagataaccatgatgagttctaaagattttctctgtctttaatgttcttcagttttgtcatgagaagactggatatagctctgttgttg

SEQ ID NO: 25787 - DNA, 201 bp, Homo sapiens
caagtatgcctggttcttctttgagcttctggtgagattcttgcgcgtttgtatctgtgctcaataggccaagagaagcacacagcagaaaggaattgacrttttgttcactgagttgcccctgctgaaaacctggggtggtttcttgaaatctaataatctctcacccctcccatccttcttccactaaattgtgttgct

SEQ ID NO: 25788 - DNA, 201 bp, Homo sapiens
gtgttggtgaataataatagcctttgtttcacagcctaatttttgtggttcttatttagcatttccatgaggagcttgcccttcagatggtggtcagcacyggaatggtgagagaaacagtcttcaagtatgcctggttcttctttgagcttctggtgagattcttgcgcgtttgtatctgtgctcaataggccaagagaa

SEQ ID NO: 25789 - DNA, 201 bp, Homo sapiens
agcagcagcacccaggaacttgttagaaatgcaaattcccaggctattgaatcagaatatctgggggtggggccccccagtctgtgtttcatcaggccctscaggagattctgatacacagaggccgggcgtagtggctcacacccgtaatcccagcactttgggaggccaaggcgggtggattgcttgagctcaggagtt

SEQ ID NO: 25790 - DNA, 201 bp, Homo sapiens
gctaacagtctatttggagtgctcagtctcaaaacagttaggaggcagtacaagacaagtgatacataagtgcaaactgtgtggtaaggagctaaatgctrtgtaaggttagaggaagagaggtcgtgatcaataaacaatctggtggccaggaaagcctgcagggagggatgacactaaaggctggggtaggattccgct

SEQ ID NO: 25791 - DNA, 201 bp, Homo sapiens
tcaggcacactgtaatggattgattgccctacctttagtcttgaacttcttcctcatcaaaatgattgtcaggaatatgaacacatagccagatatgctgkagaatggaaaaggtataagtcaccctgtgcactatttgctactgagcagtaggtgacttgaagggaagtgaagacgcaaagtggagctgggggactttcc

SEQ ID NO: 25792 - DNA, 201 bp, Homo sapiens
tgctctcagcactctgagaggttttaaaaagaaatacatccaccactgtccccagtctcaatatgctaacagtctatttggagtgctcagtctcaaaacarttaggaggcagtacaagacaagtgatacataagtgcaaactgtgtggtaaggagctaaatgctgtgtaaggttagaggaagagaggtcgtgatcaataaa

SEQ ID NO: 25793 - DNA, 201 bp, Homo sapiens
ataaggatatgatattacggtgttcaaatagctttagctttcttacctactttcttaccagaaaaaaaaaatgagtttatctacgtttattccaggttttrtgggcataagatgaaagaaaaccacagaaaattcccagacatcatttttggcattaattagggtgaccaactgttctcatttgcccaggactgagggagt

SEQ ID NO: 25794 - DNA, 201 bp, Homo sapiens
tacacaatttatatataaatatataacatttgcaagtatttattgtccaatatgcatgtgctctcagcactctgagaggttttaaaaagaaatacatccaycactgtccccagtctcaatatgctaacagtctatttggagtgctcagtctcaaaacagttaggaggcagtacaagacaagtgatacataagtgcaaactg

SEQ ID NO: 25795 - DNA, 201 bp, Homo sapiens
ggataatttaaacgactgtcaagagcaatgtttgctgtaatcagtttttgctttaggtgttgactttaaaacttaatttgcaaataaggatatgatattasggtgttcaaatagctttagctttcttacctactttcttaccagaaaaaaaaaatgagtttatctacgtttattccaggttttgtgggcataagatgaaag

SEQ ID NO: 25796 - DNA, 201 bp, Homo sapiens
actttaatgaagagcacctgagaagatccttgaggacaattttggcctattcagaagaggacacagccatgcagatgactccttttcccacccaggtacascgaagcacataccttgtctcatgcatgagtttgggatctgccaactattgtgtatgtatgtatgtacatatatacacaatttatatataaatatataaca

SEQ ID NO: 25797 - DNA, 201 bp, Homo sapiens
tgtttattaaacaggcaaggagggaatgagcctccccaagtctccctttggactggatgagggaaagaccaagtgtgggagggccggggcctggtgctgtscactttgcagtattccaggcaccatatgtctagtgagaggtaccaggatttaactataaaaggaaaagtgaaaaaagatatggttaggctaaaaacaaat

SEQ ID NO: 25798 - DNA, 201 bp, Homo sapiens
gggcgacagaatgagactccatttcaaaaaaaaaaaaaaagaaaaaaagggtaaatatgcttattgcaaaggataacacaggaagccatttgcaagagctracatcacagggaaatgtttattaaacaggcaaggagggaatgagcctccccaagtctccctttggactggatgagggaaagaccaagtgtgggagggccg

SEQ ID NO: 25799 - DNA, 201 bp, Homo sapiens
  misc_feature (1)...(201): n = A,T,C or G, or insertion/deletion polymorphism (see Tables 1-2)
atttaaacaacaatatgaatgttgtgcaaagtgtagctcccatttcattgagagaagaggaaataattaagacggggcaaaggaaacactgaggagttgtntgtgtctggccatgctgctttcagttatctactgctaagtgtgtcttatttacttcatcttttttttttttttcactgatgcagaattttgcaagagtaa

SEQ ID NO: 25800 - DNA, 201 bp, Homo sapiens
ggcagggcacagtggttcatacctgtattcccagcactttcggaggccgaggtgggtggatcacctgaggtcaggagttcaagataagcctggccaacatrgtgaaaccccctcctactaaagatacaaaaactagccgggcatgatggcaggcacctgtaatctcagctactcaggaggctgaggcaggagaatcacttg

SEQ ID NO: 25801 - DNA, 201 bp, Homo sapiens
tggcctcccaaagtgctgggaggctgagccagaagtccctttcttttaataaagtttaaataaagtcccaagaagaaactcttggcacaaaaggatatacygtattcttggacccaactttataagaatcttccagcttgcagcacaaaggcagcccagtcctcaatgaaaatttaaagggagcctgacagatttatgtga

SEQ ID NO: 25802 - DNA, 201 bp, Homo sapiens
atatgctacaatatctaagttcttccttctttacgtttactgtgtctgtgtgatggaaatattatataatggtttgctaccacactgcatttctatgacaycgtgttggtagattgaaatcagttatgatgaaagtatttgtggcacaaaaattggcaaatgctacaaattacccctacccccctgacaactggttgttaa

SEQ ID NO: 25803 - DNA, 201 bp, Homo sapiens
atccaccctccttggcctcccaaagtgctgggaggctgagccagaagtccctttcttttaataaagtttaaataaagtcccaagaagaaactcttggcacraaaggatatactgtattcttggacccaactttataagaatcttccagcttgcagcacaaaggcagcccagtcctcaatgaaaatttaaagggagcctgac

SEQ ID NO: 25804 - DNA, 201 bp, Homo sapiens
cctaccaggtttaagcaattctcctgcctcagcctctcgagtagctggaattacaggtgtccaccaccatgcccagctaatttttgtatttttagtagagrcggggttttgctgtgttgcccaggctgatcttgaactcctgagctcaagtgatccaccctccttggcctcccaaagtgctgggaggctgagccagaagtc

SEQ ID NO: 25805 - DNA, 201 bp, Homo sapiens
cctgatttatttatttagagacagggtctcgctctgtcaccgtggctggagtgcagtggcgagatcttggcccactgcaacctctgcctaccaggtttaarcaattctcctgcctcagcctctcgagtagctggaattacaggtgtccaccaccatgcccagctaatttttgtatttttagtagaggcggggttttgctgt

SEQ ID NO: 25806 - DNA, 201 bp, Homo sapiens
atgcctataatcccaacactggaaggccaagtctggacaattctttgaagccaggagtttgagaccagcctgggcaacatagcgtgaccccatctctacaraaaaattaaaattaaaattaaaaacagccagacatggttgtgagcacctgtagtcccacctactagagaggctaaggcaggaggatcatcaaaactgcag

SEQ ID NO: 25807 - DNA, 201 bp, Homo sapiens
gaaatacgtccagtaccagaatgtcccaaggaacacctgggcaacagaatattggtcaagttgctgaccttgaagtaagtatcaacaaacacactgccacygctttgagatttatcttgccttttacatacaaatgttgtgtttattatcagagcttgaatcaaagcggagctcccaaaatacgtctaacagtgggcagct

SEQ ID NO: 25808 - DNA, 201 bp, Homo sapiens
cagagtgttagaaaaaaagcaaatctaagttaacttgagccgtggagggtagccttcccttccctgggttaactctaattggagctccccacagaattcastaatgatttccttacgatgtgattaaaaataggaggatgctgtggaaatacgtccagtaccagaatgtcccaaggaacacctgggcaacagaatattggt

SEQ ID NO: 25809 - DNA, 201 bp, Homo sapiens
ttaaatttttttaaggagtaatttctgtttacatcagccataggagtaaaatgctttgttaacacaatgagagacccctgccctttgcaactcagtggctyctcaggatgacataactaaggagagctttttatattttgttcctcaggatcataagagaatgtttggaacctacttccgagttggtttctttggatccaa

SEQ ID NO: 25810 - DNA, 201 bp, Homo sapiens
aggtttgaaaactttttgttcacacaatttgaaaaattaatttctagcctaatcttgtgctagacattgtctcttagcctgctgtgttttcctataggtgrtagcagatacataatgctaaacatcaggtttgaaattactgtgctgactttagtgactgagaagtatcagtctcttattgggtaggggacatggggaaat

SEQ ID NO: 25811 - DNA, 201 bp, Homo sapiens
ttatggaaggtttgaaaactttttgttcacacaatttgaaaaattaatttctagcctaatcttgtgctagacattgtctcttagcctgctgtgttttcctrtaggtgatagcagatacataatgctaaacatcaggtttgaaattactgtgctgactttagtgactgagaagtatcagtctcttattgggtaggggacatg

SEQ ID NO: 25812 - DNA, 201 bp, Homo sapiens
atgtgtacactcattccttcattcaacaaacacttacttaatactcctgtgtcctaggcactgttctagtgctggagatacatcagtgaatcaaaaacatsagagaaaaatccctgtccttgtggaacttacactgtagtggaatctactactaataatgcaaatagaaagaaaaatatatgcaagttacccaggcactgg

SEQ ID NO: 25813 - DNA, 201 bp, Homo sapiens
ctgtgggacaggctgggaaatgcaggttgacatgccactgttaatacctagaaaattaaggcaaacttgtccctgagagatgtcaggatagcacagtatgraaaggccatgcttatcagggctcttatctgagagaatacagtggttatgagcatgactctggaactagacagtctgggttgaattccccgctctgccatt

SEQ ID NO: 25814 - DNA, 201 bp, Homo sapiens
agagtctttctccttctgaggcattctcagtgcacagtaacctgtttatctcgctttgccttgctctttcccaagcacatttttgctcaacgccccctacyttccccatacacttgttaacactttgcagagcactagggctctgtgggacaggctgggaaatgcaggttgacatgccactgttaatacctagaaaattaa

SEQ ID NO: 25815 - DNA, 201 bp, Homo sapiens
tttggagttcagctttattatagaacagtcaagtttgctttagtttgtctagattttgataccttctttggaatttccatttgtggccatgttaataagtrtgctcaagtgatatataaagataaattggcccatggaaaaaagtcagcctcctccaaatgtattagggatgattatttaaaagacattcctcaggggacc

SEQ ID NO: 25816 - DNA, 201 bp, Homo sapiens
cagaatgttaaattcataaaagctaccatgaaaggataaataaatgaaaggagttctgaggtcaaaacatttggggaaagaagagtctttctccttctgakgcattctcagtgcacagtaacctgtttatctcgctttgccttgctctttcccaagcacatttttgctcaacgccccctaccttccccatacacttgttaa

SEQ ID NO: 25817 - DNA, 201 bp, Homo sapiens
ctagccaagacttgagttttattcaaagctacgaagactttggagttcagctttattatagaacagtcaagtttgctttagtttgtctagattttgatacmttctttggaatttccatttgtggccatgttaataagtatgctcaagtgatatataaagataaattggcccatggaaaaaagtcagcctcctccaaatgta

SEQ ID NO: 25818 - DNA, 201 bp, Homo sapiens
actcttctgggaagaccatctgcacctcactgatacttgaagctcattgagtattgtcacatatcagcccagaaagtcacagggtacagcaactcatactygctcccagcaccaggccagccccattctgcctccagggagtcacccaaaatagagagatgagggtaaaataagacctaggaatactatttatttgcctcc

SEQ ID NO: 25819 - DNA, 201 bp, Homo sapiens
atgaatggaagtctcagcatttgctgaagaacttagttaaaataaactctagacctttttcattgattctttatctcttcttttccagaaaccttctctaygtctacccacagaggctgaactttgtaaacaaactagcatcagcccggaacattacaataaagatccagtttatgtgtggagaagatgctagcaatgcga

SEQ ID NO: 25820 - DNA, 201 bp, Homo sapiens
cagccccccaaagtactgagattataggcatgagccatcctgcctagccaagacttgagttttattcaaagctacgaagactttggagttcagctttattrtagaacagtcaagtttgctttagtttgtctagattttgataccttctttggaatttccatttgtggccatgttaataagtatgctcaagtgatatataaa

SEQ ID NO: 25821 - DNA, 201 bp, Homo sapiens
gctcaaatgatcctcctacttcagcctcccatgtagtaactgggattacaggcacgagccaccttacccagctaattttttttgcatttttgttgagacakggtcttgctgcatgcccaggctggtctagaacacctgagctcaagtgatcttccctcctcagccccccaaagtactgagattataggcatgagccatcct

SEQ ID NO: 25822 - DNA, 201 bp, Homo sapiens
tgactagctagtgccagaatgacctgtggaagaggattttaaatgatcggtgtcatctaacctgagttttattttaatattttatttatttatttattgakacagtgtcttgctctgtcacccaggctggagtgtagtggcactatcagagctcactgcagccttcaactcctgggctcaaatgatcctcctacttcagcc

SEQ ID NO: 25823 - DNA, 201 bp, Homo sapiens
tttaatttgcatctaaaagtgaattcatcagataaatgcagtggtctctatcagtgtgtttctaaaatagacagccaggggccaggaacgatggctttcasctataatcccagcactttgggaggccgaggtgagtggatcatttgaagtcaggagttcaagactagcctggccagcatggtgaaatcctgtctctactat

SEQ ID NO: 25824 - DNA, 201 bp, Homo sapiens
tgtcctgtgagaaagaaacaattgagtatgtagatagatagcagcttccattttaatttgcatctaaaagtgaattcatcagataaatgcagtggtctctrtcagtgtgtttctaaaatagacagccaggggccaggaacgatggctttcacctataatcccagcactttgggaggccgaggtgagtggatcatttgaagt

SEQ ID NO: 25825 - DNA, 201 bp, Homo sapiens
aacacagctctgacccttttagctggacagttcattattaaatctcaagtctactccattgcttaaatccatcttctgattcacatagctcattatctttrtggaataatgcattaactcttctaggctttttgcttgtccaaatggacatttgcatatttcaacggtccagaaagtgtatcaaactgccaagtgatgcct

SEQ ID NO: 25826 - DNA, 201 bp, Homo sapiens
tggtgccttctacatggggtcttttaaatttaaaaagtaaaattcttctgctcatccttctcaggaccattttctctttcttcatcaccagtaatttcccrggaacccaagaaactcaggtttccttccatcatagttgtgatttcaccagtgaatgcgacctggctcacagtgcagttaataacacagctctgacccttt

SEQ ID NO: 25827 - DNA, 201 bp, Homo sapiens
gcagatgccctgattctgtgggaagccaccatggagaggaaaagcagtggctcccatatttgaagtgtggacctaactctagaagtttaaaatggccattygctgaaggtctatgacatgagaacagagatcaactgagtgacttagcaatttcactctttctctgtaatacctctgctgagtgagattaaatcctctatg

SEQ ID NO: 25828 - DNA, 201 bp, Homo sapiens
atcacagtaaaggtcttaagtcttcctaggaagaaagcagatgccctgattctgtgggaagccaccatggagaggaaaagcagtggctcccatatttgaartgtggacctaactctagaagtttaaaatggccattcgctgaaggtctatgacatgagaacagagatcaactgagtgacttagcaatttcactctttctct

SEQ ID NO: 25829 - DNA, 201 bp, Homo sapiens
gtcctcatcattattaataatagtggggatgaggatgaccaggaaaccttacctagacagttgtttcgacaagacatgaatcacagaaggcacctgcactstagttactcagggccagttgctctgttttcatttcaaggttgactattttggagatttctttacaccttggtgtatagattgccatcatgggaacctggc

SEQ ID NO: 25830 - DNA, 201 bp, Homo sapiens
aatcccctgagaattgaactaagggctccccagcaaacacagcgatttacatggggcctagagagagcgagcactgccgggggcggcggcgaagggcagcrgtggtgggacgggcggggtagggggagttactgagcatgcgcccgggtaggggcgtgggggagttactgagcatgcgcccaggtaggggcgtgggggagt

SEQ ID NO: 25831 - DNA, 201 bp, Homo sapiens
cctgggcgacagagggagactccgtctcaaaaaaaaaaaaaaaaaaaaggatgatgaggttaaaatggtaaatttgatgttatgtgtactttatcacgatwtaaaaatttgatggctcatgcctgtggtcccagatactcaggaggctaaggcagagcatcacttgagcccaggagttcgaggcttcagtgagctatgata

SEQ ID NO: 25832 - DNA, 201 bp, Homo sapiens
ttttttaatgtggttaccacaatatataaaatgacatatgtggcccccattgtttctactagacagcattgctctaaatttaaaactaaactagcagtcarttaattaaaaaggatgataaggggccgggcacagtggctcacacctgtaatcccagcactttgggaggccgaggtaagtggatcacgaggtcaggagatc

SEQ ID NO: 25833 - DNA, 201 bp, Homo sapiens
ctaaatctcgaaagttatcatgacacacttttctcaagctgtaggaaattagctccaaaacttttttacagtactatagtttgttcttattttcatgaaaraaacacagtgcaacaatctttcttgattccctcataacatgacagtttctttactagaacattcctattttctctctttaggcttgctaagactggagat

SEQ ID NO: 25834 - DNA, 201 bp, Homo sapiens
tcagaaggataatttgtgttgcgtcactaatgaaatagtagtacgaaaaaacctatagcatcttttactgcaggaggtaactttccatgccattttttcasaaaatctacttatgacttcagtggcttgctagactggcctttttatttgtacttttcctgtgtttcagaattgcagagtataataaaggcatgtcaagtg

SEQ ID NO: 25835 - DNA, 201 bp, Homo sapiens
gatttccaggcctaaatgaaaatttgagatggaagaaagagcagacacattggcggcaagctaatgagaagctagataagtgagtcactcggcaactttcygctacttttacctaaagtccaaaactatttttcccaggctgcttgtattactgaaacaactgcatccttccaagggttagaaaatgaaacatcattatct

SEQ ID NO: 25836 - DNA, 201 bp, Homo sapiens
acttggacataggtgtggcgactttgtctcctaccagcaacctgcatggactctaattagcccgagaaatggtgctgaggcttctcagttgagcttgttawgaacttctggttatcttggagggtttcatgctaatcaaattcctatcatgcatttcttaactcctagggaacgaccgatttccaggcctaaatgaaaatt

SEQ ID NO: 25837 - DNA, 201 bp, Homo sapiens
tgatcaccaggccacactgctcctaagacagaggtactcagatacgtggctgaaagcctagctcaaatactgccccaggtgagcctctttgctgagtagcsctactcaaagaacacagcttcccctgcctagggaaggcagggctactggcaatagatctccagcctagcagtgatgtacagtcatggtattttaagagaa

SEQ ID NO: 25838 - DNA, 201 bp, Homo sapiens
aggcaggaagatgagacagagaaaagacatttgagatttgacatcaccgatcttactgttggagaaatattgtgtgacctcctccacctttctaatatccrtcttaccaaagttagctgcttgaggtggtatatgccttttacattatttgcctctaagggaaaaactcaaaagcccaaagttcacctgttagaacatagt

SEQ ID NO: 25839 - DNA, 201 bp, Homo sapiens
agacagcactgcatcctccaatgtcatttactttcacatttcaatgtagggtatagatgtgcagagaatttaactttcttctcccgtgagaaagcagcatsctgacctaactcttcttgctggatgactttcttgtcttccttcctgcacttagcaagctccatcaccatgaggattggggggacagtgaggcaggaagat

SEQ ID NO: 25840 - DNA, 201 bp, Homo sapiens
ttcagttgaggtgggattcatctctgttcattgatgagctctgactatcccttgtgaagacagcactgcatcctccaatgtcatttactttcacatttcartgtagggtatagatgtgcagagaatttaactttcttctcccgtgagaaagcagcatgctgacctaactcttcttgctggatgactttcttgtcttccttc

SEQ ID NO: 25841 - DNA, 201 bp, Homo sapiens
gaattatttaactaaaagaattattcaagctatttcatttaactagctcagtttaatcatgtatttcctataaaggttagtcttattaatttgacaaaaamtcaaacaattcaaaccagatcaagtatgctaccctgaagttacaccactagctaagaattaacaatctaagtaattggtttctccccaggctcaaggctc

SEQ ID NO: 25842 - DNA, 201 bp, Homo sapiens
gggccagagtgcaaggaaatgatagaaacaagctcagcacacagggctgagcaagctgcaccatgaggtcagcagcttcctctagcagcgcctgattgcgsggaattgaaaatggagttgtttttaacatttacagacataatgcagagcatggcatgtgacttgtagcccattttgagaatccttgatggcaagtttcta

SEQ ID NO: 25843 - DNA, 201 bp, Homo sapiens
aaaccccgtctctactaaaaatacaaaaattagctgggtgtggtggcgggaacctgtaatcccatctactcgggaggctgaggcagaagaatcatttgagrctggaaggcagaggttgcagtgagccaagatcatgccaatgcactccagcctgggcaacaagagcaaaactccatcacaaataataataataataataat

SEQ ID NO: 25844 - DNA, 201 bp, Homo sapiens
gtggatcacctgaggtcaagagttcaagaccagcctggccaaggtgatgaaaccccgtctctactaaaaatacaaaaattagctgggtgtggtggcgggarcctgtaatcccatctactcgggaggctgaggcagaagaatcatttgagactggaaggcagaggttgcagtgagccaagatcatgccaatgcactccagcc

SEQ ID NO: 25845 - DNA, 201 bp, Homo sapiens
gttctagggtacatgtatacaacatgcaggtttgttacatatgtatatatgcgccatgttggtgtgctgcacccattaactcgtcatttacattaggtatrtctcctaatgctgtccctccccactccccccaccccatgacagtccccggtgtgtgatgttcccacctatgagtgagaacatgcggtgtttggttttctg

SEQ ID NO: 25846 - DNA, 201 bp, Homo sapiens
aagcaggtcaccaatctccatgttgacatttcctccatccccctccgcaggtgaaaagcatggcccagcacgtacataacatggacaaacgggacagtttycggaggactcgtttttctgaccgtttcatggatgacataactactattgttaatgtggtcacctcggaaattgcagcccttttagtaaaaccacagaagg

SEQ ID NO: 25847 - DNA, 201 bp, Homo sapiens
gtgcttacaatttagtgaaggaaacaggaggttcctgcatgaaacaaatacaggagcacatcgagttcgtgcaactgcaacagtcacatgtgtcccaagckatgtacccaggctgacaccgctgaagtgactctatgtctgcgtctcctggcaggatagtgtggggaatctcatgcttttagctctcaattctgcctcctt

SEQ ID NO: 25848 - DNA, 201 bp, Homo sapiens
acaaaaccatgaaggatttctaaagacactttagatgctcttaatgaaatataaagtgtgctcccaggatacaaatacaggacaggaattactgaggaccrgtaaatctaatacttccctccctgacatcacttgtagttccaggccagcaaaagtctgacaatgtgcttaagccaaattcagaagtgtagctgaggccgg

SEQ ID NO: 25849 - DNA, 201 bp, Homo sapiens
aaagctttgtgatctcattttggatctcctcaggattcctcatcaagttgcaattaaggagagaaaaattccgccttggggtgggattttaattactcatsatgttatgacttgactttctgtgctgcatttttttccatatcactacttctgtgtttgacagctcctccaaagagtcgctccgttttatgccaggagcga

SEQ ID NO: 25850 - DNA, 201 bp, Homo sapiens
tttctgcactgggcagggcggtgccggcacgccgtgttcctgcatgcccctccattgcgtcagggatggccgtttgcagaatagctcatcttctccctccstgccttttcccccttaggcctacatacagatcacttttgtggagccctactttgatgagtatgagatgaaagacagggtcacatactttgagaagaattt

SEQ ID NO: 25851 - DNA, 201 bp, Homo sapiens
ctttgaaggacttctgatgacacacctgaacagcctggatgtgcagcttgcccaggagctcggggacttcactgatgacgacttggacgtggtgttcacgmcaaaggaatgtaggactttgcagccctctttgccggaggaagggtaaatagttttctaaaatgtagatgtgattgggattgtcatgattgttttcaataa

SEQ ID NO: 25852 - DNA, 201 bp, Homo sapiens
tatgatttttttctttggaattaattcctacaagaggaatttctatgtcaaaggatatgcacaaatttaaagatttggaatactagatcaaacattatgcygggcgcagtggctcacatttataatcttactcagcactttgggaggttgaggtaggaggatcccttgaacccaggagttcaagaccagcctaggcaatat

SEQ ID NO: 25853 - DNA, 201 bp, Homo sapiens
ccacagagagacactgttcccacacattttttcctggcgtcccctgaagtcacagactcctagaagggactactcagcagcccagattcttaaatagtttktaactgtaggttgctacacacaaactattaacgggtgttgtctcaagagcaagtaaaattaggtataacttcactgtctttgctttgttttatatttact

SEQ ID NO: 25854 - DNA, 201 bp, Homo sapiens
gcaacaaagtgagattctgtcttaaaaaaaaaaaaagaagaagaacccagacaaaaaagataactgcatgattccatgtatctgacattctggaaaagatraagctacagggatggaaaacaggtccatggttcccagggtctgggagtggggaagagggctgactacaaaaggacacgggagtgccctttgcgtggtgct

SEQ ID NO: 25855 - DNA, 201 bp, Homo sapiens
taaggaatcaagaaatgttaggcccatctttctttttaacctgttaagagtattttaaattactctgaaagtctttccctagctgcctcttcaaattcagktggcctctctgtcatagctccaggcttgtccatagcttatgagaccagacagtgacttccctatgtttacgtctcatgttcagtttgttttgacaccgat

SEQ ID NO: 25856 - DNA, 201 bp, Homo sapiens
gaggcgggcggatcacgagctcaggagatcaagaccatcctggctaacacggtgaaaccccgtctctactaaaaatacaaaaataaaaaaattagccgggygtggtggcgggcgcctgtagtcccagctactcgggaggctgaggcaggagaatggcgcgaacccgggagacggaggttgcagtgaacgcagatcgcgcca

SEQ ID NO: 25857 - DNA, 201 bp, Homo sapiens
cggaggcgggcggatcacgagctcaggagatcaagaccatcctggctaacacggtgaaaccccgtctctactaaaaatacaaaaataaaaaaattagccgrgcgtggtggcgggcgcctgtagtcccagctactcgggaggctgaggcaggagaatggcgcgaacccgggagacggaggttgcagtgaacgcagatcgcgc

SEQ ID NO: 25858 - DNA, 201 bp, Homo sapiens
tttctaaataactttgccataacaagtggcaaattattaaggtcatgggctgtcttctcaaaattacttagataacatgattctctggccagtatgagacscttaatttatcacgtatgaagcatatgagcctgtttatccgttcgttaatcattatttttatctggcttgggctctgggttactggccatgcaggcagat

SEQ ID NO: 25859 - DNA, 201 bp, Homo sapiens
gcccatttgataatccctcactggtctttacccacttgctaatttatgattcagctgagaatctcttttttaagatggagaagtggtgactgatgcctacrattctagtataataaaggaaataatatatatccaatggcagtggttcttaaactttttgttattaaaaaaaatcccttttcacatttccctcaaactgaa

SEQ ID NO: 25860 - DNA, 201 bp, Homo sapiens
gcccctgctgaaaacctggggtggtttcttgaaatctaataatctctcacccctcccatccttcttccactaaattgtgttgcttctaccatgaaaatctrtcgccgtcctgtgagttctcatcaccttcaccactctccacctggccacacaccatcatctctcatgtgcctctcgcagtgacatcctctttttcctgcc

SEQ ID NO: 25861 - DNA, 201 bp, Homo sapiens
ggttcgagattgaaattgagcccctgtttgccagcattgccctctacgatgttaaagaaaggaaaaaggtaagaaagcaaagaaaaatccatccctaaggmacatatattgttcatgattctttgcatgtatgtttttaaatcttcttcgcagcaagaacctatcagatttgaaagcaaatgatctttgatgagtccagtt

SEQ ID NO: 25862 - DNA, 201 bp, Homo sapiens
gcaatctcagctcactgtgacctccgcctctcgggttcaagcaattgtcatgcctcagcctcccaagtagctgggattacaggcacacgccaccacacctkgctaatttttttgtatttttagtagagatggggtttcaccatgttggccaggctggtcatgaactcctgacctcaagtgatctgcccacttcagcccccc

SEQ ID NO: 25863 - DNA, 201 bp, Homo sapiens
ggcggaggcgggcggatcacgagctcaggagatcaagaccatcctggctaacacggtgaaaccccgtctctactaaaaatacaaaaataaaaaaattagcygggcgtggtggcgggcgcctgtagtcccagctactcgggaggctgaggcaggagaatggcgcgaacccgggagacggaggttgcagtgaacgcagatcgc

SEQ ID NO: 25864 - DNA, 201 bp, Homo sapiens
actggcccttccctgctctctgtcaagcagtttttcactgtttgtggggaggaatgtcctcccaacatgattagacaccattactttcttgagatatttayggtagtgtcagagacagcggattctgggagtctgtgtgtgacatttgtgttagccctgtgcctgtgagggaaagcgctgttctacaattgtaggaaccct

SEQ ID NO: 25865 - DNA, 201 bp, Homo sapiens
tcatgttcagtttgttttgacaccgattgaagttgccattgaagacatgaagaagaagaccctgcagttagcagttgccattaaccaggagccgcctgatscaaagatgcttcagatggtgctgcaaggctctgtgggagctactgtaaatcaggtaagcaaaaccagaggtggcagctcctctggttcttattatttagg

SEQ ID NO: 25866 - DNA, 201 bp, Homo sapiens
ccgcacacacacgtgcatgcacacactgcacacacttaatgctaaacttgaaagagatttaaaggctaaaaggaaagttggactttaaatttcccctggasctcacattttctgggtactgaaagatatggtagatacatatgattgccttttccaaaaataacttctatggaaaatcctgagagttataagagactacaa

SEQ ID NO: 25867 - DNA, 201 bp, Homo sapiens
acatacttctacaaaactggaagtatgcttatatattgtatcataacctgcttttttatttaaaaaatatcatgaacaacttttcatgtcattaaatattsttgcattacatttctaatgaatgcataacattccattgtaaggatacagcgtaatttaactcagtctgtattgagctacattgatttccagttattcaca

SEQ ID NO: 25868 - DNA, 201 bp, Homo sapiens
tcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtgat

SEQ ID NO: 25869 - DNA, 201 bp, Homo sapiens
gtcgaagtttgccatgagctgtgatcatgccactgcactccagcctgggtgatagagtgagccccgtctcaaaaaataataaaataaggtaaaaaaaaaaaacaaacacagagatttctgggtgctacccctcagcagttatgattcattaagtctgagatagatcccagaaatctgcattttgaaaagctccacaggtga

SEQ ID NO: 25870 - DNA, 201 bp, Homo sapiens
gtctgaaaaaaaaaaaaaaaaaaaaattttagctctcaaagttttcctccatgttccatgaaaatacactttacaatctagtattccccccaccacacacrcacacacacgcacacacatatatactgaaacgaaaccatatccaacttcatttccatttccaattcattcaacattttctattctgttctattgcattta

SEQ ID NO: 25871 - DNA, 201 bp, Homo sapiens
tgcagtggcatgatcttggctcactgcaacctccacctcccaggctcaagccatcttcccacctcagcttcccaaatagctgggactgcagtcacctgccwccatacccagctaatttttatattttttgtagagatggggttttgccatgttgcccagtctggtctttaacttgtgagctcaggcaatccacccacctta

SEQ ID NO: 25872 - DNA, 201 bp, Homo sapiens
tttcttcctagtacttgtcacaatttgtaagtcctaaatcatgtgattgcctacttaatgtctcccgcaacctgcccctggtgttctgtaaacttcaagasgatatgttttgctcacctttgaatttttagatcccatacaacacctatcatatcataaatgtttaataaatatttattaaaagaattaataaatgaatgt

SEQ ID NO: 25873 - DNA, 201 bp, Homo sapiens
gcgaagtggagtgaagtcaccacccaagccttagcctacctctgaccacagcctgtgactccacaaagataaatgaaaagaggaaagtcagtgatgttttmtatactgtcagcagcaatctcacagcctcaatacattttctttcaaaagtttaatatgtaataactggcatttcttcttcattcctagttggttagactg

SEQ ID NO: 25874 - DNA, 201 bp, Homo sapiens
gccgagctctttgccctttacccatcagtggacgaggtgggtgccactgtttccatactggagaatctcagtgaagactctgagagtcatgtggacaattrtgttgttcattattactatatagcagcccatggtgtcagggctcacttgtatgatttctggggcctcgtttttcactcaggcaagcctgtgtgtcatagc

SEQ ID NO: 25875 - DNA, 201 bp, Homo sapiens
tccactaacaggccactgaaaaggtatcttagtcagttctgctcattgcccagccaaggcctacgttttataacatgatatcaaagattgcatctaaaatygtgatgatttcctaaaataatcatttcatttagatttttctattttaatccaaggtattcttcagtggaaataaggaaacagtttactctcccaccaaac

SEQ ID NO: 25876 - DNA, 201 bp, Homo sapiens
ttctcaagggtatgtattatccgacaaaaactacgatgtccactaacaggccactgaaaaggtatcttagtcagttctgctcattgcccagccaaggcctrcgttttataacatgatatcaaagattgcatctaaaattgtgatgatttcctaaaataatcatttcatttagatttttctattttaatccaaggtattctt

SEQ ID NO: 25877 - DNA, 201 bp, Homo sapiens
cttctaggctttttgcttgtccaaatggacatttgcatatttcaacggtccagaaagtgtatcaaactgccaagtgatgcctaatggccctttatgtctcycctagtttggagacttactcttcgaagaggaggtggaacagtgtttcgacctatgtcaccaagtcctgcaccactgcagcagcagcatggatgtcacccg

SEQ ID NO: 25878 - DNA, 201 bp, Homo sapiens
ttggccgggcgtggtggctcacacctgtaatcccagcactttgggaggccaaggcgggcagatcatgaggtcagaagattgagaccatcctggctaacacrgtgaaaccccgtctctgctaaaaatacaaaaaattagccgggcatggtggcacgtgcctgtattcccagcttctcaggaggctgaggcaggagaatagct

SEQ ID NO: 25879 - DNA, 201 bp, Homo sapiens
atggccttggccgggcgtggtggctcacacctgtaatcccagcactttgggaggccaaggcgggcagatcatgaggtcagaagattgagaccatcctggcyaacacggtgaaaccccgtctctgctaaaaatacaaaaaattagccgggcatggtggcacgtgcctgtattcccagcttctcaggaggctgaggcaggaga

SEQ ID NO: 25880 - DNA, 201 bp, Homo sapiens
gcacagcataggtgttgagcctatgaaaaggatatcttttctcaacagcaatttgcaaagattcccagtgtgatttttaaaacatggccttggccgggcgyggtggctcacacctgtaatcccagcactttgggaggccaaggcgggcagatcatgaggtcagaagattgagaccatcctggctaacacggtgaaaccccg

SEQ ID NO: 25881 - DNA, 201 bp, Homo sapiens
gctcataaaatggctccttacgtttctgtagaactcaagctcctgctccagcttccaggaccagaagatcgccagcatgttcgatctgacttccgagtacygccagcagcacttcctcaccgggctcctcttcacagaactggctgctgccctggatgccgaaggggaagggtatgtttctggcatttaaaatggaagatg

SEQ ID NO: 25882 - DNA, 201 bp, Homo sapiens
ttatctctttaaatattgtctccctctcattttccattcccttggagattctattagatgtgggttggatcttccttatatctctatgtttcttaaccaawtttttcatatttttttattttttaaatctcattggtgatttccttggatctgtcatacatttacttctccaattatgtctagtctattatttaaccttta

SEQ ID NO: 25883 - DNA, 201 bp, Homo sapiens
ccaggctggcatgcagtggggcgatcttggcttactgcaccctctgcctcccgggttcaagtgatccatcctcccacctcagcgtcccaagtcgctggaascacaggcacatgccaccatgctggctagtttttgtattttttgtagaggcagggtttcaccatgttgcccaggctggtttcaaactcgtgagctcaagca

SEQ ID NO: 25884 - DNA, 201 bp, Homo sapiens
atcaatctggtttctgtagaactgtgactgctagaaaaccccaggcatatttgttctaagaaaatacttgtgttcggtgaatttaccaacaaagggagcaycagaggatgtgagggaagtctggaatggttgtatcactaagtgagagcagcacagatgtttgtggacctattgagaatgttacagataagaccatttttg

SEQ ID NO: 25885 - DNA, 201 bp, Homo sapiens
tccctccttccctgagggcttaatctcttaggccatccttatcatcatttaccacttttgccgtctgcttcctcccaaaaaataaataaataaataaatawtaaaataaaattttaatggcaaaaaaagaagttgtaaatctcaataaaattatgtgagaacaaaaaaaaaagcaaacatgctcaaactgctgcaccttga

SEQ ID NO: 25886 - DNA, 201 bp, Homo sapiens
ctttagtggctatatcaagagaagcttttacagaagggtgagggtggtagcctgcgaacattggattaggagtgagagggactgaaggaagtagaaactcsagctcaggggaaggggagagaatgagcttgaggaaggccctctgatgaagggaaggctcttttctgatgccagtgagttgagcagacttataggaagcaa

SEQ ID NO: 25887 - DNA, 201 bp, Homo sapiens
gtgtgaacatactcacagattatcttgattaatgttttgatatttgaattgtttcctgtatttgacaacaattctgacagaaaaactagttgttgttgttkttttttcagtacataatacgtatcttttaaaaggctagaaaaatatttggggaattattttattattttattttattttgagacaaggtctcactctgtt

SEQ ID NO: 25888 - DNA, 201 bp, Homo sapiens
aaatttcctgagatgtccaagaccttccttatttttttttgtttatttcaaaccaactacaaaattaaatgttcaaactaagaagtcactccaatattttytcccaagcaatttaatttccttcatatatgtatgaatatattcatatatatgtgtgtgtatatatatatacatatatatgcatatacatatacatatgca

SEQ ID NO: 25889 - DNA, 201 bp, Homo sapiens
gcaaagcttagtatcctttcttctgaaagctttcgcatgctaagctttccattgccaagcccccgggaaggaaaataccagaagtttcactccgatagcarctttttctgagatgcgcctggtgataacattttccagtagggctatcttctgtctccttccttctctgtgtgtaccagtaaagccttgtacaagtctctt

SEQ ID NO: 25890 - DNA, 201 bp, Homo sapiens
cccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacct

SEQ ID NO: 25891 - DNA, 201 bp, Homo sapiens
gctgaaaatctgagatgctttcattacattttatttatgtttgtgtgaaaccagtatatttttgttctatatgaaaatgtatgtcataaacattcagaaaytcagaggagttcatccgaaaggctgacatggtacaccgtggaccgaagcctctggggcaaaatgttttctatgtatcattcgttgagtctcagtttgaag

SEQ ID NO: 25892 - DNA, 201 bp, Homo sapiens
acccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgacc

SEQ ID NO: 25893 - DNA, 201 bp, Homo sapiens
aacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatgac

SEQ ID NO: 25894 - DNA, 201 bp, Homo sapiens
tcaatgtcagacatctgggcttatgtctcatctttctactgttctcaactaagagattctcgtcattctacaactttcctgagcctgctctccttctccaratattcacccttccaggcactgactccacctcccacatcagagctttttcttaaagtaaataacagtcaacaattaatagcttcataactttggaacagt

SEQ ID NO: 25895 - DNA, 201 bp, Homo sapiens
caatgtcagacatctgggcttatgtctcatctttctactgttctcaactaagagattctcgtcattctacaactttcctgagcctgctctccttctccaartattcacccttccaggcactgactccacctcccacatcagagctttttcttaaagtaaataacagtcaacaattaatagcttcataactttggaacagtg

SEQ ID NO: 25896 - DNA, 201 bp, Homo sapiens
tttcattccagttcttgtggctcataaaatggctccttacgtttctgtagaactcaagctcctgctccagcttccaggaccagaagatcgccagcatgttygatctgacttccgagtaccgccagcagcacttcctcaccgggctcctcttcacagaactggctgctgccctggatgccgaaggggaagggtatgtttctg

SEQ ID NO: 25897 - DNA, 201 bp, Homo sapiens
gaacccgggaggcggagattgcagtgagccaagatcatgccattgcactccagcctagacaacaagagcaaaactccatctcaaataaataaataaataaataagtaagttgagtaacttgctcagtaataggaaaaggcacctgacagggtagaaaaaacatggactttgaagatagacatacttgtgatcgaattatga

SEQ ID NO: 25898 - DNA, 201 bp, Homo sapiens; identical to SEQ ID NO: 6320

SEQ ID NO: 25899 - DNA, 201 bp, Homo sapiens
ccagctacttgggaggctgaggcaggagaattgcttgaacccgggaggcggagattgcagtgagccaagatcatgccattgcactccagcctagacaacargagcaaaactccatctcaaataaataaataaataaataagtaagttgagtaacttgctcagtaataggaaaaggcacctgacagggtagaaaaaacatgg

SEQ ID NO: 25900 - DNA, 201 bp, Homo sapiens
aactagccctctgtaggcaattaaatgtatattttcctgaagaaagtaaggttatatagaatataagtataaggtcacctagaagagctattaatgtattwtggacaatttctttttattgccagagctacatgttacttatatttaagtctgatatttaattctctattatattcccttattattgaattaattaattca

SEQ ID NO: 25901 - DNA, 201 bp, Homo sapiens
tgtggtggtgcatgcctgtaatcccagctacttgggaggctgaggcaggagaattgcttgaacccgggaggcggagattgcagtgagccaagatcatgccrttgcactccagcctagacaacaagagcaaaactccatctcaaataaataaataaataaataagtaagttgagtaacttgctcagtaataggaaaaggcac

SEQ ID NO: 25902 - DNA, 201 bp, Homo sapiens
gttctcaactaagagattctcgtcattctacaactttcctgagcctgctctccttctccaaatattcacccttccaggcactgactccacctcccacatcrgagctttttcttaaagtaaataacagtcaacaattaatagcttcataactttggaacagtgcagtgtctttggtttaagaagcattgtttccatcctcca

SEQ ID NO: 25903 - DNA, 201 bp, Homo sapiens
ttctgatcagccagctacaaatttgggagtttctataacctgttagcttgaaaataggagaaaacaaagcaaataataataataataataataataataawaataataataatttgggagtttctatgatacctgttagattaaataattcactacaatgactcacagaattccaaaaagtactctggttactatcagagt

SEQ ID NO: 25904 - DNA, 201 bp, Homo sapiens
aatgttgaaggtggaaaagaaatgttttcccttacgtgcctacctattattttttttaaataggtcaaattccaaaagtaagactgtgttgaaatatggcsattagtacattcagcatgtgctcatgtttttcaccttactactcagaatagtgtaaactatctcttaaaaatatttgtgggataaaaccagtgtgcttcc

SEQ ID NO: 25905 - DNA, 201 bp, Homo sapiens
ggatttggatgaacaggagtttgtctacaaagagcctgcaattaccaagcttcctgagatctcacatagactagaggtaagaaaagtgattctgtgcgcckgacctggtacactttacaaaaacaagttagagtgggtcatcaccaaaaataaacaaataaagagttatggattcatcattgatctctacataaagttttc

SEQ ID NO: 25906 - DNA, 201 bp, Homo sapiens
ggggcaaaggaaacactgaggagttgtctgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaag

SEQ ID NO: 25907 - DNA, 201 bp, Homo sapiens
ccttgtccttccatatcttcccaggtaataaaagaattatttaactaaaagaattattcaagctatttcatttaactagctcagtttaatcatgtatttcytataaaggttagtcttattaatttgacaaaaaatcaaacaattcaaaccagatcaagtatgctaccctgaagttacaccactagctaagaattaacaatc

SEQ ID NO: 25908 - DNA, 201 bp, Homo sapiens
tttagtaaaaccacagaaggtaactgtattttactctttattttctaaattgtttacctggaacatatattactttcataatcagagaaaaataagcatcrttttaaaacaataattaaaatataactgtaatgtcagttaaacgcagtatgttatactggactggaccctgatgtggggctggaaaattgttataaacaa

SEQ ID NO: 25909 - DNA, 201 bp, Homo sapiens
gaaagagccctctccttggaggaaaatggggttggatccaacttcaaaacctccactctgagcgttagcagctttttcaagcaggtatctcttcacattayagtgtgtctggatttttccccatactggcatgggcactggaacccacaggaggaggatacgtagtgattaagagagcaaattagttaagctcactctctt

SEQ ID NO: 25910 - DNA, 201 bp, Homo sapiens
tggtctctgaggacaccctgtcacctgacgaggatggggtgtgcgcaggccagtacttcaccgagagtggcctggtaggcctcctggagcaggccgcggarctcttcagcacggtcagtgcccagagggcatcccggggcctggcctcccatactccagctggacttggggtgctgggaacacctggtcttaatggcccag

SEQ ID NO: 25911 - DNA, 201 bp, Homo sapiens
gaagcagaacgaggaggcccggaggaccaataggcaggccgagctctttgccctttacccatcagtggacgaggtgggtgccactgtttccatactggagwatctcagtgaagactctgagagtcatgtggacaattgtgttgttcattattactatatagcagcccatggtgtcagggctcacttgtatgatttctgggg

SEQ ID NO: 25912 - DNA, 201 bp, Homo sapiens
catccttccaagggttagaaaatgaaacatcattatctgtgtaaatacaattcatccagggacccaggataatcaaaggtatagggagttgtggtttccasctcttaaaaatttgtcacattgataagcatgtaaagaaaactaatatttctttagcaacctcagatggcttaataaaagcagctgattttgcagggaggg

SEQ ID NO: 25913 - DNA, 201 bp, Homo sapiens
cggggcaaaggaaacactgaggagttgtctgtgtctggccatgctgctttcagttatctactgctaagtgtgtcttatttacttcatcttttttttttttttcactgatgcagaattttgcaagagtaaagatgcaagtaaccatgtccctggcatctttggtgggaagagcaccagactttaatgaagagcacctgagaa

SEQ ID NO: 25914 - DNA, 201 bp, Homo sapiens
tacaaaatatccctttacagcttcacttagatttcataagaatggatgggctagcaaaaaaaaccattctgattccttaaagtgaaacctaatagaggagygagcaccaggcaatttcccattccctagtgggcaatgaccagtaatgtccggcaggatattagatcacctgccctacaggaatacagtcttgtttcccaa

SEQ ID NO: 25915 - DNA, 201 bp, Homo sapiens
gaagtatttgctaattttatctgcaaagataatacaagcataaaaatatatgtattcaaatgtatagatgtgtatctgcagtgagagcagagctgttcctyagtagtgggggtggctggcagagtgaggtagtgtgctttcaggaattgctttatttgtctgatgtgttctagaccaaagaccaacagaggggcttgggca

SEQ ID NO: 25916 - DNA, 201 bp, Homo sapiens
ctacagtagatgtgtattataatatatattgttaccagaaaaaaaattataaagaaatgaaagaataaaaaaacctgtttggatcaaaatctatgctataratgaatagatatattgacgtgtattgctatatatgcaacaatttagacatatgaaagctaaaagtatatatgtttgactagatagcacatgtttccgata

SEQ ID NO: 25917 - DNA, 201 bp, Homo sapiens
aacattttgtcacttttgctttagttgttttttttttaattaaaaaagagaacattacagataaatgtgaagtccctgttattctgttgcccatttctgtwctccctgctgctccctgagagtactaacacaaaggtgtacttctggggtgtgtgtgtatatgcatatccataaacaatatatggtatagcttctggaggg

SEQ ID NO: 25918 - DNA, 201 bp, Homo sapiens
gaaatcaccaggaaatttttcaaaaagatttttctcccccgatgaatatacccacgatttgcatttgacccaagataagcagttgagtcgataacatgttwatttttaaatacatggttttaaaacacacaataaaaattctacctcattgcttggagactcaattaaggaaagtatgcacattagcaaaaagaagatgtg

SEQ ID NO: 25919 - DNA, 201 bp, Homo sapiens
aaaacctgatatatttgggtataaatgttcaatcctactgtaggtttttttttccattttgcccacttgtttcttgttgctatagtcattacaacaatacrtgtttgacttattagaatcctagtattaattagtacttttaccatttcccagatgatataatatgggctttaaaacacatgaaatccgtttacccctcaa

SEQ ID NO: 25920 - DNA, 201 bp, Homo sapiens
ccaccagtcagataaaaaatataatattccattatcctctctcagttacaggcccccctcaagtaaccactattctgactcttattattagaaattaataytgcctgttgttgaatttcatagtcttttgctgaatgttgtgactgtgacatcctttagtgtggtcgcatgtgtcagtattcattttttttcaactgtatg

SEQ ID NO: 25921 - DNA, 201 bp, Homo sapiens
ttttctcccccgatgaatatacccacgatttgcatttgacccaagataagcagttgagtcgataacatgtttatttttaaatacatggttttaaaacacasaataaaaattctacctcattgcttggagactcaattaaggaaagtatgcacattagcaaaaagaagatgtgatatttgctcagaagtcttgaagtggata

SEQ ID NO: 25922 - DNA, 201 bp, Homo sapiens
attactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattgc

SEQ ID NO: 25923 - DNA, 201 bp, Homo sapiens
aagataagcagttgagtcgataacatgtttatttttaaatacatggttttaaaacacacaataaaaattctacctcattgcttggagactcaattaaggaragtatgcacattagcaaaaagaagatgtgatatttgctcagaagtcttgaagtggatattttggccttcgtatggctgaatggtcaagcttgactctctc

SEQ ID NO: 25924 - DNA, 201 bp, Homo sapiens
ttttctttgtagtcatgtttccacctgttgaatccgttttatggaagttgtacagttatggcttgtctgtttatgagaagagatagagaatatgagaaacrataaaacctgaaataatccattgtgaggccacaggctgaagaacttacaaggaatttattctagactttatggctgaaaatatgtatgcatatatgtata

SEQ ID NO: 25925 - DNA, 201 bp, Homo sapiens
agagcaatattcaggacacagccaaaaccttctttggcagacctttttgagttctctctactcagctttctgctgtgtaatatgagcactctagagaagtygggctgtcctcaggaaattacacttggggtctgtggttccccaggaaggcaaactggagctccctaaggggtactagtcatcatacggcatttatactag

SEQ ID NO: 25926 - DNA, 201 bp, Homo sapiens
tattactagcaacaaggtagagtatattcagagataatcatgtaattatgtttaatcaggtagatacattcttcaaacacacacacacacacacacacacacgcacacacgcgcgtgcacatgcacacacacagtaccctttctcccccaaaagagtaattaacagtgtaactcctttggcaacacagtaatccctgattg

SEQ ID NO: 25927 - DNA, 201 bp, Homo sapiens
agttctctctactcagctttctgctgtgtaatatgagcactctagagaagttgggctgtcctcaggaaattacacttggggtctgtggttccccaggaagrcaaactggagctccctaaggggtactagtcatcatacggcatttatactagcattgcagtccactttcacctatgcaagtagaaaaactcaggctcaaag

SEQ ID NO: 25928 - DNA, 201 bp, Homo sapiens
tcctaaaaactcttctagctttctttctctttcttctccatttcctcctctctcagtctgggacaagctccttgagttttttgcaggtactatgtactttsctaaacagtttgatgcctttctctagggaactggttctacaactttccaatggggcctttaattagaaactacgagagaacacttgtagtataaaagtca

SEQ ID NO: 25929 - DNA, 201 bp, Homo sapiens
gttaacataaatgttgttttaagatgatggccatctgttgtctgtgagaacaagactatcacccacctgttgacatgctggctggtttaatatcttactckttcattccaaataactacctggtctcacagatccccttagatggggtatccaatttacctcctgtaccttattctctgtccaataatttcactcaaatca

SEQ ID NO: 25930 - DNA, 201 bp, Homo sapiens
tgcttcatggtttattttttaaaggaagatttttcctaaaaactcttctagctttctttctctttcttctccatttcctcctctctcagtctgggacaagytccttgagttttttgcaggtactatgtactttgctaaacagtttgatgcctttctctagggaactggttctacaactttccaatggggcctttaattaga

SEQ ID NO: 25931 - DNA, 201 bp, Homo sapiens
tcaagtgcaaaagtgcccagggtatgtgtttgcctcctgttccttagatcttcctaccatcacctcacattctccagtcaccagatcctaactctgtgacygtgtctggacatcagacaatatccctctctctctctgccaaccggtacttagggtacataatagaacctctgggagctgtggttttgatgtctctagact

SEQ ID NO: 25932 - DNA, 201 bp, Homo sapiens
agctgagatgtcattcttatcaaatccgcagtttcttcagaagacttgaggcctggctgagattctgtagtcccaaattggagcagtcttgagacatccargattcttcggttctcattttagacttgccgtctctctcacaaagacccactgttttctctcacaggcaggcccccgccacttaaacgtgctgtgcgacgt

SEQ ID NO: 25933 - DNA, 201 bp, Homo sapiens
acctctgtcttgtccagggaaaacagagttctgacaaagtcagtacccaagtcctgcagaagtcaagggatgtcaaggcccggctggaagaggctttgctscgtggggaaggggccagaggggagatgatgcgccgccgggctccaggtgtgttggactggcccttccctgctctctgtcaagcagtttttcactgtttgt

SEQ ID NO: 25934 - DNA, 201 bp, Homo sapiens
ctgtcaccttctcttctgccctcctttgccatggcataggataatgtaagtcagcaatctcattactcggtatatagccagaggaatataaatcattctascataaagacacacgcgtgtgaatgtttattgcaacactattcacaatagcaaagacatggaatcaacttaaatgcccatcaatgacagattggatgcaga

SEQ ID NO: 25935 - DNA, 201 bp, Homo sapiens
acaagaatttcttgaacccaggaggtggaggttgcagtgagccgagatcccgccactgcagtccagcaacggagtgagactctgtctcaaaaaaaaaaaaagttgttttggtttttaatttttgattttttcttatgttattacatataacgaatgatatgcatactctgaaaaatcatgacataaaggtgaccttgaaat

SEQ ID NO: 25936 - DNA, 201 bp, Homo sapiens
ctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatga

SEQ ID NO: 25937 - DNA, 201 bp, Homo sapiens
tctgataaatcagatgagaggaagggtgtatgtttgatgttgatttttctttttgttttattggggtttttaaaaactataaatatcaggtctgatgactatgtgtataaacattttctaagtagataaaatattttcaaattttgcattttttagtatgaaggggatccatcatttgaagttggttttctagatgtgatg

SEQ ID NO: 25938 - DNA, 201 bp, Homo sapiens
acctttttctgcttttcattgcttgcttcatggtttattttttaaaggaagatttttcctaaaaactcttctagctttctttctctttcttctccatttcmtcctctctcagtctgggacaagctccttgagttttttgcaggtactatgtactttgctaaacagtttgatgcctttctctagggaactggttctacaact

SEQ ID NO: 25939 - DNA, 201 bp, Homo sapiens
gtatatatatatatatgtgtatatatatatatgtgtatatatatatatatatagtttaaaaaacaaactactcttgaagtgagtgaagaggaggcatgtcyatcacaaggatgatgcttcatatttctgtgctggggtggggggtgataatgatgaaatattgaggagctcaaggtgcatcagcgccccttccttccccta

SEQ ID NO: 25940 - DNA, 201 bp, Homo sapiens
tagtcccagctacttggaaggctgagatgggaggatcactcgaacccaggaagttgaagctgctgtgagcagtgattgcgccactgcactgcagcctgagwgacagagcgagactctatttcaaaaaaaaaggaacaaacccaataattttgggcataacgaccagagcacaatgagctacagagagctttctgagaagta

SEQ ID NO: 25941 - DNA, 201 bp, Homo sapiens
atatgtgtatatatatatgtgtatatatatatatgtatatatatatatatgtgtatatatatatatgtgtatatatatatatatatagtttaaaaaacaarctactcttgaagtgagtgaagaggaggcatgtctatcacaaggatgatgcttcatatttctgtgctggggtggggggtgataatgatgaaatattgagga

SEQ ID NO: 25942 - DNA, 201 bp, Homo sapiens
atggctcgagcccaggagttcgagaccagcctgggcaacatagcaaaaccctgtctctacaaaaaatacaaaaattagccagctgtggtggcttgcacctrtagtcccagctacttggaaggctgagatgggaggatcactcgaacccaggaagttgaagctgctgtgagcagtgattgcgccactgcactgcagcctgag

SEQ ID NO: 25943 - DNA, 201 bp, Homo sapiens
ttgcagtgagccgagatcatgccactgcactccagttcaacagagcaagactctgtatctctctctctctctctctctctctctctctctctctatatatmtatatatatatatacatatatatatatgtgtatatatatatgtgtatatatatatatgtatatatatatatatgtgtatatatatatatgtgtatatata

SEQ ID NO: 25944 - DNA, 201 bp, Homo sapiens
ggttgcagtgagccgagatcatgccactgcactccagttcaacagagcaagactctgtatctctctctctctctctctctctctctctctctctctatatmtatatatatatatatacatatatatatatgtgtatatatatatgtgtatatatatatatgtatatatatatatatgtgtatatatatatatgtgtatata

SEQ ID NO: 25945 - DNA, 201 bp, Homo sapiens
ataagaaccttggataaagaggacgaaagtgtagaatgcagaaaaaaacattaaccctcttgtggacagtcaggattgaaaggaagaaaaaataatggctyacacttctagaatgctttctatgtggcagagacagttctaaatatttacatatcgtaactcattcacctctatgagataggagcaatgactatctccgtt

SEQ ID NO: 25946 - DNA, 201 bp, Homo sapiens
ccttcacagtcttgcactatcagtgaatcttatgctttattgaacataaaaatcacctggaattgctgacttaaaatacagttttccaggctataccacamgagatgctaatacaggactggggtaggtccaggaattcgaatttttatctaagtagctgatgacttaatgcaaatgatccagcagccacactttgcaagc

SEQ ID NO: 25947 - DNA, 201 bp, Homo sapiens
ccaccattagctccaccatgaccacctccttcacctccaccatcacttcttccaccatcatcattgtcaccatcatcaccactacccacctccaccaccaycaccacctctcccatcaccaccacgttctctgtggttagtcacttagtgactttagataagtttttccaattttatgggtcttaatttcctcagttttaa

SEQ ID NO: 25948 - DNA, 201 bp, Homo sapiens
ctccttaccaccagtccatcaccaccattctgactccttagtcacaatgggtattgacattttaaataaatcccaaggctcccttccgggaaaataaagargataatatttataaactattttgagttccttagaagaagggtatcttagctcattaaggaaatattatcatgatataaatctaacatcatgaaacttatc

SEQ ID NO: 25949 - DNA, 201 bp, Homo sapiens
accacctcccccactaccaacagctccttcaccatcaccacaacatccaccaccaccatcacctccaccaccaccacctcctccaccatcaccacctcctycaccatcaccaccattagctccaccatgaccacctccttcacctccaccatcacttcttccaccatcatcattgtcaccatcatcaccactacccacctc

SEQ ID NO: 25950 - DNA, 201 bp, Homo sapiens
ttgaacctgggagacagaggttgcagtgagccgagatggtgccacagcactccagcctgggtgacagagtgagactctgtctcaaaaaaaaaaaaaaaaaagaaattgcaatatggactgtggtttaaatgatcatatcaggctgggtgcagtggctcacacctgtaatcccagcactttgggaggcaagggtggtcagat

SEQ ID NO: 25951 - DNA, 201 bp, Homo sapiens
gtctttccctagctgcctcttcaaattcaggtggcctctctgtcatagctccaggcttgtccatagcttatgagaccagacagtgacttccctatgtttaygtctcatgttcagtttgttttgacaccgattgaagttgccattgaagacatgaagaagaagaccctgcagttagcagttgccattaaccaggagccgcct

SEQ ID NO: 25952 - DNA, 201 bp, Homo sapiens
attttccattgtgtggatatacaactttttgttaagtcattcatcagttgatggacgtttggattttttccattttttggcctttatgaataaggctgctrcgaacattcatgtgtaagtttttgtggggaagtgtggttgtctttttttttttttttttttttgcaacagagtcttgctccgtcacccaggctggagtgc

SEQ ID NO: 25953 - DNA, 201 bp, Homo sapiens
cttgaacctgggagacagaggttgcagtgagccgagatggtgccacagcactccagcctgggtgacagagtgagactctgtctcaaaaaaaaaaaaaaaaaagaaattgcaatatggactgtggtttaaatgatcatatcaggctgggtgcagtggctcacacctgtaatcccagcactttgggaggcaagggtggtcaga

SEQ ID NO: 25954 - DNA, 201 bp, Homo sapiens
ctttttgttaagtcattcatcagttgatggacgtttggattttttccattttttggcctttatgaataaggctgctacgaacattcatgtgtaagtttttstggggaagtgtggttgtctttttttttttttttttttttgcaacagagtcttgctccgtcacccaggctggagtgcagtggagcaatctcagctcactgt

SEQ ID NO: 25955 - DNA, 201 bp, Homo sapiens
agccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcatc

SEQ ID NO: 25956 - DNA, 201 bp, Homo sapiens
ttttactctttattttctaaattgtttacctggaacatatattactttcataatcagagaaaaataagcatcattttaaaacaataattaaaatataactrtaatgtcagttaaacgcagtatgttatactggactggaccctgatgtggggctggaaaattgttataaacaaattacacacatgaggccaggggttcgag

SEQ ID NO: 25957 - DNA, 201 bp, Homo sapiens
ccagcagtgaatattcacttcctctgtgagagagctccagccctcctgtactcacttcctcacacagcacagcagcactcttgctggttctgctgcttatsttgaagaggttaggttactttttgtttctacttattacttcgaaaccacttctgccttagaaattttgtaaccttccgctcagtttccggtaaccgccat

SEQ ID NO: 25958 - DNA, 201 bp, Homo sapiens
ggcctcaaagtcctccttctgtcatcatccttccagtattgggcaggacctgactgcaggcatcatggcctctgtgaacttctcaagggtatgtattatcygacaaaaactacgatgtccactaacaggccactgaaaaggtatcttagtcagttctgctcattgcccagccaaggcctacgttttataacatgatatcaa

SEQ ID NO: 25959 - DNA, 201 bp, Homo sapiens
tgagtgtcccccccacccccacccccgagcgagccacttggttccttctcatataatgtgatgttcgttgccatggcacgctgtcttcttcattactgagwtggcatgaatcctacacatcctgtgttttgcagcacgtccctcatgtctgtgccatggacattcctcagacatgctggtttaccttgattcctggagcat

SEQ ID NO: 25960 - DNA, 201 bp, Homo sapiens
cgggcaccaccagcacagataaagtgtcagaaaatccattgttagagagcatttctgtgagtctttcccccttttctgcattgtacaagcaggtcaccaakctccatgttgacatttcctccatccccctccgcaggtgaaaagcatggcccagcacgtacataacatggacaaacgggacagttttcggaggactcgttt

SEQ ID NO: 25961 - DNA, 201 bp, Homo sapiens
attggtgtgtctgcagcattttagtccagagcttgctcgggcaccaccagcacagataaagtgtcagaaaatccattgttagagagcatttctgtgagtcwttcccccttttctgcattgtacaagcaggtcaccaatctccatgttgacatttcctccatccccctccgcaggtgaaaagcatggcccagcacgtacata

SEQ ID NO: 25962 - DNA, 201 bp, Homo sapiens
cctcctgattagctgggattacaggcgtgcaccaccacacctggctaattttttttgtatcttttagtagagacggggtttcgccatgttggccaggctgrtctcaaactcccaacctcagatggtacacccacctcagcctcccaaagtgctgggattacaggcgtgagccactgtgcccagcctcttctgtcatcttct

SEQ ID NO: 25963 - DNA, 201 bp, Homo sapiens
cagcttttactttaatgccacagccttaaattttctttcaggagaaattattttatgtaaagttacaaaggaaaataatgcttaatatctgtaagcattcrtttggtaagtttgctgcctcctcagtaagttttgatgaaagtgaattttgatgaattactaccttagccgggtagtgacgttaacatgtggcttagctgt

SEQ ID NO: 25964 - DNA, 201 bp, Homo sapiens
agtagagacggggtttctccatgttggtagggctggtctctaactcctgacctcaggtgatccgcccgcctaggcctcccaaagtgctgggattacgagcrtgagccaccatgcccggccaccagcttttactttaatgccacagccttaaattttctttcaggagaaattattttatgtaaagttacaaaggaaaataat

SEQ ID NO: 25965 - DNA, 201 bp, Homo sapiens
tatttttagtagagacggggtctcaccatgttggccaggctggtcttgaactcctgaccgcaggtgatccacccgccttggcctcccaaagtgctgggatyacaggcttgagccaccgtgcccggcctaaaccttgatttttaaaaaaatactaccctgccctaaccttgtaacttaggaagtttggggagaggggtgtgt

SEQ ID NO: 25966 - DNA, 201 bp, Homo sapiens
caaaagaaacactgtgcctaaacactcagccaaggagtgttgagtttgcctggatttctggaaaattgtctccgttccctagttcactgtatttgggtaarcaaaacatggcctcggagagcctttgcgggagaaattataaaaattcagcaaagctttgtgatctcattttggatctcctcaggattcctcatcaagttg

SEQ ID NO: 25967 - DNA, 201 bp, Homo sapiens
gagaatatgagaaacgataaaacctgaaataatccattgtgaggccacaggctgaagaacttacaaggaatttattctagactttatggctgaaaatatgyatgcatatatgtatatgagtgtatggagatacagttatggatagagatctatagatatatgtgtagatatatagatacataaagtttgctacagaaattc

SEQ ID NO: 25968 - DNA, 201 bp, Homo sapiens
ttgttgagtgtgcctatatgtgttatattatttgagcactaaatgccagatgtgtgccaagtgagataaatctgacaaatgagatggtttgtaaaaccagsagtgaatattcacttcctctgtgagagagctccagccctcctgtactcacttcctcacacagcacagcagcactcttgctggttctgctgcttatcttga

SEQ ID NO: 25969 - DNA, 201 bp, Homo sapiens
ttaaactggggaggcagaggttgcagtgagctgggattgcaccactgcacttcaacctgggtgacagagggagattccatctcaaaaggaaaaaaaaaaaacctgatatatttgggtataaatgttcaatcctactgtaggtttttttttccattttgcccacttgtttcttgttgctatagtcattacaacaatacatgt

SEQ ID NO: 25970 - DNA, 201 bp, Homo sapiens
gagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggcat

SEQ ID NO: 25971 - DNA, 201 bp, Homo sapiens
taacaattttttaaaatgtagtctgatgacctttgtcttttaattagagaatttaatctgtttacatttaataactgatataggcagggcacggtggctcmcgcctgtaatcccagcactttgggaggccgaggcgggtggatcacctgaggtcaggagttgaagaccagcctagccaacgtggtgaaaccccgtctttac

SEQ ID NO: 25972 - DNA, 201 bp, Homo sapiens
tgagccttgatcatgccattgcactccagcctgggcaacagattgagaccctgtctcaaaaaaaaaaaaaaaaaaaaaaaaaaaaagaagaagaagaagaagattcacttgagtcataatccagctatggataattcatacaaataattcattcccaatgcggaattcagcattgcttattctgagtggttccatgtggca

SEQ ID NO: 25973 - DNA, 201 bp, Homo sapiens
tcttataagtaacaattttttaaaatgtagtctgatgacctttgtcttttaattagagaatttaatctgtttacatttaataactgatataggcagggcayggtggctcccgcctgtaatcccagcactttgggaggccgaggcgggtggatcacctgaggtcaggagttgaagaccagcctagccaacgtggtgaaaccc

SEQ ID NO: 25974 - DNA, 201 bp, Homo sapiens
tgccttggaaaaattgccacccaactactccatgcattctgctgaggtaattggcaagctggccatcagctgtttcttgtccagctgtagtcttggaccaycttcccagactcactttccattcccatgtggccatggatgttcatcatgttctcagagagcacattgttctgataggatgggaggaataactgactgtga

SEQ ID NO: 25975 - DNA, 201 bp, Homo sapiens
ttcttataagtaacaattttttaaaatgtagtctgatgacctttgtcttttaattagagaatttaatctgtttacatttaataactgatataggcagggcrcggtggctcccgcctgtaatcccagcactttgggaggccgaggcgggtggatcacctgaggtcaggagttgaagaccagcctagccaacgtggtgaaacc

SEQ ID NO: 25976 - DNA, 201 bp, Homo sapiens
tttataacatgatatcaaagattgcatctaaaattgtgatgatttcctaaaataatcatttcatttagatttttctattttaatccaaggtattcttcagyggaaataaggaaacagtttactctcccaccaaaccttggccagtaccatcgacagagcataagtacctctggcttcccctctcttcaactagtaagtatg

SEQ ID NO: 25977 - DNA, 201 bp, Homo sapiens
gaagatcaaggtgtagtccagttataatatgtgcacagttagaccacctgctagactaaaactcaaccccacgcctctctcaagtgagacagcttcacttsagactcacaacagcaaacaaatgtgttaacgcatattaaaattattaaggtttgactaacctcacaaaacgaagtgaaaccagtcgataagctgaaacac

SEQ ID NO: 25978 - DNA, 201 bp, Homo sapiens
ttaggtgtacaatttggtgaacttgggcaacttagagtcacttaacctttcctcagtcaagatatagaacacttcttttatcctaaagcgttccccagcgygcttttacaatctcctctccccaggccacaccctccaactcacgcaatctctgactcacttctgtcaccataattttgctctatctggagcttcatatcc

SEQ ID NO: 25979 - DNA, 201 bp, Homo sapiens
aatttgaaaacaagtggaatagtgctgtcttccttggtatgttggtgcacatgtgtctggttgatttttcatttcatgtcttctgtcttctgttttgtttygtttgtttgtttgttttgagacagagtctcactctgttgcacaggctggagtgcagtggcgcaatctcagttcactgcaacctccgcctcccgggttctt

SEQ ID NO: 25980 - DNA, 201 bp, Homo sapiens
ccctggcagacaaactgacctattttctagaggcgacctttgaagctgggggagcatgtctttcctacaatgagaagatcaaggtgtagtccagttataayatgtgcacagttagaccacctgctagactaaaactcaaccccacgcctctctcaagtgagacagcttcacttcagactcacaacagcaaacaaatgtgtt

SEQ ID NO: 25981 - DNA, 201 bp, Homo sapiens
accctggcagacaaactgacctattttctagaggcgacctttgaagctgggggagcatgtctttcctacaatgagaagatcaaggtgtagtccagttatawtatgtgcacagttagaccacctgctagactaaaactcaaccccacgcctctctcaagtgagacagcttcacttcagactcacaacagcaaacaaatgtgt

SEQ ID NO: 25982 - DNA, 201 bp, Homo sapiens
catttaattgaagtcaagttatttagaacctaatcatttacacgtctttgttgttgctgctgttttgcaagagtgaagagcttggagtcaggtgaatctgsgatgaagtacagttgtcatttattagtcatgtaatttgtgacaagccacttaatctctctgaagacttcagtttcttcatttgtaaaattggcataataa

SEQ ID NO: 25983 - DNA, 201 bp, Homo sapiens
ggataagaacagaaggatttcctcatgccctcacactgtgcttgggaatagtcaaagtgctcccctgcctgtccctgatgtgctaacacacacacaccccmcacacacttttgcagccctgtcctttacgccacatttgaccacctaattgcccattaactcagtgtttctcccactttctcatgcatcagaattacctgg

SEQ ID NO: 25984 - DNA, 201 bp, Homo sapiens
attgaagtcaagttatttagaacctaatcatttacacgtctttgttgttgctgctgttttgcaagagtgaagagcttggagtcaggtgaatctgggatgargtacagttgtcatttattagtcatgtaatttgtgacaagccacttaatctctctgaagacttcagtttcttcatttgtaaaattggcataataatgctgt

SEQ ID NO: 25985 - DNA, 201 bp, Homo sapiens
aaatcagaagctctagcaaccctggggtccatttcccgatggcagtaatagactggagccagtagtaccccctgcctttgtaagaggcatgtgttggctgyttaccatgatctccaccactccctggtgccttatgccccatctacttctctccaaaagattgcctcctaccccaaccgggatttgttaagaagtctctaa

SEQ ID NO: 25986 - DNA, 201 bp, Homo sapiens
agaagtattctggatatatttcagaagaaagtggataggattttctgatgggtgatatgtagagtgtaggagaaagagaagaagcaagattgactttaatrttttccacctgggcaattggtggactggaattgccacttgcagaagtgtggaggtatggaaggtatgggaagagcagattgccaggaaagttgagttagt

SEQ ID NO: 25987 - DNA, 201 bp, Homo sapiens
aaaaaaaaattaaatagtaatatctcatagatttccataaccgcttgtgaaaacatgtcaacatttaaagatgaaaaacagtgctgtatacatcatatacygtaatcctcacaaggttcagatgactctatggatttttgaatctgagaaaacctcactgcatgaattgtaaagttgtcatttaaatattgacaaattaaa

SEQ ID NO: 25988 - DNA, 201 bp, Homo sapiens
tgactttaatgttttccacctgggcaattggtggactggaattgccacttgcagaagtgtggaggtatggaaggtatgggaagagcagattgccaggaaarttgagttagttttgaactcattgtgtttgagaggtctgttaaattatcaagtagtgatgttgaggtgtaattggaaaagtcaacctggaatttatggcag

SEQ ID NO: 25989 - DNA, 201 bp, Homo sapiens
aattggaaaagtcaacctggaatttatggcagaagttgaggctgcagatataaacttgtaattttaaaaatgtatatttaaagccatgggagtgaatgagwtcatttgagattgaatgcagattgagaagagatttagaattgaactccagggcactgcatagcaggaggaaaacctagtaaaagtggtatctgtaaaata

SEQ ID NO: 25990 - DNA, 201 bp, Homo sapiens
tctttattttctaaattgtttacctggaacatatattactttcataatcagagaaaaataagcatcattttaaaacaataattaaaatataactgtaatgwcagttaaacgcagtatgttatactggactggaccctgatgtggggctggaaaattgttataaacaaattacacacatgaggccaggggttcgagacctgc

SEQ ID NO: 25991 - DNA, 201 bp, Homo sapiens
gctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcctca

SEQ ID NO: 25992 - DNA, 201 bp, Homo sapiens
tgctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcctc

SEQ ID NO: 25993 - DNA, 201 bp, Homo sapiens
atgctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcct

SEQ ID NO: 25994 - DNA, 201 bp, Homo sapiens
tatgctgagaatagttttatttcaaaattccaggagacttagaaacaacatggtaatgatgaaaggagcctgaagagactctttttttttttttttttttttttgagatggagtcttgctctgttgcccaggctggggtacagtgtcacgatctcggcatactgcaacctctgcctcccgggttcaagcaattctcctgcc

SEQ ID NO: 25995 - DNA, 201 bp, Homo sapiens
ctggagtaaagatgattaaagcagagctgcagctgccctctgaaggcctttgtttttgtaaaccactgagatttttgaattgtttgttatctcaccataasctagcccaccctaacacagatgaacataaaatacagaacatttctattgggcggcttgaaatacaggcttggggcatcagtggtaggtcagcatggaaaa

SEQ ID NO: 25996 - DNA, 201 bp, Homo sapiens
ccttagcttagttcagttgtcccccacaggttgaagcagtgttcaagggcaaacaaaaactttctctctcagccacctccataagttccatagtttatttaacaaagcaaactcacaaagaaggaggaagttaggactgctccatttccccttatagcaaaggcatgtgtatttcacaactgcaatcagcttgaatagcag

SEQ ID NO: 25997 - DNA, 201 bp, Homo sapiens
agtggtaggtcagcatggaaaatgttgattaaaaagtcatctgtgaggtggagattgggactgaagaatggataaattttctgaatggaaagtataagggraagagaagaggaatgggcctagaggaagagtcactgtcaatccatacaaaaagaagagatacgaaaagataggaggggggatttggccaacacatggcag

SEQ ID NO: 25998 - DNA, 201 bp, Homo sapiens
tccttagcttagttcagttgtcccccacaggttgaagcagtgttcaagggcaaacaaaaactttctctctcagccacctccataagttccatagtttatttaacaaagcaaactcacaaagaaggaggaagttaggactgctccatttccccttatagcaaaggcatgtgtatttcacaactgcaatcagcttgaatagca

SEQ ID NO: 25999 - DNA, 201 bp, Homo sapiens
gtccttagcttagttcagttgtcccccacaggttgaagcagtgttcaagggcaaacaaaaactttctctctcagccacctccataagttccatagtttatttaacaaagcaaactcacaaagaaggaggaagttaggactgctccatttccccttatagcaaaggcatgtgtatttcacaactgcaatcagcttgaatagc

SEQ ID NO: 26000 - DNA, 201 bp, Homo sapiens
tcggcctccttagtagctgggactataggcatgcaccaccacgcccagctaatttttttttttttttcattagaaacagtgtcttgctatgctgctcaggstggtctcaaactcctggcctcatgtgatcctcccactttggactcccaaagtcctgggattataggtgtgagccaccatgcccggcccctttttactttt

SEQ ID NO: 26001 - DNA, 201 bp, Homo sapiens
tcttgaactcataggctcaagcagtcgtctcacctcggcctccttagtagctgggactataggcatgcaccaccacgcccagctaatttttttttttttttcattagaaacagtgtcttgctatgctgctcaggctggtctcaaactcctggcctcatgtgatcctcccactttggactcccaaagtcctgggattatagg

SEQ ID NO: 26002 - DNA, 201 bp, Homo sapiens
ggtccttagcttagttcagttgtcccccacaggttgaagcagtgttcaagggcaaacaaaaactttctctctcagccacctccataagttccatagtttatttaacaaagcaaactcacaaagaaggaggaagttaggactgctccatttccccttatagcaaaggcatgtgtatttcacaactgcaatcagcttgaatag

SEQ ID NO: 26003 - DNA, 201 bp, Homo sapiens
tggcaagctggccatcagctgtttcttgtccagctgtagtcttggaccaccttcccagactcactttccattcccatgtggccatggatgttcatcatgttctcagagagcacattgttctgataggatgggaggaataactgactgtgaaacctcattcttttaaatgccaccaaatcagaatgttcagtagacgcaacc

SEQ ID NO: 26004 - DNA, 201 bp, Homo sapiens
ggttcaagcgattctcctgcctcagcctcccaagtaactgggattacaggtgcccaccaccatgcctggctaattttttttttttttttgtatttttagtrggcaaggggtttcaccatgttggtcaggttggtctcgaactcctgacctcaagcgacgcccccgcctcggcatcccaaagtgctgggattacaggcgtga

SEQ ID NO: 26005 - DNA, 201 bp, Homo sapiens
ttccttgggtagaaatggaaaaaggaggtcacagcaggagtccaaacctcatcctttcttcaaattaagttgttggagttttccattgtgtgggggagttkttttttgttttttgttttttgttttttgtttttcctgacaaagcctttagttcatgaacagttttatgtaagggaagtgcatctaataacataagcttgg

SEQ ID NO: 26006 - DNA, 201 bp, Homo sapiens
agtaattataaacacacaccacctccacaccttctaggagtggatctttgttctgaggcaaaatataaatcaaattattcatatatatatatatatatataaaatgcagtgtgctccaaggaactcaaaatgccagaatttatactttttaaaccatctcctactaaatgagatggtggttagctattactatttcccata

SEQ ID NO: 26007 - DNA, 201 bp, Homo sapiens
tagtaattataaacacacaccacctccacaccttctaggagtggatctttgttctgaggcaaaatataaatcaaattattcatatatatatatatatatataaaatgcagtgtgctccaaggaactcaaaatgccagaatttatactttttaaaccatctcctactaaatgagatggtggttagctattactatttcccat

SEQ ID NO: 26008 - DNA, 201 bp, Homo sapiens
tttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagct

SEQ ID NO: 26009 - DNA, 201 bp, Homo sapiens
gtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagagc

SEQ ID NO: 26010 - DNA, 201 bp, Homo sapiens
ctttacaggtaatggcccttctgttttctttcttggattgttgggggcccctgccaaatgccccatccgaatgagatctctgtcattcgttccagtgctgmtatgttcatatgagcaattcttcacaaaaatggtctccaaacctctttaacactggccccaatcagttaaaaaaacaaaaaaagtcacatagccccatat

SEQ ID NO: 26011 - DNA, 201 bp, Homo sapiens
ttcaactagtaagtatgagttccaggtttacttagcgattggtcaagtgcaaaagtgcccagggtatgtgtttgcctcctgttccttagatcttcctaccrtcacctcacattctccagtcaccagatcctaactctgtgactgtgtctggacatcagacaatatccctctctctctctgccaaccggtacttagggtaca

SEQ ID NO: 26012 - DNA, 201 bp, Homo sapiens
taccagctgttatctctttaaatattgtctccctctcattttccattcccttggagattctattagatgtgggttggatcttccttatatctctatgtttyttaaccaattttttcatatttttttattttttaaatctcattggtgatttccttggatctgtcatacatttacttctccaattatgtctagtctattatt

SEQ ID NO: 26013 - DNA, 201 bp, Homo sapiens
gttcattagaggatttatatctctcttcaactctagaaaattaccagctgttatctctttaaatattgtctccctctcattttccattcccttggagattytattagatgtgggttggatcttccttatatctctatgtttcttaaccaattttttcatatttttttattttttaaatctcattggtgatttccttggatc

SEQ ID NO: 26014 - DNA, 201 bp, Homo sapiens
aagccagataaccatgatgagttctaaagattttctctgtctttaatgttcttcagttttgtcatgagaagactggatatagctctgttgttgttcattaraggatttatatctctcttcaactctagaaaattaccagctgttatctctttaaatattgtctccctctcattttccattcccttggagattctattagat

SEQ ID NO: 26015 - DNA, 201 bp, Homo sapiens
tattacacttactccttcagcaaaatttctctgtggtgtttttactcctttttaacatgtttaaaccatgaatgcaacaggtctaacttatatttcacttygctgctcatttacagatctcagaaaattttcactgtgacctgaactctgaccagttcaaaggatttctgcgagctcacacgccttcagtggccgcatcaa

SEQ ID NO: 26016 - DNA, 201 bp, Homo sapiens
catctgtgattattacacttactccttcagcaaaatttctctgtggtgtttttactcctttttaacatgtttaaaccatgaatgcaacaggtctaacttayatttcactttgctgctcatttacagatctcagaaaattttcactgtgacctgaactctgaccagttcaaaggatttctgcgagctcacacgccttcagtg

SEQ ID NO: 26017 - DNA, 201 bp, Homo sapiens
agtctcgccctgttgcccaggctggagtggtgcagtggcacaatcttggctcactgcaacctctgcctcccaggttcaagcgattctcctgcctcagcctsccaagtaactgggattacaggtgcccaccaccatgcctggctaattttttttttttttttgtatttttagtgggcaaggggtttcaccatgttggtcagg

SEQ ID NO: 26018 - DNA, 201 bp, Homo sapiens
ttagtgcctagtaaatgctggccactgttattgctgttatcattattcttttttgtttgtttgtttgagagagagtctcgctctgtcacccaggctgaagygcagtgacgtgatctcggctcactgcaagctccgcctcccgggttcacgcccttctccggcctcagcctcccgagtagctgggaatacaggcacccacca

SEQ ID NO: 26019 - DNA, 201 bp, Homo sapiens
atgccaagtacacttagtgcctagtaaatgctggccactgttattgctgttatcattattcttttttgtttgtttgtttgagagagagtctcgctctgtcrcccaggctgaagcgcagtgacgtgatctcggctcactgcaagctccgcctcccgggttcacgcccttctccggcctcagcctcccgagtagctgggaata

SEQ ID NO: 26020 - DNA, 201 bp, Homo sapiens
catttgtcagatttatccaggagccactttcctaaaccacatctgtgattattacacttactccttcagcaaaatttctctgtggtgtttttactcctttktaacatgtttaaaccatgaatgcaacaggtctaacttatatttcactttgctgctcatttacagatctcagaaaattttcactgtgacctgaactctgac

SEQ ID NO: 26021 - DNA, 201 bp, Homo sapiens
ttatatcacagtctgatgcagatcgagtggttctcctccaagcagtgactcagggacccaggctgcttccatcttacagctctaccatcttgtgactttcrgattatgttggcatcattcagccagtgactaggaagaagagagaatgaaagattgtgcacccaattcttaaatacctccactcaacactgggacacatag

SEQ ID NO: 26022 - DNA, 201 bp, Homo sapiens
agttttttttaaaataatgccaagtacacttagtgcctagtaaatgctggccactgttattgctgttatcattattcttttttgtttgtttgtttgagagrgagtctcgctctgtcacccaggctgaagcgcagtgacgtgatctcggctcactgcaagctccgcctcccgggttcacgcccttctccggcctcagcctcc

SEQ ID NO: 26023 - DNA, 201 bp, Homo sapiens
agtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacagag

SEQ ID NO: 26024 - DNA, 201 bp, Homo sapiens
gaattcatattttatttgagaaaaaaacaagatgttcctggtctggcagatgacattctaaattattcactcccacttgtggaatagctgagttatagtcyggcccctcctctgtagaggaggatttataggagaagatgagtcacgttactttttgtgactatttttctttgcatttgttgactcctcttgttttattca

SEQ ID NO: 26025 - DNA, 201 bp, Homo sapiens
tagtttttgaatgacagcatctttgttcatgcagttggctttgctgcatttccacttcatcaattttttggctctgtctttgcaaaaaaaaaaaaaaaaaaaaattacagagggagaattttaaaacacaaatgaagaaaaagaaattactttgaaattgccaaaattgtttggctgaaagagcttatttagaaaaacaga

SEQ ID NO: 26026 - DNA, 201 bp, Homo sapiens
cacatgtttaaaaaatattgtttctttttcctcttatcttttagaaaagggaaaatgattattgtttctttttcctcttatcttttagaaaagggaaaatratttgtataaatcattaaatactcccttgatattacaaaactagcaaattgttttttgattttattttttaaattgtcacataataattgtacatattca

SEQ ID NO: 26027 - DNA, 201 bp, Homo sapiens
attgaaaaactaaaactccaagctgaatccttctgccagcgtttggggaaataccggatgccctttgcctgggcacccataagcttatcaagcttcttcartgtctccacccttgagagggaggtaactgatgtggactctgtggttggtaagattttcacctgcagtgggaaagggagggctccccagtgtgcgctgccc

SEQ ID NO: 26028 - DNA, 201 bp, Homo sapiens
catagctcactgcagccttgaactcctggactcaagtgatcttccagcctcagccttctgagtagctgggattacaggcatacaccaccatgcctggctartaaaaaaaaaattctgttgtacagatggggtctcactatgttccccaggctaggctagtctcgaactcctggcctcaaacagtcctcctgccttgacctc

SEQ ID NO: 26029 - DNA, 201 bp, Homo sapiens
aaatgctgctgcctgattgttcctctggaagttttgtgtcagaggagtacctggctgtgtgaggtgtcagtctgcccctactggggggtgcctcccagttrggctactcgggggtcagggacccacttgaggaggcagtctgcccgttctcagatctgaagctgtgtgctgggagaaccactcctctcttcaaagctgtca

SEQ ID NO: 26030 - DNA, 201 bp, Homo sapiens
ttgtattgggcatgttcaatatcctccctttaagtatttgaaacgacacaatacattattgttaactacctcatcccacagtagtatagagcactagaacrtattcctcctatgtagctgtaatttcgtatcccttaacaaatctctcccatctttcccttccccctacccttcctggcctccagtaaactctgttctact

SEQ ID NO: 26031 - DNA, 201 bp, Homo sapiens
gtatctatcccacattttctttatccattcatttattgtcagacacgtaagttgattccatatcttggctattgtgaaaatgctgcaggaaacatgggggygcagatgtctcttcaatataataatcttttcctttggataaattcccaggagtgggattgctagatcatatggtagttctaattagcaaattctatattc

SEQ ID NO: 26032 - DNA, 201 bp, Homo sapiens
cttttatctaacctaaaacattggaaacaggaataaacacaaataatggcatgaggccgtggccacagaatgacaagacaggacacagcaaatgttttggktttttttcacatttatgaaccttctcattctatttatttatttatttacttacttatttcttgagacagggtctcattctgtcacccaggctggagtgca

SEQ ID NO: 26033 - DNA, 201 bp, Homo sapiens
gctggaacatggtttcatcctggccttccacggaatctgttgagcttgttttttttttttttccatatgccataatatgtttagtttcacctcagatgagwcagaggatttactttcaagaaagttggacgctgtccactctaaacagtaccagaggtagccttacagcatcagaaaatcctgtggtagtatctcttcatc

SEQ ID NO: 26034 - DNA, 201 bp, Homo sapiens
cagtggctgcgagttaggaaagatacatttatccagtggaccttttgactgtcttgtcaatcttaagaaaaaaatgtagagtaaaaaattttggctgggcktggtggctcacgcctgtaatcccagcactttgggagaccgaggcgggcggatcacgaggtcaggagattgagaccatcctggctaacacagtgaaacccc

SEQ ID NO: 26035 - DNA, 201 bp, Homo sapiens
atattgagtatttaaagcattctgaatgacctgagtgttttccttctcatgcttattaaaaacatttaccacttacagctgaattggaatatagttctacrtaaattgttatttacacctgatacacagaaagaaatgtgtttccttatttatcatactattaatttgaatgtgctattctttttttaattgctttaaagt

SEQ ID NO: 26036 - DNA, 201 bp, Homo sapiens
ggtggatcacctgaggccaggagttcaagactagtctggacaacttggcaaaaccctgtctttactaaaaatactaaacttagccagccgtggtgacgggygcctgtagtcccagctactcgggaggctgaggcaggagaatcacttgaacccgagaggtggaggttgcagtgggccgagatcacagcattccactccagc

SEQ ID NO: 26037 - DNA, 201 bp, Homo sapiens
tgactgcacacttatggaaagagggctgcctccaccacagacaggtagtgggaggtcccactcttccaggttgaacccaatatcctatcttctccttccgstcttggtacctgttgttgctattgtaaacacttccctcacctgggactgcatatagatgaaagattgctggggggtttcccaggatcttgggccagtgcc

SEQ ID NO: 26038 - DNA, 201 bp, Homo sapiens
gtgtgtgtgctgccccgtgtctctaccttattcaagtttctttaaggaacagctgtagatgagttctggtagaactgggtagtgctcccagaagtatcccygtgggtccgtgagggttgggcattcataaaataaatccttgctctaacgatagagaccaacttctagagccagaagtgctcatcccaggaatgaccaggg

SEQ ID NO: 26039 - DNA, 201 bp, Homo sapiens
ccaacaaatggcaaactttcaagtctagagatggtcctatggcatgactgggggacaccacttccttcaccagaacattcacatccttcccaaggtgccaygcccagttcttttgtccaacaataaactctgcgaagtggagtgaagtcaccacccaagccttagcctacctctgaccacagcctgtgactccacaaagat

SEQ ID NO: 26040 - DNA, 201 bp, Homo sapiens
tccacaagttttaccaatgggaactttttaatggcttgcatttttggaaatatcagtattgattcatgtaaaggtttgtgggtttttttggggtttttttygtttttttgttttttttgagatggagtctcactctgtcacccaggctggagtgcagtgacatgatctcggttcactgcaacctccgcctcacaggttcaa

SEQ ID NO: 26041 - DNA, 201 bp, Homo sapiens
caaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcatttttg

SEQ ID NO: 26042 - DNA, 201 bp, Homo sapiens
ccaaaaaggttgaggattgctgctctaggtgttatattacactttgtttttgtcactcaaaagattgatttgtttttcttttttctttttttttttttttttgtttgagtattactatggagtcgtgagtcatttttctttctacttacccagatttccacaagttttaccaatgggaactttttaatggcttgcattttt

SEQ ID NO: 26043 - DNA, 201 bp, Homo sapiens
acctgaactctgaccagttcaaaggatttctgcgagctcacacgccttcagtggccgcatcaagtcaggcgagatctgcagtcttctcagtcacctacccrtcctcagacatctacctggtagtcaaggtaattcagtacgatctgatttgcccaatctgatgttttcattgctgtgttgttcccagcacatgtttggggt

SEQ ID NO: 26044 - DNA, 201 bp, Homo sapiens
cctagacattgtgacaaaacatttgtcagatttatccaggagccactttcctaaaccacatctgtgattattacacttactccttcagcaaaatttctctstggtgtttttactcctttttaacatgtttaaaccatgaatgcaacaggtctaacttatatttcactttgctgctcatttacagatctcagaaaattttca

SEQ ID NO: 26045 - DNA, 201 bp, Homo sapiens
gtttttggtgtggatgtcctttctgtttgttagttttccttctaacagacaggaccctcagctgcaggtctgttggagtttgctagaggtccactccagaygctgtttgcctgggtatcagcagcggtggctgcagagcagtggatattggtgaaccgcaaatgctgctgcctgattgttcctctggaagttttgtgtcag

SEQ ID NO: 26046 - DNA, 201 bp, Homo sapiens
tttcaaagcttttaacttctttgccattggtttgaatttcctcctgtagctcagagtagtttgatcgtctgaagccttcttctctcaactcatcaaagtcmttctccatccagctttgttccattgctggtgaggagctgcgttcctttgcaggaggagaggcactctcatttttagagtttccagtttttctgctctgtt

SEQ ID NO: 26047 - DNA, 201 bp, Homo sapiens
tctgttgatttggggtggagagttctgtagatgtctgttaggtctgcttggtgcagagctgaggtcaattcctcggtatccttgttgactttctgtctcaytgatctgtctaatgttgacagtggggtgttaaagtctcccattattattgtgtgggagtctaagtctctttgtaggtcactaaggacttgctttatgaat

SEQ ID NO: 26048 - DNA, 201 bp, Homo sapiens
acccaggggaatctctcctttgattaacttaaagtcacctgtttagggactttaattacattggcaatagtcccttcacagaagcacctaaatgactgatkatgtaactgaaaaaatgtgtgtgtatgctacaaaatggctgcagtctcccttctgtcctccagctcttgcaggagaactctcttgtagctcaccctgtct

SEQ ID NO: 26049 - DNA, 201 bp, Homo sapiens
ctttcctgctttctcttgtgggcatttagtgctataaatttccctctacacactgctttgaatgtgtcccagagattctggtatgttgtgtctttgttctkgctggtttcaaagaacatctttatttctgccttcatttcattatttacccagtagtcattcaggagcaggttgttcagtttccatgtagttgagcggttt

SEQ ID NO: 26050 - DNA, 201 bp, Homo sapiens
agtttcagtgtagaaagagtaggggagacgaactattcaatgtcagcttgggtgtagtgccagaaccgtactcagtaatgctgtcattgctgttggtgctyaccagctcttcagtactggaatagcttcagacctcgagagtttatgactttatcatcaactgggtgtgttgcccttggcacattgccacacagtgcttaa

SEQ ID NO: 26051 - DNA, 201 bp, Homo sapiens
gtgtatgttgaaccagccttgcatcccagggatgaagcccacttgatcatggtggataagctttttgatgtgctgctggattcggtttgccagtattttaytgagtatttttacatcaatgttcatcaaggatattggtctaaaattctcttttttggttgtgtctctgccaggctttggtatcaggatgatgctggcctc

SEQ ID NO: 26052 - DNA, 201 bp, Homo sapiens
agtctagagatggtcctatggcatgactgggggacaccacttccttcaccagaacattcacatccttcccaaggtgccacgcccagttcttttgtccaacrataaactctgcgaagtggagtgaagtcaccacccaagccttagcctacctctgaccacagcctgtgactccacaaagataaatgaaaagaggaaagtcag

SEQ ID NO: 26053 - DNA, 201 bp, Homo sapiens
tgatatatgttctttatcaaattccccccaccaaataatggcattatttacgtgtgagaaagttgcacatttcaccacctcatggtttattagagtgcaaytccgtgagaacaactgcctgtgatcctctgtatccccagtggccaactcaggagctcagtatgccctacccagtagatgctcagaacatcattgctgagt

SEQ ID NO: 26054 - DNA, 201 bp, Homo sapiens
gttttctagagacagggtcttcctgtcactcaggctggagtgcagtgatgtgatcacagctcactgcagcctcgaactcctgggctcagtgtttctcccayctcagcctttggagtagccagcagtataggtggtgtaccaccacacccatctaactttaaaaaaaaaaaaattgtaaagacagagtctcacttttttgcc

SEQ ID NO: 26055 - DNA, 201 bp, Homo sapiens
tttggttccatatgaactttaaagtagttttttccaattctgtgaagaacgtcattggtagcttgatgcggatggcttgaatctctaaattaccttgggcrgtatggccattttcacgatattgattcttcctacccatgagcatggaatgttcttccatttgtttgtatcctcttttatttcattgagcagtggtttgta

SEQ ID NO: 26056 - DNA, 201 bp, Homo sapiens
ggctcaacagctttgacattgtcccttcaaggaatgaaacaattaaagaaactgatctcctctgagaaaaagaccatttacaataacctatctactctacrtaaaatattcccagtagactcatcaaaacaagaccctctgataccacaccatactgggtttttccttattgggattcccccatgttttttctttaatgct

SEQ ID NO: 26057 - DNA, 201 bp, Homo sapiens
ttcatccatgtccctacaaaggacacaaactcatcatctttatggctgcatagtattccacggtgtatatgtgccacattttcttaatccagtctatcgtkgggcatttgggttggttccaagtctttgctattgtgaatagtgctgctataaacatacgtgtgcatgtgtctttatagcagcatgatttatagtcctttg

SEQ ID NO: 26058 - DNA, 201 bp, Homo sapiens
gggtttttccttattgggattcccccatgttttttctttaatgcttccccatgttttagaaacagatttgcttacccggaaccttccacactcaattccawatttatcatagtactatcatttgggagtaaacaacatgtaaggggcctacacgggtggaaagcccattcaagaaactgaggatgatcaaatagtagagtt

SEQ ID NO: 26059 - DNA, 201 bp, Homo sapiens
ggtctcatactcctggctcaagcaatcctcctgcgttggcctcccgaagtgctgggactgcaggtgtgagccaccttgcctatccaacatgacaagtattrttctctggcaggaagtgaaattttttctcactgatgattgcacacaaatgtcatatctccatgaggcttctactcactagttttacggctcatgtcacct

SEQ ID NO: 26060 - DNA, 201 bp, Homo sapiens
tagtaatgctcaataattattacttaaatgggtataaactttatagtaatgaggttggggctggaaaaaatgcagtttcataatttcctatagaagtcatwcaatcctgactctaaactctgtattccatgtggtggttgggtggcgtgggagagtcctctttatcctgtggggttggtcctatggaggtgtctgtggcag

SEQ ID NO: 26061 - DNA, 201 bp, Homo sapiens
tataaagaaaaaaaggtttaatggacttacagttccacatggctggggaggcctcacaatcatggcagaaggtgaatgaggagcaaaggcatatcttaaayggcggcaggcaagagagcgtgtgcaggggaattgccctttataaaaccatcagatctcgtgagacttattcactatcatgagaatagcatgaggaaaaac

SEQ ID NO: 26062 - DNA, 201 bp, Homo sapiens
ccccatcccacattctagaaaaatatttggtgcattaacagattttggacttcacagggcttcacttttattgtgcttaatatttgttccttggtgaaacrcaaagagacaaactacacaaaaagagaatcatacttgatgaaaaaaatcaatgtttagaagttgctcttaaatcttttacccattgctaacatgggtatt

SEQ ID NO: 26063 - DNA, 201 bp, Homo sapiens
gtaatgaggttggggctggaaaaaatgcagtttcataatttcctatagaagtcattcaatcctgactctaaactctgtattccatgtggtggttgggtggsgtgggagagtcctctttatcctgtggggttggtcctatggaggtgtctgtggcagattggcagatgcatttgtcttgtgcatagatggtgtctgttgttt

SEQ ID NO: 26064 - DNA, 201 bp, Homo sapiens
tacccattgctaacatgggtatttggatgccatttggaacgtattccaggactacttatccatgaaaggattaatgatattggagccaggttcaaagtctyagcaacaagctaaaacctgctctttttagtagtcaggggcaaagcttagtatcctttcttctgaaagctttcgcatgctaagctttccattgccaagccc

SEQ ID NO: 26065 - DNA, 201 bp, Homo sapiens
gcaacaagctaaaacctgctctttttagtagtcaggggcaaagcttagtatcctttcttctgaaagctttcgcatgctaagctttccattgccaagccccygggaaggaaaataccagaagtttcactccgatagcagctttttctgagatgcgcctggtgataacattttccagtagggctatcttctgtctccttcctt

SEQ ID NO: 26066 - DNA, 201 bp, Homo sapiens
agaccagcgtacgcacaaagcacacgctttcctgcagcatactagcagagaactcaagtcactgtgttgtgtgtggttttttttgtttttttttttttttktttttttttttttgagatggagttttgctcttattgccaggctggagtgcaatggcatgatctcggctcactacaacctccgcctcccaagttcaagcga

SEQ ID NO: 26067 - DNA, 201 bp, Homo sapiens
aggagttcaagagcagcctggccaacatggtgaaaccccatctctactaaaaatacaaaaaattagccgggcctggtgatgcatgcctgtagccccagctrcttggtaggctgaggcaggagaattgcttgaacccgggaggtcgcagtgagccgagatcacaccactgcactccagcctgggcaacagagcaagactcca

SEQ ID NO: 26068 - DNA, 201 bp, Homo sapiens
ttagtagagacggggtttcaccgtgttagtcaggatggtcctgatctcctgaccttgtgatccgcctgcctcggcctcccaaagtgctgggattacaggcrtgagccaccacgcctggccagttgtcattattcttataaagtaattacagtttaaaattcaagttaaagtgtacatcttgtgaaatgaacttttaacact

SEQ ID NO: 26069 - DNA, 201 bp, Homo sapiens
ggccaacccagcactcttaattgtacaaaatgcagctctatgagaccagaacatcctgttggcctgatgatagtcaatttgatgtacccaaatgttactgrtaatttgatcctttctctactggtgaacaggtcatctttggaaagtccagcgggcctgaatttctgcaggaagtgtacacagctgttacataccataata

SEQ ID NO: 26070 - DNA, 201 bp, Homo sapiens
aaaactacagagtcaggtctagatgactccgccatccctagtctctgctgccctctgatccaacccttcccatggcttccccttgcatttcaatgtaatcstaactcttcacctgggactacaaagctaagattattttgaggcttacactttttgcaggtggaggaacttctctgtaatctgaatagcatcttatatgac

SEQ ID NO: 26071 - DNA, 201 bp, Homo sapiens
agggtcacttgagaccaggagtttgaggctgcagtgagctatgattgcgccactactctccagcctgggccacagagtgaaaccctgtctcaaaaaaaaamcacaaaaaaccaaaagagataggttctgacttttcacaatagtgtatagagtttgatggagcagtcttatacatacttttttctgcgctagtgcaaacac

SEQ ID NO: 26072 - DNA, 201 bp, Homo sapiens
gaggccaaggtgagtggatcacttgaagtcagaagtttgagaccagcctggccaacatggtgaaaccccatctctactaaaagtacaaaaaaaaaaaaaaattagccaggtgtggtggcaggtgcctgtagtcccagctactcaggaggttgaggcaggagaatcgcttgaacctgggaggcggaagttgcagtgagccga

SEQ ID NO: 26073 - DNA, 201 bp, Homo sapiens
taacatgaggctgtgtgcggtggctcttgcctgtaatcccagcactttgggaggccgaggcagggggattgcctaaggttgggagtttgagaccagcctgrccaacatagagaaaccgcatctctactaaaaatacaaaattatctgggtgtggtggtgcatgcctgtaatcccagctacttgggaggctgaggcaggaga

SEQ ID NO: 26074 - DNA, 201 bp, Homo sapiens
gctgtgcttctactacagctttctgcattgtaagttgagtaacatgaggctgtgtgcggtggctcttgcctgtaatcccagcactttgggaggccgaggcrgggggattgcctaaggttgggagtttgagaccagcctggccaacatagagaaaccgcatctctactaaaaatacaaaattatctgggtgtggtggtgcat

SEQ ID NO: 26075 - DNA, 201 bp, Homo sapiens
caccaccacgcccagctaatttctttttgtatttttagtagagacggggtttcaccgtgttagtcaggatggtcctgatctcctgaccttgtgatccgccygcctcggcctcccaaagtgctgggattacaggcgtgagccaccacgcctggccagttgtcattattcttataaagtaattacagtttaaaattcaagtta

SEQ ID NO: 26076 - DNA, 201 bp, Homo sapiens
cattgttctgagctttttctctccatgccatggacctggacagcactctctcatgagaaacatctatgcacattgaaattctcagcctgcatgggtgtacmtgttggggagtgagatgtggactctctacagattagggcacaccccactagagacacgtcacagaacctttgacaagacattagtagtttaaaattctga

SEQ ID NO: 26077 - DNA, 201 bp, Homo sapiens
ttgagtgctgtgcttctactacagctttctgcattgtaagttgagtaacatgaggctgtgtgcggtggctcttgcctgtaatcccagcactttgggaggcygaggcagggggattgcctaaggttgggagtttgagaccagcctggccaacatagagaaaccgcatctctactaaaaatacaaaattatctgggtgtggtg

SEQ ID NO: 26078 - DNA, 201 bp, Homo sapiens
gagtgcagtggcacgatcttggctcactgcaagctccgcctcccgggttcacgccattctgctgcctcagcctcccaagtagctgggactacaggcgcccrccaccacgcccagctaatttctttttgtatttttagtagagacggggtttcaccgtgttagtcaggatggtcctgatctcctgaccttgtgatccgcctg

SEQ ID NO: 26079 - DNA, 201 bp, Homo sapiens
ctaaaattcctagcacacactcctcccagggatcattctgtctctatatgcacctgtcgtattttatctgtggggagaatccagtacactattgccagatktccttcatctcccaacctcacacagtacatttttagcttattgttttctgtgagttgtatctgtattgttttagaatgatggtagaaggagaaggacaag

SEQ ID NO: 26080 - DNA, 201 bp, Homo sapiens
cttaagcagtcccttaacttctttgagtgtttgttgccttgcctacttcattggaagtaaggctctggaacagggaaggtttgcctccataagactaaaakttatgctaatataagagactagcaaaatgggagacatattcagctctcttcttgtggggaataccttgcccttgaccaaaagccttgtcccagaaagagc

SEQ ID NO: 26081 - DNA, 201 bp, Homo sapiens
acattttgggggaacacaattcaacctataaaattcagaaaagactctaccccaaaccagcagaacttagcaaatagattgattgacccttaaaagaattscatttactggaaattcaccctcagttggagaaggcacaggtgatatcaaaagcctgtgttatgatgggggagaaaatcttgagtgctgtgcttctactac

SEQ ID NO: 26082 - DNA, 201 bp, Homo sapiens
gctggagtgcagtggcacgatcttggctcactgcaagctccgcctcccgggttcacgccattctgctgcctcagcctcccaagtagctgggactacaggckcccaccaccacgcccagctaatttctttttgtatttttagtagagacggggtttcaccgtgttagtcaggatggtcctgatctcctgaccttgtgatccg

SEQ ID NO: 26083 - DNA, 201 bp, Homo sapiens
tacattaaggagccagcgtctgcacccagttccttctgactctagagcctggattctgctggctgcaccacactgtctttaaagagaacactctcaaaacrtgcttggtctttggattgtctcaaatgtgttagaatagtgttttaagaaaaggaatgcagatctcctgggaagcaataggtcgagttcatttcatgagaa

SEQ ID NO: 26084 - DNA, 201 bp, Homo sapiens
gcaaaatgggagacatattcagctctcttcttgtggggaataccttgcccttgaccaaaagccttgtcccagaaagagccgtgtgggtgttggctttgtgyccaacatgtggctcctctgccatgattgatggcttcatttaagaaacaggttttaggattttttcccctaaaatcttattcctgttaattatcatggatc

SEQ ID NO: 26085 - DNA, 201 bp, Homo sapiens
agatttcctcttctcgtaaggacaccagtcatattggactagggcttaccctgctggcctcattttaacttgattgcctctgtaaagaccctatctccaamgaaggtcacattctgaggtactgaaggttaggacttcgacatatacattttgggggaacacaattcaacctataaaattcagaaaagactctaccccaaa

SEQ ID NO: 26086 - DNA, 201 bp, Homo sapiens
agcttttaaaatgcaaagtattctaaaactgttgaaagttgaagctaactgttgttcccttgttgaaggtaaaaagtaaagcatttttaggaaagcacttytccttatgtgtctaatatttgggaactgcataggagaacagtttaataggaaccctgatattgacagtaagatatattcttaatgtagtaaccagaccca

SEQ ID NO: 26087 - DNA, 201 bp, Homo sapiens
aggcctctctccctgacctgtggacagccctcttctccctgtgtctcttcacatcatcttccctctgtgttcgtgtccagatttcctcttctcgtaaggayaccagtcatattggactagggcttaccctgctggcctcattttaacttgattgcctctgtaaagaccctatctccaaagaaggtcacattctgaggtact

SEQ ID NO: 26088 - DNA, 201 bp, Homo sapiens
gtctcgctctgtcgcccaggctggagtgcagtggcacgatcttggctcactgcaagctccgcctcccgggttcacgccattctgctgcctcagcctcccargtagctgggactacaggcgcccaccaccacgcccagctaatttctttttgtatttttagtagagacggggtttcaccgtgttagtcaggatggtcctgat

SEQ ID NO: 26089 - DNA, 201 bp, Homo sapiens
cttcatgtactaggaaagtttacccagtcagcacacacagatatgttgttgcctacatttatatttgtgagagtgactgttaagaaactagcaggtttatraaatccgtgtgagaatttctctcaaataactgttaatggacaatccagcaatcctcccatctcaggctcccaagtagctgagactacaggcaggtggcac

SEQ ID NO: 26090 - DNA, 201 bp, Homo sapiens
ctcagtcgggttttccattggctcgaagttcacaaggcagttgttgcttgtctcagagtgtccttaggtggactacatctgaacccttggcgttattatartgcagattctagctgtgctcaaaccaatgaatcagaatctcaggagggtggcgctcagaaatctgcatggttgatcagttctttagcagattcttatttt

SEQ ID NO: 26091 - DNA, 201 bp, Homo sapiens
aactgttggcctcaaacgatcctcctacctcagcctcccaaggtgctgggattacaagtgtgagccactgcaccagcctgaagttttcttggccttccttmgttccccaacaacctcaacaacagttctcagctgtttgctagggctgtagaacaaagttccatagactgggtggcttaaacaactgaaatttactgtctg

SEQ ID NO: 26092 - DNA, 201 bp, Homo sapiens
tcaacctagatgcccatcgacagtggactagataaagaaaatttggtacatatacaccatgaaataccacacagccataacaaagaacaaaatcatggggktttttttgcagcaacatggatgcagctggaggccattatcctaaacgaattaacacaggaacagaaaaccaaataccacatgttcttatttataagcagg

SEQ ID NO: 26093 - DNA, 201 bp, Homo sapiens
aaagaaaaaaagagaacagtctcaatatataaaaggaaaggttttcatatatgtgcccaattataagtatcttgagtattctaggagtctaaacagaatgyctttagatcatccttataacgatcctgagactcttttgactgttttgagttgaagacaggtaataagaaagaaatcaccaattaatgcagaaggaaataa

SEQ ID NO: 26094 - DNA, 201 bp, Homo sapiens
aaaaaaaaggcaaaaattaacatgttggaaattagttcagtcactatggaatgcagtgtgaagatttctgaaagaacttaaaacagaactaccattcaacycagcaatcccactactgggtctatacccaaaggaaaataaattgttctacaaaaacgacacatgcactcgtatgttcctcacagcacaattcacaatagc

SEQ ID NO: 26095 - DNA, 201 bp, Homo sapiens
tgcacatgtgtctggttgatttttcatttcatgtcttctgtcttctgttttgttttgtttgtttgtttgttttgagacagagtctcactctgttgcacagsctggagtgcagtggcgcaatctcagttcactgcaacctccgcctcccgggttcttcatgcctcagcctcctgattagctgggattacaggcgtgcaccac

SEQ ID NO: 26096 - DNA, 201 bp, Homo sapiens
atcacactaacatgaccaactctttagtaagggaagagtaagggaacttattttatatctagatagaaattttattaaggatacagtattaggattcatasgggaaatagtggatagatcacaagaacgaggctctttctgagccctgcaggaaagaatatttgcagaacaataaaggacatggtggcttcctggagaatg

SEQ ID NO: 26097 - DNA, 201 bp, Homo sapiens
cttcagtgcacatcagaatagaagcttcatgagggcagaggcttttgtctgctttcctcattgcagtatccccagaactttgagcaagtgcacactcgatraatacttgaaagaataaatcaatgtcagacatctgggcttatgtctcatctttctactgttctcaactaagagattctcgtcattctacaactttcctga

SEQ ID NO: 26098 - DNA, 201 bp, Homo sapiens
agttgacaataacaagccatgaggaaaggtctccctattcaataaatggtgctggagcaactggctagtcatatacagaatattgaaattggacccctccytttaatcatatacaaacattaactcaagatggattaaggacttaaatgtaagacctaagattacaaaaaccctagagaaaaaaactgggaaatactattc

SEQ ID NO: 26099 - DNA, 201 bp, Homo sapiens
cacaaactagaaaacgtagaagaaatggatagattcctggaaacacacaagccccctaaaattgaagcaggaagaaattgaaatcttgaacagaccaatartgagttctgaaattgaatcagtaatacaaaacccaccccaaaaagcccttaatcagatggattcacagccaaattataccagatatacaaagaagagcta

SEQ ID NO: 26100 - DNA, 201 bp, Homo sapiens
taaaaagactggatctcgaaaagattttcacaagacgcttccgaaacagacgtttgagtcggaaaccttggagtgcagtgaacccgctgctcaggtatttmctgtcaacaaacatggttaccaggttactgggctcttctgcccagggcatgctgtcagttttacaaactagaataaacgatagacgcatagaaagtttga

SEQ ID NO: 26101 - DNA, 201 bp, Homo sapiens
atctttctactgttctcaactaagagattctcgtcattctacaactttcctgagcctgctctccttctccaaatattcacccttccaggcactgactccayctcccacatcagagctttttcttaaagtaaataacagtcaacaattaatagcttcataactttggaacagtgcagtgtctttggtttaagaagcattgtt

SEQ ID NO: 26102 - DNA, 201 bp, Homo sapiens
gcccaggttctgtgatcagagatggctgggctcaaaaccggaccgaacactcacggaaaaagcccaggttctgtgatcagagatggctgggctcaaaacckgaccgaacactcacggaaaaagcccaggttctgtgatcagagatggctgggctcaaaacctgaccgaacactcacggaaaaagcccaggttctgtgatca

SEQ ID NO: 26103 - DNA, 201 bp, Homo sapiens
attgtctcttagcctgctgtgttttcctataggtgatagcagatacataatgctaaacatcaggtttgaaattactgtgctgactttagtgactgagaagyatcagtctcttattgggtaggggacatggggaaatgtcatgtttgacttgacatcacaaacgatgttttcattgcagttgcagatactcgcagataccgc

SEQ ID NO: 26104 - DNA, 201 bp, Homo sapiens
acaattaatagcttcataactttggaacagtgcagtgtctttggtttaagaagcattgtttccatcctccaaactaaaataaattttgagaaaagatggaratggtttgggactggggaagaagggaatggaagaagtgattatttgagggcacattaactatttgtacaaagtagaatatcttagttaaatttggctaca

SEQ ID NO: 26105 - DNA, 201 bp, Homo sapiens
gggtcagagaaattcaagcggccaggggatgctgaagatggcccattatggccgggcgcggtggctcacatctgtaatcccagcactttgggaggccgagkcaggcagatcacaaggtcaggagatcgagaccatcctggctaacacagtgaaaccccgtctctactaaaaatacaaaaaaattagctggctgtggtggtg

SEQ ID NO: 26106 - DNA, 201 bp, Homo sapiens
tggagggcttgttttttgtttgttgttgttgtttgtttgtttttggttttgtttttttgagacagagtctcactctgtcgacaggctggagtgcagtggcrcgatctcggctcactgcaccctcagccttccaggttcaagcgattctcctgcctcagcctcctgagtagctgggattacaggcatgtgccaccagcccag

SEQ ID NO: 26107 - DNA, 201 bp, Homo sapiens
accaggcatctcctgatctgcggctgacctggctccagaacatggcagagaaacacaccaagaagaagtgctacacggaggctgccatgtgcctggtgcaygccgctgcgttagtggctgagtatctgagcatgctggaggaccacagctacctgcccgtgggcagtgtcagcttccaggtagggtgtgtgcagcttttcc

SEQ ID NO: 26108 - DNA, 201 bp, Homo sapiens
ttattatttgctgagttgtccatgactgatgtccatttctactgggtgatccacccccaaccctttctaaaaggctaactgatcttttcttgcttctgtaygctctctttccctctcctccctctcttttcttaatttcagggactccttccacagatctagtttcaggaaatgtgaaacccagttgtcacagggcagcta

SEQ ID NO: 26109 - DNA, 201 bp, Homo sapiens
ttaaaaatacagagagatatatattttgtaagagacaggggtcttactttgttgcccagtctggtctcaaactgttggcctcaaacgatcctcctacctcrgcctcccaaggtgctgggattacaagtgtgagccactgcaccagcctgaagttttcttggccttccttcgttccccaacaacctcaacaacagttctcag

SEQ ID NO: 26110 - DNA, 201 bp, Homo sapiens
tgcagcctcgacctcctgggctcgagcaattttcctacctcagcctcctgtgtagctgggactacaggcttgtgccaccatgcccagctaattaaaaatayagagagatatatattttgtaagagacaggggtcttactttgttgcccagtctggtctcaaactgttggcctcaaacgatcctcctacctcagcctcccaa

SEQ ID NO: 26111 - DNA, 201 bp, Homo sapiens
ctccattatctaattagattgggtcattaaaataacaagtataacaggcataatcaagttggtgaacaaacacagatgaattgtggtgaatatatacctcrtcaggcagaagcagaaatagctgagctaactggagagtcatccagcaggtagtgttcagctgggtaaccacatcagggtgtggctttcacagaagctgaa

SEQ ID NO: 26112 - DNA, 201 bp, Homo sapiens
aatatgacaggaatttttatagcaactcactttcataatatcttgtccaaccatttggcttggttttcatagaaagaaatctttttctttccacacccatrgttcatcagtttctccattatctaattagattgggtcattaaaataacaagtataacaggcataatcaagttggtgaacaaacacagatgaattgtggtg

SEQ ID NO: 26113 - DNA, 201 bp, Homo sapiens
caggaatctcaccatgctggaaatgattcgaggtttttaaataatactaatttttcagacaaggtggtccccctaaagcaaagcccactacttacttggarcttcacagtagaatcagccatcatttccagcgctaaatatgacaggcttactgagggatagaatacctggatgctctgctctatgggagatttaaggaat

SEQ ID NO: 26114 - DNA, 201 bp, Homo sapiens
acacctaatatgacaggaatttttatagcaactcactttcataatatcttgtccaaccatttggcttggttttcatagaaagaaatctttttctttccacrcccatggttcatcagtttctccattatctaattagattgggtcattaaaataacaagtataacaggcataatcaagttggtgaacaaacacagatgaatt

SEQ ID NO: 26115 - DNA, 201 bp, Homo sapiens
ttgtacacaggtattgagatattacactgtattccataaataggtacaactattatgtgtctattaaatttttttaaagagccaaattgtacaaaagttgyttgttttgaaatattggaataatactcatcatggagagaatctcagactgcgagatgacagcaatgttttcaattccactctcattcttgtgcaccttct

SEQ ID NO: 26116 - DNA, 201 bp, Homo sapiens
gcctgcgtttcacccagccctagcaatataggtttgggtcagagaaattcaagcggccaggggatgctgaagatggcccattatggccgggcgcggtggcwcacatctgtaatcccagcactttgggaggccgagtcaggcagatcacaaggtcaggagatcgagaccatcctggctaacacagtgaaaccccgtctctac

SEQ ID NO: 26117 - DNA, 201 bp, Homo sapiens
cttccactgcaatagattgtcttgtgtaccctcggagtgcctccatacctctcttcgtctctgcagactgctattttcaagaattagttctccttcaaatycacagatgaaaactttaaagttgtacatattttacctaagcaaaactacagaagcgtaacatttatttatatactattagatgggtcatccatctctcaa

SEQ ID NO: 26118 - DNA, 201 bp, Homo sapiens
ttctcctcccttagcctcccgagtagctgggactacaggcatgtgccacgacacccggctaattttttgtatttttagtagagacggggtttcaccatgtkagccaggatggtcttgatctcctgacctcatgatcccccggccttggcctcccaaagtgctgagattacaggcatgagccaccgcacctggccaggttct

SEQ ID NO: 26119 - DNA, 201 bp, Homo sapiens
cacacctaatatgacaggaatttttatagcaactcactttcataatatcttgtccaaccatttggcttggttttcatagaaagaaatctttttctttccayacccatggttcatcagtttctccattatctaattagattgggtcattaaaataacaagtataacaggcataatcaagttggtgaacaaacacagatgaat

SEQ ID NO: 26120 - DNA, 201 bp, Homo sapiens
ctggtcaagaaggtctctcaaaccacagaattgttcaaaattctacacaccataaacaacttattattctttaaaacacatatatatacacttatttgtcrtcctttttatgcagggccacagacttctctgtgactgtgggtttgctgatcacaattcagcattttcttttataaaccacacccgtagtgctttgtccat

SEQ ID NO: 26121 - DNA, 201 bp, Homo sapiens
aaccgccgtaaccacaaggaatggggaccacagggagaggttggagtaatgatgagcttaccacattgatcattccatcaaagtgggtacatatttaccargaaggtgactttactgctatttgcaagaatgttaagcttgctgtggggtattcactggaaagctcccaggaaaagacagtgagatgtgaccctgttcttc

SEQ ID NO: 26122 - DNA, 201 bp, Homo sapiens
gctggagtgcagtggcgcgatctcggctcactgcaccctcagccttccaggttcaagcgattctcctgcctcagcctcctgagtagctgggattacaggcrtgtgccaccagcccagctaatttttgtatttttcgtagagacggggtttcaccatgttggccaggatggtcttgatcccttgacctcatgatctgcccac

SEQ ID NO: 26123 - DNA, 201 bp, Homo sapiens
gcccaggttctgtgatcagagatggctgggctcaaaacctgaccgaacactcacggaaaaagcccaggttctgtgatcagagatggctgggctcaaaacckgaccgaacactcacggaaaaagcccaggttctgtgatcagagatggctgggctcaaaaccggaccgaacactcacggaaaaagcccaggttctgtgatca

SEQ ID NO: 26124 - DNA, 201 bp, Homo sapiens
atattttaaagttatatctttagtataagtgtgtttatgtatttaattataatatttaatatatatttcaattataaacttgtacaacagatatatttacmttttaaatattttatataaaatttttctatatttcaaagcttagaggtgattcaagcatagtcgtgctgttaattattggagacgggacctgcacgtggg

SEQ ID NO: 26125 - DNA, 201 bp, Homo sapiens
agaaggtgactttactgctatttgcaagaatgttaagcttgctgtggggtattcactggaaagctcccaggaaaagacagtgagatgtgaccctgttcttyggacccttgcgatcggcagagcactcaccagtgtttggaaagcatactgcaagagtgggaattactgttttcaaggatttgcactacttatttttgcata

SEQ ID NO: 26126 - DNA, 201 bp, Homo sapiens
cttccaggttcaagcgattctcctgcctcagcctcctgagtagctgggattacaggcatgtgccaccagcccagctaatttttgtatttttcgtagagacrgggtttcaccatgttggccaggatggtcttgatcccttgacctcatgatctgcccacctcggcctcctaaagttctgggattacaggcgtgagccaccgc

SEQ ID NO: 26127 - DNA, 201 bp, Homo sapiens
ttcaattgtatactatgatagcaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatacc

SEQ ID NO: 26128 - DNA, 201 bp, Homo sapiens
tggagtgacatttgggttgtttctagtctttgttatgaataaagttgctggagacatttgtgtacaggtttttgtatggacataagctttcatttctctcmtgtacacacataggagtggggttgctgggtccaatggtagtgcagtttaactgcataagagaccgccagcttcttctgcaaagtagctgtgcattttgca

SEQ ID NO: 26129 - DNA, 201 bp, Homo sapiens
ctgctatttgcaagaatgttaagcttgctgtggggtattcactggaaagctcccaggaaaagacagtgagatgtgaccctgttcttcggacccttgcgatsggcagagcactcaccagtgtttggaaagcatactgcaagagtgggaattactgttttcaaggatttgcactacttatttttgcatacatgaatgtaatta

SEQ ID NO: 26130 - DNA, 201 bp, Homo sapiens
ggattacaggcatgtgccaccagcccagctaatttttgtatttttcgtagagacggggtttcaccatgttggccaggatggtcttgatcccttgacctcaygatctgcccacctcggcctcctaaagttctgggattacaggcgtgagccaccgcgcccagccaggagggcttgtgaaaacacagatagctgggcccatcc

SEQ ID NO: 26131 - DNA, 201 bp, Homo sapiens
tttcaattgtatactatgatagcaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccatac

SEQ ID NO: 26132 - DNA, 201 bp, Homo sapiens
ccaagatatagaacagatccaccactccaaaatacttcccgtgcccattggtagtccatgttgcaatagttccttcctttccgttgctgagtagtattctrttgtgtgactacctcaccatttgcttgttaattccccactggagtgacatttgggttgtttctagtctttgttatgaataaagttgctggagacatttgt

SEQ ID NO: 26133 - DNA, 201 bp, Homo sapiens
tgcgatcggcagagcactcaccagtgtttggaaagcatactgcaagagtgggaattactgttttcaaggatttgcactacttatttttgcatacatgaatrtaattaacatagaatgatagttcagatacagatgttaaggttacaataggggcttgatatttctctttaagtgtttagtttctgtgcggtaaaataaaca

SEQ ID NO: 26134 - DNA, 201 bp, Homo sapiens
taggtctggcggaggcctgatagtctgcatttctagcttggccaggggatgttgatgttgctggtcccaggaccacattttgagaaccactgcaatagagrgtgtgcatgaagatacaacaacaattacctgatggtccttagcttagttcagttgtcccccacaggttgaagcagtgttcaagggcaaacaaaaactttc

SEQ ID NO: 26135 - DNA, 201 bp, Homo sapiens
gtcagatttatccaggagccactttcctaaaccacatctgtgattattacacttactccttcagcaaaatttctctgtggtgtttttactcctttttaacrtgtttaaaccatgaatgcaacaggtctaacttatatttcactttgctgctcatttacagatctcagaaaattttcactgtgacctgaactctgaccagtt

SEQ ID NO: 26136 - DNA, 201 bp, Homo sapiens
aaaaacacacaaaaacatcaacaataggtataagattttgcaatgccatctggtggatgttactaagccatatccatgttcacatttccttccttcctgcytcagtctctttgtcttgaatgcttgggtttctaaaaggagaaactgttttgctgcaaatgctggctttgaggttgggggttggaagagaaactttcttat

SEQ ID NO: 26137 - DNA, 201 bp, Homo sapiens
gtttcaattgtatactatgatagcaaaaaaaaaaatcctctatagacatgtattaattttgtactttcatattaaaatattatctacattataaaacataatagaaattttaaagatgaactagataaatctatataaattctagtattttcttcttccactgcaatagattgtcttgtgtaccctcggagtgcctccata

SEQ ID NO: 26138 - DNA, 201 bp, Homo sapiens
aggcctgatagtctgcatttctagcttggccaggggatgttgatgttgctggtcccaggaccacattttgagaaccactgcaatagagggtgtgcatgaaratacaacaacaattacctgatggtccttagcttagttcagttgtcccccacaggttgaagcagtgttcaagggcaaacaaaaactttctctctcagccac

SEQ ID NO: 26139 - DNA, 201 bp, Homo sapiens
tcttataaaaggcagagtgttagaaaaaaagcaaatctaagttaacttgagccgtggagggtagccttcccttccctgggttaactctaattggagctccycacagaattcactaatgatttccttacgatgtgattaaaaataggaggatgctgtggaaatacgtccagtaccagaatgtcccaaggaacacctgggcaa

SEQ ID NO: 26140 - DNA, 201 bp, Homo sapiens
attaaccgggcatggtggtgcatgtctgtaatcccagctacttgggtggctgaggcaggagaatcacttgatcctctaaaaatagctaaactgggaggcaraggttgtggtgagccaagatcgcgccattgcactccagcctgggcaacaagagtgaaactccgtctcaaaaaaaaaaaaaaaaaaaaaaaaaaaaagatt

SEQ ID NO: 26141 - DNA, 201 bp, Homo sapiens
agcagtgttcaagggcaaacaaaaactttctctctcagccacctccataagttccatagtttatttaacaaagcaaactcacaaagaaggaggaagttagractgctccatttccccttatagcaaaggcatgtgtatttcacaactgcaatcagcttgaatagcagaggctggaaggctctccatgtctttactgaagtc

SEQ ID NO: 26142 - DNA, 201 bp, Homo sapiens
gcaacagaatattggtcaagttgctgaccttgaagtaagtatcaacaaacacactgccaccgctttgagatttatcttgccttttacatacaaatgttgtrtttattatcagagcttgaatcaaagcggagctcccaaaatacgtctaacagtgggcagctgtggagtagtagaaagggcacgtttgagtccattcctgga

SEQ ID NO: 26143 - DNA, 201 bp, Homo sapiens
tttgagaccagcctgaccaacatggagaaacccagtctctactaaaaatacaaaattaaccgggcatggtggtgcatgtctgtaatcccagctacttgggwggctgaggcaggagaatcacttgatcctctaaaaatagctaaactgggaggcagaggttgtggtgagccaagatcgcgccattgcactccagcctgggca

SEQ ID NO: 26144 - DNA, 201 bp, Homo sapiens
aactttctctctcagccacctccataagttccatagtttatttaacaaagcaaactcacaaagaaggaggaagttaggactgctccatttccccttatagyaaaggcatgtgtatttcacaactgcaatcagcttgaatagcagaggctggaaggctctccatgtctttactgaagtcacgtcactaagtcacacagacat

SEQ ID NO: 26145 - DNA, 201 bp, Homo sapiens
ctccataagttccatagtttatttaacaaagcaaactcacaaagaaggaggaagttaggactgctccatttccccttatagcaaaggcatgtgtatttcayaactgcaatcagcttgaatagcagaggctggaaggctctccatgtctttactgaagtcacgtcactaagtcacacagacatgctgctaattcactgcctt

SEQ ID NO: 26146 - DNA, 201 bp, Homo sapiens
tgaatgtttattgcaacactattcacaatagcaaagacatggaatcaacttaaatgcccatcaatgacagattggatgcagaaaatgtggtacatatacascatggaatactatgcagccataaaaataatgagatcatgccttttgtgggaacatggatggaactggaggctattatcctttgcaaactaacgcagaaat

SEQ ID NO: 26147 - DNA, 201 bp, Homo sapiens
tgctccatttccccttatagcaaaggcatgtgtatttcacaactgcaatcagcttgaatagcagaggctggaaggctctccatgtctttactgaagtcacstcactaagtcacacagacatgctgctaattcactgccttggccagcacatctgaaaataaatagcaccattataggccctttcatgaatatacagcatgt

SEQ ID NO: 26148 - DNA, 201 bp, Homo sapiens
ctaattcactgccttggccagcacatctgaaaataaatagcaccattataggccctttcatgaatatacagcatgtggcctctaaattggccaaggagctrgctatgctgggacaaataacttagataaatcacaaatcagagtggagaaatgaggtgtttttaatcaacagcatccaacaatgtgtgttgagtttaactg

SEQ ID NO: 26149 - DNA, 201 bp, Homo sapiens
gcaacaggtctaacttatatttcactttgctgctcatttacagatctcagaaaattttcactgtgacctgaactctgaccagttcaaaggatttctgcgarctcacacgccttcagtggccgcatcaagtcaggcgagatctgcagtcttctcagtcacctacccgtcctcagacatctacctggtagtcaaggtaattca

SEQ ID NO: 26150 - DNA, 201 bp, Homo sapiens
ctacattaaggttcatagctgttgcatgccaggaggggtaattcattcaaggagtatagggaatcaaactgaagttactgatgggtgtattatttgctatrgctcctgatcctctgtctttgtgaattttagatcaggaagtgtgactggggcagaaagatgttagaaactatggggttgggcagggttgatctggggtga

SEQ ID NO: 26151 - DNA, 201 bp, Homo sapiens
atgtgactaccttcataaccaagatatagaacagatccaccactccaaaatacttcccgtgcccattggtagtccatgttgcaatagttccttcctttccrttgctgagtagtattctgttgtgtgactacctcaccatttgcttgttaattccccactggagtgacatttgggttgtttctagtctttgttatgaataaa

SEQ ID NO: 26152 - DNA, 201 bp, Homo sapiens
ggtaggttgtgagagtttggaatgagagtctgaacccagagttacaaccagatttcattatactaagtcgtgatttacagtctgaggtcagtgaccccacycatccctttcagtgggtgagtgtcccagcatctgaactcatggtcactttttttcctaagagattgtcgtctttaatgagtacttattcgctctgtgttt

SEQ ID NO: 26153 - DNA, 201 bp, Homo sapiens
taaaatatgcaacagatttcaaaaacttcatggggaaaaatgtgaaatattgtattaataattttttacattgattacatattgaaacagtctttaggctrtattgagttaaatgaaatattactttcacatggtccttttgtgtttttttttttttttttttttttttagagacagggtcttgctctgtcactcaggctg

SEQ ID NO: 26154 - DNA, 201 bp, Homo sapiens
tctgtacatagcacaagctgtgtaaaatgtgacctccctcagccaaggtgcccttttcccctcttttaaaattcccagggtaggttgtgagagtttggaaygagagtctgaacccagagttacaaccagatttcattatactaagtcgtgatttacagtctgaggtcagtgaccccactcatccctttcagtgggtgagtg

SEQ ID NO: 26155 - DNA, 201 bp, Homo sapiens
caaacacactgccaccgctttgagatttatcttgccttttacatacaaatgttgtgtttattatcagagcttgaatcaaagcggagctcccaaaatacgtytaacagtgggcagctgtggagtagtagaaagggcacgtttgagtccattcctggattttttttctaccaacttcttgatggtcattcttctacaatagag

SEQ ID NO: 26156 - DNA, 201 bp, Homo sapiens
tttatggcttcctggctcatcagtgtgttctccaaccaggaagctccgccaagtctcagtgtccagagattttgttggggtttcattatgtaggcaaattraatacagtctccagcccctctcctgtctccagaggtcatccagttcctaccctgtaatcacagaattggtctttttggtggccacttggcatcctgaagc

SEQ ID NO: 26157 - DNA, 201 bp, Homo sapiens
gctagtgcaaacacctccttacaaatttctaacagtataattggtcataggaaagaaacatttttcaagcttttgattgccaaattgacgcccagaaaagstatacctgtttctgctcctaccagtggccctacgaatgctcctttccccacattcacacccccaccgagttttatcattcttttaaatctttatttgcca

SEQ ID NO: 26158 - DNA, 201 bp, Homo sapiens
gatggtcattcttctacaatagagaaggcaaacacacgtgtctactaaagttaggcaggtaaggtcattgagtgaaatgacctacattaagaaaaatagcrcttaagtcagtggtgtgctggagtcgactgtactaactcgtgagatctgacagtgcatatctcttcctgggttcggtgaagtcacattggtaactttaaa

SEQ ID NO: 26159 - DNA, 201 bp, Homo sapiens
aaactccaccgcctcactcccatctcttcgtaagttagtaggcttgtaagtcctaggctggttagttcattcatttgttcactcatgccagccattgaggrttattgtgttctaagtgctgtgctaagccccagaaatacaaagacaagtgagtcatgggcctgcctgcaaggagtgaggagatttactcaaaattgagag

SEQ ID NO: 26160 - DNA, 201 bp, Homo sapiens
aaaatgtgctagttgtcaaaaggacaggttttcagctaaagattagctctttccaacagaatttacagcaataacataataatagcacacattccaatagmatttacagcaataacagaaagttctgtatgtgtgccagcagtacaatagccactaatcacatgtagctgttcagcatttgaaatgtggccagtgcaatgg

SEQ ID NO: 26161 - DNA, 201 bp, Homo sapiens
ggctgcaagtattccttccatccaagtccaggatcactgtgctgttgggggaatggtaaaaacggcttgggtttgggtttcctcactttcacaagagggtrtgttccatttcaccccaaaatgggtgtacagttctgatgctaacacgtggaggtggtatcagctcccacagggtaaaggctcagtcctcctcaagactgc

SEQ ID NO: 26162 - DNA, 201 bp, Homo sapiens
ccactagggataatagcattatccaaaaacatttttggaaatccttttagaattattctcagggactggagtacatttatttttaaaaagaaacttggtgktttaaaatctttttttttttttagggagaatctgctttattatttgagaagtttcaaaaaatatagaaaatacagatgataatatggcaagtatctaaag

SEQ ID NO: 26163 - DNA, 201 bp, Homo sapiens
ctgaaaaattgattttaattaattttaatttaaagtcaagtaactgtatgtgtctactatattggagagtatggagctagacactgaaggcctaacaggtkgggctgccttggtttctgaatcgcttatggtggcacctgacctattccatggggtctggaaggagtgcttgtcaacacatatctgccaaaggcattaatg

SEQ ID NO: 26164 - DNA, 201 bp, Homo sapiens
ttactgcctttttataaaacctttaaactctccatttcaaactcgacaacacttagtggcttccttctttaggctgcaagtattccttccatccaagtccrggatcactgtgctgttgggggaatggtaaaaacggcttgggtttgggtttcctcactttcacaagagggtatgttccatttcaccccaaaatgggtgtac

SEQ ID NO: 26165 - DNA, 201 bp, Homo sapiens
taatagtttaaaaagctgtatgtgtgtttacaatttctgtcataaatctatggtaaccacagcacaaacattttagaaaaagaaaaaaaaaaacaactctmggttgagtgtggtggttcatgcctataatcccagcaatttgggaggctgaggcaggaggatcacctgcatccaggaatttgagaccagcttgggcaacat

SEQ ID NO: 26166 - DNA, 201 bp, Homo sapiens
tgtacttctggggtgtgtgtgtatatgcatatccataaacaatatatggtatagcttctggagggatccaaagtcattagcactcaagcaagcctattaartaaaataatatcagcttgagttaaagataacatatagccgtgaaataacggagctgatttttaggtaccttgtcaaatagttctgaaagtaattgcaaag

SEQ ID NO: 26167 - DNA, 201 bp, Homo sapiens
ttactatggagtcgtgagtcatttttctttctacttacccagatttccacaagttttaccaatgggaactttttaatggcttgcatttttggaaatatcartattgattcatgtaaaggtttgtgggtttttttggggtttttttcgtttttttgttttttttgagatggagtctcactctgtcacccaggctggagtgca

SEQ ID NO: 26168 - DNA, 201 bp, Homo sapiens
aggtgagatcatgaggtgatgtaatattttgatagtttttccctaatactctgtgtatgcttttcacagtttggaattttatatggtgaatatttattttsaagtctgtgcaaaattcaatcaaggtcatgtgctttcttatcaccctttccaaatattagtagtttatactagtagatagagagtagtagagtttttcaa

SEQ ID NO: 26169 - DNA, 201 bp, Homo sapiens
tgtcataaatctatggtaaccacagcacaaacattttagaaaaagaaaaaaaaaaacaactctcggttgagtgtggtggttcatgcctataatcccagcartttgggaggctgaggcaggaggatcacctgcatccaggaatttgagaccagcttgggcaacatagcatgacccatctcgacataaaattaaaaattaggt

SEQ ID NO: 26170 - DNA, 201 bp, Homo sapiens
tgcatggtactgcatacaggaaactataaagaacaacggttatttagaactgttcattctgacagtgtttttcaattactccttaatattataaccacttmctcatttcctgaaatcaccaggaaatttttcaaaaagatttttctcccccgatgaatatacccacgatttgcatttgacccaagataagcagttgagtcg

SEQ ID NO: 26171 - DNA, 201 bp, Homo sapiens
ttggggatttggatgaacaggagtttgtctacaaagagcctgcaattaccaagcttcctgagatctcacatagactagaggtaagaaaagtgattctgtgygcctgacctggtacactttacaaaaacaagttagagtgggtcatcaccaaaaataaacaaataaagagttatggattcatcattgatctctacataaagt

SEQ ID NO: 26172 - DNA, 201 bp, Homo sapiens
tagcatgacccatctcgacataaaattaaaaattaggtatggtggtacatgcctgtagtcctggctactctcaggggactgaggtaggaggatctcgtaaktcctggagtttgaggctgcagtgagctgtgatctcgccactgcactcagcctgggtgacagagcaagaccctgtctcaaaaaagaaaaaaaattctattt

SEQ ID NO: 26173 - DNA, 201 bp, Homo sapiens
tggcttgcatttttggaaatatcagtattgattcatgtaaaggtttgtgggtttttttggggtttttttcgtttttttgttttttttgagatggagtctcrctctgtcacccaggctggagtgcagtgacatgatctcggttcactgcaacctccgcctcacaggttcaaacgattctcctgactcagctgcccgagtagc

SEQ ID NO: 26174 - DNA, 201 bp, Homo sapiens
ctaccaaacttctctcctgttttttcttttcgttttgttttgtttttgtttttgtttttgaggcagcgtcttgccttgtcacccaggctggagtgcagtgrtgcagccttggctcactacagccttgacctcctgggctcagcctcccacctcaaccgcccaagtagctgaggctacaggagcatgctaccacacctggct

SEQ ID NO: 26175 - DNA, 201 bp, Homo sapiens
aagcttatacccatataataagcatagtaactaacagaatgttctttggagtcagatagtcttgggttcaaatcctccagacatttccagccctgagtttygcatttgttaaatagggatgataaacctggttcatagcattgctgtgtggattcactgaggtgctcatcaagtgctcagcacagagccctgtgtcatgta

SEQ ID NO: 26176 - DNA, 201 bp, Homo sapiens
atttcagtcttaagttttctaaaattttacatttgcagtcctaacagcagtgtgagagaattcccattttccagttcctcacccatactttccagtatgaygtatgtgggactaaaatgcaaagaacttcagagctcacctgatccaagcattcccacccccacatttccagatgcacaaaattaagacccggaaaggata

SEQ ID NO: 26177 - DNA, 201 bp, Homo sapiens
cttatggatgctttgtatctttttagaaactttatcctataatcgggaaacaatgcttgtggcattggaagagacttgcatccaatgaattctgtagttaytgaacttcccctcagcatttaatcacccacaggtggcatttacaatgttctctactcgttcctgcaaacattatcccttaattacatcacagtgggactt

SEQ ID NO: 26178 - DNA, 201 bp, Homo sapiens
tatggatgctttgtatctttttagaaactttatcctataatcgggaaacaatgcttgtggcattggaagagacttgcatccaatgaattctgtagttactsaacttcccctcagcatttaatcacccacaggtggcatttacaatgttctctactcgttcctgcaaacattatcccttaattacatcacagtgggacttag

SEQ ID NO: 26179 - DNA, 201 bp, Homo sapiens
ctgctgtgttttcctataggtgatagcagatacataatgctaaacatcaggtttgaaattactgtgctgactttagtgactgagaagtatcagtctcttaytgggtaggggacatggggaaatgtcatgtttgacttgacatcacaaacgatgttttcattgcagttgcagatactcgcagataccgcaccagtggctcgg

SEQ ID NO: 26180 - DNA, 201 bp, Homo sapiens
tcatgttatcaggtattttttccccataaggcttttactaagtactatttcttggaggtcagcacagcttaaacatggaataaaaatagttggactaatamatgttttcttctgtctcgttttctggaaatatagggcaaaatctcaggtggaggggtacagggaactcttggggagaaaaaaagaaaaggtcacacaaag

SEQ ID NO: 26181 - DNA, 201 bp, Homo sapiens
tcccttcgcaggacaaccacctggagaagttcttcaccctctgccactccctggagagccaggtgaccttccccatccgcgtgctggatcagaaaatcagygagatggcgctggagcatgagctgaagctcagcatcatctgcctcaactcctcccgcctggagccgctcgtgctcttcctgcacctggtgctggacaagc

SEQ ID NO: 26182 - DNA, 201 bp, Homo sapiens
gaattagaatcctactaactctttggaggcatacatttagcatctggctagaggaggacctctgatgaaatttaaatatactaaaactgcctttctgaatkgctgttagtccctgctaccaaacttctctcctgttttttcttttcgttttgttttgtttttgtttttgtttttgaggcagcgtcttgccttgtcacccag

SEQ ID NO: 26183 - DNA, 201 bp, Homo sapiens
ctcaaactcaacaaaatgaattagaatcctactaactctttggaggcatacatttagcatctggctagaggaggacctctgatgaaatttaaatatactamaactgcctttctgaattgctgttagtccctgctaccaaacttctctcctgttttttcttttcgttttgttttgtttttgtttttgtttttgaggcagcgt

SEQ ID NO: 26184 - DNA, 201 bp, Homo sapiens
ggccgcggagctcttcagcacggtcagtgcccagagggcatcccggggcctggcctcccatactccagctggacttggggtgctgggaacacctggtcttmatggcccagtcagccccacttcccgaggacacgtgccagggtgtgcggggcaggggatgggcccggggaggactttgatgtatgcaaattgcatgagctt

SEQ ID NO: 26185 - DNA, 201 bp, Homo sapiens
ggcaaaggaggacaagtctggacggattacaatggacccaacttgtcatcatgagaaacagacccacaaatacagagttaatcttcttgagctgtactggscactgtagaagtgccaaggacaccccgttagaaatgccaaggccaccctgttagaaaccaggtcttggggaatgacagaagagatttctctccagtttgg

SEQ ID NO: 26186 - DNA, 201 bp, Homo sapiens
ccagttccgtgactctgtgttgaagatgtataactttgccattaaccaagactgagagaagaacgtgtcttcaagaatccaatatagttttgacttttccrgaagcttctattctagtatgatgcaaagaggttgtattacgttaattaaggaaacacatttcctaacttgctttgagaccctggaggggaccagaagcac

SEQ ID NO: 26187 - DNA, 201 bp, Homo sapiens
ggcctcctggagcaggccgcggagctcttcagcacggtcagtgcccagagggcatcccggggcctggcctcccatactccagctggacttggggtgctggsaacacctggtcttaatggcccagtcagccccacttcccgaggacacgtgccagggtgtgcggggcaggggatgggcccggggaggactttgatgtatgca

SEQ ID NO: 26188 - DNA, 201 bp, Homo sapiens
tagaaatgccaaggccaccctgttagaaaccaggtcttggggaatgacagaagagatttctctccagtttggttgtggccccttctcttggctcacagttyttctctgtggctctcaggccaccatattttatagtctatttaaggaaagagagagataatgaacttggtttggaatcttacttcatgaaaatttcacaga

SEQ ID NO: 26189 - DNA, 201 bp, Homo sapiens
gtttcatcatctcctggtttttccaagtcccgtgggtggttcctcctaactatttttataattcagggactgaggggcaaaggaaatccatgccagttccrtgactctgtgttgaagatgtataactttgccattaaccaagactgagagaagaacgtgtcttcaagaatccaatatagttttgacttttccagaagcttc

SEQ ID NO: 26190 - DNA, 201 bp, Homo sapiens
ctttatacaaaatctcctaatggttaaaaagaaaaacgtgaggtttgaagaccagttgctcagtgcgcctcttctaaatgaatggcagacagatactctcsgggtagaattacagacctagtttagtcacggtcttggtaaggatctgcacaccagcttcctcgtttccccattcggggttcctgtggtctcttactagtc

SEQ ID NO: 26191 - DNA, 201 bp, Homo sapiens
cccagtcccagatgagtgtcccctttcctgcacctccccccattcacgacatggaaatggaaagaatcgagtgaggtctgaaccccaggtaaaattggcargctgactaagttcgccttgggtgacctcaccttttcatttctgtccattttcctctctttttgttccttgccatctccccatatctcaaaaaacctggac

SEQ ID NO: 26192 - DNA, 201 bp, Homo sapiens
aagtgtacacagctgttacataccataataagtaagtctatttcagcattctaaatatatgccaagatggtttcatcatctcctggtttttccaagtcccstgggtggttcctcctaactatttttataattcagggactgaggggcaaaggaaatccatgccagttccgtgactctgtgttgaagatgtataactttgcc

SEQ ID NO: 26193 - DNA, 201 bp, Homo sapiens
atggaaacaaaatgttcaggaagaacaaaaacacacacacagtaactgctgcaatgccatgaaaacttccttaatgaagacagcctcgcttgctgttgtcrtatgtcatggctgtttatctgagtcaactccagagtagcaacatacttcagaaaaacaccactgtaagtcagaggtccactcggtgaaacagggagccta

SEQ ID NO: 26194 - DNA, 201 bp, Homo sapiens
taatcctagcgctttcggaggccaaggcaggtgaatcacctgagtgaggtcaagagttcgagaccagcctggccaacacggtgaccccttgtctctactawaaatacaaaaagtaactgggcgtggtggtgggtgcctgtaatcccagctactcaggaggctgaggcgggagaatcgcttgaacccaggaggcagaggttg

SEQ ID NO: 26195 - DNA, 201 bp, Homo sapiens
aggaaacaaatgcatggaaacaaaatgttcaggaagaacaaaaacacacacacagtaactgctgcaatgccatgaaaacttccttaatgaagacagcctcrcttgctgttgtcgtatgtcatggctgtttatctgagtcaactccagagtagcaacatacttcagaaaaacaccactgtaagtcagaggtccactcggtga

SEQ ID NO: 26196 - DNA, 201 bp, Homo sapiens
gttttaattctatgtatattttaaacttcacattattatcattattatatttatattgcacagtcactatcatttagatttacttatgtttacccttttgrtgtatttcaatgctttcagcacttctgtgtttccctttgggattgcttttcttctgcctcaaaaactctccttactatttattttagtatggctctgctg

SEQ ID NO: 26197 - DNA, 201 bp, Homo sapiens
gacacatctttacttgtagcaaaacagagagcgatgggggttattttcagatgactgtagctgaagaggaagaatcaagtaattcactccccccaataatwattcacttctgagaggaaaaacttctttggaaaaagcaccccatgaatggaagtctcagcatttgctgaagaacttagttaaaataaactctagaccttt

SEQ ID NO: 26198 - DNA, 201 bp, Homo sapiens
ttcaccccaaccatggtctctgcatgctctgctagaggctctaaacgcaatagtttatgtaaaggaaacaaatgcatggaaacaaaatgttcaggaagaamaaaaacacacacacagtaactgctgcaatgccatgaaaacttccttaatgaagacagcctcgcttgctgttgtcgtatgtcatggctgtttatctgagtc

SEQ ID NO: 26199 - DNA, 201 bp, Homo sapiens
tatttcaatgctttcagcacttctgtgtttccctttgggattgcttttcttctgcctcaaaaactctccttactatttattttagtatggctctgctggtrataaattctctccatttttgtttatctggtaaaatatttttccttcattacttatgaagaatattttcactaggtagaaaattctagattgttagttatt

SEQ ID NO: 26200 - DNA, 201 bp, Homo sapiens
taaatgagatggtggttagctattactatttcccataagtcatagaattcagttaatataactttctttctttttttctttttttttttttttttgagacrgagtttcactctttttgcccaggctggagtacaatggccgcaacctccacctcccaagttcaagtgattctcctgcctcagccttccaagtagctgggat

SEQ ID NO: 26201 - DNA, 201 bp, Homo sapiens
tcttctgtttttcatatgcatttcttccatagctgtgagctaggaagaaaatgattcttgacctgtcacatattcactgccagggccagtgctagggtgargaggcactcaccctcagggtcgagcgggtacaagatcagtacttccatggccctaaaagcgagtacctctctaaattttgtcttgggtttctcatttggt

SEQ ID NO: 26202 - DNA, 201 bp, Homo sapiens
tatgctgcttcatcagcagatggtgattatatcaagaaggaaacttatatgatgacatataaaagctggggagaggagatgtctctgaagacagtgagaartccttctctagtcttgctgctggaaccctcaaacacttaagtcatctaataaacattctactgtcttcagaggaattttctcagtgaaagggatttggga

SEQ ID NO: 26203 - DNA, 201 bp, Homo sapiens
ataagtcatagaattcagttaatataactttctttctttttttctttttttttttttttttgagacagagtttcactctttttgcccaggctggagtacartggccgcaacctccacctcccaagttcaagtgattctcctgcctcagccttccaagtagctgggattacaggcgcgtgccaccacgcccagctaattttg

SEQ ID NO: 26204 - DNA, 201 bp, Homo sapiens
agaatttcgagactatgtccaagctctggggaaaaagtgctacagttgattagttatgcctgccatgattacagcaataggaaggagtggcatgtgtgccrcctgtttgtaatccctaaactgggaaggtttcccatttcttctgtttttcatatgcatttcttccatagctgtgagctaggaagaaaatgattcttgacc

SEQ ID NO: 26205 - DNA, 201 bp, Homo sapiens
ctctgaagacagtgagaaatccttctctagtcttgctgctggaaccctcaaacacttaagtcatctaataaacattctactgtcttcagaggaattttctmagtgaaagggatttgggacacccctgtgaggaagaaacataagttccatgccttccaaataaggggcaaacttttctttgtagtcatgtttccacctgtt

SEQ ID NO: 26206 - DNA, 201 bp, Homo sapiens
tgtcttaagacagcggtggggtcctcttagtcctctctgctcaggcccctggcatgccactgccaggagtgccagatatgcttgtgcagatcctgtggcarccaagatgcccagccaagagtgactgtgggctaaagtccagtctgttcttcattcactgagccatgggttctggtgttgggattactgcatctagaggaa

SEQ ID NO: 26207 - DNA, 201 bp, Homo sapiens
gcagccttcaactcctgggctcaaatgatcctcctacttcagcctcccatgtagtaactgggattacaggcacgagccaccttacccagctaattttttttgcatttttgttgagacagggtcttgctgcatgcccaggctggtctagaacacctgagctcaagtgatcttccctcctcagccccccaaagtactgagatt

SEQ ID NO: 26208 - DNA, 201 bp, Homo sapiens
aagtcatctaataaacattctactgtcttcagaggaattttctcagtgaaagggatttgggacacccctgtgaggaagaaacataagttccatgccttccwaataaggggcaaacttttctttgtagtcatgtttccacctgttgaatccgttttatggaagttgtacagttatggcttgtctgtttatgagaagagatag

SEQ ID NO: 26209 - DNA, 201 bp, Homo sapiens
tacgctatgattagttgtggtttgtagtcccaattgtatatcataattatctgctgatctgaaaaaaacatagagcttctctacccactccttaccaccartccatcaccaccattctgactccttagtcacaatgggtattgacattttaaataaatcccaaggctcccttccgggaaaataaagaagataatatttata

SEQ ID NO: 26210 - DNA, 201 bp, Homo sapiens
ctctacccactccttaccaccagtccatcaccaccattctgactccttagtcacaatgggtattgacattttaaataaatcccaaggctcccttccgggaraataaagaagataatatttataaactattttgagttccttagaagaagggtatcttagctcattaaggaaatattatcatgatataaatctaacatcatg

SEQ ID NO: 26211 - DNA, 201 bp, Homo sapiens
tttgacagttttgaagtgacaggtttaattgccttctgtataattgattctgtagggagagaaaataggagtgctattaggtattgggttaggctcaaagwgtcaagaaagaagattagttgtgtagttctgaatttggaaacttgtatgtggacgactggaacagaaataccagttgaccctgtttaagaagggctagag

SEQ ID NO: 26212 - DNA, 201 bp, Homo sapiens
gttttgaagtgacaggtttaattgccttctgtataattgattctgtagggagagaaaataggagtgctattaggtattgggttaggctcaaagagtcaagraagaagattagttgtgtagttctgaatttggaaacttgtatgtggacgactggaacagaaataccagttgaccctgtttaagaagggctagagagcagga

SEQ ID NO: 26213 - DNA, 201 bp, Homo sapiens
agacatgttatttgagagctcttaggggaagacctggacacagcagtcgcaggagaagtcagtcttatctgtaaaaaggtcagcttgatcacagaaaaagkctttggcttggttgtgttggccctccatggcttatgatcctctttcaagtaagcaaataaatgattgcagtgttggtttgagtcctgtggtgccaaacac

SEQ ID NO: 26214 - DNA, 201 bp, Homo sapiens
gggcaccaccagcacagataaagtgtcagaaaatccattgttagagagcatttctgtgagtctttcccccttttctgcattgtacaagcaggtcaccaatmtccatgttgacatttcctccatccccctccgcaggtgaaaagcatggcccagcacgtacataacatggacaaacgggacagttttcggaggactcgtttt

SEQ ID NO: 26215 - DNA, 201 bp, Homo sapiens
ccactccctggtgccttatgccccatctacttctctccaaaagattgcctcctaccccaaccgggatttgttaagaagtctctaattccaaggcctaatcbggtggcttttcatccaccctatccctcttcaattccttcttaaactcagtaagtaactctgttcccctgtctgttgacatgtctctgcctggtggggtgc

SEQ ID NO: 26216 - DNA, 201 bp, Homo sapiens
ccttactgttctaattttacctagaattcagttgatttgctaataatgacatgccaaagtgaatcattattacacaatcaacagaaatattccacattatyccaacatgggggcatacagctctatctgttcacatatatttatccattgattccttcttttagagaatatttattgaatacttattctgtcctcatgaac

SEQ ID NO: 26217 - DNA, 201 bp, Homo sapiens
tactgttctaattttacctagaattcagttgatttgctaataatgacatgccaaagtgaatcattattacacaatcaacagaaatattccacattatcccracatgggggcatacagctctatctgttcacatatatttatccattgattccttcttttagagaatatttattgaatacttattctgtcctcatgaacgtt

SEQ ID NO: 26218 - DNA, 201 bp, Homo sapiens
ctaaccaggccagaaggcagacagcttttagttcacaagccaactctgatcagttagtagtggctgactggagaactatgcttaagaatttcgagactatrtccaagctctggggaaaaagtgctacagttgattagttatgcctgccatgattacagcaataggaaggagtggcatgtgtgccacctgtttgtaatccct

SEQ ID NO: 26219 - DNA, 201 bp, Homo sapiens
atgatcttgctaaccaggccagaaggcagacagcttttagttcacaagccaactctgatcagttagtagtggctgactggagaactatgcttaagaatttygagactatgtccaagctctggggaaaaagtgctacagttgattagttatgcctgccatgattacagcaataggaaggagtggcatgtgtgccacctgttt

SEQ ID NO: 26220 - DNA, 201 bp, Homo sapiens
atattcctaaaactacgttacagtattgcatgtgaagagatagggctatctatgacaactatgtcctgactgattgctaaggttgattcacatgatcttgytaaccaggccagaaggcagacagcttttagttcacaagccaactctgatcagttagtagtggctgactggagaactatgcttaagaatttcgagactatg

SEQ ID NO: 26221 - DNA, 201 bp, Homo sapiens
tctgcctcaactagatgtgtgaccctgagaagttacctaccctcggtttccccagatgtaaaatcggaataataattgtacctctcccttgcagttagtgwcagaataaaatgagttaatacatggaacttagaataagacttcatacatactaagggatcagtaagtgtaacattgttcagtggggcaaataggggactg

SEQ ID NO: 26222 - DNA, 201 bp, Homo sapiens
atctgttcctctaatgtggaaaattgcatacattctaatagtattagtatcttgggttattaaatgctttcaactgaatttcttggatcttctgttgtcasagaaacatcataatacatagggcaggtttggaagaaagactggccacaaaggctttgagagcctcctcctatattcctaaaactacgttacagtattgca

SEQ ID NO: 26223 - DNA, 201 bp, Homo sapiens
agtatataaaataattttttgcattataaaagtttaaagacataaagtaatattactacataaaatctaagttttttactccagctattaatatgtttttstttataaaacatcacatttattaattgctgtgtaacaaactacctcacaatttagtggcttaaaagaaaatttaattattatgcatgtggtacataataa

SEQ ID NO: 26224 - DNA, 201 bp, Homo sapiens
ccagaacatcctgttggcctgatgatagtcaatttgatgtacccaaatgttactgataatttgatcctttctctactggtgaacaggtcatctttggaaartccagcgggcctgaatttctgcaggaagtgtacacagctgttacataccataataagtaagtctatttcagcattctaaatatatgccaagatggtttca

SEQ ID NO: 26225 - DNA, 201 bp, Homo sapiens
ggaagtggagcttgcggtgagccaagattgcgccactgcactctgcactccagcctgggcgacagagggagactccgtctcaaaaaaaaaaaaaaaaaaaaggatgatgaggttaaaatggtaaatttgatgttatgtgtactttatcacgatataaaaatttgatggctcatgcctgtggtcccagatactcaggaggct

SEQ ID NO: 26226 - DNA, 201 bp, Homo sapiens
gatcacgaggtcaggagatcgagaccatcctggctaacgcggcgaaaccccgtctctactaaaaatacaaaaaagtagccgggcgtggtggcgggcgcctrtagtcccagctactcgggaggctgaagcaggagaatggcgtgaacccgggaagtggagcttgcggtgagccaagattgcgccactgcactctgcactcca

SEQ ID NO: 26227 - DNA, 201 bp, Homo sapiens
ctgggcctaattaagtccttcatttaagcacattctgggattgggatgaggattaagtgaggtaatgtacattacatacctacattactttacaatgtacrtaatgtacttcgtaattaatgaagaacctagggcttcataatgcagttaaattggttcctttttcctcctgcctcattcatttgcttctactctttgatg

SEQ ID NO: 26228 - DNA, 201 bp, Homo sapiens
ataaagaggcacaagatattgtgagcatttatggtccaggccctgtgggtcagggaagggtgaagaaggtgaaaaggaaggcagaagaaactgaagtgtgmgggcttcttgatgtagaggaggcaatgagttaggtgttgtcagctacagaagagaagccaaattatattaatgtgtatgagtgaattcttacttctctca

SEQ ID NO: 26229 - DNA, 201 bp, Homo sapiens
ttttttttgggggagacaaggtctggttctgtcacccaggctggagtgcagtggcatgatcttggctcactgcaacctccacctcccaggctcaagccatyttcccacctcagcttcccaaatagctgggactgcagtcacctgccaccatacccagctaatttttatattttttgtagagatggggttttgccatgttgc

SEQ ID NO: 26230 - DNA, 201 bp, Homo sapiens
atgcatgtaaaacttcttgaaacttcttctggcacatagcaagtcagaggttctcaattctggctaggttggcttcagtatcccctgggcaactttttaamattagacatttctgggccagaagcaatggcccacacttgtagtcccagctacccaggaggctgaggtaggaggatcactggggcccaggaggtcgaagtt

SEQ ID NO: 26231 - DNA, 201 bp, Homo sapiens
ggtaagtggatcacgaggtcaggagatcgagaccatcctggctaacgcggcgaaaccccgtctctactaaaaatacaaaaaagtagccgggcgtggtggcrggcgcctgtagtcccagctactcgggaggctgaagcaggagaatggcgtgaacccgggaagtggagcttgcggtgagccaagattgcgccactgcactct

SEQ ID NO: 26232 - DNA, 201 bp, Homo sapiens
gatcattctagctttgatttttctctttctttctggcacctggtgttcccctttctctttcaacaagtttttgctgtgctttcctagcacttccatatgtrcgtagcaggaggaggctgaatgccatctgctctgtctgccatgttgctgtaaatcacagtgagttttttgtaagtgtaacagcttccattctgcagtgtg

SEQ ID NO: 26233 - DNA, 201 bp, Homo sapiens
gcaattctgggcatttcatataaagaatcatagaacatgtggtcttttggtttagcttatttcacttaggataatgtttccaaggttcatttatgttgtgrtgtatataggtactcttttcctttttattgctgagtaattttccattgtgtggatatacaactttttgttaagtcattcatcagttgatggacgtttgga

SEQ ID NO: 26234 - DNA, 201 bp, Homo sapiens
attggctacagagaaaaatgctactgctttagctccaaaagcaataaatcatcaatattaccatttcaggaggtctcggagatttaaaatgcaaagaactrgacagaaattactgccaaaaagagtactggtcaatatctactcactgtttagttgcatttgattattgcgagctagataaattatcagaattatatgctg

SEQ ID NO: 26235 - DNA, 201 bp, Homo sapiens
catataacacatttaactcagtcaagggcacatggtgagcaatcagaaggtgttagctagctgctgctacttctgcaaacaaagactaaggagagtttagytgattttaccaaagttgtccgagtagacttccccaaattagctgttagctttggcaggactcatcccacctcctgtagcctgccaatgttataaacttgg

SEQ ID NO: 26236 - DNA, 201 bp, Homo sapiens
ggccgaggtaagtggatcacgaggtcaggagatcgagaccatcctggctaacgcggcgaaaccccgtctctactaaaaatacaaaaaagtagccgggcgtrgtggcgggcgcctgtagtcccagctactcgggaggctgaagcaggagaatggcgtgaacccgggaagtggagcttgcggtgagccaagattgcgccactg

SEQ ID NO: 26237 - DNA, 201 bp, Homo sapiens
ttgcaaacacttgttattgcccctctttcttgttatagccagcctagtggttgtgaaatggcaactcattgtgatttgatctgcatttcccatttccctcrcggctagtagaatacttacttcctatcctagtttttccttatacttttaaaaaattaaataaagaaaacgctgtagaaaattaaggagcacaatgtattc

SEQ ID NO: 26238 - DNA, 201 bp, Homo sapiens
gaccagcctggccaaggtggcaaaaccccatctctactaaaaatacaaaaattagctgggcctgctgttgggtgcctgtaatcccagcactttgggaggcygaggcaggcagatcacttgaggtgagaagttcaagaccagcctggccaacatggtgaaactccatctctactaaaaatacaaaaaaattagccgggcgtg

SEQ ID NO: 26239 - DNA, 201 bp, Homo sapiens
actacctcacaatttagtggcttaaaagaaaatttaattattatgcatgtggtacataataatttttgctttcctcatttctactcctgatacttgcctakgatgtggtcatgatggctggggccctagcgaggtgtattgtggccatgagaatggttttgctgcaacttggggttggctgggctcagctaagcagttttt

SEQ ID NO: 26240 - DNA, 201 bp, Homo sapiens
aggccgaggtaagtggatcacgaggtcaggagatcgagaccatcctggctaacgcggcgaaaccccgtctctactaaaaatacaaaaaagtagccgggcgyggtggcgggcgcctgtagtcccagctactcgggaggctgaagcaggagaatggcgtgaacccgggaagtggagcttgcggtgagccaagattgcgccact

SEQ ID NO: 26241 - DNA, 201 bp, Homo sapiens
aaacacttgttattgcccctctttcttgttatagccagcctagtggttgtgaaatggcaactcattgtgatttgatctgcatttcccatttccctcacggstagtagaatacttacttcctatcctagtttttccttatacttttaaaaaattaaataaagaaaacgctgtagaaaattaaggagcacaatgtattcttgc

SEQ ID NO: 26242 - DNA, 201 bp, Homo sapiens
ccatcacaataccattgtcatactttaaaattttaactgtaatttcttagtatcatcaaatattcagtcactgatcaaatttttaattatcccactaatgmtatatttttgacgcttgctttttaaaattggtattcagataaggtccacacactgatattgattgttacatctctggagacgcttttaatctacagatcc

SEQ ID NO: 26243 - DNA, 201 bp, Homo sapiens
gggatagtagaaattatttcaattttaatcaaataacctagagaatataacccaaatgactgaaaggaagaaatgtagaaaaagtatataaaataattttwtgcattataaaagtttaaagacataaagtaatattactacataaaatctaagttttttactccagctattaatatgtttttctttataaaacatcacatt

SEQ ID NO: 26244 - DNA, 201 bp, Homo sapiens
tcaaaaaaaaaaaaaagttaaacagacagttaccatacaagccagcaaatgtactctgaggtatgtacccaagaaaagtaaaacttaaaacttgtatacamatactcatagcagcgttggtaagtcacaatagctcaaaagcagaaacaatccaaatgtttatcagttgatgaatggataaaattcaccaatggaatatta

SEQ ID NO: 26245 - DNA, 201 bp, Homo sapiens
tcttctctccatttgtcattcagaatcctgggaaagagagacacttgtcctgccgtgagttatgtgcccactcttttgatttgtgtttctgcctagacagygcacagcatgagtgttggcatcttgaaaggaaactggggtgctcctgagggagaatagatgccaaagttgggacaagagcccagtttcctgcctttctag

SEQ ID NO: 26246 - DNA, 201 bp, Homo sapiens
gtaatttcttagtatcatcaaatattcagtcactgatcaaatttttaattatcccactaatgctatatttttgacgcttgctttttaaaattggtattcarataaggtccacacactgatattgattgttacatctctggagacgcttttaatctacagatcctccatctcttttgctttccttgcaattttaagttgaag

SEQ ID NO: 26247 - DNA, 201 bp, Homo sapiens
ggttgcagtgagctgagatcatgccactgccttccaccctgcatgacagaatgagatcctctctctaaaaatagagggggtaccaagagatgcaggggggktgagggcagcatgactactctctctgtaggagaccttaactctataaatggaggccccaaaatgttactgccatcaaaagccaggaatccttttctggag

SEQ ID NO: 26248 - DNA, 201 bp, Homo sapiens
aaatgccaagttacagacctcctttttgtaaaataattttcttgctagtataatttacatataataaaattcacacattttaggtgtacaatttggtgaayttgggcaacttagagtcacttaacctttcctcagtcaagatatagaacacttcttttatcctaaagcgttccccagcgcgcttttacaatctcctctccc

SEQ ID NO: 26249 - DNA, 201 bp, Homo sapiens
ccatctaaggggcaatccgagtatgtccacagacatttccctgattggtctttatgatttggacatcaacacctttcagtatccctcaaaaccaccttctyatcatcaagttgcacactctaatttcttagaaccccctattatctttttaagctataggaaagacctgagtgttggagagagacaaatctgtgtccaaag

SEQ ID NO: 26250 - DNA, 201 bp, Homo sapiens
aggaacccatgtatgggctgtgctgaaaaaggggggccaaggctgggtacagtggctacgcctgtaatcccagtactttgggaggctgaggtgggcggatyacttgagctcacaagttcgagaccagcctgggcaacatggcaaaacctcgtctttacaaaaaatacaaaaaaaattaaccgggtgtagtggcgtgcctgt

SEQ ID NO: 26251 - DNA, 201 bp, Homo sapiens
ctgaacatttgatatgtttcaactaatttaatctttacattaatttatgaggtaggctcttatcacccacacatcacagatgaagaaactatgacatgaaraggttaagtagcttgtttaaggttgcaaagccagtaagcagcaaagcgggattcagagttgagcactctggctccagagtccatcctcttaattgccatg

SEQ ID NO: 26252 - DNA, 201 bp, Homo sapiens
ttcattactgagttggcatgaatcctacacatcctgtgttttgcagcacgtccctcatgtctgtgccatggacattcctcagacatgctggtttaccttgrttcctggagcatttaccgacagtgtagaagggtcaacagattcatctgtgggaattaaaatttgtgatatgatctgaatcttcaatttgacattcaacag

SEQ ID NO: 26253 - DNA, 201 bp, Homo sapiens
tctttaacttgtgagctcaggcaatccacccaccttagcttcccaaagtgctgggattacaggcatgaggcaccacacccagcctagtgactgcatttttyttttttctagaagttctgtttggtccttttctgaacttttcctggtctcttttttcattttccctgtttatttgtttttatcatggattttatacctttt

SEQ ID NO: 26254 - DNA, 201 bp, Homo sapiens
aaccaggagccgcctgatgcaaagatgcttcagatggtgctgcaaggctctgtgggagctactgtaaatcaggtaagcaaaaccagaggtggcagctcctytggttcttattatttaggttgtcattatacgtctgcacccttcttccttggggttgatgaggactttgatccatagacaaacacagaaatgttcctacac

SEQ ID NO: 26255 - DNA, 201 bp, Homo sapiens; identical to SEQ ID NO: 6342

SEQ ID NO: 26256 - DNA, 201 bp, Homo sapiens
aatgggattgaattggaaacttttcaaaaattgtttaaaaattggtatgccgtgcccaatttaaatatttcataagttgcgatgggcctatccttatgtargggccacatagtttgagaaaacacaaagcagagagcctagcactttagaagtcttgcagatgttaaatttcccatcttaaagagtttacaatccagttaa

SEQ ID NO: 26257 - DNA, 201 bp, Homo sapiens
ccagcgctgcaggcgggccgtgcatgtctctagatgcatattaagcaaaaagtttctaaagaggatcgcgtggaacccagcaattgattaagaatctcaayggccctaatcccctgagaattgaactaagggctccccagcaaacacagcgatttacatggggcctagagagagcgagcactgccgggggcggcggcgaag

SEQ ID NO: 26258 - DNA, 201 bp, Homo sapiens
ggctcttatctgagagaatacagtggttatgagcatgactctggaactagacagtctgggttgaattccccgctctgccatttagttatatgatatggggkgtattacctaacatctctgtatctcatttgttcctcacttgtgacatggggatgatgacaatgataatagtaccaacctataggatagctatgagaatta

SEQ ID NO: 26259 - DNA, 201 bp, Homo sapiens
ccattcagcacttacttctggaagcttctttccctttccttcccaccactcattggcctttcaccccctagttttttgtctgtgtgtgggactgtcttccyccactccccttgactgaagttccttgagagcagcagccctctttttatcagggaagagatttgaagctcaggacattcttatccaagtaggtgctagcca

SEQ ID NO: 26260 - DNA, 201 bp, Homo sapiens
gatgaaagacatacaaacctaggcgaggccctcactcaacactgcaggacatctctaaaggaatgcaatttcaatgggaatttaaggcaagaaactgtctstaagacctacgaaggtattgatatataaacgtataaaagagtcactttgagtaattaaagcaggagccgacctggcctagaaacatgtgggaaacacttg

SEQ ID NO: 26261 - DNA, 201 bp, Homo sapiens
tttcctaggcagtatatgtggcgttggggttgggaatatgggcactcaagccagattgcctgagttcagatcccattctgcctcaactagatgtgtgaccytgagaagttacctaccctcggtttccccagatgtaaaatcggaataataattgtacctctcccttgcagttagtgtcagaataaaatgagttaatacatg

SEQ ID NO: 26262 - DNA, 201 bp, Homo sapiens
acacaccatcatctctcatgtgcctctcgcagtgacatcctctttttcctgcctgtatccatttttgctcttggcccacccattctgcacatggcagccartactaaacagagaatgtcacgctccttttaaaaaccgatcgatgattttcactgcactgagaagaaagcacaaatttttatcatgacctaaaaagccctt

SEQ ID NO: 26263 - DNA, 201 bp, Homo sapiens
caggaggtcaaggctgcagtatgccatgatcataccactgtactccagcctgggcaacagagtgagatcctgtctcaaaaattgaaaaaaaaaaaaaaaaaggtttaatgtgtagaggggaaaaggctaaatggaaatgtgttaaagtcttaacggtgatcttccttggagcaatgatatagtgggtggttgctattcttt

SEQ ID NO: 26264 - DNA, 201 bp, Homo sapiens
gcttgggcaacatggtgaaaccacatttctacaaaaaatagaaaaattagttgggtgtggtggtgtgtgcctgtagtccccgctactccagagactgagaygggaggatcatttgagcccaggaggtcgaggctgcagtgaaccgtgattgcaccactgcacttcagcctggcgacagagtgggaccctgtctcaaaagga

SEQ ID NO: 26265 - DNA, 201 bp, Homo sapiens
tactttgtgccaggcactgtgctacatatgtggaaggatgaagtcccaatatcagtaggacaaggctacagacaaaacagtactgctgctcattattcatstctatgtgcaaacacaacagatggcctgccctccacttcattctacagagatcagaagtcgtgggtgagagtgtgctgatggtgcacaactgtgtaaatt

SEQ ID NO: 26266 - DNA, 201 bp, Homo sapiens
ttaactagtttggtgtagaattgaagttgaatccagggctcctgactccaagaacagttagattagttttcaagagagttctgtatttgtataaccctgayatttccagtcaagttggtctgcattgcttgttagtaatcagaaaagggaattggattgctaatcttttttttttctctttaacacagaaagtcccattac

SEQ ID NO: 26267 - DNA, 201 bp, Homo sapiens
ttttaatggtgattccacatgggaaccagtcccacctttctccccactggctgggctgctgcattgttctaggaggccaggagactgtccatgcttcccaracttcactgttcttacacgtcacctgaggatttgtcaaaatgcagattttggcctgatgcagtggctccgcctctaatcccagcactttgggaggctgag

SEQ ID NO: 26268 - DNA, 201 bp, Homo sapiens
ttagattagttttcaagagagttctgtatttgtataaccctgacatttccagtcaagttggtctgcattgcttgttagtaatcagaaaagggaattggatwgctaatcttttttttttctctttaacacagaaagtcccattacagaatcctcccattaagtgggctgaaggacataagggagtatttaatattgaagtgc

SEQ ID NO: 26269 - DNA, 201 bp, Homo sapiens
ccagtgcccagtaaaactagtcccaggcaagagatacaagaggaaatggactttcctaggggtcgctcctttaacaaagtcattagagtttcaataatgakgctatcattctccccagatggcctacagaaatgttggattttcaaaatcaaattcaccattttaaagttgttctcctacccttttaatggtgattccaca

SEQ ID NO: 26270 - DNA, 201 bp, Homo sapiens
acatgcaaacctctttaggtttcatttgtcattggaatagaaagaccttacaaaaccgccgagcacctaaaggaaagaacctagtatctgcactgttggtkgagaaactttgcagggggacttgatttgaaactctcatctgctgttacttcttttccctctgtaactctgccactttgccagcttttaaaaagaaattcc

SEQ ID NO: 26271 - DNA, 201 bp, Homo sapiens
tcactatattccaggcatgatattagttatgggactacagagatctggcttgttcctctgttcttaatgacaggacatagccctgcatggctgaataatasaatgcagcatatgcacagaactttaagaatgactaactacaggactataaagatcagaaaagagaaatcagtttcaggctggagcatttgtgggaggcgt

SEQ ID NO: 26272 - DNA, 201 bp, Homo sapiens
gaatagaaagaccttacaaaaccgccgagcacctaaaggaaagaacctagtatctgcactgttggtggagaaactttgcagggggacttgatttgaaactstcatctgctgttacttcttttccctctgtaactctgccactttgccagcttttaaaaagaaattccgtactctctcctttacctgccactgtctgagttc

SEQ ID NO: 26273 - DNA, 201 bp, Homo sapiens
tttattttttgtggagacagggtctcactatgccgtctaggctggtcttgaattcctgggctcagagattgggggcttaaaaaaattttttttcatatatytttatttaaaattcattatggttgaatgcttccaaagttgactatgccccaggacctctaaaaggacctatgaaatgtttgaagagcactcactatattc

SEQ ID NO: 26274 - DNA, 201 bp, Homo sapiens
cggtctgaaacatcatgtcttagaccttctggtctgaaacgctggataagaggttctacccataaagagctattcgattgtgtttgtgaatccactggtgracattgatggtataaaaccccatgaggcctgccttctcccttcgcaggacaaccacctggagaagttcttcaccctctgccactccctggagagccaggt

SEQ ID NO: 26275 - DNA, 201 bp, Homo sapiens; identical to SEQ ID NO: 6297

SEQ ID NO: 26276 - DNA, 201 bp, Homo sapiens
acaggcatataccaccgtgcccggccctattttttattttttgtggagacagggtctcactatgccgtctaggctggtcttgaattcctgggctcagagaytgggggcttaaaaaaattttttttcatatatttttatttaaaattcattatggttgaatgcttccaaagttgactatgccccaggacctctaaaaggacc

SEQ ID NO: 26277 - DNA, 201 bp, Homo sapiens
tatcttgattaatgttttgatatttgaattgtttcctgtatttgacaacaattctgacagaaaaactagttgttgttgttgttttttcagtacataatacrtatcttttaaaaggctagaaaaatatttggggaattattttattattttattttattttgagacaaggtctcactctgttgcccaggctggagtacagtg

SEQ ID NO: 26278 - DNA, 201 bp, Homo sapiens
gatgtgtgctcaagggaggccaagtcttatgctatttttttttgagactctctgcatgttggaaagaaaaagaaacattaaaatagggttcttaatattayagctttttgtaaactttattaaatgattataggcagtctttaaaattccatttctggtaattgatgaatttattttaccttgaagatatttttgttttct

SEQ ID NO: 26279 - DNA, 201 bp, Homo sapiens
ttgcagtggttgtggggagggtggtatcaaaggagagagtgagaaaacatccatctgggaggatgcaggaggtccacataaagagatggccttgaagaagrgatagagtgaaaaccgacagaataggggcaatgagatgagtgcagcactgcagagaaccagaaaagtgtgggagtgtcaggaagaaagtcagtagcacag

SEQ ID NO: 26280 - DNA, 201 bp, Homo sapiens
agtgtttagtccataaagtacagaacttcgatatcacagaagctagaagaactttactgccttcagcttcgtttaaagatagtagagagcttactcattcrttttagaaatatgtattgggtctctatgtcaggaactgctggcacagcagtgagattgaagatacaacagtgaatacaatagagggcctatcctcataga

SEQ ID NO: 26281 - DNA, 201 bp, Homo sapiens
aggcagccaggtcctgtgtgactgcacatgtgacttggggcaagtcatttaacctctctgttttcactatcctatttgtgaaatattgtttagatttgtgstttgagtcagctatctgtatactacactgtgttaggagctatgtagattaattttcaacagatatggttctggggttgtaggaattttcaatttgagaac

SEQ ID NO: 26282 - DNA, 201 bp, Homo sapiens
ttgtggataatttaagctttggtgatatttctaattattttttgtgtgtttctagtctactgaccagaagtctgaaaaaaacaactaaaaagaaagactgmataagccttcactagagaagtattgaaaattgcttgagggaagtgacggtttctttagcctagtgtctgtaggaccccagtgtagtgtttgttgaatgaa

SEQ ID NO: 26283 - DNA, 201 bp, Homo sapiens
tcggaaaccttggagtgcagtgaacccgctgctcaggtatttcctgtcaacaaacatggttaccaggttactgggctcttctgcccagggcatgctgtcarttttacaaactagaataaacgatagacgcatagaaagtttgagtaggaggaactttaccatctgagtcagtgattttttttttcaaacttatttgtagct

SEQ ID NO: 26284 - DNA, 201 bp, Homo sapiens
cttatttgtagctgtagaaattggtgttcaaatgaaaacccagaaacccaatgattaaaatagaaaaaagtggaaaagctctaactgcgggacagagacaycttgggcccatccctacgacagttcctgcagagactcttggtgcccctaaggcaaactacagagtaatgaaaagctctatgctgaggccagaatacctgc

SEQ ID NO: 26285 - DNA, 201 bp, Homo sapiens
acctccgcagcctgcagcctgacaagcggctagaaaacctcctgcagcaagtgagtgccgaggactttgagaagcagaacgaggaggcccggaggaccaayaggcaggccgagctctttgccctttacccatcagtggacgaggtgggtgccactgtttccatactggagaatctcagtgaagactctgagagtcatgtgg

SEQ ID NO: 26286 - DNA, 201 bp, Homo sapiens
tactattgcctttgtgcttttaccagaaaactgggtgagaacctccttttccttttccctgcccctccagcctcagttttatgaccctgtggagccagtgractttgaaggacttctgatgacacacctgaacagcctggatgtgcagcttgcccaggagctcggggacttcactgatgacgacttggacgtggtgttcac

SEQ ID NO: 26287 - DNA, 201 bp, Homo sapiens
cctgcagcctgacaagcggctagaaaacctcctgcagcaagtgagtgccgaggactttgagaagcagaacgaggaggcccggaggaccaataggcaggccragctctttgccctttacccatcagtggacgaggtgggtgccactgtttccatactggagaatctcagtgaagactctgagagtcatgtggacaattgtgt

SEQ ID NO: 26288 - DNA, 201 bp, Homo sapiens
cacttatatatagaatctaaaaaagtggatctcatagaaacagagtagaaaggtggttatagcaggggctgtggggagagggagaaggtgttggtcaaagrccacaaagtctcaggcgggaggaatacgctttagtgacctatcgcactgcacagtgaccagagttaataataatgtgttacatatttcaaaactgcttta

SEQ ID NO: 26289 - DNA, 201 bp, Homo sapiens
tcctcccacctcagcgtcccaagtcgctggaaccacaggcacatgccaccatgctggctagtttttgtattttttgtagaggcagggtttcaccatgttgsccaggctggtttcaaactcgtgagctcaagcaatgtgcccgccttggcctcccaaagtgctgggattacgagtgtgaaccaccacacccagtccttccct

SEQ ID NO: 26290 - DNA, 201 bp, Homo sapiens
gttgtccttgtcacccaactgcaaatggcctgtcactctggaacttccacagtgcttctttgtatgcatgtggtgacttgtattttgcttttactgtagtyagttacatgtttaccttttccctcacctttttttttttttttttttgagtcagggtctcactctgttgcccaggctggcatgcagtggggcgatcttggc

SEQ ID NO: 26291 - DNA, 201 bp, Homo sapiens
tgatgctgacgctgacgttgatgctgctactcattggactgccctttgagtagtaaaattttagctcactcagaaaaacctcatagtttatttggagtaasatccctttagcccttgtagatattataagactacattacaataaagttctggtgagtctaattgttgaccagagagattgtttacttcagagcacctgga

SEQ ID NO: 26292 - DNA, 201 bp, Homo sapiens
agagcagtcagttaggaactgggtctttggtcaaagccttgtaatttattgcaatacagacagatatattgggtctcctatggtcctaaaaatatgagtaygaaggatgtgatggcatttcacctataagagaaaaggacttcagaaaaatgtgtagcaatatttctttctattcaaaaccttagagaagaatattaagta

SEQ ID NO: 26293 - DNA, 201 bp, Homo sapiens
gaaagtcagtagcacagttggtggtggaacagaagcacgtgtggaagtgggctgggacaatgaagtgagacggcttttagagccagggaggggcatgtccycttaatctctcactctgctttgcaccctgatatgcatcttctgtggttccacagatcaaacgtcctgtgttggaggctaacttttcatccatgtagcagt

SEQ ID NO: 26294 - DNA, 201 bp, Homo sapiens
aatcctgatttttagaaaagcaactcaaagcacataccatttgatgtagttgtattacacttatatatgaatgaaaatctattattagtagtatttgattrataaaataatattcggcgccaggctcagtggctcatgcctataatcccagcactgtgggaggccgaggtgggtgaatcacttgaggtcaggagtttcaga

SEQ ID NO: 26295 - DNA, 201 bp, Homo sapiens
gcagagctctgccctccttcgattactttctgtgcccccgcatatgtggcacactgctttgtatgttccagctagttaatacagacttgttcaccagacaraaatatttatatgttttgagcagcttctccatagcaagttgccaccttgtggtgtgaggaccacagggtgttggcataggcagaataagtggaggtggct

SEQ ID NO: 26296 - DNA, 201 bp, Homo sapiens
cccagcatgccaaggaccttgacaaccaggaatgacctgggacctgacttcttaggctacttcagacaagactagatcttcctatcagacttcttagaacsctgactcccaagttcagcatggtgctcaagcagtctcagatgaagggaggtaccagcctaatacctctgtccagtgggcctccttaattcaaatctagat

SEQ ID NO: 26297 - DNA, 201 bp, Homo sapiens
gctggagaatcatgtaactcagtttcacttgagccctgtactgtgtggagtcagacggcttcatggaggaggtgggacttgtgctgagattcacagggtckgtatgattttgtggatgggagtgaggagggcttcctaggcgaggacaacagcatgagcaaagtctcagaggtaagagagcaggcatgatgggacaataca

SEQ ID NO: 26298 - DNA, 201 bp, Homo sapiens
aggaaaaggatctagaacatccaactcttggctcagtcagcagatgaacccagcatgccaaggaccttgacaaccaggaatgacctgggacctgacttctyaggctacttcagacaagactagatcttcctatcagacttcttagaacgctgactcccaagttcagcatggtgctcaagcagtctcagatgaagggaggta

SEQ ID NO: 26299 - DNA, 201 bp, Homo sapiens
tattggagccaaactatagaggcttagggcaccagaacaagaggttctatgcagtaaatcaaatgtgtatgggcccactgtgggaatgacttgatatgcaracatttttaggttaatctgtacaagaatcagggttgtgcagcacatctcaaatcatagtgtccacaacagtcacgtgagcatcttgtaaagatgcagaac

SEQ ID NO: 26300 - DNA, 201 bp, Homo sapiens
aggtgagagtgaattatatataaacctcttaatatattaaatctaccaagcagtgtttcagaaggaaatctgctaacatgggcatcttacttgaaaaaaaatttcagttggttcaacaaagtatggtttagaaatcattttcaatcaggatcggggagagaatttttttttttcttaaagcagttaggtttccccagcaga

SEQ ID NO: 26301 - DNA, 201 bp, Homo sapiens
gtaccactttctcagaggagtctccacttcggggccagacctgacaatatgatgcaaatctggagtcatgttgaagaatgcttagtcatgaccaattcacrcagagtaattgcagggcttgagactcacctacaaatgcctataggagagaaggaaaaggatctagaacatccaactcttggctcagtcagcagatgaacc

SEQ ID NO: 26302 - DNA, 201 bp, Homo sapiens
cccactgtgggaatgacttgatatgcagacatttttaggttaatctgtacaagaatcagggttgtgcagcacatctcaaatcatagtgtccacaacagtcmcgtgagcatcttgtaaagatgcagaacctgattaatacactctctggggtggggcctgagattctgcatttcttagtagcaagcaggtgatagtggtcgt

SEQ ID NO: 26303 - DNA, 201 bp, Homo sapiens
agtaccactttctcagaggagtctccacttcggggccagacctgacaatatgatgcaaatctggagtcatgttgaagaatgcttagtcatgaccaattcaygcagagtaattgcagggcttgagactcacctacaaatgcctataggagagaaggaaaaggatctagaacatccaactcttggctcagtcagcagatgaac

SEQ ID NO: 26304 - DNA, 201 bp, Homo sapiens
tgtgggaatgacttgatatgcagacatttttaggttaatctgtacaagaatcagggttgtgcagcacatctcaaatcatagtgtccacaacagtcacgtgrgcatcttgtaaagatgcagaacctgattaatacactctctggggtggggcctgagattctgcatttcttagtagcaagcaggtgatagtggtcgtgtgtg

SEQ ID NO: 26305 - DNA, 201 bp, Homo sapiens
ttcttattatttaggttgtcattatacgtctgcacccttcttccttggggttgatgaggactttgatccatagacaaacacagaaatgttcctacacttarcctgaacacctgtaaggtttagaagacttttaggaaacctcttccctttcatgtaacaaccccaggtaaaaaagaaatcctagagatgagtggaccaggc

SEQ ID NO: 26306 - DNA, 201 bp, Homo sapiens
ggtagagttgccctgagtgtgggactctggcgggcggggcaacaccacctccaccccactgcagtgtaatccaaaataaaacatcctatgctgggtgcagkggctcacatctgcaaccccagcactctaggaggctgagatggcaggatcgcttggagcagtggctcacatctgcaaccccagcactctaggaggctgaga

SEQ ID NO: 26307 - DNA, 201 bp, Homo sapiens
aggtggcctctctgtcatagctccaggcttgtccatagcttatgagaccagacagtgacttccctatgtttacgtctcatgttcagtttgttttgacaccrattgaagttgccattgaagacatgaagaagaagaccctgcagttagcagttgccattaaccaggagccgcctgatgcaaagatgcttcagatggtgctgc

SEQ ID NO: 26308 - DNA, 201 bp, Homo sapiens
agcagatcacttgagctcaggagttcaagaccagcctaggcaacgtgacaaaagcccatttctataaaaattacaaaaattagccagtcgtggtggcgggygcctgtagtcccagctactcgggaagctgaggcaagaggattgcttgaacctgggaggcggaggttgcagtgagctgagatcatgccactgcactccagc

SEQ ID NO: 26309 - DNA, 201 bp, Homo sapiens
acttgtgatcgaattatgacctcctcccttactacctgtggcattctgtggaacttaaccttacaaatccccctttgactgtaaaatggagagtataaagmggttgttgagaggaataaatgctaaatgtatgtaaagttcctggaacataaggaatcaagaaatgttaggcccatctttctttttaacctgttaagagta

SEQ ID NO: 26310 - DNA, 201 bp, Homo sapiens
gctgtttaccatgatctccaccactccctggtgccttatgccccatctacttctctccaaaagattgcctcctaccccaaccgggatttgttaagaagtcyctaattccaaggcctaatccggtggcttttcatccaccctatccctcttcaattccttcttaaactcagtaagtaactctgttcccctgtctgttgacat

SEQ ID NO: 26311 - DNA, 201 bp, Homo sapiens
ccgggaggcggagattgcagtgagccaagatcatgccattgcactccagcctagacaacaagagcaaaactccatctcaaataaataaataaataaataartaagttgagtaacttgctcagtaataggaaaaggcacctgacagggtagaaaaaacatggactttgaagatagacatacttgtgatcgaattatgacctc

SEQ ID NO: 26312 - DNA, 201 bp, Homo sapiens
aggggacacaggcttttttattttttaactaaaacttggagaagtaacacagaagcaaccactactgctgcccaccatgctggtcggatgctttaatgctsagctttggagtgattaacgttctttagaacagattaagaccattctgacagatgcagcagcaagaccagcatctgaggatttgctgagaactacttagct

SEQ ID NO: 26313 - DNA, 201 bp, Homo sapiens
tctcatagaaacagagtagaaaggtggttatagcaggggctgtggggagagggagaaggtgttggtcaaaggccacaaagtctcaggcgggaggaatacgytttagtgacctatcgcactgcacagtgaccagagttaataataatgtgttacatatttcaaaactgctttaaaaaaggatttttaatgttctcatcacac

SEQ ID NO: 26314 - DNA, 201 bp, Homo sapiens
tttagtgacctatcgcactgcacagtgaccagagttaataataatgtgttacatatttcaaaactgctttaaaaaaggatttttaatgttctcatcacacrcacacaaaaggtaagttggtgaggtgatagatatgttaattagcttgatttaatctttctacaatgtatgcatagatcaaaacattacttgatttaatct

SEQ ID NO: 26315 - DNA, 201 bp, Homo sapiens
gatgcagagaatatgtccagtgagacgtttgcttgtcagtgtctccctggtggtattagaggggagaatgttccatctgaacagattaaaataatgaaacrtagcctggttttagaggaactttgttttatgatctttgaaacaatgcagacactccattgggactgaatgttataatctgggagcaggcctaatggggcc

SEQ ID NO: 26316 - DNA, 201 bp, Homo sapiens
aaacatctactattgcctttgtgcttttaccagaaaactgggtgagaacctccttttccttttccctgcccctccagcctcagttttatgaccctgtggakccagtggactttgaaggacttctgatgacacacctgaacagcctggatgtgcagcttgcccaggagctcggggacttcactgatgacgacttggacgtgg

SEQ ID NO: 26317 - DNA, 201 bp, Homo sapiens
taaaaccaattcagaaaaaaaggctaggggagtacttcttggctcacctaagaaaatcacaggtaggcaaatgtggagttgacctctggatccattgggasagtaaatgaaagaatatcatctctctcatactgtctctttctctctcattatctctttcattccgttcatttatatatatttttaggatgatgaaaacaa

SEQ ID NO: 26318 - DNA, 201 bp, Homo sapiens
aaagaatatcatctctctcatactgtctctttctctctcattatctctttcattccgttcatttatatatatttttaggatgatgaaaacaagaggtatcyattaatgtttcacatttccactttctgtttgcttgggaattagttgccatttcagttagctataaagcctgaggaaattcatatagcttagaagagactt

SEQ ID NO: 26319 - DNA, 201 bp, Homo sapiens
cattaatgtttcacatttccactttctgtttgcttgggaattagttgccatttcagttagctataaagcctgaggaaattcatatagcttagaagagactkaggaaatatatcacccaaatgtcatatgtggaccttgtttggatcttgatttaacaaaataacagtaaaaacaaattgagacagtcagggaaatttgaaa

SEQ ID NO: 26320 - DNA, 201 bp, Homo sapiens
tgttaagcttgctgtggggtattcactggaaagctcccaggaaaagacagtgagatgtgaccctgttcttcggacccttgcgatcggcagagcactcaccrgtgtttggaaagcatactgcaagagtgggaattactgttttcaaggatttgcactacttatttttgcatacatgaatgtaattaacatagaatgatagtt

SEQ ID NO: 26321 - DNA, 201 bp, Homo sapiens
cccttgcaaaccaacctggcagtgggagcttcctcatctgtctggttggcgggaggactgagtggaagtggctcttcccctctgcattgtttaggaagccytcgctattgtctgagggacacacctgccccgacaggatgcatcatcaggctacttttagatgcagcgactatgtcatttgagatggcagaaattctcctc

SEQ ID NO: 26322 - DNA, 201 bp, Homo sapiens
gctcatgtgttttaaatagtatctatactaacctataactgcaagagaagagatagaccaaaaagacagccctccgagtaactacttagagtaaactagaygaaagaaagaaacaaattcttataggtaagcctagaatgtgacagtatgaatagtaaaaatataagggtaatattaatggcaaatgttttcccatttaca

SEQ ID NO: 26323 - DNA, 201 bp, Homo sapiens
gattctagctgtgctcaaaccaatgaatcagaatctcaggagggtggcgctcagaaatctgcatggttgatcagttctttagcagattcttatttttgtaygctaaagtttgagggtcaccactggagagattccagaacagggcctgcaagggaattgttcaaagtttgctcaagttaactttgttgttacagcattagc

SEQ ID NO: 26324 - DNA, 201 bp, Homo sapiens
gcagtggtctgagaatgtaatttatgatctttgaagaattttagagggagaggctactggaggtgctggcctggttggaatagagaaagaatgaaatagcrcatggggttatgtataaaacaaacccatttaaatacatttttaacaagcttggatgcgcatgtaaagcttcctcagtttgagagttctttgcactgtgaa

SEQ ID NO: 26325 - DNA, 201 bp, Homo sapiens
aaataaatttctgtatataataatattcacatttgccatgtctcttttaaaaagtccaaataacaggcagagcgcggtggctcatgcctgtaatcccagcrctttgggaggccaaggcgggcagatcacctgaggtcaggagtttgagatcagcctggccaacatggtgaaaccccatctctactaaaaatacaaaaatta

SEQ ID NO: 26326 - DNA, 201 bp, Homo sapiens
atgttaaagaaaggaaaaaggtaagaaagcaaagaaaaatccatccctaaggcacatatattgttcatgattctttgcatgtatgtttttaaatcttcttygcagcaagaacctatcagatttgaaagcaaatgatctttgatgagtccagttctgttgcctttgcaatttttcaagcagtggtctgagaatgtaatttat

SEQ ID NO: 26327 - DNA, 201 bp, Homo sapiens
gctttttatattttgttcctcaggatcataagagaatgtttggaacctacttccgagttggtttctttggatccaaatttggggatttggatgaacaggartttgtctacaaagagcctgcaattaccaagcttcctgagatctcacatagactagaggtaagaaaagtgattctgtgcgcctgacctggtacactttaca

SEQ ID NO: 26328 - DNA, 201 bp, Homo sapiens
atgaaatccgtttacccctcaaaccttttgtgtatcattgatgttttaattctatgtatattttaaacttcacattattatcattattatatttatattgyacagtcactatcatttagatttacttatgtttacccttttggtgtatttcaatgctttcagcacttctgtgtttccctttgggattgcttttcttctgcc

SEQ ID NO: 26329 - DNA, 201 bp, Homo sapiens
caatctttgttcagttataattatgagaaatactgttataaagaggcacaagatattgtgagcatttatggtccaggccctgtgggtcagggaagggtgargaaggtgaaaaggaaggcagaagaaactgaagtgtgagggcttcttgatgtagaggaggcaatgagttaggtgttgtcagctacagaagagaagccaaat

SEQ ID NO: 26330 - DNA, 201 bp, Homo sapiens
cagctgtggctagtaaataaccctgtgtgtagactcacttattggctttggcattctctattgccacagctgtgtgaatagattaaccagagaccctctgstgccagccacctattcaggcaaacaagtctataatcagtacctctgttaaaatgaaactgtaatatactattgtcttttcatttatttatttatttattt

SEQ ID NO: 26331 - DNA, 201 bp, Homo sapiens
tttttaataataattactgaaatgccaccatccagaagcattttaattgcttacagttatgagactggatcaagttagaaacataaggtaaacccacattyattgagcatctactatgttctgggtactgagataaaaagatgaataagtcaaagtccctcctttaaagaaagtgtcatgcagtgctaaaacagtggggag

SEQ ID NO: 26332 - DNA, 201 bp, Homo sapiens
ttctctttctagaaagaagcaagaagttaagaaattccttgaattagcgcctggtgtgtcaggtgggagtgcagaggagggctgttagagcagtgtcaaarggaccctggtgggccagacgggttggacatcgttaataatcatagttggcttctaaatactggtagcaagatgacttctgatttgtaatcttaggtaaat

SEQ ID NO: 26333 - DNA, 201 bp, Homo sapiens
aataggcaggacatgttagttataaagtagttacagcctaattcacaaaagttaccaactgtttctctttctagaaagaagcaagaagttaagaaattccytgaattagcgcctggtgtgtcaggtgggagtgcagaggagggctgttagagcagtgtcaaaaggaccctggtgggccagacgggttggacatcgttaata

SEQ ID NO: 26334 - DNA, 201 bp, Homo sapiens
aaaagttaccaactgtttctctttctagaaagaagcaagaagttaagaaattccttgaattagcgcctggtgtgtcaggtgggagtgcagaggagggctgwtagagcagtgtcaaaaggaccctggtgggccagacgggttggacatcgttaataatcatagttggcttctaaatactggtagcaagatgacttctgattt

SEQ ID NO: 26335 - DNA, 201 bp, Homo sapiens
taccccatggagctgggctaagtaaataggaattggtttcacgcctgaggcaattagacactttggaagatggcataacctgtctcacctggacttaagcrtctggctctaattcacagtgctcttttctcctcactgtatccaggttccctcccagaggagccaccagttctcatgggtggcactcagtctctcttctct

SEQ ID NO: 26336 - DNA, 201 bp, Homo sapiens; identical to SEQ ID NO: 6375

SEQ ID NO: 26337 - DNA, 201 bp, Homo sapiens
ttcatctatgagggtgtttcctctaaacctacgagggaggaacacctgatcttacagaaaataccacctcgagatgggtgctggtcctgttgatcccagtytctgccagaccaaggcgagtttccccactaataaagtgccgggtgtcagcagaactgtgtgtatgtcctgtgtcattgtcatttgggaattctttttctt

SEQ ID NO: 26338 - DNA, 201 bp, Homo sapiens
catctatgagggtgtttcctctaaacctacgagggaggaacacctgatcttacagaaaataccacctcgagatgggtgctggtcctgttgatcccagtctytgccagaccaaggcgagtttccccactaataaagtgccgggtgtcagcagaactgtgtgtatgtcctgtgtcattgtcatttgggaattctttttctttt

SEQ ID NO: 26339 - DNA, 201 bp, Homo sapiens
attttcaaaaaactgcccaccccagagctatgccaacaaaatctgttacggagtaaagccctgaagtggtgactcaccagagtaccttgcagctgacagawaataggcaggacatgttagttataaagtagttacagcctaattcacaaaagttaccaactgtttctctttctagaaagaagcaagaagttaagaaattcc

SEQ ID NO: 26340 - DNA, 201 bp, Homo sapiens
ttggcagttgcagtgctgctgtctcgggggggttttcatctatgagggtgtttcctctaaacctacgagggaggaacacctgatcttacagaaaataccayctcgagatgggtgctggtcctgttgatcccagtctctgccagaccaaggcgagtttccccactaataaagtgccgggtgtcagcagaactgtgtgtatgt

SEQ ID NO: 26341 - DNA, 201 bp, Homo sapiens
tgccaacaaaatctgttacggagtaaagccctgaagtggtgactcaccagagtaccttgcagctgacagataataggcaggacatgttagttataaagtarttacagcctaattcacaaaagttaccaactgtttctctttctagaaagaagcaagaagttaagaaattccttgaattagcgcctggtgtgtcaggtggga

SEQ ID NO: 26342 - DNA, 201 bp, Homo sapiens
atctgactttatttccaaatacactttcttttttaaaaaaccaatacactttctttgaggatgacagtattaggaaatccaattatacaaaaaatactacwtctagtctggggtagatatatttatttttggtaacatacattaagtggcactaattacacagtaactataaggtaactaacatgaaaccacagaactgta

SEQ ID NO: 26343 - DNA, 201 bp, Homo sapiens
ggacatgttagttataaagtagttacagcctaattcacaaaagttaccaactgtttctctttctagaaagaagcaagaagttaagaaattccttgaattascgcctggtgtgtcaggtgggagtgcagaggagggctgttagagcagtgtcaaaaggaccctggtgggccagacgggttggacatcgttaataatcatagt

SEQ ID NO: 26344 - DNA, 201 bp, Homo sapiens; identical to SEQ ID NO: 6379

SEQ ID NO: 26345 - DNA, 201 bp, Homo sapiens; identical to SEQ ID NO: 6380

SEQ ID NO: 26346 - DNA, 201 bp, Homo sapiens
  misc_feature (1)...(201): n = A,T,C or G, or insertion/deletion polymorphism (see Tables 1-2)
gcagggagtggctgagccaggatttgttcctggacctgtctgagctcaacaggagagggcagaccccagactcaggctccagaggcctgtgggaggggccntcctgcctcagtggggctggccagcccgggtcagccgtgtgggtggggctgtcctccattatcggggttgacgcatctcccacgtcagcccccttatcac

SEQ ID NO: 26347 - DNA, 201 bp, Homo sapiens
ggcatggggtataggagagaatgttgtctgaggagtttgcagccctgtactagaatcctctccgggactcagtttccatttctcaggagtgggggcagccrcattggtggtttgaggatgcaggggtgtggtgtgggaaatggttttggaacccagcaggtaggaggaaccgatgttccaggcccggctctggggcctcag

SEQ ID NO: 26348 - DNA, 201 bp, Homo sapiens
tgagggggcttcaggcagccttctgggaaggagccgagtgtggggagggcagtcaagccctcccccactcaggagttccctccagtctggtgggcctcagrgtctggccctgcttcccccatcaccagggcggggcggtggcctaaggcatggggtataggagagaatgttgtctgaggagtttgcagccctgtactagaa

SEQ ID NO: 26349 - DNA, 201 bp, Homo sapiens; identical to SEQ ID NO: 6392

SEQ ID NO: 26350 - DNA, 201 bp, Homo sapiens
  misc_feature (1)...(201): n = A,T,C or G, or insertion/deletion polymorphism (see Tables 1-2)
ccaggcaggggaggaaatggtagtagggggtctgactcatccccatgtccccagcacccagtgcagggcaggggtggggggtgggcaggaagtgctctccnggtcaatggtgacaacaatgggtatgtgaacagaggcggcgggggtgggggacgcaccccagaaagcacctctctggagggcctggggtcagtgcagggg

SEQ ID NO: 26351 - DNA, 201 bp, Homo sapiens; identical to SEQ ID NO: 6393

SEQ ID NO: 26352 - DNA, 201 bp, Homo sapiens
tgaaagccacccttcccggctgtgggatgggtaaggggaggggaatggcgctggctgaggctcagagagaagggagttggccagagttagccagagtggayacctagcccccagctccctactctgccaccagtaccttggggttgagggggctacctgtcagggaccaacatctctgcctccagagggcaggaggaggtc

SEQ ID NO: 26353 - DNA, 201 bp, Homo sapiens; identical to SEQ ID NO: 6395

SEQ ID NO: 26354 - DNA, 201 bp, Homo sapiens
  misc_feature (1)...(201): n = A,T,C or G, or insertion/deletion polymorphism (see Tables 1-2)
agtcccagccccagcaccaaccgctcaggtaaggctttctgtgggctggggcttggggcgggggctacctgcgtagagagaaaggcccaaatactcattgntgggagggtctcctggagcctagaacgaggctctggacaatgactgggaagttcccctgagaggaccaagagacacatggggttcactcagtcttgtggg

SEQ ID NO: 26355 - DNA, 201 bp, Homo sapiens
  misc_feature (1)...(201): n = A,T,C or G, or insertion/deletion polymorphism (see Tables 1-2)
catgtgtgaacctatcagggctacagggcagggaaccaaggcccaagtttcaagccccagattcctgtggagtcctgtggaggagagaagcaggtcttccngtgcctcagtttctctccctctgtgacttgggaggcaggaacccttgttcacacctgctggctgagcagcccaggcaggggcacccctaagcctcagtca

SEQ ID NO: 26356 - DNA, 201 bp, Homo sapiens
ctgactgcctcccagcccactccgcttctcagaacctccctggaacatctagccagaccctctggcccccttttgtgcccctgtctaccaatgcagcgagmccagcccctgccccgagctccctctagtccctaaggccacatcctgctccttggtgcattgagaaccttcccttcatgtgtgaacctatcagggctacag

SEQ ID NO: 26357 - DNA, 201 bp, Homo sapiens
  misc_feature (1)...(201): n = A,T,C or G, or insertion/deletion polymorphism (see Tables 1-2)
ctcctccatctaaccaactccctgtcttttcctggacgacccctgcccctcctgcagggccaccactcctcctggtgctgggttctggagggatgggaccncagtgggagggggaggggaagttctggctgactgcctcccagcccactccgcttctcagaacctccctggaacatctagccagaccctctggcccccttt

SEQ ID NO: 26358 - DNA, 201 bp, Homo sapiens
agagaatgttgtctgaggagtttgcagccctgtactagaatcctctccgggactcagtttccatttctcaggagtgggggcagccgcattggtggtttgargatgcaggggtgtggtgtgggaaatggttttggaacccagcaggtaggaggaaccgatgttccaggcccggctctggggcctcaggggagtgccctcacc

SEQ ID NO: 26359 - DNA, 201 bp, Homo sapiens
actctcgcccccagcaaacttcccgagtctggggaccctctactttgcttccccagaaccccaagcgggatacaaccccattcaaggcccagacccccggygtgccttctaggaccttccgtacctcttgaggctggaccccagcctgcttcccagaatctgtgacccccgcctagagaccaagaccccctgtgtgccctt

SEQ ID NO: 26360 - DNA, 201 bp, Homo sapiens
acagagtctccacacccaccaggacacccaggtaggtgggactgggaagctgcgggccggccaggcccgagctgcttctctcctggcacaactgggccccmaaatgggcaaggagcagaagctgggagttatagagtaaagccttctccacaagggacactctggggcctgggcctctgtgtcccagggaggggcacgcgt

SEQ ID NO: 26361 - DNA, 201 bp, Homo sapiens
ctggcttgcagttctccagcctcactgcctctggtgcttccctctccttgtgactctgtagccctcccagccccgtttctctttcttctccctttgccccyggggaaatggggcacccccttaaccgctcctccgacctccagcagagcccactggggacagcctcagcctggccctctttgcatttgcacttttcctctt

SEQ ID NO: 26362 - DNA, 201 bp, Homo sapiens
tcggggcagaggggagcctgatttgtgtgatgctgtcaacactgctgatttcaagctaccagtgtaactgatgtttctgaacccagaactgggagagatgcccgcagtcaggaacacaggcctcgagcgggctcctgcacacctggcaggggatgtgaagacccatccctacttctgggtgttccagttcttttgaggagg

SEQ ID NO: 26363 - DNA, 201 bp, Homo sapiens
ttcctgcagggaaccatcattgccctggtggtggtcatggccttcaggtgacttgtcccctgggctctcatggtggctgactaggggagtggagctgcccrgtggagtcagctgcccatgggctcaggcctgggggaagaggaggatgtagcttgggagatcaggcagctgaggtctcggtgaggtgggcctttctgcctc

SEQ ID NO: 26364 - DNA, 201 bp, Homo sapiens
  misc_feature (1)...(201): n = A,T,C or G, or insertion/deletion polymorphism (see Tables 1-2)
agccatgcagggagccagttcagtcgggcgggcagcgtcccccacaagaagaggccccccaaggtggccagcaaggtaggggtgagcagggatggcaggcnggttggaaagggggcctcccttgtggcctccctttctggcttgcagttctccagcctcactgcctctggtgcttccctctccttgtgactctgtagccct

SEQ ID NO: 26365 - DNA, 201 bp, Homo sapiens; identical to SEQ ID NO: 6398
  misc_feature (1)...(201): n = A,T,C or G, or insertion/deletion polymorphism (see Tables 1-2)

SEQ ID NO: 26366 - DNA, 201 bp, Homo sapiens
gctccgacagtcccccttgaccacggggctaccaggcatacagccctctttgctgctgggtgcgtgtctgggcaggtctgggtaggacagggaggttgctrtgttctgtctttggggcttctctggctcatacagcctctggcctcctcagtgaccaccagcctcaccagctcggccccaggttctgctgtccgcaccttg

SEQ ID NO: 26367 - DNA, 201 bp, Homo sapiens
  misc_feature (1)...(201): n = A,T,C or G, or insertion/deletion polymorphism (see Tables 1-2)
gtgcttccctctccttgtgactctgtagccctcccagccccgtttctctttcttctccctttgcccccggggaaatggggcacccccttaaccgctcctcngacctccagcagagcccactggggacagcctcagcctggccctctttgcatttgcacttttcctcttggtcctcagtcatcgtccgtggttccggaccag

SEQ ID NO: 26368 - DNA, 201 bp, Homo sapiens
  misc_feature (1)...(201): n = A,T,C or G, or insertion/deletion polymorphism (see Tables 1-2)
gcaggtgggacagcccaggtgaaggtgcagaggtggaggtgttgctcggagacaggcacaggagctgtgggagccgaggctggattggaggggcccgcccnggtagggagactttgagggcctcccagtggccaaggacagtggccgcccctcctgccccctgatgtctggcagcctggggctcccggggctgactgggcc

SEQ ID NO: 26369 - DNA, 201 bp, Homo sapiens
  misc_feature (1)...(201): n = A,T,C or G, or insertion/deletion polymorphism (see Tables 1-2)
gctaacaacatgcgtaagaagggcaagcccaacccggaccagaggtgagcaggtgggggccctgccccggagcccctccatttctgaggcaggaagacacngccctgggtggcacaccaggcacagagtcctacaggctgagccatttcacagatgagagacctgagatttagagcccttcattgacttaaggatgggaag

SEQ ID NO: 26370 - DNA, 201 bp, Homo sapiens
accaggtgcctcagctccaggtcccaaactaaactccctgcacacttgcctcccaccctgggctcccctctcagggaatggggcgcagggccttggttacmtgagccgcaaatctgggtcagggccctctttccccaacctcatcatgcatctggccttgctattgccctggaagatccctctacctggtccggtcctcgc

SEQ ID NO: 26371 - DNA, 201 bp, Homo sapiens
taggccagccccaggcctccctgagaaggtgatgactgccagggaggggcagctgggaaccaagtcagggagaagtgggcagatgggtgttttttcccccrgttcctccttccccacctcctccctctgcattccaggaaggtagccggaagctgagcccaagctgggccctcccggcagccccctccctagagggaggga

SEQ ID NO: 26372 - DNA, 201 bp, Homo sapiens
gctgagggctgggtgctgccctgtttcctggtgagctctagttgggccaggcctggctgagagggggcaggagggcaggaccagccgggtagccccatccygaggtgccactggcttcactccccacagctggaggccctgaaccagtccattaacatcgagcagtcccagtcagaccggagcaagcggcccttcaacccg

SEQ ID NO: 26373 - DNA, 201 bp, Homo sapiens
gaggcccagaggaggagcaggcctcagaggagatggggacggagggggacctttagatttgggttggattctcctggtccagcctgggggcaggaggtggrtaggatgaggtgaaaggctgcccctccttgggcaggtttgtgcctccctgcccaggcctctagtaggtggctgaccaacggccctcccacctagggtagg

SEQ ID NO: 26374 - DNA, 201 bp, Homo sapiens
gggcaccttaccctgactctgtgcctccttgcctccctgcctccctctcgccccgtttcctgctccagcctgtgattcccaagtctgcaaccccagtcaaracccatctcctgggccctctaccaggtgcctcagctccaggtcccaaactaaactccctgcacacttgcctcccaccctgggctcccctctcagggaatg

SEQ ID NO: 26375 - DNA, 201 bp, Homo sapiens
agacaacctggagacgcgcattgatgagctggagcgctggagccacaagctggccaagctgcggcggctcgacagcctcaagtccaccggcagctcgggcrccttcaggtaggggtgcggggtgggggaaggtgagacccttcttcccagggacacccctgatcctggccctcttgctgcagccatgcagggagccagttc

SEQ ID NO: 26376 - DNA, 201 bp, Homo sapiens
ccatggcagggattcgtgctccatctgatggagaaggaagccagggctcaggtcacttgctgagggtcatagccatcaagtgggaagtccacattagaaamcaggcctctttgactctggaggtctctctgggcatcgtggttatgcccaggtgggctgtcccttgactgctaccaccctggccctcagctgctgcctgaa

SEQ ID NO: 26377 - DNA, 201 bp, Homo sapiens
cagcctccttgacctctctagacctcagagccctcactcacatggtcaaggttgggtgatgttagcagttagatcccacgagtgccaaggcctggagtgagggggggaggggcaaagcccctgggtggggagtacagttgggtccggagccccctgccggcctagagtatggagggggctcccggacattctgtcctccct

SEQ ID NO: 26378 - DNA, 201 bp, Homo sapiens
  misc_feature (1)...(201): n = A,T,C or G, or insertion/deletion polymorphism (see Tables 1-2)
gagggacttaggagaaggtgaggatgtccctcggaggctctggagcacgtgtgcagcaaggcggaggggcctgggggagaggggacagcctgggcggaggngtgcaggcaggaaaggagatgggagtcctaagagagatggaaacagggcggttcaccctgactgcggaatggcctcctgggggtcacctcgtttaaggtt

SEQ ID NO: 26379 - DNA, 201 bp, Homo sapiens
gagatgctggttgggataagggcagcagtctgtcctgacccctctctcccttctctccagggcacctctcaccggtggccaataaccatcctgtccttccrtgaattcacctaccacttccgggtggcactgctggtgagcaggggcatcccacctaccctggaggtctgggcacccctgtctgcgacgtggggcttgagg

SEQ ID NO: 26380 - DNA, 201 bp, Homo sapiens
acggagggggacctttagatttgggttggattctcctggtccagcctgggggcaggaggtggctaggatgaggtgaaaggctgcccctccttgggcaggtktgtgcctccctgcccaggcctctagtaggtggctgaccaacggccctcccacctagggtaggtggggggcagcccccgggcttggctcaggacggggtgg

SEQ ID NO: 26381 - DNA, 201 bp, Homo sapiens
acgcacccttcggcggtaagtgggtggctggggaaggccgtgggtgcagcctgggtgcaggcttcccaggccgggcccacctcaccttagagggtgctcakgggtgccctggcccccaggtggccaagagcagaaccaccgcgggagcaggctccccgcagtccggattggggtcaagagttctgtttatcttaccaaaaa

SEQ ID NO: 26382 - DNA, 201 bp, Homo sapiens
  misc_feature (1)...(201): n = A,T,C or G, or insertion/deletion polymorphism (see Tables 1-2)
actgccccccaagtgccctgtaggtctgaggggatcctgggcggtcccctacccacaattcggccccaggccctgccaggcaccccaatgtgggtggtgcngagaaatgcccctaagggtggatgtgacgaaacctcagtgtcgccagcttctggggggctgtgggaccctaccacgcagagaagctgcccagctggaagg

SEQ ID NO: 26383 - DNA, 201 bp, Homo sapiens
gattgtactgaggatggggctaatgaaatactttgatgtgcccagagcatagtgggtgagggaacccagcacaacaggactgggaaggaggcaggggccasgtggaggtggctgtggacctgccagtcccgggcacggtctgcatggagtagctgccattgctccttctgccaaagcagaacatgctccttcctatctctt

SEQ ID NO: 26384 - DNA, 201 bp, Homo sapiens
gggcccggggctgtgctcttacccagaccccagtgattttgcagctgtctcatggaaccctcaggtttctgaggagtcttcttcctagacccaagcccccsactctgactcaacctgcacgattgtcttttcatctgttttacatgtggagattccatgaaaggtttagttcaaaggaaggttctgctgtcaaaacatttt

SEQ ID NO: 26385 - DNA, 201 bp, Homo sapiens
acctgctgaatgccctgaggcccagccccctagggccctgtgtttccaggaagctgtggggcttcagtgggtgcaggaagagagaagaagtcctggccttyggtctggggcgggagtctttgagtccctgtgccatcatcaaggacactagtaactgccccccaagtgccctgtaggtctgaggggatcctgggcggtccc

SEQ ID NO: 26386 - DNA, 201 bp, Homo sapiens
actggattgtactgaggatggggctaatgaaatactttgatgtgcccagagcatagtgggtgagggaacccagcacaacaggactgggaaggaggcagggsccaggtggaggtggctgtggacctgccagtcccgggcacggtctgcatggagtagctgccattgctccttctgccaaagcagaacatgctccttcctatc

SEQ ID NO: 26387 - DNA, 201 bp, Homo sapiens
ccagcactttggaaggccaaggtaggcatattgcttgagcccaggagttcaagaccagtctgcaacatgatgaaaccccatctctacaaaaaatacaaaamttagctgggtgtggtggcgtgtgcctatagtcccagctactcgagaggctgaggtgagagaatagtttgagccagggaggtcgaggctacagtgagctgt

SEQ ID NO: 26388 - DNA, 201 bp, Homo sapiens
  misc_feature (1)...(201): n = A,T,C or G, or insertion/deletion polymorphism (see Tables 1-2)
ctctatagtgagggagaaaagacgtgcagaaagcacctgcaacagaggtgggggtgcttctgagggaggcccgagccctgtcgccctgcagaagagacagngtccaagacagagggagagcccagctagacacacagcagacatggtgctcgggcctgaaaccacatcacagacgcacagccaaagcctcaggtagatggg

SEQ ID NO: 26389 - DNA, 201 bp, Homo sapiens
  misc_feature (1)...(201): n = A,T,C or G, or insertion/deletion polymorphism (see Tables 1-2)
gtgcccactgctgtatcatgtgcctatgattgcgtgagctcatcagccttcctgggtatccagctcctgggagaccccacaaggagccctggccactgctnccgtcaggattttaatggcacactgaggctcagagagggaaaggggcttgtccagagccacacagggactctgtgggcagggccactccaggaagggacc

SEQ ID NO: 26390 - DNA, 201 bp, Homo sapiens
  misc_feature (1)...(201): n = A,T,C or G, or insertion/deletion polymorphism (see Tables 1-2)
agcatgggagtgatgagggctgacgtaagtgctagaaaaatctcgatgctgtgtggagagtggacaggaagcggcgggactggaggctgtgactgtttacnttcatgggaacacctgcatacccgtgcacgcgcgccaagcccacccacttacgcatccagctgacgtgtactgtggccacaggagctggcccatggctca

SEQ ID NO: 26391 - DNA, 201 bp, Homo sapiens
gactggctgtgcgtgggcaggtgagggaagggaggatgagtccaggtcaaggggggactcctgggctttgttctgaggcagtgggcagccacaaagcttcyaagcatgggagtgatgagggctgacgtaagtgctagaaaaatctcgatgctgtgtggagagtggacaggaagcggcgggactggaggctgtgactgttta

SEQ ID NO: 26392 - DNA, 201 bp, Homo sapiens
gccatactctttgggccacccttgccaccccaggccccaaggccaggaagcttggcagctgcagccccggaagtggcccaggcacttcctgggtgctttgmtaggtcaggcaggtgggtggagctccaggagggaagaggtggtgagcccaggcctttggcaacactggccaggcccagaggcctcttcccacaagtttgg

SEQ ID NO: 26393 - DNA, 201 bp, Homo sapiens
tgttcctcacccactaccaaccctaccactggtcctagtcttggccccagctttaaccctggccatgttctcagcccaagtcccagccccagcaccaaccrctcaggtaaggctttctgtgggctggggcttggggcgggggctacctgcgtagagagaaaggcccaaatactcattgatgggagggtctcctggagccta

SEQ ID NO: 26394 - DNA, 201 bp, Homo sapiens
catcaaggtcctggagcagggcctgggagcactcatttcacagaagagcaaacaggctcagggaagagccaggactggcagtcagggctcctgactcctakgccagccccaggcctccctgagaaggtgatgactgccagggaggggcagctgggaaccaagtcagggagaagtgggcagatgggtgttttttcccccggt

SEQ ID NO: 26395 - DNA, 201 bp, Homo sapiens
  misc_feature (1)...(201): n = A,T,C or G, or insertion/deletion polymorphism (see Tables 1-2)
ccaggcctcctgcaggacagtgacagcctcagtggctcctacctggaccccaactaccagtccatcaagtggcagcctcatcagcagaacaagtgggcgancctgtacgatgctaactacaaggagctgtgagtgccctacaacactccccactcctccaggcccccccaccttgggacgccccagcccaggaccccatca

SEQ ID NO: 26396 - DNA, 201 bp, Homo sapiens
tcttgcctgaggctgtgaaagacaccggagacatggtctttgccaatgggaaaaccatagagaacttcctggtggtgaacaaggtctgtgggtgggggaawgggagggagcccagaggcaagtggggagccagctggggaacactcatcacctccatagatactgggggcactgcaaagcagaggcaggagcaccctcggc

SEQ ID NO: 26397 - DNA, 201 bp, Homo sapiens
  misc_feature (1)...(201): n = A,T,C or G, or insertion/deletion polymorphism (see Tables 1-2)
accagaaggggaaggagtgccgtgcggaagctccccttccctggtttttgtggcccaggccctctgtggcttgtttctgatcacagggcctgctctccatngagcccccactataaagggtgaccttgagtgtgacactgcaggcagggacaaactcattcattcctcaagcgattgctgtgattctgtaagccagccctg

SEQ ID NO: 26398 - DNA, 201 bp, Homo sapiens
ggaggggctcggggagagccagcccccacggcgcacacttctgtttccccaggctccctacacacccctccaagaagaggaagcactctgaatcccccccsagcaccctcaatgcccagatgctgaatggaatgatcaaacaggagcctgggaccgtgacagccctgcctctgcaccccactcgagccccatcgccaccct

SEQ ID NO: 26399 - DNA, 201 bp, Homo sapiens
ggcacagggcctgcagagaggggacccaccgggcaggatgcactggcttccagcaggtaaccgggccatggtataagggggctttggactccagagccagkgcaggcacgggacagggcagtgtctgagaatcctgccaggacctcagagttctggtgcaggctggaccactgagagtggggtgaccgtctgtgcctggca

SEQ ID NO: 26400 - DNA, 201 bp, Homo sapiens
gtccagcgtgggccctgctgagcccacctgggcccagggccagtcaggtacttgctgcacccctgacactacccagcccagcctggcaaggctcactggcmagggcccacctcagcccagtcatgtgactgtctgggttcagacttgtcagtcaatagacgtttgctgagcacagaataaggatcaggaatcaggcctgca

SEQ ID NO: 26401 - DNA, 201 bp, Homo sapiens
caggtggtacgtgatcatgcgcatgtcagtggatacctgactgcagggtgtgcccttacatatatgtgtgtgtgttggcagtgtgcctgcgtggggccacrccggtgtgtaggcacagatgggcacaggtgaccctggtggagacctgtgtccaccccaagctgcagggtctctacctggcacctggtggcctgcctgccc

SEQ ID NO: 26402 - DNA, 201 bp, Homo sapiens
tcactgctgtagccccaaagctgggcactatgcttgcctggcacataacaggtgctcagtaaataactgctgaatgaatgaaggcacacggatgaacgctkgtgtgcgcatgtgtgtgggtatatgtgtggggcatgccactgtgtgtcagtactgtgtatgtgtgagtagggggcaggtggtacgtgatcatgcgcatgt

SEQ ID NO: 26403 - DNA, 201 bp, Homo sapiens
  misc_feature (1)...(201): n = A,T,C or G, or insertion/deletion polymorphism (see Tables 1-2)
ggaagaagaggaggtgggagctcttcctgggtggccactaacctaacccatgcatgtgacgctgtgcctgtgggcctgggcctgtcgtcgggtcagtgagngtttgtgtacatgcgtgtcctggcatatacacctgtgaagtgtgctgaggtgtgaacatgcacaggcatgctcgtacctcagggcttttgcaccggctgt

SEQ ID NO: 26404 - DNA, 201 bp, Homo sapiens
  misc_feature (1)...(201): n = A,T,C or G, or insertion/deletion polymorphism (see Tables 1-2)
gcagccgccggagtgcacaaccacagcctctgtctctcctttgtggagtttgaggatcctatctccctccggcctccctcactcccctctcttctccctcnatggctggggcaaggggatccccatcccctgccctgctagcttggaggagggaagttgtgcctgtgacactgagttcactcagtggggcctggctccagc

SEQ ID NO: 26405 - DNA, 201 bp, Homo sapiens
agtaagggcagggagtagggggatacagcggcataggggcaggcagggagcagggctgtggccgtgacctgggaggtgctagacactggcctggcatgggwtgggctgggtgactggctgtgcgtgggcaggtgagggaagggaggatgagtccaggtcaaggggggactcctgggctttgttctgaggcagtgggcagcc

SEQ ID NO: 26406 - DNA, 201 bp, Homo sapiens
tagagtatggagggggctcccggacattctgtcctccctgtgccccaggtcgcatcagtgagggaagttctccctccagctgaccggggtccgtgcagccyccggagtgcacaaccacagcctctgtctctcctttgtggagtttgaggatcctatctccctccggcctccctcactcccctctcttctccctccatggct

SEQ ID NO: 26407 - DNA, 201 bp, Homo sapiens
gtcctccattatcggggttgacgcatctcccacgtcagcccccttatcaccccgccctctggctccccctgcaaggtgaccctgggaggggaaaggccggyacctcccccgtcctccctcatgatgcccaagagccctggctgcctttcctctaggggcccctccccttggtggggccggggccagcgcagagggcccagg

SEQ ID NO: 26408 - DNA, 201 bp, Homo sapiens
gagtccctggtgggggtggggggtggcagggtaccctcaggctaaggtgccagttttgcccctgcaggcctgggaacttcacctaccacatccctgtcagyagtggcaccccactgcacctcagcctgactctgcagatgaagtgagtgccggtgtggggaagtgggaggcaggaggggagccagggagaatctcccgcag

SEQ ID NO: 26409 - DNA, 201 bp, Homo sapiens
  misc_feature (1)...(201): n = A,T,C or G, or insertion/deletion polymorphism (see Tables 1-2)
tgaacactccattggtccatggcaggtgttctgcgccctaccttgaagattactggtccccagggtaggtcagtgcccctaagcttagggggcttgttgancatgttctgtggttctgtgtgcaaggcctgaaccatgacagctctggcccagcgtggcctggtcctggtccctggcacatccagtggggcccgccccacc

SEQ ID NO: 26410 - DNA, 201 bp, Homo sapiens
aaaagaaataaagtaaagaaactcctgtgattattaatgtatttgattcacaaaatgcctggcacacagtaggcactcagtaaatgggacccgtggttacrgcagggtggggcttgagcagaggcagggtcctggaacccaggcacacagactggccacgcccagctcgagaagctgctcttgccccggccacaccgccct

SEQ ID NO: 26411 - DNA, 201 bp, Homo sapiens
  misc_feature (1)...(201): n = A,T,C or G, or insertion/deletion polymorphism (see Tables 1-2)
gtcccagggtttctggggtgattaggtaagattgtgcctggcctggtgaacactccattggtccatggcaggtgttctgcgccctaccttgaagattactngtccccagggtaggtcagtgcccctaagcttagggggcttgttgagcatgttctgtggttctgtgtgcaaggcctgaaccatgacagctctggcccagcg

SEQ ID NO: 26412 - DNA, 201 bp, Homo sapiens
ttgacctctctgaacaggggatggtgattatgttacctatctgaacatccccactgtttagagagggaaaatgcataaagcacttagaatcgtccctggcstggtaggcagtcagtgtgagctgcagtcactgtcaccaccactgtctttgtcatcatcgccatgatgagttgagaagcactgggagatactcactatgag

SEQ ID NO: 26413 - DNA, 201 bp, Homo sapiens
  misc_feature (1)...(201): n = A,T,C or G, or insertion/deletion polymorphism (see Tables 1-2)
acctcagcccagtcatgtgactgtctgggttcagacttgtcagtcaatagacgtttgctgagcacagaataaggatcaggaatcaggcctgcagccttacntagatcatcccatttagtcctcacagcactcctgcaagaaaggaattgttgttcctattgttcagctgaagaaatgggatggagactaaggtgaagtgac

SEQ ID NO: 26414 - DNA, 201 bp, Homo sapiens
gaccacttggagtttagtgggcctctgcccggcctctggagccccaccagggctggaggagggaggcctgggatttcgccccttctgaagctgatgggtgyctggactggtgacttccttctctggcctcattcccctcccagggtaagtaagtgggttggaccagagcaggggcttccaatgtgattttttaaccatcaa

SEQ ID NO: 26415 - DNA, 201 bp, Homo sapiens
  misc_feature (1)...(201): n = A,T,C or G, or insertion/deletion polymorphism (see Tables 1-2)
ggtcagcgttcctcaggaggccctccgagcccccaaccctcaaacttcttccccacccactggcctccccgcaacgctgccccatcagttccctcctcccncctccttcctccatcctccgtccgcccggaccctggcacgggagggtccctcctcccccaaagcacatctggttctcgttagggtctcccaggatgcctc

SEQ ID NO: 26416 - DNA, 201 bp, Homo sapiens
tatatcccagagagacagaacagggcagcgctcatagcccagtgcctgcccctgtaagctatgggcacatgcccatcctttctgagcctcagtttcctcakctataaaatgaagaaaaagaaaatcacctaccttgtaggttgggatgagaattcaatatgagccatgtaaagtgcatggcacagggctgggcacagagtg

SEQ ID NO: 26417 - DNA, 201 bp, Homo sapiens
gaggggtctctgtaggcagcctgtgggggctcttctgcatttttggtaagaagctgggagagaacaaagactactgtgactcagatcgaagaacctgataraaaaacggctcaagagccccatctttgtcaggtgtggctgctgggcccaagctaactgagatttgatgcggagaggcaaagggttgcttgcacaagcaaa

SEQ ID NO: 26418 - DNA, 201 bp, Homo sapiens
  misc_feature (1)...(201): n = A,T,C or G, or insertion/deletion polymorphism (see Tables 1-2)
gttcccctgagaggaccaagagacacatggggttcactcagtcttgtggggccctagagacagctggacaggaagcagccagcttccagcttcttagcctntgcctggttctatccacaggccccagccagatggcccttctgccagtcaccaacatcagagccaagtcctggggtctttcagtcaatggcattggccact

SEQ ID NO: 26419 - DNA, 201 bp, Homo sapiens
tcccagctccttgggaggctgaggtgggagaatcacttgaactcaggaggcggaagttgcagtgagccaagattgtgccactgcactccagcctgggcaayagagtgaaactttgtctcaaaaagaaaggtaaaaaaaaaagagaggggtctctgtaggcagcctgtgggggctcttctgcatttttggtaagaagctggg

SEQ ID NO: 26420 - DNA, 201 bp, Homo sapiens
agtatggagggggctcccggacattctgtcctccctgtgccccaggtcgcatcagtgagggaagttctccctccagctgaccggggtccgtgcagccgccrgagtgcacaaccacagcctctgtctctcctttgtggagtttgaggatcctatctccctccggcctccctcactcccctctcttctccctccatggctggg

SEQ ID NO: 26421 - DNA, 201 bp, Homo sapiens
aggagatcttgcctgaggctgtgaaagacaccggagacatggtctttgccaatgggaaaaccatagagaacttcctggtggtgaacaaggtctgtgggtgsgggaatgggagggagcccagaggcaagtggggagccagctggggaacactcatcacctccatagatactgggggcactgcaaagcagaggcaggagcacc

SEQ ID NO: 26422 - DNA, 201 bp, Homo sapiens
agactggaaggctggacagagtgctccttggggtcttaagtagagccaaggagggcatttgagggcagaatggccttttccctgggggcctgactccccamttaccaactcccaaggggttacagactggagggccctggcagcagaggctgctgggtaacagcccagcagagctgctcattggctgccacccttggactt

SEQ ID NO: 26423 - DNA, 201 bp, Homo sapiens
cagccacccggccagccagactccagggcagctcccggggcacatgctcacagcgggaggctgggagcatgggtctgcaggggagctcagggcaaatgtakgggcccctgtctctgggtggaagagcattaaaacactaggtgcatgaactctgtgttcagacagcctggctccaacttcagcttccccatttatcagccg

SEQ ID NO: 26424 - DNA, 201 bp, Homo sapiens
catttctttttaattgtctggctcacttctagtccctaactaaatgctcactcaagagttttagcttgaatgtcaaatgtcaaaaaattaattgggtgatytttctccatttctaggataagaagaaagagaagaaatgaagtgaccatccagcctttcccaattagacttcctctccttccacccctcatttcctttttg

SEQ ID NO: 26425 - DNA, 201 bp, Homo sapiens
cttagcctcccaaagtgttaggatgacaggcgtgagccatagtaccctgcctcctggcttttttttttttttttttttttaagatggagtctcaccctgtkgccaggctggagtgcagtggcgagatctcagctcattgcaatctctgcctcccaggttcaagcgattccccttcctcagcctcccaagtagctgggacta

SEQ ID NO: 26426 - DNA, 201 bp, Homo sapiens
taaatgtagaccgtatacctgtagcccttaatctaatggtctttttttctaacagcatccttcccactgctttcatgggcacggcaatgatctttacctgyttcaccctcagtgcactctatgccaggcgccgtagctacctctttctgggaggtaagtgtgaactgggaaacagggaatgggggctcctttttagccaga

SEQ ID NO: 26427 - DNA, 201 bp, Homo sapiens
atggggtcttaccatatgcccagattggtctcaagcagtcctcttgccttggtttcccaaagtgttgggattacaggcttaagccaccatgcccagccacttttttttttttttttttttttttgagacagttttgctttgtcacccaggctggagtgcggtggcaacatctcagctcactgcaacctccgcctcctgggt

SEQ ID NO: 26428 - DNA, 201 bp, Homo sapiens
taatctttccctttccttgtgggttgatgtgtgaggattgaaggtgatacatatataaaagcaccttaaaagttataaattttatataaatatagtcaggrgtattagtatagaaggtactactgctggcctgacgagtttcattttatttcgtaaactgcccaagggtattaattttctctagagaaaccattgaatatt

SEQ ID NO: 26429 - DNA, 201 bp, Homo sapiens; identical to SEQ ID NO: 6439

SEQ ID NO: 26430 - DNA, 201 bp, Homo sapiens
atgattgcaaatatattgtaggacacataaaaataaaaatggttgtgttagggctgtagaattttaggcaagttttcatctttctgaacttacatgttgcttttttttttttttataagctgttcgtgtgattctgtatgacttaatgactctaacctttctttattctgcagagtggagactgctgcacggactctggaa

SEQ ID NO: 26431 - DNA, 201 bp, Homo sapiens
gccctgccctggagttttgtattgctgtcaaccccaggtaactcttttggtagtgtcttatgtgcttttatctttatgaatataccttctaaatgtagacsgtatacctgtagcccttaatctaatggtctttttttctaacagcatccttcccactgctttcatgggcacggcaatgatctttacctgcttcaccctcag

SEQ ID NO: 26432 - DNA, 201 bp, Homo sapiens
taaaaatgtttgcaaaacatttgaattagaacagcttgttctgagtgacagtctaatatacgtaggagaaattttagaaaggaagagatttagggattaaratttttgcatcagggcaagctagtttttgaaggcattaaggggtggaattatcagaaggaaagaggaaagtaattagaacgaaagaaatgttagagctgg

SEQ ID NO: 26433 - DNA, 201 bp, Homo sapiens
cctcatgatccgcccgtctcggcctcctaaaatgctaggattacaggcatgagccaccgtgcctggccctttttttcctttttttttgagacagtgtctcygtctgtcacccaggctagagagtgcagtggcgtgatcttggctcactgcaaactctgccttccgggttcaagcgattctcctgcctcagcctcccaaata

SEQ ID NO: 26434 - DNA, 201 bp, Homo sapiens
tcccaggaagggaaagagagaaatgattcttcttagcttaaatatgagattgatctgggactgattgctcttattcacattcttttcttagaaccccgtcracgcagcagcacctgaagaaggtctatgcaagttttgccctttgtatgtttgtggcggctgcaggggcctatgtccatatggtcactcatttcattcagg

SEQ ID NO: 26435 - DNA, 201 bp, Homo sapiens; identical to SEQ ID NO: 6437

SEQ ID NO: 26436 - DNA, 201 bp, Homo sapiens
actttgctgattctcaaaaaaagaaaggcacagctcttctagaattgtcataaaggaaacaagactcaagctatgtaataaaaatgtttgcaaaacatttraattagaacagcttgttctgagtgacagtctaatatacgtaggagaaattttagaaaggaagagatttagggattaaaatttttgcatcagggcaagcta

SEQ ID NO: 26437 - DNA, 201 bp, Homo sapiens
cgtgatcttggctcactgcaaactctgccttccgggttcaagcgattctcctgcctcagcctcccaaatagctgggattacaggcatgtgccaccatgccyggctaatttttgtatttttagtagagatggggttttaccatgttggccaggatggtgttgatctcttgacctagtgatccacccaccttagcctcccaaa

SEQ ID NO: 26438 - DNA, 201 bp, Homo sapiens
cggcaactgctttgctaacagaaaaaagtaaaaaaaaacttacaggaaacctcattctgagcacacctcaccagttcagaagcatcctaaggaataaaagggggggggggggcggaatttatgtaaaaagagtattatatggtaaatttttgtcctgaattaaattaactggttgtttaaagaaagaaatatttgtaataa

SEQ ID NO: 26439 - DNA, 201 bp, Homo sapiens
tgtactgcatttcttttcatatctctttgtcccttttctgcatttataacttttgtgtgtataagctaacaaattaacttggccagaatccagaggacctratgaaaatgtccagattctacacgttgctgtgtggttattggaaaggcatttattctagtttgggtactgattattcataattttgggcatttggtcttc

SEQ ID NO: 26440 - DNA, 201 bp, Homo sapiens
aggcagcccacctcggcactcctggggtgggggtggggacagctgcttaacctttattcttggtcggtctgtcggcaactttgggaaccaccagtaggatrtggttaagattcagttcttgctgagctaaggaagcatttctcatttctttttaattgtctggctcacttctagtccctaactaaatgctcactcaagagt

SEQ ID NO: 26441 - DNA, 201 bp, Homo sapiens; identical to SEQ ID NO: 6435

SEQ ID NO: 26442 - DNA, 201 bp, Homo sapiens
ttgtggataaaaaagtctgaagtacagatcctaatctggttcttgcctttcaggcactgcattgatctcttcttagatttcattactgtcttcagaaaacycatgatgatcctggccatgaatgaaaaggttagttagcctacaacccaaagatgagacaataatggctcctgagcttggcatgtgtgtatacttcagatt

SEQ ID NO: 26443 - DNA, 201 bp, Homo sapiens
ggagagagatttaattctttagtccacgtttgttaagagcatgagtatgcctatatttcgggatcagcttttggatgaggatcctattcaagaattgatcrtaatactgtgttctgggttttctgttttctaggagttggcctgggccctgccctggagttttgtattgctgtcaaccccaggtaactcttttggtagtgt

SEQ ID NO: 26444 - DNA, 201 bp, Homo sapiens
tttctcatatgtaagtgttttgaccttgactggttttgtactgcatttcttttcatatctctttgtcccttttctgcatttataacttttgtgtgtataasctaacaaattaacttggccagaatccagaggacctgatgaaaatgtccagattctacacgttgctgtgtggttattggaaaggcatttattctagtttgg

SEQ ID NO: 26445 - DNA, 201 bp, Homo sapiens
actcatttcattcaggtaagaacgattttctctcctggttgctgtggtacaaattacattaggaaaaaaccagctcagcaaggtggtccaagggaccctgytcctctctttaatctttatcagtagtttaggatttaaactcagacattaaatcaggacatgtaaagccattttaattttctggcaactgtgccccctcta

SEQ ID NO: 26446 - DNA, 201 bp, Homo sapiens
ttactgccttttaaagtggcaaatcacctgaaagaatagaaatcagatgatagtaacaaaatagtttgagggagaagaagatgcattcaattcctctgtcstctttaagatggttgactatgattgcaaatatattgtaggacacataaaaataaaaatggttgtgttagggctgtagaattttaggcaagttttcatctt

SEQ ID NO: 26447 - DNA, 201 bp, Homo sapiens
ctttatgaatataccttctaaatgtagaccgtatacctgtagcccttaatctaatggtctttttttctaacagcatccttcccactgctttcatgggcacrgcaatgatctttacctgcttcaccctcagtgcactctatgccaggcgccgtagctacctctttctgggaggtaagtgtgaactgggaaacagggaatggg

SEQ ID NO: 26448 - DNA, 201 bp, Homo sapiens
ctaatttttgtatttttagtagagacgggcttttgccaagttgtccagcctggtctcgaactccacacctcaagcgattcgcccgccttgacctcccaaawtgctaggattacaggtgtaatcctttcctaaagaaaaagagtcatctctcctgaagaataagaaaaggtaaaattaatctagatacttagcattttcaag

SEQ ID NO: 26449 - DNA, 201 bp, Homo sapiens
caggcacctgccaccacacccggctaatattttgcatttttagtagagacggggtttcatcgtgttagccaggatggtcttgatctcctgacctcatgatycgcccgtctcggcctcctaaaatgctaggattacaggcatgagccaccgtgcctggccctttttttcctttttttttgagacagtgtctccgtctgtcac

SEQ ID NO: 26450 - DNA, 201 bp, Homo sapiens
gttattactagagttatagaataagtcttgatatcccattgtttttttttttttttgagacagagtttcactcttgttgtccaggctggagtgcaatggcrtgatctcggctcactgcaacctctgcctcctgggttcagcgattcttgtgcttcagcctcccgagtagctgggattacaggcatgcagcaccatgactgg

SEQ ID NO: 26451 - DNA, 201 bp, Homo sapiens
acatttaatgtaaattgattcatgcattatgtatattcttgtgtctggagtatttcatttatcatgcttttgaagttctttcatggcatagccagtagttkgttcctttttattggcaaataacttccctggctgggcacagtggctcatgcctgcaatcctagcacttggggaggctgaggcaggaagattgcttgaacc

SEQ ID NO: 26452 - DNA, 201 bp, Homo sapiens
ggatagaaatctaggagtggaattgttaggtgatatggtagttttatgttgagctttttgagaaactgagggagtggattcagaaggaacacaaaagaagmgaccctaagtagtgacttggtggccttgtctttgtaacctgccaggtaatcctcacagccagaacatcagcagcaagctcacccatgacactgtggagca

SEQ ID NO: 26453 - DNA, 201 bp, Homo sapiens; identical to SEQ ID NO: 6487

SEQ ID NO: 26454 - DNA, 201 bp, Homo sapiens
ctctgggggtggggggctggttcttgggcaaatggagttatgttcccaggggaattatggctgtttctgctgtgtcaaataggtctccagagacatggggraaagctggcattgaaagacctcacccagctcccacacagccagcaaggccagtctcactcccactgtgcctccccagcagcactgaggtttctgtacagg

SEQ ID NO: 26455 - DNA, 201 bp, Homo sapiens
aaaagtctgttttgattatccagggcacaggccacagtagagctgatgaagttaggtgttacatggcaggcatgatgaattattatagtggtacaattatytgccatcctccccctacttactctttttggttgctttaatcagtgatgagaatggaaaggaggaattattctcactgaaggatctcagcttgcgttttcg

SEQ ID NO: 26456 - DNA, 201 bp, Homo sapiens
aagttcactgggaagattgaacttactgcgggtccctattttgccattttctcacattgttactttgtttttagagagcatctttggatctctccaacccrtttgtagtgaggaagggagtctatgcccagtgatcctgggtatgagaaggtgctcctctcctcccatgtacatgatggtgtgggtttatgctcaggggcc

SEQ ID NO: 26457 - DNA, 201 bp, Homo sapiens
aacagtatctggcaaataatttccaggttgtccttaaaattattaacacaatttccaatcacacaatttcaagttagttcaaatgtgaaagtgatactgtkttgctattagagttgccaaaactaaaagcaatgtaaacaggttgattactacttaaaccttgttatgttagagctgagcagaaagcaccaaggagagaaa

SEQ ID NO: 26458 - DNA, 201 bp, Homo sapiens
ttgcactccagtgcctgggtgacagagcaagactccatccccgtccaaccaaagaaaaaaaaaaagaagaagccgggcacggtggctcatgcctgtaatcmcagcactttgggaggccgaggtgggcgagtcacctgaggtcaggagttcatgaccagcctgaccaacatggagaaaccctctctctactgaaaatataaa

SEQ ID NO: 26459 - DNA, 201 bp, Homo sapiens
gagggaggagaagaaatagagagggagagggaggctcagaacacaaacacagctccagatagaatatttggtcctatggaacgctgtggctccatttgttygggtgtctgacccggatccagcaccaaggtttgtccaggactgctccatgcactgtgctgacctgtgaccaacaccaggcagccgggctcggagactgag

SEQ ID NO: 26460 - DNA, 201 bp, Homo sapiens
aatggccccttgagattgatattggtcccaatttacagttgagcaaaatgagatccagaaagtggtcccctgcaggtagagagctgaactatgtcccagaygcacagcacatattaatgttgcagttctgttttcctgggttaattttaaaattaacaaaatttattttgccgaactgtttccaatgtctctatgagaaag

SEQ ID NO: 26461 - DNA, 201 bp, Homo sapiens
tgaactatgtcccagacgcacagcacatattaatgttgcagttctgttttcctgggttaattttaaaattaacaaaatttattttgccgaactgtttccartgtctctatgagaaaggggtcactctggctgatgcacttccctcttatcctaggctggtcatgtctgtggggacaatatggacctcatagatgggcagcc

SEQ ID NO: 26462 - DNA, 201 bp, Homo sapiens
gagtctattgattagttgtaatatcaggtcaatggtaattcctaattttgatggttgtactggggttatgtcagagagtgtccttatacttagaatatgtrcagtagagtattatggggatgatgagacattattttgcaacttattctcaaatgatttagaaaagtcaacaatcagaattggagtgaaacgtttatggga

SEQ ID NO: 26463 - DNA, 201 bp, Homo sapiens
aatcccagctactcaggaggctgaggcaggagaatagcttaaacccaggaggcagaggttgcaatgggctgagattgcaccactacactccagcctgggcracagagcaagactccatcttaaaaacaaacaaacaaacaaacaaattaaaaaacagcaaaaaaagagcaatggctggagccagctgggaaaggaggcttg

SEQ ID NO: 26464 - DNA, 201 bp, Homo sapiens
tggcgtgatctcggctcactgcaacctctgcctcctgggttcagcgattcttgtgcttcagcctcccgagtagctgggattacaggcatgcagcaccatgmctggctgattttgtatttttagtagagacagggtttctccgtgttggtaaggctggtctcgaactcccgacctcaggtgatctgcccaccttggcatccc

SEQ ID NO: 26465 - DNA, 201 bp, Homo sapiens
atccttatcttgtgccagttttcaagggaagggcttgcagcttttgcccattcagtatgatgttgggtgtagttttgtcatagatgggtcttgttattttkatgtatgttccttggattcctagtttgttgggagtttttaacagaagggatgctgaattttgttataagccttttctgtgtctattgagatgatcatgtg

SEQ ID NO: 26466 - DNA, 201 bp, Homo sapiens
ttcattttttttagagacagggtcttgctatgttgatcaggctggtcttgaactccttgcctcaagtgatccccctgcctcaacctcccaaagtgctggcrttacagacataagccactgcgcccagctctactcactttattttattttatttatttatttatttatttatttatttatttatttatttatttatttttg

SEQ ID NO: 26467 - DNA, 201 bp, Homo sapiens; identical to SEQ ID NO: 6492

SEQ ID NO: 26468 - DNA, 201 bp, Homo sapiens
caattagagatgagatttaggtggagacataaagccaaaccacatcaacagctaagcctaaaatctaaagctcattatataccacgaaatgcacatggatygttttgaccacagcttgacctgttctccttaccccgtggttataggtttgaagatggcaccatctcattccttgatgttatcgcgctaaaacatggattt

SEQ ID NO: 26469 - DNA, 201 bp, Homo sapiens
acttaccattttaactatttttaagtgtacaactcagtcgtagtaaatacattcacaatgtcgtgccaccatcaccactatctatttccagaactttaccrtaccaaacagaaactctgtacccattaaacaataactctctatttcctcctccccttccaacccttggaactacttttttttctctgtggatttgcctat

SEQ ID NO: 26470 - DNA, 201 bp, Homo sapiens
aaccaaatgttactcccagagcagcactgtggggaatggattcaatcgttgggtgtttggaagacggtgctggtttttccttgaaagcacatctgcatccmcatttttatttatttttttgaggtggggtctcgctctttcacccaggctggcatgcaatggcatgatcttggctcactgcaacctccacctcttgggttc

SEQ ID NO: 26471 - DNA, 201 bp, Homo sapiens
agcctttcctcaatgtgggcctctgtttctgaacttgggcccttctcacaattacatgaagctgcttctattgctccacagctgaacttctataccagaayggtcaacccaaagaacatcatctccattagtttaggatctcaccatcttgcaaaagcaggatggggcgacaaggcttggcatctgtggtaggtgaaccca

SEQ ID NO: 26472 - DNA, 201 bp, Homo sapiens
tgggaggcgtggcgggggcggagtcgccgggggccggcttcgcgcacttcccgggcccggccagcctggatggactagccggggccatggccggcgcggcrgcggagtcagggcgggagctgtggaccttcgcgggttcccgggacccgagcgcaccgcggctagcctacggctacggcccgggcagcctgcgcgagctgc

SEQ ID NO: 26473 - DNA, 201 bp, Homo sapiens; identical to SEQ ID NO: 6495

SEQ ID NO: 26474 - DNA, 201 bp, Homo sapiens
aaatccgcaggtggacaaaatggccagtctttacaacatccacctgcgaactggctgcttctgtaacactggggcctgccagaggcacctgggcataagcracgagatggtcaggaagcattttcaggttggtacagggctctgcgatccagacgctggtcagcgagacccagcaacacctgttgctgcctgcgtgtctgg

SEQ ID NO: 26475 - DNA, 201 bp, Homo sapiens
ttttgcctcacagctctttagattctttccttcatcttgactttagctaacctgatgactatgtgcctaggtaataatccttttgctatgaatttcccagrtgttctttaagctttttatatgtggatgtctagatctctagtgagatcagagaagttttccttgattattccctcaaataagttttccaaagttttagat

SEQ ID NO: 26476 - DNA, 201 bp, Homo sapiens
tagtcacaaattttgtcagcatttctttttctaaaaacgactttatctttccttcatttatgaagctttgtttcactggatgcaaaattcttggctgatawttattttgtttaaggaggctgaagataggaccccaatcccttctgacttgcaaggtttctgctgagaaatctgctgttaatctgttaggttttccttttg

SEQ ID NO: 26477 - DNA, 201 bp, Homo sapiens
tattctgtgatgtcagcttttgatacctatacccacctaactggtggttttaattttttccatcagcagactctgtcaaatttaattttaccttttatggytttttttttttcttttagagaaacacaccaccaggaagaacatttgtaccttatcttccgggtcttcgaaaaagccagcatctttttggggaaacagttt

SEQ ID NO: 26478 - DNA, 201 bp, Homo sapiens
caggagtatcgcttgagccccagaggtggaggctgcagtgagcccagatcgcaccactgcactccagcttgggcaacagagggtgatgatgtctcaaaagaaaaaaaaaaaaaagtataaactttatattaattagatgatgtcctatttacttaagtttcttttattttcttcactcatcatcatgtatactgcaggctt

SEQ ID NO: 26479 - DNA, 201 bp, Homo sapiens
tagatgtgattaccaactgtgtgaaggactatggacaaaaggtgcctggttccaggccagcctgtatctgcagtgacagtggggttggcttgtgcatgtctagggaaagcttcctttggagtggagtggatgctggaggatgagccagaattcactcagacaagagggggagaagtgcgagcaggcagggtaacagcctga

SEQ ID NO: 26480 - DNA, 201 bp, Homo sapiens
tctattctgttaatgtagtatgtcacattaattgattttcatatgttgaatcatccttacatcccaggaataaagctcactttctcatggtgtatgatccttttaatgtactgttagattaagttttgttgaggatgtttgtgtttatattcgtcagggatattggcctgcagttgtctttgcctgcctttagtatcaaga

SEQ ID NO: 26481 - DNA, 201 bp, Homo sapiens
tattttatgttttcatttgtctttggtattttataatttttaaaattttcttctttgatcaaatggtcatttaagagtgtgttgtttcatttccacatatwtgtgaatttttccattttcttgctgctactatttctagtttcatttcattgtggtcagaaacttgatatgatttcaatctttttaaattcattgtctttt

SEQ ID NO: 26482 - DNA, 201 bp, Homo sapiens
ggcttttctttgttgagaggtttttgattactgattcaatcttcatactagttgtaggtttgctcaggctttattttgttcatgtttagtttcgatagatrgtatgtttctaggaatttattcatttcttctaggttatccagtttgttggcatatagttgtttatagtaatttcttagaatattttatttttgtggcatt

SEQ ID NO: 26483 - DNA, 201 bp, Homo sapiens
ccacatccagctaatttttgatattttcagtagagatggggttttgccatgttgcccaggctggtctgaaactcctgagctcaagcgatccacctgcctcrgcctctgaaattgctgagattccaggtatgagccaccatgcctgaccttaaaattattgtatatttcataataatgagctttgatttacagttattcctt

SEQ ID NO: 26484 - DNA, 201 bp, Homo sapiens
attagggatggagcctatagaggtgcctcttgaggaaaatagtgaacggactcagattcgccaaagcagggtctgtgctgacaggtgagactctgaagcasgtgaaaatctcagctttattgacaggctggcacagagggggaagagggtaatgccctatgcaatctatcctttgctacccttcagtccagttgctgccca

SEQ ID NO: 26485 - DNA, 201 bp, Homo sapiens
tcagggactcctcccagaacctccagaataggttgtgagtgacaatgtgaaacagctttgccatcattcatcacgaatgtctgctgggcgtcttctctgtrtgggatgctgttccaggttcacaaaagagtgaagagagctgattaatcaggagggctctctcagtgctttaaaagtccttcagcattagaagtgcagtcc

SEQ ID NO: 26486 - DNA, 201 bp, Homo sapiens
ccctcttatcctaggctggtcatgtctgtggggacaatatggacctcatagatgggcagcccacaggatctgtgaggatttcatttggatacatgtcgacrctggatgatgtccaggcctttcttaggttcatcatagacactcgcctgcactcatcaggggactggcctgtccctcaggcccatgctgacaccggggaga

SEQ ID NO: 26487 - DNA, 201 bp, Homo sapiens
gggatagaaatctaggagtggaattgttaggtgatatggtagttttatgttgagctttttgagaaactgagggagtggattcagaaggaacacaaaagaaragaccctaagtagtgacttggtggccttgtctttgtaacctgccaggtaatcctcacagccagaacatcagcagcaagctcacccatgacactgtggagc

SEQ ID NO: 26488 - DNA, 201 bp, Homo sapiens
gctacaggtaagcatcagggacacctgcctgactgggcatacctaggcagacagacttccttcctaggacttgcctgcatcccacaaaagttctgagttgrtttcaggaggatcacagttggctaaaaggcaatgcatgtatgttgagaaacatcagagtcagagctcagaaaggcagcggtgagtagatgcagtgtgggg

SEQ ID NO: 26489 - DNA, 201 bp, Homo sapiens; identical to SEQ ID NO: 6489

SEQ ID NO: 26490 - DNA, 201 bp, Homo sapiens
tccatctgtttactttcagtctatgtatatccttaaacctaatgtcagtttcttttaaacagcatacagttgggtttttttttatgtctttttatgcttctttttttttattcagccactctaagtcttttgattggagagtttaatcaaatatatttagagtaattattgataaggatttaatattgccatttggctagt

SEQ ID NO: 26491 - DNA, 201 bp, Homo sapiens
gcaggtgaaaatctcagctttattgacaggctggcacagagggggaagagggtaatgccctatgcaatctatcctttgctacccttcagtccagttgctgyccatttctcccttgcatgcttctctctaaccacactcttggctctttggtcttcaaacctcccaagcatgctcccttctcaggtctttgcacttgctgtt

SEQ ID NO: 26492 - DNA, 201 bp, Homo sapiens
cttaatacctgggtgatgaaataatctgtataacaaacccccataacgcaagtttacctatgtaataaacctgcacttgtaccacggaacttaaaagttgaaaaaaaaaaaaaaaaaagatgagatctcgccatgtttcccaagctggtttcaaactcctggcctcaagaaatccttctgccccagccccctagtagctgg

SEQ ID NO: 26493 - DNA, 201 bp, Homo sapiens
atttacataaagctcatgattctcttgtgtttcatgattgatttgaggtggaatggagaatataaagcagcacaccttcaccttggctcagtatacctacrtggccctgtcctctctccagtaccccaatggagcccctgtggtgcggatttacagcgattctgagttcagcagccctgaggttcagggcccgatcatcaa

SEQ ID NO: 26494 - DNA, 201 bp, Homo sapiens
tgatttgcatgttgagaagaccagctggtgcctgtggagcagttggaagggggaaggggtgcaagcaggaaggccacataagcacctgtgttagcaacacwggtgagacaagatggaggcttggaccagggtcagagagaaagtcaggaagctgcaggtatgtattctggaaatagaataacctgaactagctgatgattg

SEQ ID NO: 26495 - DNA, 201 bp, Homo sapiens
ttaatacctgggtgatgaaataatctgtataacaaacccccataacgcaagtttacctatgtaataaacctgcacttgtaccacggaacttaaaagttgaaaaaaaaaaaaaaaaaagatgagatctcgccatgtttcccaagctggtttcaaactcctggcctcaagaaatccttctgccccagccccctagtagctgga

SEQ ID NO: 26496 - DNA, 201 bp, Homo sapiens
tccagggtggtgctaagaactgtctgcaaagagtcctgtgatgtgattcatcttcacgtcttccagctatggataccagcacctgctctagtgaaggtggyggggagtaaagtggactctgttgggagtccttggttgtagttttgttttagtgtgctggttttagtccttggttgtagttttgtttagtgcggtggtttt

SEQ ID NO: 26497 - DNA, 201 bp, Homo sapiens
agatggcaggtcgtcctgccttggaaatctccttgcagcatctgtcacttcaggctgccttcagggctcatgcaatgttttgttttattttattttgtaaycaaactttttgcaattcagattattatttaaataaatactatgtaacagttcactctttctctctctcttttgccagagtaagtacttatgattgtggag

SEQ ID NO: 26498 - DNA, 201 bp, Homo sapiens
ctggggttcaagctggagaccaggagtccctacagggctcttcctgctgctgcttctacttttatattttgcttggctgcctaaatccatttcagctctakgtaagggtaaatctttcccttgtcatctggattttcaggttccccaatggggatgtgtgttcggagaccaacttctcaccttctcacactttgggaactc

SEQ ID NO: 26499 - DNA, 201 bp, Homo sapiens
catagatagctcttattattttgaaatatgtcccatcaatacctaatttattgagagtttttagcatgaaggttgttgaattttgtcaaaggccttttctscatctattgagataatcatgtggtttttgtctgtggctctgtttatatgctggattacatttattgatttgcatatattgaaccagccttgcatcccagg

SEQ ID NO: 26500 - DNA, 201 bp, Homo sapiens
tctgttctgttctgttctgttcccgtggtttatttttccttgaaccaagaggccagtgttattactagagttatagaataagtcttgatatcccattgttkttttttttttttgagacagagtttcactcttgttgtccaggctggagtgcaatggcgtgatctcggctcactgcaacctctgcctcctgggttcagcgat

SEQ ID NO: 26501 - DNA, 201 bp, Homo sapiens
cccagggatgaagcccagttgatcatggtggataagctttttgatgtcctgctggatttggtttgccagtattttattgaggatttttgcatcaatgttcrtcaaggatattggtctaaaattctcttctttggttgtgtctctgcctggctttggtatcagaatgatgctggcctcataaaatgagttagggaggattcc

SEQ ID NO: 26502 - DNA, 201 bp, Homo sapiens
aacagttcactctttctctctctcttttgccagagtaagtacttatgattgtggagaaaaaatttcaagctggttgtcaacattttttggccgtccttgtmatttgatcaaacaaagttcaaactctcaaaggaatgcaaagaagaaacatggaaaaggtattacattttgaattggttcgtagagaacaggaaccctggc

SEQ ID NO: 26503 - DNA, 201 bp, Homo sapiens
ggtgcatgcctatagtcccagctacttgggaggctgaggtgggaggatcacttgagcctgggaggtggaggttgcagtgagttgagatcacaccactgtastccagcctgggtgacaaagcgagactctgtctcaaaaaaaaatttaaaaaattgctaggtgtggtggcatgcacctgtagtcccagctgcttgggagact

SEQ ID NO: 26504 - DNA, 201 bp, Homo sapiens
cttccagttgatcacatcggctcctgaggcttctgcattcttcgcgtagttctcgagccttggttttcagctccatcagctcctttaagcacttctctgtwttggttattctagttatacattcttctaaatttttttcaaagttttcaacttctttgcctttggtttgaatgtcctcccgtagctcagagtaatttgatc

SEQ ID NO: 26505 - DNA, 201 bp, Homo sapiens
acctgactgtaaatgtgtggatttatattttggttctgtatcctgtcacattggtctatgtgtctatttttatgtcagtaccatgctgttttggttactayagctttgtagtatattttgaagtcaagtagctgttgtttttacataatgataaatttgtttttaacctttgttcattagggatggagcctatagaggtgc

SEQ ID NO: 26506 - DNA, 201 bp, Homo sapiens
tctaatcttatctgtacctgaatacatgtggaatagcaaattttccaatcttgggaaatttatcctatcttaagccccaaccaattcccctttcacccccrcccatatactaaaacagttaactatataacacttcactaaagatttatgtataataaaaaaccttcagagtgctgattgcctaccagttaacacaatgca

SEQ ID NO: 26507 - DNA, 201 bp, Homo sapiens
gtggaatagcaaattttccaatcttgggaaatttatcctatcttaagccccaaccaattcccctttcacccccgcccatatactaaaacagttaactatayaacacttcactaaagatttatgtataataaaaaaccttcagagtgctgattgcctaccagttaacacaatgcactcattagtgggtaggtctgtgctcag

SEQ ID NO: 26508 - DNA, 201 bp, Homo sapiens
caggaggctggctgagatagttaagccttagtcctggtcctttggagtctccgttggtgagatcaattgccagcagatagcaatgctgcaacgtaagagaygtaataaaggtctatgcgaagggcagaatcctctacacctggaatgagtcacagagggcttcagggaggaggtgagtttggagctgcaacttaaaaggag

SEQ ID NO: 26509 - DNA, 201 bp, Homo sapiens
tcctggccattgctcttttgtcacagtaatgggacccttcagtgccttaaccttagccttagcccaacataggggcagacaggattcacgggaagagaggktcgccctgatggcaatgcagggaggtgagtgggcatgatctgggacaaacggagtagttaataaatacaggcagtgagtagtgagtactttccaaggaaa

SEQ ID NO: 26510 - DNA, 201 bp, Homo sapiens
cttgcactggcctgcttctgagctgacttccagctctaaaatactcttcccgatcacatttggttttactagtgaggagagattttttttttttaactatwtcataaaatttaccagctgggtacagtgtctcaggcctataatcccagtgctttggtaggtcaaggtaggaggattgcttgagcccaggagttcaagaca

SEQ ID NO: 26511 - DNA, 201 bp, Homo sapiens
atgtaggcatttactgctatgaactttccttttagcagtacttttgctgtatcccacaggttgtgattggttgtgtcactgttatcattcagttcaaagarttttttaaattccatcttgatttcattgttgacccaaggatcagtcaggagcagattatttaatttccatgtctttgtatagtttcgagagttctttttg

SEQ ID NO: 26512 - DNA, 201 bp, Homo sapiens
cttcactagtgatctcatggaaaacacttatggtaaagaaaaacacctgaaacaggttttagtcaactacatgcagctgatatacctgtgcatgttaaacsctggattaataggccaggaatattctgaccacaaaaagctgaataagccccatgtaagataggggccaggcaagcaccctgggtcattctgtactgtaaa

SEQ ID NO: 26513 - DNA, 201 bp, Homo sapiens
tggagtgcagtggcacgatctcggctcactgcaacctccgcctcctgggttcaagtgattctcctgcctcagcctcccgagtagctgggactacaggtgcrcaccaccatgcccagctaatttttgtacttttcgtagagagagggtttcaccatgttggccaggatggtctcgatctcttgacctcgtgatctgcctgcc

SEQ ID NO: 26514 - DNA, 201 bp, Homo sapiens
gcattacctacttaaaacatggctcgaagtggagaagggtggagtgtggacctggaggctgaatgggagatatccagctcctacatcatcttctttgcacwgtcctctctgttttagtttcttctcttcctccctttcttccttccagtgtaggtgctgaattcatgaagtctatctgtgtttgtgtagccactgtacaaa

SEQ ID NO: 26515 - DNA, 201 bp, Homo sapiens
gaaatgcacatggatcgttttgaccacagcttgacctgttctccttaccccgtggttataggtttgaagatggcaccatctcattccttgatgttatcgcrctaaaacatggatttgacaccctagagcgcctcacaggtcagtggacatttctatccctgtggaatttgctcctgttgtgtccttgagggagctctggca

SEQ ID NO: 26516 - DNA, 201 bp, Homo sapiens
caatggtgggcgcccctcccccagcctcgctgccgccttgcagtttgatctcagactgctgtgctagcaatcagcgagattccatggggtaggaccctccragccaggtgcaggatataatctcgtggtgcgccgttttttaagcccatcggaaaagcgcagtattcgggtgggaatgacccgattctccaggtgccgtcc

SEQ ID NO: 26517 - DNA, 201 bp, Homo sapiens
acagtccaaagtctcatctgagacaaggcaagtcccttccacctaggagcctgtcaaagaaaaaacaagttagttccttccaagatataatggggtacaakaattgggtaaatatacccattttaaatgggagaaattggccaaaacaaatggtctgcagtctccttgtaagtctgaaatccagcagggcaggcattaaat

SEQ ID NO: 26518 - DNA, 201 bp, Homo sapiens
ggagctttttggatgagtctttaaggttttttaggtatacagttatatcattggcaaacagggacagtttgacatcctctttaccgatttggatgcccttyatttctttctcttgtctgattgctctggctacaactttgctgagggttttaatcataaagcgttgctggattttgttaaatgttttttctgcatctattg

SEQ ID NO: 26519 - DNA, 201 bp, Homo sapiens
tatctttatgatatgctgttgaatttagttagctaggattttgttgaggatttttgcatctatattcatcagggatatttgtctgtagttttctttttttkttgttatgtcctttcctggttttggtattagggtgatactggctttatagaatgatttagggaggattccctctgtctctgccttttgaaatagtttcag

SEQ ID NO: 26520 - DNA, 201 bp, Homo sapiens
tttagttagctaggattttgttgaggatttttgcatctatattcatcagggatatttgtctgtagttttcttttttttttgttatgtcctttcctggtttkggtattagggtgatactggctttatagaatgatttagggaggattccctctgtctctgccttttgaaatagtttcagtaggattggtaccagttcttctt

SEQ ID NO: 26521 - DNA, 201 bp, Homo sapiens
ttaatagagatggggtttcgccatgttgcccaggctggtctccaacttttgagttcaagcagtcctctcaccttggcctcccaaagtgctgggactacagkcatgagcctttgcacccagcccataatttttcgtagtacacagttgatcaaagcaacataagtatattataacttttgaaaaataattattaaacgtaag

SEQ ID NO: 26522 - DNA, 201 bp, Homo sapiens
ttgaaatagtttcagtaggattggtaccagttcttctttgaatgtctgacagaattcagctgtgaatccatctggtcctggactttttttatgttggcagyttttttattaccatttcagtctcgctacttgttattggtctgttcatagtttctatttcttcctggtttaatctaggagggttgtatatttccaggaatt

SEQ ID NO: 26523 - DNA, 201 bp, Homo sapiens
caacttttgagttcaagcagtcctctcaccttggcctcccaaagtgctgggactacaggcatgagcctttgcacccagcccataatttttcgtagtacacrgttgatcaaagcaacataagtatattataacttttgaaaaataattattaaacgtaagaaaaaaattagcgaaaatgagcctcttaatgaggtggctggg

SEQ ID NO: 26524 - DNA, 201 bp, Homo sapiens
gaatgtctgacagaattcagctgtgaatccatctggtcctggactttttttatgttggcagtttttttattaccatttcagtctcgctacttgttattggwctgttcatagtttctatttcttcctggtttaatctaggagggttgtatatttccaggaatttatccatcttctctaggttttctagtttgtgtgcataaa

SEQ ID NO: 26525 - DNA, 201 bp, Homo sapiens
cctggaaaaagtgggtctgcagttttttggggttcttcgtgtggaaagataggaggtggggagaggcttgctgtcaccccagttcctaccaggaggggccrcgttccccaccatctggtttatagcagggtggacccgctgggcagctgatccaagagcagagctagggtcccctgctaggtatttctctgtgctttattt

SEQ ID NO: 26526 - DNA, 201 bp, Homo sapiens
agcagtcctctcaccttggcctcccaaagtgctgggactacaggcatgagcctttgcacccagcccataatttttcgtagtacacagttgatcaaagcaamataagtatattataacttttgaaaaataattattaaacgtaagaaaaaaattagcgaaaatgagcctcttaatgaggtggctgggcaccctgccatttgt

SEQ ID NO: 26527 - DNA, 201 bp, Homo sapiens
ggtgtcttatctttatgatatgctgttgaatttagttagctaggattttgttgaggatttttgcatctatattcatcagggatatttgtctgtagttttcttttttttttgttatgtcctttcctggttttggtattagggtgatactggctttatagaatgatttagggaggattccctctgtctctgccttttgaaata

SEQ ID NO: 26528 - DNA, 201 bp, Homo sapiens
ccatttcatttctaattgatcttatttgaatcttctctcttcttttcttggttaatcacactaatgatctattggttttgtttattttttcaaagaaccasctttttgttgtatttatcttttgtgttgttttttgtttgtttcaatttcatttagtgttactctgatctttgttatttctttttttttctgtttggtttg

SEQ ID NO: 26529 - DNA, 201 bp, Homo sapiens
gcaaacagcttttccctgattagattcagaagctcttcctgggccttttgccctcaccagggctctctgccttgctccgtcctatccagggaaaggatgcrcctgctgtcatccctcctcctcgaagtcttgcctccaagtctaatttgctggaacaatttcatctcagcatttttcattttatttttttaattttctaaa

SEQ ID NO: 26530 - DNA, 201 bp, Homo sapiens
taccagttcttctttgaatgtctgacagaattcagctgtgaatccatctggtcctggactttttttatgttggcagtttttttattaccatttcagtctcrctacttgttattggtctgttcatagtttctatttcttcctggtttaatctaggagggttgtatatttccaggaatttatccatcttctctaggttttcta

SEQ ID NO: 26531 - DNA, 201 bp, Homo sapiens
tctaattgatcttatttgaatcttctctcttcttttcttggttaatcacactaatgatctattggttttgtttattttttcaaagaaccagctttttgttstatttatcttttgtgttgttttttgtttgtttcaatttcatttagtgttactctgatctttgttatttctttttttttctgtttggtttgggtttgattt

SEQ ID NO: 26532 - DNA, 201 bp, Homo sapiens
tttgtagtcactcttgtttctatccattgttgaaaatatacaacatcattctcatactgtggcccagctcgctatctttgagagcaaaagtgtgatgcagycacatgttctctgggtattcactgagttcttctggcactgagggacccttctcctcaggcatccagagtcctggaaaaagtgggtctgcagttttttggg

SEQ ID NO: 26533 - DNA, 201 bp, Homo sapiens
tcactggtatgaaacccagttgatcatggtgtcttatctttatgatatgctgttgaatttagttagctaggattttgttgaggatttttgcatctatattmatcagggatatttgtctgtagttttcttttttttttgttatgtcctttcctggttttggtattagggtgatactggctttatagaatgatttagggagga

SEQ ID NO: 26534 - DNA, 201 bp, Homo sapiens
gatgtcaccttcttggaaaggatgcccctgacctgccgcagggtcacgttctgcttattcctgcagtgtgtgggagggtgagaccaagtctgttttattcyctgctgtacctctatggccttgaatgacactggcccagagtcagtgctcaataagtaattgttgagggaagaaatggacagaagagataaggaatatcta

SEQ ID NO: 26535 - DNA, 201 bp, Homo sapiens
gaatatgaccactggagcattttggatttcagattttcaaattaggaatgctcaactggttaagtataccagagatatataatgtaaatattccaaaattwaaaaaaaaatctcaaaatgcttctggtgtcaagcatattggataaggaatactcaacctgtggtagtgtaattagccactggtataaactgactataacg

SEQ ID NO: 26536 - DNA, 201 bp, Homo sapiens
acaagcctgggcaacatggtgaaactccatctctgcaaaaaatacaaaaattagtcaggcatggtggtgaatgcctgtcgtcccagctacttgggaggctraggtgagaggatcacctgagcccaggaggttgaggctgcagtgagctgtgatcataccactgcactccagcctgggtgacagagtgagtgagaccgtgtc

SEQ ID NO: 26537 - DNA, 201 bp, Homo sapiens
attcatcacgaatgtctgctgggcgtcttctctgtgtgggatgctgttccaggttcacaaaagagtgaagagagctgattaatcaggagggctctctcagkgctttaaaagtccttcagcattagaagtgcagtccttccactgctcatgcctacacttggattaagaggcacatatcaagaggcacaagtcagtggcctg

SEQ ID NO: 26538 - DNA, 201 bp, Homo sapiens
ccccaaactcctggtaccaatttactgtattagtccattgtcacactgctataaagaaatatctgagactgggtaatttataaaggaagcagtttaattgrctcacagttccacatggctggagaggcctcaagaaacttacaatcatggtggaaggtgaaggggaagcaaggacatttttcacatggtggcaggagagag

SEQ ID NO: 26539 - DNA, 201 bp, Homo sapiens
ctgctgataaacacattaagtgttttggatcttcaccagcaactaccactacctagatcaagctaagaatgtactccagaaacctcccttgtatcccatcycagtcagcctcactgaaggtcaccactattctgacttctttcaccatagctagtttcacccattcttcaacttaatatggtgggatcatacaggatgtgt

SEQ ID NO: 26540 - DNA, 201 bp, Homo sapiens
gctcatcaccccttccctctctgcctctgtcacagtgaccttctctctgttccctaaacagccacccttcctgccttagcccttgccatcccttctgcttrgcatgttgtccaagggtctcagctcagatgtcaccttcttggaaaggatgcccctgacctgccgcagggtcacgttctgcttattcctgcagtgtgtggg

SEQ ID NO: 26541 - DNA, 201 bp, Homo sapiens
tttcaacccatggaatgccaggccatccattgtgaaaattgcaaaatgcaaggatgaggtggctttctatgtcctgactggaaggatgtccttgcatattkcagagtaattgaaaaagaaacccaagtgggctctgagatcccagcgagtgtgtttacacaggtgcacatacacagttgtatgcagttacatgacacagtc

SEQ ID NO: 26542 - DNA, 201 bp, Homo sapiens
caccctttctctggtgaatgaggcacagtatctgctgatcaacacatccagtattttggaacttcaccggcaactaaacaccaggtaagacctcatacctygggactagcagacaagcataaccatttgccactgggagcagggcctggcacctgcctggagcggagagatctgagagtcatgaagttcagccctgcttca

SEQ ID NO: 26543 - DNA, 201 bp, Homo sapiens
tggggctggtgcaagctgcagggccctggcatcctttctgcaggagctggccccatgcatcagctgttttctaggcaaagaggtaagaggtaagagggtgyaggagccacactggctcctcgaggacacagctttgtggcgttacaaaagcctcgttccactgcagggatcctcgtgtataatagtgatagtttccactct

SEQ ID NO: 26544 - DNA, 201 bp, Homo sapiens
gtgcaggagccacactggctcctcgaggacacagctttgtggcgttacaaaagcctcgttccactgcagggatcctcgtgtataatagtgatagtttccastctcgagcacggtcaagtgccaggcctgggcttgagtccttgtatccctgatgtagttctcaccaaatacagccaagaatctagacaaggaaacgatatc

SEQ ID NO: 26545 - DNA, 201 bp, Homo sapiens
tgagatcagagaagttttccttgattattccctcaaataagttttccaaagttttagatttctcttcttcctcagggacaccaattattcttatgtttggkcatttaaaataatccaaaatttcatggagactttgttcattttttaaaattcttttttatttgtcttttggattgggttaatttgaaagcgttgtctttg

SEQ ID NO: 26546 - DNA, 201 bp, Homo sapiens
ctaaatccatttcagctctaggtaagggtaaatctttcccttgtcatctggattttcaggttccccaatggggatgtgtgttcggagaccaacttctcaccttctcacactttgggaactcaaatttttggccatcttgtgtttgcagcagcaagctgcttctttcaaagtgtctgtgaattctatcagttttcctgatat

SEQ ID NO: 26547 - DNA, 201 bp, Homo sapiens
taaatccatttcagctctaggtaagggtaaatctttcccttgtcatctggattttcaggttccccaatggggatgtgtgttcggagaccaacttctcaccttctcacactttgggaactcaaatttttggccatcttgtgtttgcagcagcaagctgcttctttcaaagtgtctgtgaattctatcagttttcctgatatg

SEQ ID NO: 26548 - DNA, 201 bp, Homo sapiens
taaaaaaaaaatctcaaaatgcttctggtgtcaagcatattggataaggaatactcaacctgtggtagtgtaattagccactggtataaactgactataaygagctaccttgtattcaggctctgcactcagaaggaacaccactctaacatctaggaaagcagtaaacagtcatttgaatctttattaaagaattttaga

SEQ ID NO: 26549 - DNA, 201 bp, Homo sapiens
aaatccatttcagctctaggtaagggtaaatctttcccttgtcatctggattttcaggttccccaatggggatgtgtgttcggagaccaacttctcaccttctcacactttgggaactcaaatttttggccatcttgtgtttgcagcagcaagctgcttctttcaaagtgtctgtgaattctatcagttttcctgatatgt

SEQ ID NO: 26550 - DNA, 201 bp, Homo sapiens
ctaaattttttatttttggtagagatgggatttcaccatgttggccagactggtttcaacctcctgggctcaagtgacgtgctagcctcagcctcccagtrttgggattataggcataggccaccacgcttggcaatactgtgcctttcaagaaagtaaatgcttggctgggcacagtggctcatgcctgaaatcccaatg

SEQ ID NO: 26551 - DNA, 201 bp, Homo sapiens
gacaagatggaggcttggaccagggtcagagagaaagtcaggaagctgcaggtatgtattctggaaatagaataacctgaactagctgatgattggataargaggctgagggtgaggggggttatcaagacatctctcaggtttctaaaacctagctttcaggtgataactcacagattatatacccatattatgggttat

SEQ ID NO: 26552 - DNA, 201 bp, Homo sapiens
aggtttgccaagtccttggtagagctcctttccagcaagttctgggtgcttacgtggcctgggaatcttgacttcggtaccacagggagcatatatttccrctgatttagtacccagtgcagaatgtgagcgtcaacctaaaaaaaaaaattagagctttgtacagtgccagtatcagagccaatgaggtttttctgaggt

SEQ ID NO: 26553 - DNA, 201 bp, Homo sapiens
taagcaaaaaggattataaactaggatgcatagctatggcaagccacaggtgcacctgaagaggagagagtaagggaaagcttttattggcaaaaataaaktcatacaagctgcttgaaaacagaatttattggttcctggggctcacagccagaattggcatcagttcattggtggagacgctgttactgggcaaatgtt

SEQ ID NO: 26554 - DNA, 201 bp, Homo sapiens
tttcttgtgggattattttagaaagtccttgagacagtcgttatctcagaaatgcaagcatgaactccctgccttcgtgccatcctggctccaatttcttygggtctaatcagtgatttcatcctggtatctgcaactttcacaccagtaacaggaacaggccaagacacatccagattaggtgagtgtttctaatttcag

SEQ ID NO: 26555 - DNA, 201 bp, Homo sapiens
ggtatctgcaactttcacaccagtaacaggaacaggccaagacacatccagattaggtgagtgtttctaatttcagtgcataatttgtatttgcccgtgartgagctgaggagaaaatggttatgagaaaatagttttaagaaaatcaagtacctttgcactttttacatgtgcaataaaagaagcatctcgttattgctg

SEQ ID NO: 26556 - DNA, 201 bp, Homo sapiens
tgagttgatttgtgtatatggtgaaaaataggggtctagttttcttcttctgcatatggttatctagttttcccagcatcatttattgaagagaactcttsttgctccaatgtttgttcttgacacctttgtcagaaatcacctgactgtaaatgtgtggatttatattttggttctgtatcctgtcacattggtctatgt

SEQ ID NO: 26557 - DNA, 201 bp, Homo sapiens
ctcaagcaatcctgccttggcctcccaaaatcctgggattatagatatgagtcactgtgtccagtacacttaaaatacgtgtgcacacacacacacacacatgtgagccatatgtctcaccacttgacatagtttgtgtttaaggtctttctctgccattatcatgctatcttctattttgttcattgctgtgtctccagc

SEQ ID NO: 26558 - DNA, 201 bp, Homo sapiens
cctcaagcaatcctgccttggcctcccaaaatcctgggattatagatatgagtcactgtgtccagtacacttaaaatacgtgtgcacacacacacacacacatgtgagccatatgtctcaccacttgacatagtttgtgtttaaggtctttctctgccattatcatgctatcttctattttgttcattgctgtgtctccag

SEQ ID NO: 26559 - DNA, 201 bp, Homo sapiens
gttttatgtatgtttgttaggtccatttggtctacagtatgattcaagtcctcccttgatcttcagtttgcatgttctgtccattattgaatttatttttsttttgctgtctatttctcctttcggttctgtcaatgtttgctttatgtatttaggtgctctgatgttgggtgcatatatatttataattgttatatactc

SEQ ID NO: 26560 - DNA, 201 bp, Homo sapiens
gatctaatttcaattttcttaaatgtattgagacttgttttatggccatgatatggttcatcttggagaatattacatgtgccagttaaaagaatgtataytctgcagttgttgggtagaattttcataaatatctgttaagtccatttgttttagggtatagtttaagtccattgtttctttgttgacctgtcttgatga

SEQ ID NO: 26561 - DNA, 201 bp, Homo sapiens
atgtgccagttaaaagaatgtatattctgcagttgttgggtagaattttcataaatatctgttaagtccatttgttttagggtatagtttaagtccattgwttctttgttgacctgtcttgatgacctgtctaatgctgtcagtggagtattgaagtctcccactattattgtgttgtcatgtatctcatttcttaggtct

SEQ ID NO: 26562 - DNA, 201 bp, Homo sapiens
tcttaggctaaaatctgtgctcctcacatggttgacaaggccctacgagatcccatgctgccactgtctctgagctcatcaccccttccctctctgcctcygtcacagtgaccttctctctgttccctaaacagccacccttcctgccttagcccttgccatcccttctgcttggcatgttgtccaagggtctcagctcag

SEQ ID NO: 26563 - DNA, 201 bp, Homo sapiens
ctgttttgttcacaggtgaactttggcatgtacctgatgcatgcatcattggatttatcctccccatgtttcctgtctgtaggatctcaggtgctccctgygttgaaagagaatgtggaaggtcatgatttacctgcatctgagaaacaccaggatgttacctcctaaaaaaaatttttagcatacattaaagtttctctt

SEQ ID NO: 26564 - DNA, 201 bp, Homo sapiens
agcccatgaactgcacttacgggtgacttgctgatgtatggaaagcaggggtcatcagcctttagcagaaacctactgcagtagccccaggtcagcaggcraaatgggctccaggatcttcttaaggaggctgaggagggcataaagccagctgtccagcctctgcccaaacattcagccttagtcctgcatgttcaaaag

SEQ ID NO: 26565 - DNA, 201 bp, Homo sapiens
ggggtcatcagcctttagcagaaacctactgcagtagccccaggtcagcaggcgaaatgggctccaggatcttcttaaggaggctgaggagggcataaagycagctgtccagcctctgcccaaacattcagccttagtcctgcatgttcaaaagcataattaatccaattgtattaaataaaaaccctaatagcttgctat

SEQ ID NO: 26566 - DNA, 201 bp, Homo sapiens
aaaaaaaaaaaaaggtatcagaaaaatagcagatgttacactgcaaatagaatggaaattaggaaatactatcttctttatttataatgttttaatacccaaaaaaaaaaaaagagtgagatctcaacacctgtgaaaagaagggggaaaaaagggaatgagatctcagtgcttcttaggtctttgatcattaagcctgtt

SEQ ID NO: 26567 - DNA, 201 bp, Homo sapiens
ctgaggcaggagaattgcttgaacccaggaggcagaggttgcagtgagccaagaccacgccactgcactccagcctggtgatagagcaagactctgtctcaaaaaaaaaaaaaaggagagtacgaatttttcaggcagtcacaggcgggatggttaccagggagcagcatggcagggcttggcattcatgggctcagagaa

SEQ ID NO: 26568 - DNA, 201 bp, Homo sapiens
gattttaagctccaccagacagtatgacctgtattaagaaattgtaacaatgcgttttaagtattgtgtatgtgtggcatgtaggcgtgggtacgtatggwtatatatatatatatatgcatacagatatgtatattaaaaataattttgtttcctacttattacagttacaaaaacaattccccattttatttaaaggtt

SEQ ID NO: 26569 - DNA, 201 bp, Homo sapiens
attttaagctccaccagacagtatgacctgtattaagaaattgtaacaatgcgttttaagtattgtgtatgtgtggcatgtaggcgtgggtacgtatggatatatatatatatatatgcatacagatatgtatattaaaaataattttgtttcctacttattacagttacaaaaacaattccccattttatttaaaggttt

SEQ ID NO: 26570 - DNA, 201 bp, Homo sapiens
ttcctacttattacagttacaaaaacaattccccattttatttaaaggtttttatagattccttttaatacgtgcatgatataattttaatgcctgaaccrtatacatcatatatatgtagcatggtttacttaaccatttctctccactatatgacgttaatgatgttaacaagtttttcctattatgaacaatgtgagg

SEQ ID NO: 26571 - DNA, 201 bp, Homo sapiens
taaatgggggatttgctgcccatccaaagctgttgggctgccattaacctatccttgtttgtagtttcattttatttttcctttccatccaagttctcacttttttttgttttacttcatgtatttttatgctttccaatcttgttgaagagatatggagtacaaaaaaaacaagtaattctgttgtcttgatcattattt

SEQ ID NO: 26572 - DNA, 201 bp, Homo sapiens
atccagctcctacatcatcttctttgcactgtcctctctgttttagtttcttctcttcctccctttcttccttccagtgtaggtgctgaattcatgaagtytatctgtgtttgtgtagccactgtacaaataggtgaagaccaactttggggagccctggcctgagacacgtctacctttttgtttaggtgaccaggtggc

SEQ ID NO: 26573 - DNA, 201 bp, Homo sapiens
ttcactagtgatctcatggaaaacacttatggtaaagaaaaacacctgaaacaggttttagtcaactacatgcagctgatatacctgtgcatgttaaacgytggattaataggccaggaatattctgaccacaaaaagctgaataagccccatgtaagataggggccaggcaagcaccctgggtcattctgtactgtaaac

SEQ ID NO: 26574 - DNA, 201 bp, Homo sapiens
tcgaaagcttcactagtgatctcatggaaaacacttatggtaaagaaaaacacctgaaacaggttttagtcaactacatgcagctgatatacctgtgcatrttaaacgctggattaataggccaggaatattctgaccacaaaaagctgaataagccccatgtaagataggggccaggcaagcaccctgggtcattctgta

SEQ ID NO: 26575 - DNA, 201 bp, Homo sapiens
agttataacaaacttgttttcttaaaagtgagttagtggtgccaggcgtggtggctcatgcctgtaatcccagcactttgggaggctgaggcaggtggatyacttgagcccaggagctcaagacaagcctgggcaacatggtgaaactccatctctgcaaaaaatacaaaaattagtcaggcatggtggtgaatgcctgtc

SEQ ID NO: 26576 - DNA, 201 bp, Homo sapiens
tcaaaggaatgcaaagaagaaacatggaaaaggtattacattttgaattggttcgtagagaacaggaaccctggcttacccttgcacacatcaaaacagcycatgaactgcacttacgggtgacttgctgatgtatggaaagcaggggtcatcagcctttagcagaaacctactgcagtagccccaggtcagcaggcgaaa

SEQ ID NO: 26577 - DNA, 201 bp, Homo sapiens; identical to SEQ ID NO: 6491

SEQ ID NO: 26578 - DNA, 201 bp, Homo sapiens
acctgtggctgcggaactcactggaggattctaagccgagaagcttcataacactgcttatgttagaaagtcagccctgacttggcgaggtggctgcatckagtgggaaactcaggcagtaaaggcacaggtgggaggcagctgggactgtcctggtgggagatggggccttggtggaacaaaggtggtaggtgcagagga

SEQ ID NO: 26579 - DNA, 201 bp, Homo sapiens
gtcaggctggtgtcgaattcctggcttcatgtaaccctcccacctcagcctcccaaagtgctgagccactgtgcccagcccttattgttattttctccacrttattttaaacagagtattctagaatctccttttgcctctttattgagagatatgcaccatgcttaggacatttttattattgccaggacatcacttttt

SEQ ID NO: 26580 - DNA, 201 bp, Homo sapiens
tgttgcagatgaggaaattgtggtcctcataggttgtgggagttgcccttagtaagtggcaaaaccagactcaggtatcccggtctctggcttttcatacrttgtttgccattcaaaggagattgggactcctccttcccaaccccatagtctttcaaccctgtctctggcgcatactctaaccatgcctgaggatttacc

SEQ ID NO: 26581 - DNA, 201 bp, Homo sapiens
cagttttacagatgtatacggctatgctccatcattttcagatcaatctcctggtacaacagccacccttcctctgttgaatgaggcaaagtatctgctgrtaaacacattaagtgttttggatcttcaccagcaactaccactacctagatcaagctaagaatgtactccagaaacctcccttgtatcccatcccagtca

SEQ ID NO: 26582 - DNA, 201 bp, Homo sapiens
gttaccatttgcatggaatatctttttccatctgtttactttcagtctatgtatatccttaaacctaatgtcagtttcttttaaacagcatacagttgggkttttttttatgtctttttatgcttctttttttttattcagccactctaagtcttttgattggagagtttaatcaaatatatttagagtaattattgataa

SEQ ID NO: 26583 - DNA, 201 bp, Homo sapiens
tagaatggaaattaggaaatactatcttctttatttataatgttttaatacccaaaaaaaaaaaaagagtgagatctcaacacctgtgaaaagaagggggraaaaagggaatgagatctcagtgcttcttaggtctttgatcattaagcctgttgacaggtttttaaatgccttatgccgccccaccttatagaactggtg

SEQ ID NO: 26584 - DNA, 201 bp, Homo sapiens
cagaaaatgcccctttcttctgctagtttgagaaactgttctaagagggcctttcattgaagtgacaggatttttacagaagttgttgcctgtcgggtggctgctagaggctggggctggtgcaagctgcagggccctggcatcctttctgcaggagctggccccatgcatcagctgttttctaggcaaagaggtaagagg

SEQ ID NO: 26585 - DNA, 201 bp, Homo sapiens
ctggggctcacagccagaattggcatcagttcattggtggagacgctgttactgggcaaatgttcctttaagagcatcttatctgaactgctgcagtcctgaagaatgtctagtgataaaccctgtctagaaatacgtgcatacatgcaagacatggatcatgaaaagcatgagatgcatgaaggacatggaggaatttct

SEQ ID NO: 26586 - DNA, 201 bp, Homo sapiens
tccttattcaggagaatttgacaaaattaacttgcatcattctttctcaaggaaaatgcagagttctgccactgtcttccccaaaaggcttttacatcagrcagcaaacaggaaatgggcctgatggtggtcacaagctgagagtaggaagaaagtccttctgcaggaagttcagggcatgtgggacagagatgtgcccag

SEQ ID NO: 26587 - DNA, 201 bp, Homo sapiens
gaacatgtagaacagactcttgcactggcctgcttctgagctgacttccagctctaaaatactcttcccgatcacatttggttttactagtgaggagagattttttttttttaactatatcataaaatttaccagctgggtacagtgtctcaggcctataatcccagtgctttggtaggtcaaggtaggaggattgcttga

SEQ ID NO: 26588 - DNA, 201 bp, Homo sapiens
gtagctggactctacttctcaaaaatatcatggttgtgaaagacaagaggagactgaaggagactagagagacgcgacaaatgtatgcaacgtgatattcsatgcagacagcagaggtggaatctgaatggagtctattgattagttgtaatatcaggtcaatggtaattcctaattttgatggttgtactggggttatgt

SEQ ID NO: 26589 - DNA, 201 bp, Homo sapiens
atcagagaagttttccttgattattccctcaaataagttttccaaagttttagatttctcttcttcctcagggacaccaattattcttatgtttggtcatktaaaataatccaaaatttcatggagactttgttcattttttaaaattcttttttatttgtcttttggattgggttaatttgaaagcgttgtctttgggct

SEQ ID NO: 26590 - DNA, 201 bp, Homo sapiens
ttagccaagtggtaggatacaagatcaatatgcaaacatcagttcaatttctatacattggcaatagatactatgaaaatgaaattagaaaaacaattcckaaggcatcaaaaataataaaatacacagaaaaaaatttatcaaaagaagtatcacatacactgaaaattgtaaaacatcattgaaagaaattaaagaaga

SEQ ID NO: 26591 - DNA, 201 bp, Homo sapiens
ggtgtaaggggctggggtggaaccttccttttggagggatccctcagcagcgacaagatactttcccctgtcctggagaaaagccattcagacagttatcragccccttttgtgagtcaaactctagactcaccccatgagcttaactgacacttcccccaagcagcccctaaggcttaggcccttcactccttcccccaa

SEQ ID NO: 26592 - DNA, 201 bp, Homo sapiens
tgtaaggatgtttatggtttttatggcaatgttgtttataatagcagaaaatgagaacaggttaaatgtccaactatagggtaaaggaaaaataaattgtkgttaggatgggttgtgaggatccttaaatggctgatatatctttcagcaaaaaaagtaggttacaaaaaatatataccctatacaacataattccatatt

SEQ ID NO: 26593 - DNA, 201 bp, Homo sapiens
ttccctttgccaagggtcagagcagggaaggtgagcctatcctgtcacctagtgaacaaactgcccctcctttctttcttcttttcttcctccctccctcyctttcttccccttttccttccttccttcctcttattcttctagtaggtttcatagacacctactgtgtgccaggtccagtgggggaattctgagatataa

SEQ ID NO: 26594 - DNA, 201 bp, Homo sapiens
ccagccgccatcttaacggtgcgccgcttgtgtgggcccaccacccccggaaacccgaaccttcgacacttaggttccgcttcccgtgcctggcgtcccamcaggctaagcgccgatccgagtagccagtcttcatttactccactaaaatgtaatttttctgcatttgtctcctctgatgcactccacgctccataggag

SEQ ID NO: 26595 - DNA, 201 bp, Homo sapiens
cacacacacacacacacagctgaagaagaaactctggggtttgcctaaaacagtcaagggctttgaagactgaaagactgagctttaaattttgattccgscgggcgcggtggctcacgcttgtaatcccagaactttgggaggccgaggcgggcggatcacctgaggtcgggagttggagaccagcctgaccaacatgga

SEQ ID NO: 26596 - DNA, 201 bp, Homo sapiens; identical to SEQ ID NO: 6516

SEQ ID NO: 26597 - DNA, 201 bp, Homo sapiens
tgccttttctcacctgtgccacctgcagagggcaaacagcaggagcagggtgaggtgggcagtcaacagggccaggtggaaggctcgatgcaggaagagcrcctctgggaggaagcgccagttcactgtccagtggaacagaaactggcggccaaggtcaaaggagcgggacaggtagccgctggggttctccagcaggaa

SEQ ID NO: 26598 - DNA, 201 bp, Homo sapiens
ggacaggtagccgctggggttctccagcaggaagggcagccccagcaccacctgaggattggtgtgatgtcagcagagctgccaaggctcattcccaatgrccagccttcatgctactcattgaggggtgtgggacggggatgtaggcctcagaggttccccaattcccactagaaatagcaggaaaaccacgttccccac

SEQ ID NO: 26599 - DNA, 201 bp, Homo sapiens
actcctttactccctctgctgcaggaaattgggaagagatggaaatgcagaaaacgagaggggaccagaaaggaagaggtgttgacctgaaaaagcagcarccccagccccagcgctgggccagcaggaggttgatactgaggaagagcagcaccatggccactgggtcattgaagagccgcagcacaaagatggagtgga

SEQ ID NO: 26600 - DNA, 201 bp, Homo sapiens; identical to SEQ ID NO: 6514

SEQ ID NO: 26601 - DNA, 201 bp, Homo sapiens
  misc_feature (1)...(201): n = A,T,C or G, or insertion/deletion polymorphism (see Tables 1-2)
acacagcgcttctacctatcttgcctacaggtggagcgcattgaggagctgggagcccagccactgagagacctcattgagaaggtagggccactgagccngttgagggcaggggagcaggagaggccttgagagaggagatggcccaggaacgctttgggagctcctgcactaatcattccacttatggtctctacatag

SEQ ID NO: 26602 - DNA, 201 bp, Homo sapiens
  misc_feature (1)...(201): n = A,T,C or G, or insertion/deletion polymorphism (see Tables 1-2)
ccctgttattcaacagatatttattgagcacctactctgtggcagacagctgcgcttgggtctgaaattacagtggtgaacaaagcaaacccagccctgcnttcatggagcctcagggccagcaggggtgaggccacatgagtttgtactggacccgagcagggccagggccgccatggccctggggtcatcaggcctggg

SEQ ID NO: 26603 - DNA, 201 bp, Homo sapiens
  misc_feature (1)...(201): n = A,T,C or G, or insertion/deletion polymorphism (see Tables 1-2)
acactgcagcggggacccccccctccagcccgggctggagagcggctggtgcgctggtctgcggcaagagctgcgggcactcggcggggaacggcagccgnggggcgcccggcggagggtttctgggtcaggcggcgactccgggcccgggccgcgtacctcgcttggctcggccgatctggcccagcttggggggtcgct

SEQ ID NO: 26604 - DNA, 201 bp, Homo sapiens
aggctgagcacagtggctcacacctgtaatccccgcactttgggaggctgaggccggcggatcacttgaggttaggagttcaagaccaggctggcctacawggtgaaaacccgtctctactaaaaatacaaaaattagccaggcatggtggtgtgcacctgtaatctcagctacttgggaggctgaggcaaagagaatcgc

SEQ ID NO: 26605 - DNA, 201 bp, Homo sapiens
ccaggtcctgtagaatacataggagtggatgagggcatgctgggtagaaagaagtttaggccaggtgcggtggctcacgcctgtagtcccagcactttggraggccgaggtgggtggatcacctgaggtcaggagttcgagaccaggctgaccaacaaggtgaaaccccatctctactaaatatacaaaaattagccagtc

SEQ ID NO: 26606 - DNA, 201 bp, Homo sapiens
tctctggcctctgctctaggactatggtgaggcgatgctaagccgtgacgttgcacaaaacagactcaaggctcaactcactggctggcctcattgccccygggcccagagttaaccctgtggctctgaaaactgcctgtggcttcaccctctggtaatcttggatccctgccctgcatctcagtcactctctgtccccct

SEQ ID NO: 26607 - DNA, 201 bp, Homo sapiens
cttggttacctccttcttaaataattatattcccgtcccggccgtgcctgctggatcatggttaaagcaaaagtcctaagtacaaacctgtggactattaygatatataagcttcagctatgttgtaaaaatgtggggatttctttaaattctgctcctctctttaaaattctgatattctgcttccttcccatgagagga

SEQ ID NO: 26608 - DNA, 201 bp, Homo sapiens
acaacaacaacaaaaccaaatgaggttaatattccacagtggtgtggggctagacacagttacacagactttatacaggcggcaatcaagcgtcctggacktcaagaaatctagtttgtctgtcgcgccacgcagtcaactggagtgtcactgtgggttctatttacaccgttatgagaaaaacctgtggcggagtaaaac

SEQ ID NO: 26609 - DNA, 201 bp, Homo sapiens
gaccaggactctgtcagcacctagagagggcaagacttaccttcccacaatttaaaggatatggttgggtgtaaggggctggggtggaaccttccttttgsagggatccctcagcagcgacaagatactttcccctgtcctggagaaaagccattcagacagttatcaagccccttttgtgagtcaaactctagactcacc

SEQ ID NO: 26610 - DNA, 201 bp, Homo sapiens
tgtacttaaaacattttaggaggccgggctcagtggctcacgcctgcaataccagcactttgggaggccgaggtgggtggatcacctgaggtcaggagttygagaccagcctgatcaacatggcaaaaccctgtctctactaaaaatacaaaaaaaattagccaggtgtggcacacacctgcagtcccagctacttgggag

SEQ ID NO: 26611 - DNA, 201 bp, Homo sapiens
agggcaagacttaccttcccacaatttaaaggatatggttgggtgtaaggggctggggtggaaccttccttttggagggatccctcagcagcgacaagatrctttcccctgtcctggagaaaagccattcagacagttatcaagccccttttgtgagtcaaactctagactcaccccatgagcttaactgacacttccccc

SEQ ID NO: 26612 - DNA, 201 bp, Homo sapiens
tctccgggatgagggccacagctggaggtggaggcccagcctggagtgagaggagccctgaaactggaaggacaataaaggcggaagactggggtcactgraagagagtccagaaaattccacatacactggaagttgtccagtaatgggttccaatcctgactcccactttctcagtgaccttgaactgaaggacccata

SEQ ID NO: 26613 - DNA, 201 bp, Homo sapiens
  misc_feature (1)...(201): n = A,T,C or G, or insertion/deletion polymorphism (see Tables 1-2)
tgctccaaagtagggagggagcgcagtgctttgggaagtcagtttgtttggggtgtgaagagtagatgtgagaaagaaagcctggagatgaattaagagcntctgcggtactccgtgctctgagtcaggaaggtcccaaatgaaagaggtggcagaaggaatggtaggaaggggaggatgtaagcgatatcatcaagtcag

SEQ ID NO: 26614 - DNA, 201 bp, Homo sapiens
ctagtctccgggatgagggccacagctggaggtggaggcccagcctggagtgagaggagccctgaaactggaaggacaataaaggcggaagactggggtcwctggaagagagtccagaaaattccacatacactggaagttgtccagtaatgggttccaatcctgactcccactttctcagtgaccttgaactgaaggacc

SEQ ID NO: 26615 - DNA, 201 bp, Homo sapiens
attctcaattttccaaattttctgtgaatgtcctcttttcataatcagataaaaatcattgcactaggctgggcgtggtggttcacgcttgtaatcccagyactttgggaggctgaggcgggtggatcacgtggtcaggagttcaagaccaacctggccaagatggtgaaaccccagctctactaaaaatacaaaaattac

SEQ ID NO: 26616 - DNA, 201 bp, Homo sapiens
ccagacttccctctcctgtgacaggcaggctgggctgaccccccggccccacccctacccccgctcgggaattcaggttcccatggtggggaaagcgaggrgctcacctcctttccttgacattgcaggtggaccagtctgggctctttctgccctctcgggattactacttaaacagaactgccaatgagaaagtaagga

SEQ ID NO: 26617 - DNA, 201 bp, Homo sapiens
gaggccaaggcgggtgaatcatggggtcaggagttcgagaccagcctggccaacatggtgaaacctggtctctactaaaaatacaaaaaattagccgggcrtggtggcgggtgtctgtaatcccagctacttgggaggctgaggcaggagaatcacttgaacccaggaggcggaggttgcagtgagccgagatcgcgccag

SEQ ID NO: 26618 - DNA, 201 bp, Homo sapiens
ctgaggtttggagagatactaatgagtagccaaactggcgctattatcttctccaatggattctcttgctctctttctacttcccacctttcccacagtaygaaatttctgaagattctttcttccaaaacatgttgaatttgtacaacttctctgccaaggttatggctgaccagctccgcaagcctcccagccgagacc

SEQ ID NO: 26619 - DNA, 201 bp, Homo sapiens; identical to SEQ ID NO: 6513

SEQ ID NO: 26620 - DNA, 201 bp, Homo sapiens
ggggatgatcagcgaaatccggaccgcatttgaggaggccctgggacagctggtttggatggatgagaagacccgccaggcagccaaggagaaagtgagcrgtggctagggttggggcgccatcttgaggtggggttcaaggatacagttttgctaggaacctggggaaggaaacaaacccttaacctggtctcttcaggc

SEQ ID NO: 26621 - DNA, 201 bp, Homo sapiens
taacagtcctgtgtgccgaggtggcagacctgcatctccaacacggatgacgcccttggctttgctttggggtccctcttcgtgaaggccacgtttgaccrgcaaagcaaagaaattgtgagtctacaagattctttcaacactatgccctcaaaattgactgttcatgtatgtgcagacatatagaaaaacaacgggagc

SEQ ID NO: 26622 - DNA, 201 bp, Homo sapiens
  misc_feature (1)...(201): n = A,T,C or G, or insertion/deletion polymorphism (see Tables 1-2)
ctggagggtcacctgcccccacctccgctccatctctggcctctgctctaggactatggtgaggcgatgctaagccgtgacgttgcacaaaacagactcanggctcaactcactggctggcctcattgcccccgggcccagagttaaccctgtggctctgaaaactgcctgtggcttcaccctctggtaatcttggatccc

SEQ ID NO: 26623 - DNA, 201 bp, Homo sapiens
tgtgatggaagtcaagccgtgtcatcttcccaagcttctgccctggggtgtgaaatgggactcatcttcacttcatgaagttgctgtgtggggaggaaaamatacactgtatggaaagcctctaatagagagtctgatgtatgtctgcagaagtggtcactaaatatttcttctccatgcttttctctcccttggagacca

SEQ ID NO: 26624 - DNA, 201 bp, Homo sapiens
acattacggggccctgggaccaggacaactttatggaggtgttgaaggcagtagcagggacctacagggccaccccattcttcaccgtctacatcagtgcygactctaagagttccaacagcaatgttatccaggtgatgagctgggaaagggtggggagagacttagggacactttgctgagcccagacttccctctcct

SEQ ID NO: 26625 - DNA, 201 bp, Homo sapiens
tttgcagagcacttactctgtgttctagtccctagagacagcagtgagtaagctgctgtaacttggaacaatgctctgctggaactcaccttctccttggmgaaatagatgataaacaagtacagaagtaagtaaacatggccgggtgcagtggctcatgcctgtaatcccagcactttgagaggccgaggcgggcagatc

SEQ ID NO: 26626 - DNA, 201 bp, Homo sapiens
ggaaagggtggggagagacttagggacactttgctgagcccagacttccctctcctgtgacaggcaggctgggctgaccccccggccccacccctaccccygctcgggaattcaggttcccatggtggggaaagcgaggggctcacctcctttccttgacattgcaggtggaccagtctgggctctttctgccctctcggg

SEQ ID NO: 26627 - DNA, 201 bp, Homo sapiens; identical to SEQ ID NO: 6517

SEQ ID NO: 26628 - DNA, 201 bp, Homo sapiens
gctccctgtgatctctgtccccccactgctctccaacctgacctctacaggcaggtgtgtggccccgggaccaaagaggaaccccgggacagcttccacayatgcctctcgggactcctgcaacttgcatgtttctgggggctggtttgaggggtgtgaagggcatcccacctgcccttttcttattttctggtctggttg

SEQ ID NO: 26629 - DNA, 201 bp, Homo sapiens
ggaggagcagcaactgccagccgtggggctcaccaaccaccagctcttcttcgtgggatttgcccaggtatcaccctctcggaaggcctggggtctgcccytttgtcctgctccctcctgagtatgtcattaggagaactctggggcacgtgtcaaacgggctggtgaatggggctgaggctggggcatgaaaggtgggct

SEQ ID NO: 26630 - DNA, 201 bp, Homo sapiens
  misc_feature (1)...(201): n = A,T,C or G, or insertion/deletion polymorphism (see Tables 1-2)
caacctgacctctacaggcaggtgtgtggccccgggaccaaagaggaaccccgggacagcttccacatatgcctctcgggactcctgcaacttgcatgttnctgggggctggtttgaggggtgtgaagggcatcccacctgcccttttcttattttctggtctggttgtcagcatcctgaacaattacctgatctggaacc

SEQ ID NO: 26631 - DNA, 201 bp, Homo sapiens
aagacaagcagcaaggtagccaggtagagcacagcaaagatgttctgggccatgcggatgtcagtgcctcggctggtggcatagtacaaccccataaagaygtacacgaaaccagctgggtacctggaagatgagagaaaatgtgagcctgggtcaggtcacacagactagtacctaaccagcccctcacatcctccctga

SEQ ID NO: 26632 - DNA, 201 bp, Homo sapiens
agtatgctgttgcagtgaccctgggaatatttctaatgatcctgttgccaggtggcccatacgtagtagctttcattatgcaatcatgcaccacataacarcctttatgtcaatgatggactgcatgtataataacagtggtttcataagattataatgctgtaagccaggcgcagtggctcacatctgtaatcccagcac

SEQ ID NO: 26633 - DNA, 201 bp, Homo sapiens
ttccagaggtggcgagcatcgaatccggggcaccgtgttcccgggagaagggaagagggggacacacactgcagcggggacccccccctccagcccgggcyggagagcggctggtgcgctggtctgcggcaagagctgcgggcactcggcggggaacggcagccggggggcgcccggcggagggtttctgggtcaggcggc

SEQ ID NO: 26634 - DNA, 201 bp, Homo sapiens
gccatggaggtgggcaagggggcttcccctttctcaccaggccccagccctggcatgacgcctggcacacccaggagctctgggctgttctggagggtcayctgcccccacctccgctccatctctggcctctgctctaggactatggtgaggcgatgctaagccgtgacgttgcacaaaacagactcaaggctcaactca

SEQ ID NO: 26635 - DNA, 201 bp, Homo sapiens
aacataagcatatttattaattgggctttaagttgattaaatgagcatgaaggatacctagaacaatgcctggcaaaatgaaaagtatattcaaggttctstgtgtggtcctcctaaaaccccttctccccacaagtaaacactttcttgaatctgtgattttaaaccattgcacttatttatagatttaccttagatctg

SEQ ID NO: 26636 - DNA, 201 bp, Homo sapiens; identical to SEQ ID NO: 6496

SEQ ID NO: 26637 - DNA, 201 bp, Homo sapiens; identical to SEQ ID NO: 6498

SEQ ID NO: 26638 - DNA, 201 bp, Homo sapiens
aaattgggccgggtgtggtggctctcacctgtaatcccagcactttgggaggccaaggcaggtggatcacttgaggtcaggagtttgaaaccagcctgacyaacatggtgaaaccccatctctactaaaaatacaaaaattagcccgacgtggtggcgggtgcctgtaatcccagctacttggaaggccgaggcaggagaa

SEQ ID NO: 26639 - DNA, 201 bp, Homo sapiens
  misc_feature (1)...(201): n = A,T,C or G, or insertion/deletion polymorphism (see Tables 1-2)
gcggagcgcgccagtgtgtgccccgagggagtgcggtagagatggagggtgccccccgccctcgttgctttggaccacgggtgagttctcgcctcaccgangggaacatgccctcttctccccttgcctcccgcccccacaacccccgccctggctggccgtcacccgcggcgtcacctgcttgccagcgcgcaggagctc

SEQ ID NO: 26640 - DNA, 201 bp, Homo sapiens
atacaaaaattgggccgggtgtggtggctctcacctgtaatcccagcactttgggaggccaaggcaggtggatcacttgaggtcaggagtttgaaaccagmctgactaacatggtgaaaccccatctctactaaaaatacaaaaattagcccgacgtggtggcgggtgcctgtaatcccagctacttggaaggccgaggca

SEQ ID NO: 26641 - DNA, 201 bp, Homo sapiens; identical to SEQ ID NO: 6519

SEQ ID NO: 26642 - DNA, 201 bp, Homo sapiens; identical to SEQ ID NO: 6521

SEQ ID NO: 26643 - DNA, 201 bp, Homo sapiens; identical to SEQ ID NO: 6522

SEQ ID NO: 26644 - DNA, 201 bp, Homo sapiens
ggggcacagggtggcgaagggggcaaacgttcatcctcacgctgttcctgtgagggagacatgcaggaaacgaaagctcgggacgcagagtggcctgtccrgggctgcccaggaatagagtaagtggcagagcaaggacccaggcagagcctccgctgggcagccacagcaggcagcttctggggctccgctttttcccct

SEQ ID NO: 26645 - DNA, 201 bp, Homo sapiens; identical to SEQ ID NO: 6523

SEQ ID NO: 26646 - DNA, 201 bp, Homo sapiens; identical to SEQ ID NO: 6524

SEQ ID NO: 26647 - DNA, 201 bp, Homo sapiens
ctaatgtgggtctcaggaatctgtatgttcaacaagcttcacagcagattcttatgctggtgattggcagagtaacactgccttaaaatctgcttgactgstttttcaccaaactgatgctttaaaaaaaatctgcttaactgggaactatccttttctggataggaggggcaagaagtctaaaaatcaaaaggggaattt

SEQ ID NO: 26648 - DNA, 201 bp, Homo sapiens
  misc_feature (1)...(201): n = A,T,C or G, or insertion/deletion polymorphism (see Tables 1-2)
gagcagtactgacctttgagaacctgaagatccacttctcaccaatggcttctctgtctgccttgcaggtgagccgcgtgcttgtccctggaggccggttnatctcaatgacttctgctgccccccactttcggaccagacactatgcccaagcctattatggctggtccctgaggcatgctacctatggcagcggtttcc

SEQ ID NO: 26649 - DNA, 201 bp, Homo sapiens
gaagcacctgcttggtgagtggggctgttagggaggccttgggccacctatgtgccttgtgcccagcacagggcctggcacttagcaaataggcagtgtcyatgaatgaggaagtggatggttctgtgaacactccagagggtggggaggcagagagcaggggactattgagaagtgcagatgggtttgatgggggcagaa

SEQ ID NO: 26650 - DNA, 201 bp, Homo sapiens
tcacagagactgccaggctggggtgagcaggggagaggaagggtggagatcagctccagggccatgcacacaacacccaaagacataccccccaccatcaycacagcaacctcccccccgccgccacgccaacaaactccaagatgggacctacactcacaactgttggagggaagagcctggagtaggcaggaggcagat

SEQ ID NO: 26651 - DNA, 201 bp, Homo sapiens
  misc_feature (1)...(201): n = A,T,C or G, or insertion/deletion polymorphism (see Tables 1-2)
tgttgacctccgctgattcccacttgcggccacctgacccaggagcctgcaacgattggggtgtcctgatccttgaggcacctgagctccactgactgccncaaccccccagccctctctggccctgcccaactctaacaacctggggatgggactggggtcttggggtggtgggtttcatcagtggggaaggaagtctga

SEQ ID NO: 26652 - DNA, 201 bp, Homo sapiens
tgccacaccagagccctatccccaaactgctcctttcttctctagcccctaccccaccttcccttagcttggtccccaaagctctcctttctgcccttgcsctaccaaaccctgccctccacaattgcctctctcactgtgcccctctccggctgtcctggccgggtccccatcctggctctggcccaagcttggtcccgc

SEQ ID NO: 26653 - DNA, 201 bp, Homo sapiens
tgaggcaagtccagaaggcaggctcaagactggaatgctggggtgggtggtgatggccatgggaatggattcaggccccttcctcagcctcattggtcccmtctgccccagatgtggatgagtgtgcccgaagccccccaccctgcacctacggccggtgtgagaacacagaaggcagcttccagtgtgtctgccccatgg

SEQ ID NO: 26654 - DNA, 201 bp, Homo sapiens
ggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtccca

SEQ ID NO: 26655 - DNA, 201 bp, Homo sapiens
gtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccag

SEQ ID NO: 26656 - DNA, 201 bp, Homo sapiens
ctccggctgtcctggccgggtccccatcctggctctggcccaagcttggtcccgctcccgcttccctctacccctgcctccttgcgtcgcttctcccgggrctgtctgccccagtcccagccgcctggtctgtgcctacagatgtggacgagtgccaccgcgtgccgccgccgtgtgacctcgggcgctgcgagaacacgc

SEQ ID NO: 26657 - DNA, 201 bp, Homo sapiens
tttgggaggctgaggagggtggatcaccaggtcaggagttcgagaccagcctggccaacatggcgaaaccctgtctctactaaaactacaaaaattaactrggcgtggtggcagatgcctgtaatcccagctacttgggaggctgaggcaggagaatcacttgaacccaggaggcagaggttgcagtgagctgagatcgtg

SEQ ID NO: 26658 - DNA, 201 bp, Homo sapiens
tgttaggaaatctagtatgtagggggagggcctggaaggtcaggaaatctagaatatggtggtgttttgtaatgctcacagatctagaatattagagtcatttttttttccaggccggagaatccagaacgctcgtgttgctgaaatgctggtcattctattcttatttcatgtttaaatttttattattttctttatttc

SEQ ID NO: 26659 - DNA, 201 bp, Homo sapiens
  misc_feature (1)...(201): n = A,T,C or G, or insertion/deletion polymorphism (see Tables 1-2)
cggtgtgtgcgtgaagcctgaccgctgcctctgtcccccggacttcgctggcaagttctgccagttgcactcctcgggcgcccggcccccggccccggctntaccaggcctcacccgctccgtgtacactatgccactggccaaccaccgcgacgacgagcacggtgaggaaagggtggccagagtcccctccgacccctg

SEQ ID NO: 26660 - DNA, 201 bp, Homo sapiens
ggggcaccccgcttcgacatgccagactttgaggacgatggtggcccctatggcgaatctgaggctcctgcgccacctggcccgggcacccgctggccctwtcggtcccgggacacccgccgctccttcccagagcccgaggagcctcctgaaggtggaagctatgctggtgagcactgccagcgcatgatgagactgaga

SEQ ID NO: 26661 - DNA, 201 bp, Homo sapiens
gaccgggatgtgcgggagggcggggttctagattcccagacagtccgggcttagaaatgctcttagaaatcgagtcttttgtttttgtttttgttttttaatcacttttaaaaggctttaaaataacgtattttttcaataaaatcttacgccaaaatctcttcataagacaaaagtacggtttctgtgcccttcagcccg

SEQ ID NO: 26662 - DNA, 201 bp, Homo sapiens
actcaattaaaagcccccattagaccaccctggagtcatggccccacactcctacctaagggagctgagtttttgctccaggccctagacccgctctccamccatggcaacagactttagagaccactcctccagtgaaattccctctcattcttccctcccacctcccaaactgtgcctttccccagataactctgtagt

SEQ ID NO: 26663 - DNA, 201 bp, Homo sapiens
  misc_feature (1)...(201): n = A,T,C or G, or insertion/deletion polymorphism (see Tables 1-2)
gaacaggattgaaaatagaggagcacagggttcccaagggaaattcaaggtttctcactagaagaaaaacagatgatgggatctgggccattaaatatacncattatatttgaaagctgagactttcggacctttggaatcatagaagcttataaccactgagtccctctcccctgttgtctcctgcttacagatgtgaac

SEQ ID NO: 26664 - DNA, 201 bp, Homo sapiens
ccgggatgtgcgggagggcggggttctagattcccagacagtccgggcttagaaatgctcttagaaatcgagtcttttgtttttgtttttgttttttaatcacttttaaaaggctttaaaataacgtattttttcaataaaatcttacgccaaaatctcttcataagacaaaagtacggtttctgtgcccttcagcccgaa

SEQ ID NO: 26665 - DNA, 201 bp, Homo sapiens
aggagcacagggttcccaagggaaattcaaggtttctcactagaagaaaaacagatgatgggatctgggccattaaatatacacattatatttgaaagctsagactttcggacctttggaatcatagaagcttataaccactgagtccctctcccctgttgtctcctgcttacagatgtgaacgagtgtgaaacactacag

SEQ ID NO: 26666 - DNA, 201 bp, Homo sapiens
aatcccagctacttgggaggctgaggcaggagaatcacttgaacccaggaggcagaggttgcagtgagctgagatcgtgccattgcactccagcttgagcracactccatctcaaaaaaaaaaaaaaaaaaagaattcagggcattgatgggggtattacaggtgggattctggggtaaaagactccaaggtgaagattcc

SEQ ID NO: 26667 - DNA, 201 bp, Homo sapiens
agaaatcaacaagactgtgatggggaaagcccaggggggttttggaggaggcgcctggcccagcatgagaagaggattagggagttcttcctgtaggagasgacatctgaactgagagctgtgggatgaatagaaatgagccaggcccgatgagtgaggagggcattctgggcagaggacacagcaagggcaaaggcctgg

SEQ ID NO: 26668 - DNA, 201 bp, Homo sapiens
acaggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccagg

SEQ ID NO: 26669 - DNA, 201 bp, Homo sapiens
  misc_feature (1)...(201): n = A,T,C or G, or insertion/deletion polymorphism (see Tables 1-2)
tcgctagcgcttgcaacgcggtgctggaggctgctcccttggggactgaggaggggcgccctgcttcccagacttaggcggagggaaagaacaccctctcnccgtatctctgtagtggaaataagccgccaccgtgtccatgtattttcttgtgtcaggatcacggccaagcctcccttccagccgcagtccattccccct

SEQ ID NO: 26670 - DNA, 201 bp, Homo sapiens
ctcctggactcaagcgatccacctcggccttccaaagtgctgggattacaggcccgcgccagggcacctagccggaactgggaactctctaaggagaaagyctgcaattctgggtggtgggaggctgctcttgggagcattcaaagactcaggcaaggaagggggtctgataccctctgggggcggcgataagtggggtgc

SEQ ID NO: 26671 - DNA, 201 bp, Homo sapiens
tcatcatattggtcaggctggtctcgaactcctgacctcaggtcatccacctgcctcggcttcccaaagtgcagggattacaggcgtgagccaccatgctyggcccaacagccagtttttcaacccttgtacctctgtccctcccccatctagtggtccccagcaactattgtgggcatctttacatccatgagtacccac

SEQ ID NO: 26672 - DNA, 201 bp, Homo sapiens
gagggtggaaagccaaagtgacagaggtcagggaggcagaggggaacaagtgaccccgggccccctgccctgtgcagatgtggatgaatgcacccagagcscaggcctgtgtggccgaggggcctgcaagaacctgcctggctctttccgctgtgtttgcccggctggcttccggggctcggcgtgtgaagaggatgtgga

SEQ ID NO: 26673 - DNA, 201 bp, Homo sapiens
tgtttccctatctatgccagcctcagtttccccatctatgatagtggcggggctggggattcagcccacactgggctaaagctccttgtctccccaggcaygttcccaggctcgcagccccaggcacctgctagccccgttctgcccgccaggccacctccgccacccctgccccgccgacccagcacacctaggcagggc

SEQ ID NO: 26674 - DNA, 201 bp, Homo sapiens
  misc_feature (1)...(201): n = A,T,C or G, or insertion/deletion polymorphism (see Tables 1-2)
gggtggaaatactgggtggggtgtgggcctgggacaggggacacttttggacagggccttgaggtactagtactgtcagggcaagggcgagctgccaggcnggtgggcatgggcagacataaggctgagaggtgggcactaacaggcacagggccagagggacttttgtgacaagtgggcacgagcaggtcagggctgggg

SEQ ID NO: 26675 - DNA, 201 bp, Homo sapiens
gtctagactccatccatcacactgccaatgtgctgggaagagaaatgggaaagggtggggagagttgaaggggatgcctcttaatcatcctctccctagayaatgacgagtgcgccgatgaggaaccggcctgtgagggcggccgctgtgtcaacactgtgggctcttatcactgtacctgcgagcccccactggtgctgg

SEQ ID NO: 26676 - DNA, 201 bp, Homo sapiens
ctgacttcctgctctccttgtgcccctcagtctgtgccgacaacaaccacgtgcggacatggtctgtgactcgcttccgcggcatgatttccacccagccyggctccaccccactcgcttcctttaagatcctggctctggagtcggcagatgggcatggcggctgcagtgctggcaatgacattggtgcctactggctcc

SEQ ID NO: 26677 - DNA, 201 bp, Homo sapiens
ctggtgtcctggctcaggcttgtctctgtgtgtagctgagtaccagtcattgtgccctcacggccggggctacctggcgcccagtggagacctgagcctcyggagaggtgaggccagcctttgaccctccaccccactcagctctgaggcccagcttcgtctcttcctgttttctttgcctctgtctctcaccctttctgt

SEQ ID NO: 26678 - DNA, 201 bp, Homo sapiens
agtctccttgttcctcaatccagaaccctggagtgacctcagagaacttccagagttagatcacagctgatgagaaggatttgctgataggcagagggtgsctgggctgctcagcaggggaagggtccagcccctgggaggacctgagtgccaggcccactctgacacatgctgtctccacctacagatgacaatctggga

SEQ ID NO: 26679 - DNA, 201 bp, Homo sapiens
accgggatgtgcgggagggcggggttctagattcccagacagtccgggcttagaaatgctcttagaaatcgagtcttttgtttttgtttttgttttttaatcacttttaaaaggctttaaaataacgtattttttcaataaaatcttacgccaaaatctcttcataagacaaaagtacggtttctgtgcccttcagcccga

SEQ ID NO: 26680 - DNA, 201 bp, Homo sapiens
gaactgcagccacagtggtggggactgggacgaggaagggtgagaaagcgagggtgaccacctcccccactgcaccccccagggtgtgctccgtgcgctcygtggacggctcacccacgacggccttcacagtgctggagtgcgagggctcccggcggctcggctctcggccccggcgctacctgctcactggccaggcca

SEQ ID NO: 26681 - DNA, 201 bp, Homo sapiens
gtgggtgtccatcaggcatcgggtgagatgtggagatggtagaaggtccagaaatggcctgactgtctggtggttgcagatgtggacgaatgccggaaccrgtccttctgcggtgcccacgccgtgtgccagaacctgcccggctccttccagtgcctctgtgaccagggttacgagggggcacgggatgggcgtcactgc

SEQ ID NO: 26682 - DNA, 201 bp, Homo sapiens
  misc_feature (1)...(201): n = A,T,C or G, or insertion/deletion polymorphism (see Tables 1-2)
ggactgggacgaggaagggtgagaaagcgagggtgaccacctcccccactgcaccccccagggtgtgctccgtgcgctccgtggacggctcacccacgacngccttcacagtgctggagtgcgagggctcccggcggctcggctctcggccccggcgctacctgctcactggccaggccaacggcagcttggccatgtggg

SEQ ID NO: 26683 - DNA, 201 bp, Homo sapiens
gccgccctgtgggcccggccgctgtgacaacacggcaggctcctttcactgtgcctgccctgctggcttccgctcccgagggcccggggccccctgccaargtgagggtgctgagcccagccctactccatcactgtttgctgtggagactggagagagattattgaggggcagagaggcagagtgatggggctcagggat

SEQ ID NO: 26684 - DNA, 201 bp, Homo sapiens
aggtggaggcgggaccaaggcgctgtgggaggagcttagaaacctggcattggtgggggcggggttactgcgatgtgggcggagcttgtctgggaggccgsgtcccgtgactccgcccaatctcccgcgtaccctagacgtgaacgagtgcctggagggcgatttctgcttccctcacggcgagtgcctcaacactgacgg

SEQ ID NO: 26685 - DNA, 201 bp, Homo sapiens
cctgcgcttgcgactctggcttccggctcagcccccagggcacccgatgcattggtgagcaagacggagggcgcggaaggaggcggggcggggggctttgyctggtcaccttgtcaccagccccctccgtgtcctcagatgtggacgaatgtcgccgcgtgcccccgccctgtgctcccgggcgctgcgagaactcaccag

SEQ ID NO: 26686 - DNA, 201 bp, Homo sapiens
attcctgtgggaaccccgggttcagggccagggcctccttggaataaatggttattgttactaggtccccaccttccctcttttctggaagccaaagtcascctccccaataaagtcctcactgccaacatcttgcttattcttagcaggtttgggactccccaggaaaggggtggggaagatgtgggacccaacccgata

SEQ ID NO: 26687 - DNA, 201 bp, Homo sapiens
tttttgtagagacattgtctcactatgttgcccaggctggtctcaaactcctgggctcaagccattctcctgccttagcctcccaaagtgctgggattacrggtgtgagctaccatgcccagcctcacactctagaaaattttttacatgccaggatattcagaatattgggggatattggcatgttaggaaatctagtat

SEQ ID NO: 26688 - DNA, 201 bp, Homo sapiens
  misc_feature (1)...(201): n = A,T,C or G, or insertion/deletion polymorphism (see Tables 1-2)
gagggcttgacctagacaccagacagaagcgagggaggcagccatgcagagagctgaggggagactgttcctggcagagggaagagccagtgcaaaggctntgaggcaggaccatgcttttgagaaatggcagtgaggacttgagagttatcaactatgctaggtgtggtggcacaagcttgtaatcccagctactcagga

SEQ ID NO: 26689 - DNA, 201 bp, Homo sapiens
gtcttgggggttatacaaaaacagggtcatggagtacagtcatggggcagagccgggctctgggacagcccacgaatagctgtgaatggagtgtgagtgcygtcgtcacctgccccagggactgtgtgtccctggacggtgctggacccagatttctgggtgtcagtgtgggatggaggcatggattgctgtaggtggcag

SEQ ID NO: 26690 - DNA, 201 bp, Homo sapiens
aggttcaacatggcatgatttagagagcaaaggaaggggtagggagagatggggccagggaaagagtcaggtgcccgatcacactgacttatcacagtaagagagcactgcggtaccgtggaaggggtttcggcgttttttttttgaaaattttttttaaatgttttttttttaagacagggtcgtactttcacccaggcc

SEQ ID NO: 26691 - DNA, 201 bp, Homo sapiens
cccatgcattgatctctgcttcctctctcctgtcctgaccctcggtgcttgcactgcaatgcaacccaggcccttgccctatgacccctgtcttgccccctgaccctgcttccgtgccccccagcaggtggcctgacggagcaagagctgatggaacagctggaacactgtgagctggccccgccggctccttcagctccc

SEQ ID NO: 26692 - DNA, 201 bp, Homo sapiens
agagatggggccagggaaagagtcaggtgcccgatcacactgacttatcacagtaagagagcactgcggtaccgtggaaggggtttcggcgtttttttttwgaaaattttttttaaatgttttttttttaagacagggtcgtactttcacccaggccggagtgcagtggcgtgatctcagctcactgcaacctccacctcc

SEQ ID NO: 26693 - DNA, 201 bp, Homo sapiens
ggatgagtgtgcccgaagccccccaccctgcacctacggccggtgtgagaacacagaaggcagcttccagtgtgtctgccccatgggcttccaacccaacrctgctggctccgagtgcgagggtgaggccggggagggagggaggagtgtggatgggtgaggggggagttggaccacttcttcaaggccaccctctcccct

SEQ ID NO: 26694 - DNA, 201 bp, Homo sapiens
tggggccagggaaagagtcaggtgcccgatcacactgacttatcacagtaagagagcactgcggtaccgtggaaggggtttcggcgttttttttttgaaawttttttttaaatgttttttttttaagacagggtcgtactttcacccaggccggagtgcagtggcgtgatctcagctcactgcaacctccacctcctgtgc

SEQ ID NO: 26695 - DNA, 201 bp, Homo sapiens
gagtcaggtgcccgatcacactgacttatcacagtaagagagcactgcggtaccgtggaaggggtttcggcgttttttttttgaaaattttttttaaatgttttttttttaagacagggtcgtactttcacccaggccggagtgcagtggcgtgatctcagctcactgcaacctccacctcctgtgctcaaggaatcctcc

SEQ ID NO: 26696 - DNA, 201 bp, Homo sapiens
cctgctgagtaactgggactacaggcacatatcaccacaacagctaatttttgtattttttgtagagatgtggttttgtcatgttgcccaggctgcagtatttttttttttttaatttttaaatgttacatatttaggctaggattggtggctgaaggccataatcccagctctctgggaggccaaggcgggaggatcacc

SEQ ID NO: 26697 - DNA, 201 bp, Homo sapiens
ctggcccgggcacccgctggccctatcggtcccgggacacccgccgctccttcccagagcccgaggagcctcctgaaggtggaagctatgctggtgagcaytgccagcgcatgatgagactgagatgaggggtgaggtgtgcacggagagaggagggagggaaacagaaggcgggaggagagacggaacacaggtgcaact

SEQ ID NO: 26698 - DNA, 201 bp, Homo sapiens
cccgggccacacctttgcgacggccacgccctccgaaggccacgccccatgctcctggctcgaccacgccccactgagccctcactcagtctctgtcccabtgtctgtctctctgaggcgagctggctaggtggttaaaggcaaaagttttagggcaacctttgcatgttgcctcttggactccaggtttctttctgcaca

SEQ ID NO: 26699 - DNA, 201 bp, Homo sapiens
tcccatgggtcgctccaattccagcctctcagaccctgattcttagcaggcttcattacccttgatctcagcacgtccgaatcccagtctcagccttcagmttctcagcgctggctccagaaaccccggggccacccaggaccctccccatccagtcctctgcctcctctcccaaggggggtatgtgagtggtgggtgtgg

SEQ ID NO: 26700 - DNA, 201 bp, Homo sapiens
gcagcttccacctctcatgcccaaatgatcctcccacctcagacttgcagtagctgggagtccaggagcccgccaccaagcctggctaatttttgtatttwtatatatatatatatatatatatatatatttttttttttttttttttttttttttttttgtaaagatgggtttttgccatgttgcccaggctggtcttga

SEQ ID NO: 26701 - DNA, 201 bp, Homo sapiens
aggtactagtactgtcagggcaagggcgagctgccaggcaggtgggcatgggcagacataaggctgagaggtgggcactaacaggcacagggccagagggrcttttgtgacaagtgggcacgagcaggtcagggctggggctggggctctggtgtcctggctcaggcttgtctctgtgtgtagctgagtaccagtcattgt

SEQ ID NO: 26702 - DNA, 201 bp, Homo sapiens
ccaggagcccgccaccaagcctggctaatttttgtatttatatatatatatatatatatatatatatatttttttttttttttttttttttttttttttgwaaagatgggtttttgccatgttgcccaggctggtcttgaactcatgggctcaagcaacccccccacctcagcctcccaaagtgctgggattacaggctcc

SEQ ID NO: 26703 - DNA, 201 bp, Homo sapiens; identical to SEQ ID NO: 6533

SEQ ID NO: 26704 - DNA, 201 bp, Homo sapiens
accactgagtccctctcccctgttgtctcctgcttacagatgtgaacgagtgtgaaacactacagggtgtatgtggagctgccctgtgtgaaaatgtcgarggctccttcctctgtgtctgccccaacagcccggaagagtttgaccccatgactggacgctgtgttcccccacgaacttctgctggtgagactgatgtgt

SEQ ID NO: 26705 - DNA, 201 bp, Homo sapiens
aaccagccaggcagcttagtagggattggtggaggatgcagagtcagatgatggtgacaaggaggaatagagatggggtcacggggacagaatgttggagrgtggaaagccaaagtgacagaggtcagggaggcagaggggaacaagtgaccccgggccccctgccctgtgcagatgtggatgaatgcacccagagcccag

SEQ ID NO: 26706 - DNA, 201 bp, Homo sapiens
gcccaagccccccgcaggctgaggcccggcgccgtggtgggggcagctttgtggaacgctgccaggaactggtgcggagtgggccagacctccgacggccmcccacaccagccccgtggccctccagcggtctcggcactcccctcacacctcccaagatgaagctcaatgaaacttccttttgaacaacgcagctgccat

SEQ ID NO: 26707 - DNA, 201 bp, Homo sapiens; identical to SEQ ID NO: 6562

SEQ ID NO: 26708 - DNA, 201 bp, Homo sapiens
tttttcatggctgtgtagtattcatggaagggttctaagcaggaaagatagaatcagattttgaaacctccctctggccgccatgtgaaggtgattgaagygggtgatatggaggctgggagctcagggaacaggctggggcaggggcctggacaggagagaacagggctggaccaaggcaggggctgtggaaggggagga

SEQ ID NO: 26709 - DNA, 201 bp, Homo sapiens
tgaaacctccctctggccgccatgtgaaggtgattgaagcgggtgatatggaggctgggagctcagggaacaggctggggcaggggcctggacaggagagracagggctggaccaaggcaggggctgtggaaggggaggagaaggtggtgggagaaaaacccaagaggccatgtggacaagctgtggatgtctgggtgggg

SEQ ID NO: 26710 - DNA, 201 bp, Homo sapiens
acaagctgtggatgtctgggtggggaagctgtgtccaagacaaggcataggttttttgtttgtttgttttgtgacagagtctcgctctgtcgcccaggctrgaatgcagtggtgtgatctcggctcactgcaacttccgctcccgggttcaagcgattctcctgcctcagcctcccaagtagctgggattacaggcatgcg

SEQ ID NO: 26711 - DNA, 201 bp, Homo sapiens
gtgtgatctcggctcactgcaacttccgctcccgggttcaagcgattctcctgcctcagcctcccaagtagctgggattacaggcatgcgccaccacaccyggctaattttttctatttttagtagagaccgggtttcaccatgttggtcaggctggtctcgaactcctgacctcaagtaatccaaccgcgtcggcctcct

SEQ ID NO: 26712 - DNA, 201 bp, Homo sapiens
gctgttagctgcagtgacgggaaagtgtgaggtggggaggcaagagatgcagaaatgacaggaggtgacagtgggagaaagagaaacagtgacagaggagygtgagaggtgtggagtctggttctgccactgatggctgccaccctctgtttccctatctatgccagcctcagtttccccatctatgatagtggcggggct

SEQ ID NO: 26713 - DNA, 201 bp, Homo sapiens
cccagcatccctgcctggactggtcctgagattcctgaatcaggtttgctagaaagaactgagggcattgggcctgcagcagtggctcacgcctgtaatcycagcattttgggaggctgaggagggtggatcaccaggtcaggagttcgagaccagcctggccaacatggcgaaaccctgtctctactaaaactacaaaaa

SEQ ID NO: 26714 - DNA, 201 bp, Homo sapiens
agacccctgggccaggagccaccccgagtgtcactcagccagcctcgtaccctgccagccacctctcggccatctgcaggtgagctggctctggcagaagygggtgccatcttcaaggggctgccccagccccatagtgaaaggaggcaagagaggatttgggctccactcgttgataccccttctttatcaggctttctg

SEQ ID NO: 26715 - DNA, 201 bp, Homo sapiens
ctcggcctccgacctccgctacaacaccagacccctgggccaggagccaccccgagtgtcactcagccagcctcgtaccctgccagccacctctcggccawctgcaggtgagctggctctggcagaagtgggtgccatcttcaaggggctgccccagccccatagtgaaaggaggcaagagaggatttgggctccactcgt

SEQ ID NO: 26716 - DNA, 201 bp, Homo sapiens
  misc_feature (1)...(201): n = A,T,C or G, or insertion/deletion polymorphism (see Tables 1-2)
tggcccttggccctgcccttccctgacccgcctccacccagctccagcctccctttgaccccacccctacccagctcccaaactgccagtttctatcgggncctggtcgcaactcgtattgctccgcccccacgcccaggccccgcccttattggccacgcccctccctgactaactccctcccccaggccccgccactgt

SEQ ID NO: 26717 - DNA, 201 bp, Homo sapiens
cgggcccggggccagcatgcgcagggagaggcgaggcttgtccagggagggtggaagccctgactagggggtgctggtcagggacgggaaaggacctcacyacaggggacgggccagcgcaaaagggaggagtaattcttccacctgggtggggcttgactgaagaaggcggagtcagggtgccagcagggcagggcttaa

SEQ ID NO: 26718 - DNA, 201 bp, Homo sapiens
ccaccctctcccctgccccccagatgtggatgagtgtgagaaccacctcgcatgccctgggcaggagtgtgtgaactcgcccggctccttccagtgcaggrcctgtccttctggccaccacctgcaccgtggcagatgcactggtgagaccaggccctggctgtgaccttgggcctgcatcatgacccccgacccttgacc

SEQ ID NO: 26719 - DNA, 201 bp, Homo sapiens
gcctggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactg

SEQ ID NO: 26720 - DNA, 201 bp, Homo sapiens
gcgcagggagaggcgaggcttgtccagggagggtggaagccctgactagggggtgctggtcagggacgggaaaggacctcactacaggggacgggccagcscaaaagggaggagtaattcttccacctgggtggggcttgactgaagaaggcggagtcagggtgccagcagggcagggcttaaccacggggctggagccgg

SEQ ID NO: 26721 - DNA, 201 bp, Homo sapiens
attctactctttggccaggacaccaccccatcccagcctccagctcaaacccctgacactctccagccaagccctgcccctagccaaggccagagtctggkctggccatcgttttcttcccgctctcttgtcctctctctgtctctcttacctattcccagagggtttccgggagatctgcccggctggtcctggttacca

SEQ ID NO: 26722 - DNA, 201 bp, Homo sapiens
  misc_feature (1)...(201): n = A,T,C or G, or insertion/deletion polymorphism (see Tables 1-2)
cctcagtcttcccacctgtaaaatgggaatattaatcaagtctgcctaatttggatggcagtaaagccaagtgattaaaatcaagaacatagccgggcgcngtggctcacgcctgtaatcccagcactttgggaggccgaggcgggcggatcattaggtcaggagtttgagaccagcctggccaatatggtgaaaccccgt

SEQ ID NO: 26723 - DNA, 201 bp, Homo sapiens
attattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttct

SEQ ID NO: 26724 - DNA, 201 bp, Homo sapiens
ttattttcttaacaaaatcctagtgcggtatgggccaccatatccatcttacagaacacgaaactgaagcacagtgaggttaagccacctggccgggctcacacagttagcagatggcagaggccagattggactccaaactgctcagcatctgtgctcctctgttccaagaacttaaggggccaaggaggcgagcttctg

SEQ ID NO: 26725 - DNA, 201 bp, Homo sapiens; identical to SEQ ID NO: 6536

SEQ ID NO: 26726 - DNA, 201 bp, Homo sapiens
gatccaggattccctatagatctgggggctataggcgcccttcctgtctgcgggtgacgggactgaaggaagccgtctgcccagcacccccacccaccctycccgcctggcggcccagcgctccgttacaaaggccccgggctcctctcccgcctgggtctctgcgaatgcgtttagtaacccgagccgcggcgggggcgg

SEQ ID NO: 26727 - DNA, 201 bp, Homo sapiens
ggcctgtgaaaatggcgccacctgtcggccaggctcaggatggcgtctgagtcccggaccgggatgtgcgggagggcggggttctagattcccagacagtscgggcttagaaatgctcttagaaatcgagtcttttgtttttgtttttgttttttaatcacttttaaaaggctttaaaataacgtattttttcaataaaat

SEQ ID NO: 26728 - DNA, 201 bp, Homo sapiens
gccaggctcaggatggcgtctgagtcccggaccgggatgtgcgggagggcggggttctagattcccagacagtccgggcttagaaatgctcttagaaatcragtcttttgtttttgtttttgttttttaatcacttttaaaaggctttaaaataacgtattttttcaataaaatcttacgccaaaatctcttcataagaca

SEQ ID NO: 26729 - DNA, 201 bp, Homo sapiens
gggcttagaaatgctcttagaaatcgagtcttttgtttttgtttttgttttttaatcacttttaaaaggctttaaaataacgtattttttcaataaaatcktacgccaaaatctcttcataagacaaaagtacggtttctgtgcccttcagcccgaagtctaagccaatttgcctcccattgtacagatggagaaactgag

SEQ ID NO: 26730 - DNA, 201 bp, Homo sapiens
agcttggtccccaaagctctcctttctgcccttgcgctaccaaaccctgccctccacaattgcctctctcactgtgcccctctccggctgtcctggccggrtccccatcctggctctggcccaagcttggtcccgctcccgcttccctctacccctgcctccttgcgtcgcttctcccggggctgtctgccccagtcccag

SEQ ID NO: 26731 - DNA, 201 bp, Homo sapiens
cagggtctcgctcctgctctcactccagagcctctccagccctcccacgcttcccctctcgggtcccgccccaggactgctctgccctggcccttggcccygcccttccctgacccgcctccacccagctccagcctccctttgaccccacccctacccagctcccaaactgccagtttctatcggggcctggtcgcaact

SEQ ID NO: 26732 - DNA, 201 bp, Homo sapiens
ccctgactaactccctcccccaggccccgccactgtcctgcaactgcggcaaccaatctcctgaccgcgaccccgattccaaccctgccacaccagagccstatccccaaactgctcctttcttctctagcccctaccccaccttcccttagcttggtccccaaagctctcctttctgcccttgcgctaccaaaccctgcc

SEQ ID NO: 26733 - DNA, 201 bp, Homo sapiens
ggcacagggggtggggtcagggtgggatggggggcccaggcggagggggaggggtgggatgggggcccagggggagaggtcggggtgggatggggggaccrgggggaggggttggggtgggatagggggaccaggggcaggggtcgggatgggatggaggagacccagggagctgtaggagccttgcttcagctgggaaag

SEQ ID NO: 26734 - DNA, 201 bp, Homo sapiens
ctcaggtgcctccctgattcctgtgggaaccccgggttcagggccagggcctccttggaataaatggttattgttactaggtccccaccttccctcttttytggaagccaaagtcaccctccccaataaagtcctcactgccaacatcttgcttattcttagcaggtttgggactccccaggaaaggggtggggaagatgt

SEQ ID NO: 26735 - DNA, 201 bp, Homo sapiens
tggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgagg

SEQ ID NO: 26736 - DNA, 201 bp, Homo sapiens
ggcccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggc

SEQ ID NO: 26737 - DNA, 201 bp, Homo sapiens
ctctttggccaggacaccaccccatcccagcctccagctcaaacccctgacactctccagccaagccctgcccctagccaaggccagagtctgggctggcsatcgttttcttcccgctctcttgtcctctctctgtctctcttacctattcccagagggtttccgggagatctgcccggctggtcctggttaccactactc

SEQ ID NO: 26738 - DNA, 201 bp, Homo sapiens; identical to SEQ ID NO: 6555

SEQ ID NO: 26739 - DNA, 201 bp, Homo sapiens
gcctggggcgttcacgactgtcagctgtgctccgagcgcctgggtaagccccaggacgtccccgaagtgctcggagctggggagtggtgacaacctcaccrttcctcctactctgccctagataaacccagttcacaaattgtagccacgcctaccccattgtggaggcgacttccagtcctgagcttttcataccgctct

SEQ ID NO: 26740 - DNA, 201 bp, Homo sapiens
ccaggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccag

SEQ ID NO: 26741 - DNA, 201 bp, Homo sapiens
tcccagtcctgtgtcccttgatctgtcacaatggcggtgtgtgcgtgaagcctgaccgctgcctctgtcccccggacttcgctggcaagttctgccagttrcactcctcgggcgcccggcccccggccccggctataccaggcctcacccgctccgtgtacactatgccactggccaaccaccgcgacgacgagcacggtg

SEQ ID NO: 26742 - DNA, 201 bp, Homo sapiens
caggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccaga

SEQ ID NO: 26743 - DNA, 201 bp, Homo sapiens
aggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaa

SEQ ID NO: 26744 - DNA, 201 bp, Homo sapiens
ggcccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaa

SEQ ID NO: 26745 - DNA, 201 bp, Homo sapiens
cccctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaagg

SEQ ID NO: 26746 - DNA, 201 bp, Homo sapiens
cctacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaagggg

SEQ ID NO: 26747 - DNA, 201 bp, Homo sapiens
tacggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtc

SEQ ID NO: 26748 - DNA, 201 bp, Homo sapiens
cggtgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtccc

SEQ ID NO: 26749 - DNA, 201 bp, Homo sapiens
cactggcctaggctgaactcagaggccttgccccatgggctccaaatctaggccctcagatccccagtcgcagaacccccagactctatccaaactctgtsccctagaccaacccctatgtcgcagcccatcccaaaatcttggtccccgattcacactccaaagacttccaagtctcagccacagacatcccaaggcctg

SEQ ID NO: 26750 - DNA, 201 bp, Homo sapiens
ggaagggtccagcccctgggaggacctgagtgccaggcccactctgacacatgctgtctccacctacagatgacaatctgggagtgtgctggcaggaagtrggggctgacctcgtgtgcagccaccctcggctggaccgtcaggccacctacacagagtgctgctgcctgtatggagaggcctggggcatggactgcgccc

SEQ ID NO: 26751 - DNA, 201 bp, Homo sapiens
gaagggttgggtggtagttagatcaggagctggagtcacagttgggctcttctgtgtcaatcgagcaagccatttaacctctgagactcagttttctcatrggtaaaatggggatggttgttgagatgcctctgaagtgtctgacacctagtaagtgctcagataaatacttatggtagataattatttttcattatctaa

SEQ ID NO: 26752 - DNA, 201 bp, Homo sapiens
ggtgcaatcatggctcactgcagcctcggccttctgggctcaagtgatcctcctgcctcagcctcctgagtatttgggactacaggtgtgtgccaccacarccagctactttttaagtttttttgtagagacattgtctcactatgttgcccaggctggtctcaaactcctgggctcaagccattctcctgccttagcctc

SEQ ID NO: 26753 - DNA, 201 bp, Homo sapiens
cgcttccctctacccctgcctccttgcgtcgcttctcccggggctgtctgccccagtcccagccgcctggtctgtgcctacagatgtggacgagtgccacsgcgtgccgccgccgtgtgacctcgggcgctgcgagaacacgccaggcagcttcctgtgcgtgtgccccgccgggtaccaggctgcaccgcacggagccag

SEQ ID NO: 26754 - DNA, 201 bp, Homo sapiens
ttccggattatcagagaatctggaacacaaatgggagacgtaaaaggtgagtgcctctgaaaccggggtgttctgaaatagctgtgcacctcaaaccctarttttgtttttgtttgtttgtttttgagacagggtcttgctttgttgcccgggctagggtgcagtggtgcaatcatggctcactgcagcctcggccttctg

SEQ ID NO: 26755 - DNA, 201 bp, Homo sapiens
tcatgaaagatggagaagcagaatgaggagggatggagatgtcagtaatcgggtaaggggagcagagttatggaggaaaggggagaaggaggccttctcayggggactacagagacagaaccagccaggcagcttagtagggattggtggaggatgcagagtcagatgatggtgacaaggaggaatagagatggggtcacg

SEQ ID NO: 26756 - DNA, 201 bp, Homo sapiens
actggattcagattccagtcactaactctgacccatggctcagccgaatcccatccaatgatcctagtttataatacttgactggtcccttgccctagttsatttctgatccctgtctgatccctctcctgactccaaaatcctggcacaggtagttcctagaaacctagacccacaggacttgcaaccatggtccccgga

SEQ ID NO: 26757 - DNA, 201 bp, Homo sapiens
ctgatccctctcctgactccaaaatcctggcacaggtagttcctagaaacctagacccacaggacttgcaaccatggtccccggaacccgagaaccttggycagccctacccacctctgccatagagccctcccccagcctccaactcatgagacttcccaccacctcccccagacaccctactccaaggggattggtcgg

SEQ ID NO: 26758 - DNA, 201 bp, Homo sapiens
gcctaggagagccgaggggcggtggaggggtgtggcctagaatgttaggcggagcgggaggtgggccgggccttcggacgccctgtcccgcagacgttgaygagtgcagcgaggaggacctttgccagagcggcatctgtaccaacaccgacggctccttcgagtgcatctgtcctccgggacaccgcgctggcccggacc

SEQ ID NO: 26759 - DNA, 201 bp, Homo sapiens
gactccccgactcgccgattggcctcccacctctgtctttcctcctccgcttctcccctccccttacctctttcccccgcctcctctcctagcctccccawctctcctctaccccaatcttctcctgccctctcctctgcttccccggcctcccccttctgactctcctctcccctctttgtatcccccatcttgcctccc

SEQ ID NO: 26760 - DNA, 201 bp, Homo sapiens
aactctcccggctcctaccgctgtgtccgggactgcgatcctgggtaccacgcgggccccgagggcacctgtgacggtgagcctgcccccacccgccttcrctagcgcttgcaacgcggtgctggaggctgctcccttggggactgaggaggggcgccctgcttcccagacttaggcggagggaaagaacaccctctcacc

SEQ ID NO: 26761 - DNA, 201 bp, Homo sapiens
tctcaccgtatctctgtagtggaaataagccgccaccgtgtccatgtattttcttgtgtcaggatcacggccaagcctcccttccagccgcagtccattcsccctctgcagctgaagcccggtccacattttaggctatgcccccagtaagacaccgccccaaaactgttaggccccgccccttccaatcggcctctggat

SEQ ID NO: 26762 - DNA, 201 bp, Homo sapiens
ctgtaggtgtgagcgccactttgaagggcatccaacccgcggctatccatgtggaatcgctttcagtccttgtggacgattcgcggcttgtggggccgagracagacacgtatgtactgtttgactgtctataaatgtagagagtctagactttggtaatgtgtagactgtttaatattgttgcatattaggatagaaacc

SEQ ID NO: 26763 - DNA, 201 bp, Homo sapiens
tatttgagaggatccttcttccttgctaccaattaagccagtttacattcacataaaatacataatcgctgtatgattcacgaatgtataattacttaackgtgattttcataattctgtctgtgctaattataaacacactcttgaggaaagttaccatctttctttcttcgtttcctctattaagaaagtaccctgtac

SEQ ID NO: 26764 - DNA, 201 bp, Homo sapiens
acagttgatctccctccaaacctcccctgctctttggtgtgtgttgtagttttttgtttgtttgttttagacagggtcttgctctgtcacccaggctggartccagtggtgtgatcacggctgactacagcctcaaaccccctggctccagtgatgctcccacttcagcttcctgagttgctcggactggcagtctcaagc

SEQ ID NO: 26765 - DNA, 201 bp, Homo sapiens
ttctattgtatcataattgtaaatatatttttaaaaaccttggttacttgaagttgcatggcatggtttgtgtctggatgaaaaccgagactgcgtttcaytcgactgtagtgagggtgatctccaggcatctcacccctgcgtgggcacagacactggcactcactcactagcagcgaatttgctgttctgtgtccagct

SEQ ID NO: 26766 - DNA, 201 bp, Homo sapiens
gttttagacagggtcttgctctgtcacccaggctggaatccagtggtgtgatcacggctgactacagcctcaaaccccctggctccagtgatgctcccacytcagcttcctgagttgctcggactggcagtctcaagccaccacccccgactaattatttatttatttattgtttgtattaagatggagtctcaccagttt

SEQ ID NO: 26767 - DNA, 201 bp, Homo sapiens
tgtgtgagtcattgtacaaatagaaatgcaaagacagcattgttaacttctgggaaactttaaatctccagtattcttcattgagtcatctttttatttattttttttttaatttttttctgactaaggtatgtgggtgtgaaatttaaatctgttttatttaggctgtattactttgagagttgtggtttagctttgcca

SEQ ID NO: 26768 - DNA, 201 bp, Homo sapiens
catgtgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcat

SEQ ID NO: 26769 - DNA, 201 bp, Homo sapiens
atgtgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcatc

SEQ ID NO: 26770 - DNA, 201 bp, Homo sapiens
tgtgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcatca

SEQ ID NO: 26771 - DNA, 201 bp, Homo sapiens
gtgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcatcac

SEQ ID NO: 26772 - DNA, 201 bp, Homo sapiens
tgattgttaaaatatactagatttctaaatgtaataaaaaatattaaataggattaaaggcttagagactagggttttaaaacgttaagtgtttaatgaattgaattttaaatttataaacatcaaaataaaccataaataattttcctgtgtacaaaaccatcttggtgcatcagaaactcatgctgcagtagcatcaca

SEQ ID NO: 26773 - DNA, 201 bp, Homo sapiens
agtcttgcttgtggttattggaagcacctcctaggctcttgcactagagcgtctgcgcctggtgctgtgtgtgaagttctcatcttttgctgttggggagygtcagggagccccccaggagttcctgccctggcttcatttagccaggaagtctctataagaagccaagctacttagagcttgaggacatcttactgggaa

SEQ ID NO: 26774 - DNA, 201 bp, Homo sapiens
aggcatctcacccctgcgtgggcacagacactggcactcactcactagcagcgaatttgctgttctgtgtccagctcctccggggtttgctctgtttgtcygacccctcctacagacatgttaaggtgggagggcttcggcaggcaaagaagctaatggaacagtcactgcttccctctggagacgcggcctctgctcatg

SEQ ID NO: 26775 - DNA, 201 bp, Homo sapiens
cactcgggaactggagaaaggtttccttctcaaatttattgactagaactcagttccaaatcaacatttcaaaaaagtttcttatttctgtgagaggcaayatatattatatttctactaatgtggcattaatgcttgtttttttcttttttagtccctgagtggtttcaaatgtgtgttttcatgtacaatttatagttc

SEQ ID NO: 26776 - DNA, 201 bp, Homo sapiens
agtgcaatgtattatgatctacagtgtaaaacaaaagattctgaatttgagtcagtaatagctggtttattccaggattcaaatgtaagtaacttactctyaccaacagtagtcaaaatgagaagcctgctatgctgtggatttatggctcatggactctggatgagttctgcatttatcttcgtggagtgacgaataatt

SEQ ID NO: 26777 - DNA, 201 bp, Homo sapiens
attcatttgaccagcaagacccacatccagcagcaaggactccaccgggatgggagcctggtgcttattctcgaactcagcaatccagcagtgcacctggstctgtttccagcctggccaatgatattctaagcatgaattattacatattactaattattaaaaattaaatgtaatatcttgagcatgccctgttcaatt

SEQ ID NO: 26778 - DNA, 201 bp, Homo sapiens
ataatacttaaggttacatgccagtgttcactgagtgcaaggagaacttaggaaatatatttttattggcgagagagagagaaataaacctttattgtggrgaaatgaatctggaaaagtttcttttataatgaaggtgtttgccactcagcagtcatgcatgtttgattgaatgaaacaggaacgtatgggaagacctgt

SEQ ID NO: 26779 - DNA, 201 bp, Homo sapiens
ttttactgggtggtgtcgctaacgatgttgaaaccgcgtccctgcaggtgctgtgcttgctggcctccctctttggcgggaagattgccgtgttggagatsaacccggccgcgctagtcagggctcagcagtgccccagcatggggcagagcctctcggtgccagccaggtagagtgtcttcaagtgtggagtgtgtgtgt

SEQ ID NO: 26780 - DNA, 201 bp, Homo sapiens
acacttaggctgctataaaaaattatcccatttttatattcaagtcaatatgttttttcaagtctaaaacagtgtacagtatagaaaagggcaatgaagayagtctcttattttagtgataatcttctgtcctgataacttattaagtggaggggaatgcaagtttttaaaaaatactttgatatttttatttttattgaa

SEQ ID NO: 26781 - DNA, 201 bp, Homo sapiens
ggctccattacaaaagtgaaggctcactaatattattctggaaaattactcacttaagattggttaattatattgtaattgacctcatgtgtcatatggcmatagttttggtgtgttaatttacaatttttatttttcccctaagaatttttgtgagaaatataaatgatgattgttttttcatcctcttcactgcctgta

SEQ ID NO: 26782 - DNA, 201 bp, Homo sapiens
gtatagatcagatgctcagtgaatgctggtgaaataaatcaatccatgttcttatgttataactagttatttctaacaactttacttatgttaatattgcytagaaagtacagtatttttcatccaagagtatttatgtcatcgtggaggcaaaaatatacatctaccacacagaattctagaaaacaaaatgtatgtagt

SEQ ID NO: 26783 - DNA, 201 bp, Homo sapiens
tgtggaagtattttcagtttgttctgggagaagagaaccttaagtatctccttaagcatgttatgctcttctagcaggtcgtaatgttcacataaaaataycaatttagccttcaaagcaggccttaaaagaaggtgttatcattcccttatatagaaaggagcctgagatttaaagcgcttgaggttgacccctggccac

SEQ ID NO: 26784 - DNA, 201 bp, Homo sapiens
cacgcgccctaaatgtacacattgctcctcataggtcaagtttatgaagcacgtcacggtcacctgccgacatggcactgtctgggttgtgtctcccatcrtgaagcctgccccaggtgctgtcacccattctgtggatctgtctaatcttagtccagtcctttctgctgagtgcagtatctacatattcaattatttgac

SEQ ID NO: 26785 - DNA, 201 bp, Homo sapiens
ttcttttctaaagataaaaatggtaccatgtcttcctcctgacctgtgtactaaaccggaaagaatggcttgcggatgggcagggagacgttgctgggccrggctgggagtgagaggtcggcggctccctagagcaggggccacatcgggacagccaggactctggtgctgcctgaaaacgttccctgagcacccgcagtc

SEQ ID NO: 26786 - DNA, 201 bp, Homo sapiens
catgtccccaatcctgtgtctggtgttcacctcgcctcgtgggtggctgcctgttagctggttttgctgtttgtgtttgtgtctaccttctttttgctcakgctgtgtcactcctaggctcatttactaggacctagagaagtgtgccctcagccagtgtgaggaaaacaggcccaggctggcactgagtagccgttggga

SEQ ID NO: 26787 - DNA, 201 bp, Homo sapiens
gcatttgattacaggctgaagaaggaggacggcgtgggggatcttttgtatgtcaaaaatcaccacaaataattagatgttaatagaaaaacaggtttttyttcctaaagaaaaattaaggtagctaattcacttttcccctcagtatcataaaatatgatttttaaagtgatatgaaaactttcttttcatgtttaatgt

SEQ ID NO: 26788 - DNA, 201 bp, Homo sapiens
cagaataattcatcccaaatgtgggttgttgatgctcccccaccatggctctcttgggcaccctggctggaccctcactgtctctgcatgtgagtgggtaygcaggctgtgacttctgtgtgaagcctgcgggcccggtgagtggtgccgtcactggctgagggccacagctgagccactggggtaaccgcccaatggttc

SEQ ID NO: 26789 - DNA, 201 bp, Homo sapiens
cacacagggagttcaggaagaacaggaagcgtgcaggttaagtatggagaaagctgcttcacacgcggatacacagagatataatttattggaatggatarcagagtcacaaatatcacattaccttatattatcaaattgattttatattactatcgcaatcatcaattttctattgtcagttgtaaaatagttacagtc

SEQ ID NO: 26790 - DNA, 201 bp, Homo sapiens
agaaagtccatttgcataataagattagggttgggcggctgggcacagtggctcaggcctgtaatcccagcactttgggaggcagaggtgggtggatcacytgaggtcaggagttcaaaaccagactggccaacatggtgaaacccggtctttactaaaaatacaaaaattagccgggtgtggtggcatgaccttgtaatc

SEQ ID NO: 26791 - DNA, 201 bp, Homo sapiens
cgcgctagtcagggctcagcagtgccccagcatggggcagagcctctcggtgccagccaggtagagtgtcttcaagtgtggagtgtgtgtgtgtgttcacyaataagtgccatctggatttctatgttcagaaataaagattagaaaactctgagctctggccgggcgcggtggctcacgcctataatcccagcactttgg

SEQ ID NO: 26792 - DNA, 201 bp, Homo sapiens
ataattgttgtttactgttgaatgcaataataaaacttacaggcaggtttgtttactattattatttcaaattagtgatgagaatctgtatgagcaatcaygttgcacatgaggatgtcttaaccagtgactgaccatatcacattgctggtggcataagattatgatggagctgaaaaattctttttgtttattatttcc

SEQ ID NO: 26793 - DNA, 201 bp, Homo sapiens
cttctgaggcttggctggactgggctcagctcggcgaggcttcaggctggtggaagggagtgctcgctgacagcgtacctggtgggggtctccccggctcycgtgtgctggtccctggcatggtcacttaactcccgacccgttctgcacctgtggttgcgtgtggggtccacatgggtgttggcatgaggacgcgggcgt

SEQ ID NO: 26794 - DNA, 201 bp, Homo sapiens
ttcgcagtttctaccccgtgctggtcagaacacatctcccgccgtgtaagcaaggtggcgggactgcactcccaggccgggaggcttctgaggcttggctrgactgggctcagctcggcgaggcttcaggctggtggaagggagtgctcgctgacagcgtacctggtgggggtctccccggctcccgtgtgctggtccctg

SEQ ID NO: 26795 - DNA, 201 bp, Homo sapiens
  misc_feature (1)...(201): n = A,T,C or G, or insertion/deletion polymorphism (see Tables 1-2)
tggaaactggccttcagtctcggcagaagcacacacaacaacgttagcagtttgttcactgggaagggagtactaggtatctcttgattcgcagtttctancccgtgctggtcagaacacatctcccgccgtgtaagcaaggtggcgggactgcactcccaggccgggaggcttctgaggcttggctggactgggctcagc

SEQ ID NO: 26796 - DNA, 201 bp, Homo sapiens
tattgattgattgattgattgatttgagatggaatcttcctctgtctcccaggttggagtgcagtgccatgatctcggctcactgcaacctccacctcctyggttccaatgactctcctgcctcaggctcccgagtagctgggattacaggcgcgtgccaccacgcctggctaatttttgtatttttagtagagatggagt

SEQ ID NO: 26797 - DNA, 201 bp, Homo sapiens
tccaaaggtcccccagacagccccacctggctcgggctgccgcctatcagactctggggcacgcagacatcgttgttggcctgcttggtgcctgaggctcycaggcattgcccagcacttgaggtgtctctatgtgggatgcctcccctctgccctggcctattatgcatttttaataaatggagccaagtagagtaaata

SEQ ID NO: 26798 - DNA, 201 bp, Homo sapiens
ggactgtgtgtggtgggctctgggctgtgtgtggtgggctctgggcagtgactccgtgtgtatgtgctacctccctccccatcatgttcttcctggtcttygctcaactgaagatttccagagcctcagcatcctgctggccggatcgtgtgccctgaggaaccgcactgcggatcaaaaggtcagtcctgagacgcggcc

SEQ ID NO: 26799 - DNA, 201 bp, Homo sapiens
ttatcagatgaagatcatggcccaaaggaagcttgaataatagacattttgcttaagaacacatacagatggccaatgggtacaggaaaaaagggctcacytcaccaatcatcagggaaatgcaagtcaaaaccatattgagacaccacctcacacctgttagaatatcagaaagacaggtgatgatgaggatgtggagaa

SEQ ID NO: 26800 - DNA, 201 bp, Homo sapiens
acttgaggtgtctctatgtgggatgcctcccctctgccctggcctattatgcatttttaataaatggagccaagtagagtaaatattaattttgtttttayagttgagttcccagtttcagtgtccacacttgttatccactgtctcaaatgcacatctgtgcatgttcttagtcaagcacagactatggctgattttgtt

SEQ ID NO: 26801 - DNA, 201 bp, Homo sapiens
agtactttctggagttgtcatttaatggaaggattatgagtactttgatgatttttctctttgtgtttctttttttttaatagtaaagaatgtaaaaattwaaaaatcaatgtaaaagaaaaaaggaattaaatttatgacaaatattgtgacaaatgtttatgacatttttataaagatttaatcttttctcagtagtac

SEQ ID NO: 26802 - DNA, 201 bp, Homo sapiens
cactccagcctgggcaacagagcgagaccctatccctaaaaacagaataattttaaaaatgttacttggtttacaaaacttgttctttaacattgactctttaggaacagattaagtaaaggaaatgaagtggcttgtgtgcatgctcgaacccttccagcatctgtgtgattatgaacacacattgtgaacgggacactc

SEQ ID NO: 26803 - DNA, 201 bp, Homo sapiens
tagtcactatcacgagaacagcacgggaaagacaggctcccgtgattcagttaccttcccctgggtccctcccacaacttgtgggaattctgggagatacrattcaagtggagatttgggtggggacacagccaaaccatatcagaggtcaatttaaacatttacttgcactgattaggtgcttactgtgtcacagtcacc

SEQ ID NO: 26804 - DNA, 201 bp, Homo sapiens
acaggcgcctcccatgctcacagacaggggtcacatgagggcatgggtccctcctctacctccatcacaaactgattttgggtggggagaaaggtaaggtaaagagtcatttttccctatatgagtatcggtttgctccagcaacacgtgttaaaaacaatttccttttcccgctaaatttcactggtgttcttggtggaa

SEQ ID NO: 26805 - DNA, 201 bp, Homo sapiens
ttgccccccaaaaattaggctttgcatttggaaactggccttcagtctcggcagaagcacacacaacaacgttagcagtttgttcactgggaagggagtaytaggtatctcttgattcgcagtttctaccccgtgctggtcagaacacatctcccgccgtgtaagcaaggtggcgggactgcactcccaggccgggaggct

SEQ ID NO: 26806 - DNA, 201 bp, Homo sapiens
tacgtgtatgaaatgggctcaagcacgttttctcaccggctggctgggcacacagacactgtcactggagtggccttcaacccatcagcgccccaggtacwgtcttgctgagtgggtggggcgcctctgctgcatacaagtcttacattatatttttgtatctttatgactttattttggtgaaatcttataatacttaag

SEQ ID NO: 26807 - DNA, 201 bp, Homo sapiens
gtctggatgaaaaccgagactgcgtttcactcgactgtagtgagggtgatctccaggcatctcacccctgcgtgggcacagacactggcactcactcactrgcagcgaatttgctgttctgtgtccagctcctccggggtttgctctgtttgtctgacccctcctacagacatgttaaggtgggagggcttcggcaggcaa

SEQ ID NO: 26808 - DNA, 201 bp, Homo sapiens
tatatgtgtacatgtgtttacacacatatgtacacagatatgtatatctatattatttatatatctttttagccaaatttctttcctgttaatttttcagrcatggtctgttcttaccaccttaacaattttgaaataataaatttttgttaaaatttagtttagaaaatgccgtagccgatgctcctccctgtcatgcag

SEQ ID NO: 26809 - DNA, 201 bp, Homo sapiens
gatggttggtgtgacttcagatatgaaacctcttaaatttatggtcaggaattcattctgtttgtgtgaatgtttctgttttgaagagactctgttcttcycatgtccatcatgagatgctaattttaagtgtttgtttcttctttaaaattgcctttccacagctgcacggaacgtcatgaaggaccaacgcctggtttt

SEQ ID NO: 26810 - DNA, 201 bp, Homo sapiens
ccacctacacctgcccagcaccctcacatcctcacctggtctcctgcgcatcacagatgccacctgcacccgcccagcaccctcgtactcacctggtctcytgcgcattgcagatgccacatgcacccacccagcaaccttgtcctcacctggtctctggctgtccagagttgcttcctgttgacgacagctctcctcagg

SEQ ID NO: 26811 - DNA, 201 bp, Homo sapiens
cccgaacagcacgcattggttgctggtgagcatagttatacccactcttaattatatgctacataaggggtgggctattcatgagctttctggaaaagggytgggagttccggaaccacataaggtcacttctgggttgtttccatgcatttgtaatctgtcatggtaccagtgggagtgtcttatgcagatgaattataa

SEQ ID NO: 26812 - DNA, 201 bp, Homo sapiens
tctgaagagtggatcctcagaaaccctttgatattaaatcagtcctgaattaaaaatagcaaaataagcaaagatggttttggaaacacctgtgagattasagggaatttgaggatgccctaaaccatgtgtgaatgggagttgtctttggcagcctagtgaaataaatagcaaaaccttagtcagaaaaatcagtttgga

SEQ ID NO: 26813 - DNA, 201 bp, Homo sapiens; identical to SEQ ID NO: 6671

SEQ ID NO: 26814 - DNA, 201 bp, Homo sapiens
tgccagacagtgaggaagaagacatggaagaagcagtgccaggaaacaaattgacattaaacaatctggaagaagggttctgatgactcaatgcttttgaygtctttcacgacacggatccttctatgatataggcactgaaacgaaagcaaatggtaggagaaggattggtaccatatggaaaaatgtttagagaaatga

SEQ ID NO: 26815 - DNA, 201 bp, Homo sapiens
  misc_feature (1)...(201): n = A,T,C or G, or insertion/deletion polymorphism (see Tables 1-2)
tccaggttcttcagcttttggactcttggaccttggacttacactagtggtttgccaggggctcttgggccttcggccacagactgaaggctacattgttngcttccctacttttgaggttttgggacttggtctggcttccttgctcctcagcttgtagacagagcattgtgggacttcgcctggtgatggtgtgagtga

SEQ ID NO: 26816 - DNA, 201 bp, Homo sapiens; identical to SEQ ID NO: 6674

SEQ ID NO: 26817 - DNA, 201 bp, Homo sapiens
cagaagagacggctgtggctgcatccctgtggccagggccttcctcttgtctctcgtgagcacagttccacgcagcctccttcacagacatcccctctgcyctcgaatacagcttttcttttaaggtacacttgaattttaaactgaaaataacctttggtttgttagagactcacggatgttagttcaggcacatgtttg

SEQ ID NO: 26818 - DNA, 201 bp, Homo sapiens
agcttttcttttaaggtacacttgaattttaaactgaaaataacctttggtttgttagagactcacggatgttagttcaggcacatgtttggagttgaagmcaagttgggtctgactggtgtgagctgaacacttcagtgttcagggtccggcttggtagagaccctgttggggttgtgggctcccgtcaggactcacgcg

SEQ ID NO: 26819 - DNA, 201 bp, Homo sapiens
tttaatccgaagtgatccagaaaggataaagagaagagatgtgaaatgtataccaggcaaatgaaaataaaaataaagcagattatatgattttagtatcrcacaaaacacaattcaaccaaaaaattatgaggcaaagatacttataatgccaaagactaaaattcacaatgaaaatacagtatatgttagtatctaatt

SEQ ID NO: 26820 - DNA, 201 bp, Homo sapiens
  misc_feature (1)...(201): n = A,T,C or G, or insertion/deletion polymorphism (see Tables 1-2)
tatattcagggaaatagagtacaagtcagagaccacagatataaggatggagaattttactgcattgttggactttcctagaactgaaagatatatcattngaaattaagagtgtagagacagaagtgttgaaagtagcaggatgggaaatgaagctgatatgataatactttagtgtaaagtagactttgggtcttaatg

SEQ ID NO: 26821 - DNA, 201 bp, Homo sapiens
gcggcttgtggggccgaggacagacacgtatgtactgtttgactgtctataaatgtagagagtctagactttggtaatgtgtagactgtttaatattgttrcatattaggatagaaacctactttcagcttgactgttggtcaatattttaagactcttacacagtaatagcattttaataatgtgtgaggtatgaaagat

SEQ ID NO: 26822 - DNA, 201 bp, Homo sapiens
ttgcatgttttaaatcttaaagttggtaaacttgggcaatgatacgtaagtgtctttaataaaaggaattggatgatttttaagtttattaccaaagtctrggcagatctttgcctctgtgatacaactttttctttagaaagaggaaatggtgattggaatggcctagactttcccatctaccgctgtgctatacattac

SEQ ID NO: 26823 - DNA, 201 bp, Homo sapiens
gcattgctttgcgaattcttatgttaaaatatgcattccgtacttccttccatccttctgtccttcatgtctctgcctctcgtgcgtgttccatgtccgcygtggtggggaacttgctgggtgcttcgcctcctgaattggccatcactcatgggattcagcaacgtgcccaagactgaccgctgttcctctggtgcctgt

SEQ ID NO: 26824 - DNA, 201 bp, Homo sapiens
ctgcattgctttgcgaattcttatgttaaaatatgcattccgtacttccttccatccttctgtccttcatgtctctgcctctcgtgcgtgttccatgtccrctgtggtggggaacttgctgggtgcttcgcctcctgaattggccatcactcatgggattcagcaacgtgcccaagactgaccgctgttcctctggtgcct

SEQ ID NO: 26825 - DNA, 201 bp, Homo sapiens
gctgcattgctttgcgaattcttatgttaaaatatgcattccgtacttccttccatccttctgtccttcatgtctctgcctctcgtgcgtgttccatgtcygctgtggtggggaacttgctgggtgcttcgcctcctgaattggccatcactcatgggattcagcaacgtgcccaagactgaccgctgttcctctggtgcc

SEQ ID NO: 26826 - DNA, 201 bp, Homo sapiens
cccacccctcctaactccatggatgccaccagccgcactctttctgcccaggagcccaggcgacttctgaaaagcaggctggattccgtccctctcctccrctgcagcagggcctcctcggcggcctcccgggcactgctcctctcggtgcctcctttctagccctgaacgctcagacctctgtggggctgtgggatgcat

SEQ ID NO: 26827 - DNA, 201 bp, Homo sapiens
atgccaccagccgcactctttctgcccaggagcccaggcgacttctgaaaagcaggctggattccgtccctctcctccactgcagcagggcctcctcggcrgcctcccgggcactgctcctctcggtgcctcctttctagccctgaacgctcagacctctgtggggctgtgggatgcatctgtgtcttcacacacgccctt

SEQ ID NO: 26828 - DNA, 201 bp, Homo sapiens
ctgcacctacccagcaccctccacgtccccacctggcctgtgaatcttagacgccacctacacctgcccagcaccctcacatcctcacctggtctcctgcrcatcacagatgccacctgcacccgcccagcaccctcgtactcacctggtctcctgcgcattgcagatgccacatgcacccacccagcaaccttgtcctca

SEQ ID NO: 26829 - DNA, 201 bp, Homo sapiens
actttgggaggccgaggcaggcggatcacgaggtcaggagattgagaccatcatggctaacacgctgaaaccccgtctctactaaaaatacaagaaaaatyagctgggcgtggttggcgggcgcctgtagtcccagctactcaggaggctgaggcaggagaatcgcttgaacccaggaggtggaggttgcagtgagctgag

SEQ ID NO: 26830 - DNA, 201 bp, Homo sapiens
tgagaccatcatggctaacacgctgaaaccccgtctctactaaaaatacaagaaaaattagctgggcgtggttggcgggcgcctgtagtcccagctactcrggaggctgaggcaggagaatcgcttgaacccaggaggtggaggttgcagtgagctgagatcgtgccattgcactctagcctgggcaacagggcgagactc

SEQ ID NO: 26831 - DNA, 201 bp, Homo sapiens
aacgtggcaaagtaaccacagggcggcagaaaacccaaagcgagggagagagaaggcgaacccaccagcgtgatgtgtcctctgttctcccgggaaaaccygagtaagagacaacgaggctgtgttgggggttacctaaaaatcccctcctttcccagaatacctgatgatgatcccgcactgtcactaaagaaacacccg

SEQ ID NO: 26832 - DNA, 201 bp, Homo sapiens
tattcaagtttactggaatacgattatacatgtagatggggggaagcccacttcgtttcttgcttatgttttacttctaatctcactgtgaatgtctcccratcaccgttacctgtggccttccctcagggaggcataccccgtggagtgcgctgtgcccaccaagcccggcccccaggtcgctgccgcccccacctgcac

SEQ ID NO: 26833 - DNA, 201 bp, Homo sapiens
atgtgtgaatgggagttgtctttggcagcctagtgaaataaatagcaaaaccttagtcagaaaaatcagtttggaatctcagcactgaggctccgtggctktcctggcaaagtgctctctacctgtcatggtttcctcaataaaaaaatggagatttcaataaaatatggatgcaccttggtccgttattgtaaatggttt

SEQ ID NO: 26834 - DNA, 201 bp, Homo sapiens
ttgtgcaaattaatatgaaagcctctatacaaatggttgagtcacagaaatttagtttatcaaactggcccccaaagtagaaacaaatttaacaggccacktttcgtagaagaaatagagaacgtttcctaagaactccttgtgaaatagtaccaggcccatgtgctttctcaggggattttaccaacctcttaaacatca

SEQ ID NO: 26835 - DNA, 201 bp, Homo sapiens
gcattcactttttaaatagcagtaccctcaaaaaattgaaaaagtcctatgtagtaatgatgctaatgaagaattgaaagtgtttattaggtaaataatawggtcttgcacattgtttatgtggtaaagactgatttttgtagtcttgtaaaagacattttctgttcatttacttttttcattataagatatgtataaaat

SEQ ID NO: 26836 - DNA, 201 bp, Homo sapiens
gctgggtgttaccctagtgctttcctcgacacgtgatccgaatgctccgcggtgcacacgcgtcatgctgggtgttaccttagtgctttccttgacacgtratctgagtactccgcggtgcacacgcgtcatgctgggtgttaccctagtgctttcctcgacacgtgatccgaatgctccgcggtgcatgcgcgtcatgct

SEQ ID NO: 26837 - DNA, 201 bp, Homo sapiens
tttgatttctccactttccttcaaaattcagctgacccttgaacaacatgggtttgaaatgcacgggtccacttatacatgattttttttcaacaaatatrttaacatttttggagattttcaacaacttgaaaaaactcacagatgaaccacatagcctaaaagtataagaaaattaaaaacatatgtcatgaatgcata

SEQ ID NO: 26838 - DNA, 201 bp, Homo sapiens
  misc_feature (1)...(201): n = A,T,C or G, or insertion/deletion polymorphism (see Tables 1-2)
ttgggactgagggtgagagcactgggctgtgagaaagggttggggacagggcgccggcccccaccacacactcactgagtcctggaagctggcaccctctncatgacttcaggctcatgaacgcacttcgtgaaagatctggcactgcaggatgagcttcccacctctcgctgggaccgaggctggcacattctgggaacc

SEQ ID NO: 26839 - DNA, 201 bp, Homo sapiens
cttgtaaaagacattttctgttcatttacttttttcattataagatatgtataaaataaaacttgccattttaaccatttttaggtgtatggttcagtggsattccataccctcacattgttgtgcaatgtaaaaaagcctttttgaaccatttgcttaattaataacaaaggaatttatatgtatatatacatttctagt

SEQ ID NO: 26840 - DNA, 201 bp, Homo sapiens
actcacagatgaaccacatagcctaaaagtataagaaaattaaaaacatatgtcatgaatgcataaactatatgtagatactagtctgttttatccttgaytatcataaaatatacacacatctttttaaaaagttaaaatttattagaatgtatgcacattctcagtcaagagaaatataaacaaatgcagaaatgctgt

SEQ ID NO: 26841 - DNA, 201 bp, Homo sapiens
ttaacacaaatagggacacacatacatccccgagggccacagtatggagagaggacatagcaatagaaacagaagttaaaatgtggtgggttggaccccarcatgccagttagcagcagctgcagcagcaaacgtttcctgagcattcaccatgtgctgggcctcagagcagtcctccgagtccttttctgataacgtggt

SEQ ID NO: 26842 - DNA, 201 bp, Homo sapiens
  misc_feature (1)...(201): n = A,T,C or G, or insertion/deletion polymorphism (see Tables 1-2)
tgagtcctgtccctttagggatccctgactgatacagccactgtcttgtgaaggctggatcatgtcacggatgtgatgtttttagcgcctctgagctgctngagaatttcagactcttccttttaaacctccacccacccgtgtcccccttcaggtgtgggctcagaaatcacaaaattaaggcagactctgaatttggaa

SEQ ID NO: 26843 - DNA, 201 bp, Homo sapiens
  misc_feature (1)...(201): n = A,T,C or G, or insertion/deletion polymorphism (see Tables 1-2)
atttttaattgggttcttttctaaattattgaattatagaacttttcttttttaatgtattctcagctctagacaggtattgcagtatttcccctaatctntgggttgcttattggtgtcatcatggcatccattaatgaacagaaattttacatttttatgaaatctagtttttaattaaaattagatttgcttaatgct

SEQ ID NO: 26844 - DNA, 201 bp, Homo sapiens
atctttttaaaaagttaaaatttattagaatgtatgcacattctcagtcaagagaaatataaacaaatgcagaaatgctgtatgaaatcatcacttcatamactcaactgtagtccctccagcactcctgtcctcatttcatcacccctgctcttgctgttgtggtgagctcaggagttacaagtatcccttaaaatgctg

SEQ ID NO: 26845 - DNA, 201 bp, Homo sapiens
cttctcccaagaagcagggaaagccacggctttacagaaaaagctgaattgcttggtatgtaccatagactggcagtcgctgccatttcaggataaatgartccagtgtaagaaatagtgtaaaaaaagaaaaggaaactcatggagacatggctgcagctatgccagcaggcacgaaaaccttgcacgttttgttaaatc

SEQ ID NO: 26846 - DNA, 201 bp, Homo sapiens
tggccaaaaagctatacgaaaaggtgctccacatcactaatcataagggaaatgcaaattgaaaccactgagctagcacctcatacctgtaaggatggctrttatcaaaaagacaagagatagcaaatgttgtgagggtgtgaaacaagggaaccctgtgcactgttggtgggaatgtaggttggtgcagccatctggaaa

SEQ ID NO: 26847 - DNA, 201 bp, Homo sapiens
tccttgacacgtgatctgagtactccgcggtgcacacgcgtcatgctgggtgttaccctagtgctttcctcgacacgtgatccgaatgctccgcggtgcayacgcgtcatgctgggtgttaccttagtgctttccttgacacgtgatctgagtactccgcggtgcacacgcgtcatgctgggtgttaccctagtgctttcc

SEQ ID NO: 26848 - DNA, 201 bp, Homo sapiens
ccttgacacgtgatctgagtactccgcggtgcacacgcgtcatgctgggtgttaccctagtgctttcctcgacacgtgatccgaatgctccgcggtgcacrcgcgtcatgctgggtgttaccttagtgctttccttgacacgtgatctgagtactccgcggtgcacacgcgtcatgctgggtgttaccctagtgctttcct

SEQ ID NO: 26849 - DNA, 201 bp, Homo sapiens
agcaagcagcagagcaagtaagaacgggattttgaaaattcttatggaaaaaagtctgcagcatttccagaaactttcttaattagaagaaaacatgaaartaaccgttgcaaatcaattgtatataaaaatgaatggtcttctattaaaatgtagagggagattttttgcaaaggattaaaaatattaggtattggccag

SEQ ID NO: 26850 - DNA, 201 bp, Homo sapiens
attatagaacttttcttttttaatgtattctcagctctagacaggtattgcagtatttcccctaatctgtgggttgcttattggtgtcatcatggcatccwttaatgaacagaaattttacatttttatgaaatctagtttttaattaaaattagatttgcttaatgctttctgtggcctaagaaacctttgctaacccag

SEQ ID NO: 26851 - DNA, 201 bp, Homo sapiens
agccgaccatggtggtgggcgcgtataatcccagctacttgggaggctgaggcaggagaatcgcttgaacctgggaggcggcggttgcagtgagtcgagaycatgccactacactccagcctgggcaacaaaatgagactctgtctcaaaaaaaataaaaaataaatatcaggtattagttatctccagtgtttgggaata

SEQ ID NO: 26852 - DNA, 201 bp, Homo sapiens
gaaggaggacggcgtgggggatcttttgtatgtcaaaaatcaccacaaataattagatgttaatagaaaaacaggttttttttcctaaagaaaaattaagrtagctaattcacttttcccctcagtatcataaaatatgatttttaaagtgatatgaaaactttcttttcatgtttaatgtttttaaagataaggtgttta

SEQ ID NO: 26853 - DNA, 201 bp, Homo sapiens
gaaaagggcaatgaagacagtctcttattttagtgataatcttctgtcctgataacttattaagtggaggggaatgcaagtttttaaaaaatactttgatytttttatttttattgaaaaaaatgttagagacagcatctccctcttgcccaagctcaactcttgggctcctgcaatcttcccaccccagcctcctgagtg

SEQ ID NO: 26854 - DNA, 201 bp, Homo sapiens
tttcaacatttgtattcatgtgcaagttttactttttggtgaagaaattattttggaatagttcaaacttgactaacagaaatactgtaagtaaatattaygtgtaaagagataagtaaaactgacagttctcgggttaattggtaccaggcacttacaaagctaaattttccgatgttcctttcaccagcatatcctctt

SEQ ID NO: 26855 - DNA, 201 bp, Homo sapiens
gcattgcagatgccacatgcacccacccagcaaccttgtcctcacctggtctctggctgtccagagttgcttcctgttgacgacagctctcctcaggtgcrctttttatctcctgtactgtcacaaaggagctgaccctctcctggaagaaaatgttgattttacttttcaatccaggggccacctctttcattggtgtgt

SEQ ID NO: 26856 - DNA, 201 bp, Homo sapiens
taggcctgagccaccatgcctggctcatatcaatgtttaaggaaaaaaagaaaaaaactttcagattggattttacagatgaggaaaaaaatctgagtccrtgctgaatacaggagatgctttaatccgaagtgatccagaaaggataaagagaagagatgtgaaatgtataccaggcaaatgaaaataaaaataaagcag

SEQ ID NO: 26857 - DNA, 201 bp, Homo sapiens
attaaggcagactctgaatttggaaagtaaactttcttatcctcatgggttagatttttaaattgtaaaataagaaagaaaatctgttttgattaaacttrtatcttaatgatgttgaagcagaagagacggctgtggctgcatccctgtggccagggccttcctcttgtctctcgtgagcacagttccacgcagcctcct

SEQ ID NO: 26858 - DNA, 201 bp, Homo sapiens
atatttttattggcgagagagagagaaataaacctttattgtggggaaatgaatctggaaaagtttcttttataatgaaggtgtttgccactcagcagtcwtgcatgtttgattgaatgaaacaggaacgtatgggaagacctgtggacaaatacggttacatgtagacaaatacggttacatggggcactaacatgaaca

SEQ ID NO: 26859 - DNA, 201 bp, Homo sapiens
  misc_feature (1)...(201): n = A,T,C or G, or insertion/deletion polymorphism (see Tables 1-2)
ttatatgcccatttttaattgggttcttttctaaattattgaattatagaacttttcttttttaatgtattctcagctctagacaggtattgcagtatttnccctaatctgtgggttgcttattggtgtcatcatggcatccattaatgaacagaaattttacatttttatgaaatctagtttttaattaaaattagattt

SEQ ID NO: 26860 - DNA, 201 bp, Homo sapiens
  misc_feature (1)...(201): n = A,T,C or G, or insertion/deletion polymorphism (see Tables 1-2)
tgacactccccagcaaggtatgagagtctcagtgccatcatctcagttacatgtggtttctttagtctttttaattttagccttgaggtggttgcggagtngtattttcattgtggttttaatttgcatttcttttgtaatgaatgatgttgagcactttaccatatacttatatgcccatttttaattgggttcttttct

SEQ ID NO: 26861 - DNA, 201 bp, Homo sapiens
tgaaaatacaattcatttttacatatatggtaatacaaaattccactaacaatgtttaaacattagatattagaagatagtgagggataattacatcacartaaattaggttccagggaggcagttgatcaatttagagcaagcactttcttcagtggaacctggcatgaatcttgcctttacctctttctggctatatga

SEQ ID NO: 26862 - DNA, 201 bp, Homo sapiens
taatacaaaattccactaacaatgtttaaacattagatattagaagatagtgagggataattacatcacaataaattaggttccagggaggcagttgatcratttagagcaagcactttcttcagtggaacctggcatgaatcttgcctttacctctttctggctatatgaccttgaacaagtgatttcacctcttttatt

SEQ ID NO: 26863 - DNA, 201 bp, Homo sapiens
gagtaagcgggttttgggaatggccagttcactattgactgttgttaacctggtggagaaatgtcacagaagcatgtctggtgccactgacaccaagcctrcgacggtctttgcaatcaggaggagaaactcatggaaatcggctcagccaggaggcagactctggctgctgccgtgtaccgagggtgctggtgagagacc

SEQ ID NO: 26864 - DNA, 201 bp, Homo sapiens
  misc_feature (1)...(201): n = A,T,C or G, or insertion/deletion polymorphism (see Tables 1-2)
aagataaaataccttgttcctgccattcgtatttaaatatttattttaaagttctttttgaaattggaaaaaaaacccaatctagatagacttgccattcntccaaaacctaggccgtgtttgcaagtgcttccacgctgaaacaactttctggcctctcacattcataagaggactttctggaagataagcccgtgccat

SEQ ID NO: 26865 - DNA, 201 bp, Homo sapiens
gacgattcgcggcttgtggggccgaggacagacacgtatgtactgtttgactgtctataaatgtagagagtctagactttggtaatgtgtagactgtttartattgttgcatattaggatagaaacctactttcagcttgactgttggtcaatattttaagactcttacacagtaatagcattttaataatgtgtgaggta

SEQ ID NO: 26866 - DNA, 201 bp, Homo sapiens
agaaacgcaaatggtttaaaagctgctgcggcgaatgtcttggagggacgcttggacgcttcccgtcgccgctgtaacgaaccactcccatgggccgcggmggaaaaggccggtttcccgactgcagttccgtggtggggaggctgcggggctcacgggctaagctccccacgcagggccggttcttggccttttctggct

SEQ ID NO: 26867 - DNA, 201 bp, Homo sapiens
gctcactccgaccatctccccgcccgtcctccacgtgtggaccctttgtccttatcctgccccctgtggttacacctgggacatccagaaccatctccccrtctccaggcccccgacgcagccatacccgccaagtcccctttccctgtgggcgaatctgtggccgcccgttcgcagatgcccggaccgtggtgtggacat

SEQ ID NO: 26868 - DNA, 201 bp, Homo sapiens
tttttgagcatatttgagaggatccttcttccttgctaccaattaagccagtttacattcacataaaatacataatcgctgtatgattcacgaatgtatarttacttaactgtgattttcataattctgtctgtgctaattataaacacactcttgaggaaagttaccatctttctttcttcgtttcctctattaagaaag

SEQ ID NO: 26869 - DNA, 201 bp, Homo sapiens
ggacagccaggactctggtgctgcctgaaaacgttccctgagcacccgcagtccctgtggatgctgctgtcccacagtgctctggtctctctgatggcgtycccgcccaggccctccccacctccctgcatacacacacacacacacacacacacacacacacacacacacacacaggccctccaggccctccccacctcc

SEQ ID NO: 26870 - DNA, 201 bp, Homo sapiens
tgtgattttcataattctgtctgtgctaattataaacacactcttgaggaaagttaccatctttctttcttcgtttcctctattaagaaagtaccctgtamagtacttggtacattttgaaagatccttgagttccagtcttgaaaaataatttctttccttttccttttccttttttttcttttcttgtctttttttttt

SEQ ID NO: 26871 - DNA, 201 bp, Homo sapiens
aacaatgcctgtggctaagaggaccctcaaaatgagtaaggaactgtaacagctcacaagggaccacaggctctgcagagtggcttcggaatccaagactstgaagcacacctgggtgtcctgccaggaactgcagctgcgcgccacatgcgccctgtcagatgtgacttagggatgcgttgtcagcttcagtttgttgga

SEQ ID NO: 26872 - DNA, 201 bp, Homo sapiens
caagccaccacccccgactaattatttatttatttattgtttgtattaagatggagtctcaccagtttgcctaggctggccttgaactcctgggctcaagygatcctcctgcctcggcttcccaaagtgctgggattgcaggtgcgagctgccgcacgtggcccaatgcagtttttgagtggttgctgggtgttgaatgtg

SEQ ID NO: 26873 - DNA, 201 bp, Homo sapiens
ctgtctttaaagtgtgtgtcactgaggcatttccatcgtatcgtcgtttgcgctcctagtttcatggggcttgtttctgtttcagctcctgtgtcctaccracctctccactgtatctgggaattgccaaggagaagagtaccaaggctgctagtgaacagcgacgtggtcagtacagggtgctgtgagatctaagaatac

SEQ ID NO: 26874 - DNA, 201 bp, Homo sapiens
agcttacaggtgattcctgactctgagttaacatggcacacctgctcatcttgtcttgtaggcttacgtgtatgaaatgggctcaagcacgttttctcacyggctggctgggcacacagacactgtcactggagtggccttcaacccatcagcgccccaggtacagtcttgctgagtgggtggggcgcctctgctgcatac

SEQ ID NO: 26875 - DNA, 201 bp, Homo sapiens
gcatacacacacacacacacacacacacacacacacacacacacacacacacacacacacacacacaccgggcaggccctccccaaacagcacacagagcrcgtgcgagccgcgcttagctgccttttaaaatgacatctgctgctgcggaactctcaagttcatgcaatgaggacgtcatgaaggatgattattttagcc

SEQ ID NO: 26876 - DNA, 201 bp, Homo sapiens
tgcctagcttacaggtgattcctgactctgagttaacatggcacacctgctcatcttgtcttgtaggcttacgtgtatgaaatgggctcaagcacgttttmtcaccggctggctgggcacacagacactgtcactggagtggccttcaacccatcagcgccccaggtacagtcttgctgagtgggtggggcgcctctgctg

SEQ ID NO: 26877 - DNA, 201 bp, Homo sapiens
tcccctatcctgtgcccggggcactcacgcagcctggcacagagtggagaggcttgagcttgtcatcctgcagagttggagtcacctctgtgcctcccttkggccccccttctgttctcagaagcccctgacacagctgtaggtgctctacactcccccatatgctgccttaggggatcccccaaattgtgaaaatgttta

SEQ ID NO: 26878 - DNA, 201 bp, Homo sapiens
ctgggcatgaactgggcatgaactagaacccgggcatgaccacacgcttctagcctcagctctgccctttgctgttgggtttcttgagttgccttattccwcttggttattacttcgtttcctcaggtaatcaggactttgtcagcttgtctgtccatgcgaaattgtagcagaactagaacaatagcacactaaaaaaag

SEQ ID NO: 26879 - DNA, 201 bp, Homo sapiens
ggtcagaggacttgcctctgctgatgggtcccgtcttcctgcattcaccatcaacctttcccttagagcgtggtaggcacttgtgcccgactgcagccccrtcccacccagccgctgagtccttccagcccctgaggctgaagggagcatgggctgggcatgaactgggcatgaactagaacccgggcatgaccacacgct

SEQ ID NO: 26880 - DNA, 201 bp, Homo sapiens
ggtgttaccttagtgctttccttgacacgtgatctgagtactccgcggtgcacacgcgtcatgctgggtgttaccctagtgctttcctcgacacgtgatcygaatgctccgcggtgcacacgcgtcatgctgggtgttaccttagtgctttccttgacacgtgatctgagtactccgcggtgcacacgcgtcatgctgggt

SEQ ID NO: 26881 - DNA, 201 bp, Homo sapiens
acctgagtgccgtacagctcatgccatccagcaggtgggtgggctgacctggcccttctgctctggactttgttgactaatgtctactaatttagtcattstatctcatctgcatagctggcaaaaatcatagcggttgctgttcaaaataatatgaaatggaatcccagaactttaatttttgagatttttatggctaac

SEQ ID NO: 26882 - DNA, 201 bp, Homo sapiens
agacattagcaggtgcccaggggatcaccacaaatgcgttggtggcacagatgtggccagcctggcacagatgtggttctcactggcaagaacctgccccrgcccacgctctccactcctgcggagagctcacagccaggccagggggcgcacgtggggcccaacgcccacgctccccactcctgcggagagctcacagcc

SEQ ID NO: 26883 - DNA, 201 bp, Homo sapiens
gacacgtgatctgagtactccgcggtgcacacgcgtcatgctgggtgttaccctagtgctttcctcgacacgtgatccgaatgctccgcggtgcacacgcrtcatgctgggtgttaccttagtgctttccttgacacgtgatctgagtactccgcggtgcacacgcgtcatgctgggtgttaccctagtgctttcctcgac

SEQ ID NO: 26884 - DNA, 201 bp, Homo sapiens
atctctactaaaaaatacaaaaaacaattagccaggcatggtggcaggcgcctgtagtcccagctagtcgggaggctgaggcagaagaatggtgggaaccygggaggcggagcttgcagtgagctgagatcgcgccactgcactgcagcctgggtgacagagcgagactccatctcaaaaaaaaaaaaaaagaaaactcgg

SEQ ID NO: 26885 - DNA, 201 bp, Homo sapiens
tggggctggagctgtttgcttgttcgtcctgccatggcggtccctgctgctgggggtttccagcaggtcccccattcctccgccctgtttccatgaaagayccactgtcggtgtgaactgcccgtctcctgccggtttatgctctgctgccgtcccatcaccatggggacagttctgagaaattgtgagaatgaaggccgg

SEQ ID NO: 26886 - DNA, 201 bp, Homo sapiens
atgaaggccggggggaggcggccaggctcagccagcattgcagcctctgggccaagctgactcctcggctgggagtggcctctgacctccttcctcctcattaagtcatggaacttctgccttgtaaggaggtgctaattattcaccattgaaaaggcatcttaaattgcaaaagacactatagcagagaagacaacagca

SEQ ID NO: 26887 - DNA, 201 bp, Homo sapiens
taatattttattgaggagttttgcatcaattttcattagagaagtgggcctttagttttttgtttgtttctgttttgtttgtttttgtatttgttttttgraactgaatgaagtgcactgtgttctctcaaaggagatttgcgttgctttctaggggtttgggtgcacaaatccacagcttccggccttttaagccacttg

SEQ ID NO: 26888 - DNA, 201 bp, Homo sapiens
ggtctcactgtgatgcccatgtgccctccccatgtcccctccaatctcccctatcctgtgcccggggcactcacgcagcctggcacagagtggagaggctkgagcttgtcatcctgcagagttggagtcacctctgtgcctccctttggccccccttctgttctcagaagcccctgacacagctgtaggtgctctacactc

SEQ ID NO: 26889 - DNA, 201 bp, Homo sapiens
aggccaggcatttccttcccgggctgtggcctcctcccctcctgacttgtcacctgcaactcccagagcctgagcaggagccgtggagccctcctgcaagytcatcctctatctcatcggcctcctcacccctcgctgttccttatttcacttctgcagattgtacagattttttcttttttaaccagtttctatgtctca

SEQ ID NO: 26890 - DNA, 201 bp, Homo sapiens
gtggcccaatgcagtttttgagtggttgctgggtgttgaatgtggaacgtaaatgtttatgccaggatagcatggctcttttcctgctaattgctggtttsagtccgaaaagttgggaattcagctgcatgtcgttcactttattaagactttgatgagagtggggttatcagaagtaatctgtgtgagtcattgtacaaa

SEQ ID NO: 26891 - DNA, 201 bp, Homo sapiens
ccagcatcaagcgcaagagatctgccgagtccacgtggatacactatgaccccgcagaccatgaaggtagatgaggaggtaatggcattccgtggtgcccyatgtgatggcatcagggttcttcctagcagcgtggaagacactcctgccctcaagagggctaagtccagtaaaacccaaccaacaggagacagttgggca

SEQ ID NO: 26892 - DNA, 201 bp, Homo sapiens
acgtggatacactatgaccccgcagaccatgaaggtagatgaggaggtaatggcattccgtggtgcccgatgtgatggcatcagggttcttcctagcagcytggaagacactcctgccctcaagagggctaagtccagtaaaacccaaccaacaggagacagttgggcaggaagactcattctgagtgtagatggctctgg

SEQ ID NO: 26893 - DNA, 201 bp, Homo sapiens
gattttctcttccagatataaacagaagagcaagtccaagctgatttgcaggctctccacgacgggtgcagtagacatgaccagtttatcggcagtcaacracttttattcccgtatcctttctcccggatcctggtagggttttacgccctgagtgttgttcctctggcagaggcatgtgctgagcatctcgtgagtgtc

SEQ ID NO: 26894 - DNA, 201 bp, Homo sapiens
ctccctaactggattatcgcagacatcgtactcgcagctggccggaacaggaccgtggaagtgtttgacctcaacgccggctgcagtgcagcggtgatagyggaagcccactcacggcctgtccatcaaatctgccaaaataaagtgagtaagtttttggataacatgtatcatctgtaaaactatgtgcttaaagcattt

SEQ ID NO: 26895 - DNA, 201 bp, Homo sapiens
ttcactgtaaaatataaatctcttaagaaacttagacctcttaatatttgagagtgatattagagttttctttccacagtgtaactatgttttcaccaaasaccaacatcaagagtgaggggaaaggatcttcaaggagcaggagcagctgcgcacggtgtgtgatgtagcgtgcattccaagtacatttgaaataaccta

SEQ ID NO: 26896 - DNA, 201 bp, Homo sapiens
gtagtgagggtgatctccaggcatctcacccctgcgtgggcacagacactggcactcactcactagcagcgaatttgctgttctgtgtccagctcctccgrggtttgctctgtttgtctgacccctcctacagacatgttaaggtgggagggcttcggcaggcaaagaagctaatggaacagtcactgcttccctctggag

SEQ ID NO: 26897 - DNA, 201 bp, Homo sapiens
ggctgctagtgaacagcgacgtggtcagtacagggtgctgtgagatctaagaatacaaggctgatgcgttctcattgtggttagggctgctgcattgcttygcgaattcttatgttaaaatatgcattccgtacttccttccatccttctgtccttcatgtctctgcctctcgtgcgtgttccatgtccgctgtggtgggg

SEQ ID NO: 26898 - DNA, 201 bp, Homo sapiens
gagggtagggggctgccctctccgggtcccctctctgctgagagctgtcactcaataaaactctccagctgggtgcagtggctcacgcctgtaatcgcagsactttgggaggccgaggcaggcggatcacgaggtcaggagattgagaccatcatggctaacacgctgaaaccccgtctctactaaaaatacaagaaaaat

SEQ ID NO: 26899 - DNA, 201 bp, Homo sapiens
  misc_feature (1)...(201): n = A,T,C or G, or insertion/deletion polymorphism (see Tables 1-2)
ggggcttgtttctgtttcagctcctgtgtcctaccgacctctccactgtatctgggaattgccaaggagaagagtaccaaggctgctagtgaacagcgacntggtcagtacagggtgctgtgagatctaagaatacaaggctgatgcgttctcattgtggttagggctgctgcattgctttgcgaattcttatgttaaaat

SEQ ID NO: 26900 - DNA, 201 bp, Homo sapiens
gcctccctctacttacaacacttacccttgtggtaagttcacgtgatgtcagagtttttgtcaactggtagtgctatgcaaaatgtaaaataggctaggcygggcatagtggctcacgcctgtaatcccagcattttgggaggctgcggcaggtggatcacgaggtcaggcgttcaagaccatcctgaccaacatggtgaa

SEQ ID NO: 26901 - DNA, 201 bp, Homo sapiens
agagtttttgtcaactggtagtgctatgcaaaatgtaaaataggctaggccgggcatagtggctcacgcctgtaatcccagcattttgggaggctgcggcrggtggatcacgaggtcaggcgttcaagaccatcctgaccaacatggtgaaaccccctctctattaaaaatacaaaaattagccaggcgtggtggcgtgtg

SEQ ID NO: 26902 - DNA, 201 bp, Homo sapiens
atatgtgtgaatgcgcgtgtgtgtatgtataggcatgtgtgcatgtgtgtgcatatgtctacatgcatgcatgtgtgcgtatgtctacatgcatgtgtgcrtatgtatatgtgtgaatgcgtgtgtgggtatgtatatgcgtgtgtgcatgtgtgtgtgtgtgtgtatgcatgaatgtatgtgtgggtatgtatatgcctg

SEQ ID NO: 26903 - DNA, 201 bp, Homo sapiens
tgtgtgtgcatatgtctacatgcatgcatgtgtgcgtatgtctacatgcatgtgtgcgtatgtatatgtgtgaatgcgtgtgtgggtatgtatatgcgtgygtgcatgtgtgtgtgtgtgtgtatgcatgaatgtatgtgtgggtatgtatatgcctgtgtgcatgtgtgtgtatatgcatatgcgagcgtgcatgggtgt

SEQ ID NO: 26904 - DNA, 201 bp, Homo sapiens
ctaattttaagtgtttgtttcttctttaaaattgcctttccacagctgcacggaacgtcatgaaggaccaacgcctggttttccatagtaaagttaggtcrtctggttatgcgtcagcaccacagtgagtgaactcatgtcaatgagagacagaaatgcacctgcgtcacagatgcaggattttaacacaaatagggacac

SEQ ID NO: 26905 - DNA, 201 bp, Homo sapiens
agtgatccacccgcctcagcctcccaaattgctgggattacaggtgtgagccactgtacctggccaagacattgttatcagagggagatgacagctccatrcatttcactgcccctgaagaccttccagtgggaccagatgtggaggggaagacagtgatattgatgatcccgactccatgcaggcctaggctaatgtttg

SEQ ID NO: 26906 - DNA, 201 bp, Homo sapiens
ccagccgctccagccatggctgaaaggggccaacatagagctcatgccatggcttcagagggtgcaagccccagtccttggcagcttctacatcatgttgrgcctacgggtgcacagaagtcaagcactgaagtttgggatcctctgcctagatttcaggagatgtatggaagcacctggatgcccacgcagatgttttct

SEQ ID NO: 26907 - DNA, 201 bp, Homo sapiens
tttgaagtcagggaaggtgatgcctccagctttgttctttttatttaggattactttggccatttgggctcttttttggttccttatgaagtttagggtgttttttttttttaatgtaaaaaatgacattggtattttgaaaggcattgcattgtacctatggattgctttgggcagtatgttaattttaatgatattaat

SEQ ID NO: 26908 - DNA, 201 bp, Homo sapiens
ttcggcaggcaaagaagctaatggaacagtcactgcttccctctggagacgcggcctctgctcatggatgggctggaggcgccaggctggggatggcatcytgcaggctgcgcacaggattccttccttaccggaccctcagccgggaccttttcctgcagggctgagtgtgtctcggcttccgtgacagtcgcccgattc

SEQ ID NO: 26909 - DNA, 201 bp, Homo sapiens
gtgtttttgatggagtctttaggtttttctagatgtaagattatattatcagtgagcagggataatttgatgtcctctttaccaatttggatgcttctttaaaaaaaaaaactttttttttttttttttgcctaattgctctggctaggacttctaggactatattgaacagaaatggtggtagtgggcatccttgtcttg

SEQ ID NO: 26910 - DNA, 201 bp, Homo sapiens
aggctccaggaccttgtttcaggggccattggcatcctgtcctgggtgcaggggccttttgggtgcagcttttcctgttcacaaccttgaacagcagcctyactctctcatcctgctgctcatcctgctgttcctcttctgttaagggaggatggcgaggatgacaaaggcagcgccttacaaggtgttgggtagaggatg

SEQ ID NO: 26911 - DNA, 201 bp, Homo sapiens
cagcctcactctctcatcctgctgctcatcctgctgttcctcttctgttaagggaggatggcgaggatgacaaaggcagcgccttacaaggtgttgggtasaggatgtgagaaaggattaacacggtctggcacctgcagacccccatgccgatgttagtgtttgtgttttagaaccaggttaactagaagttctactctt

SEQ ID NO: 26912 - DNA, 201 bp, Homo sapiens
gcagtcctcagcctttaaacttgacggatgcatttaagttcacttcttagattctcaataattctgtccctagaagaaagccagcttccctctacaagtgmtctgggaaaaggagagcaggttgaagtaacatttcctgtactgagacttgcaccctgtgatctctcactcatcccaaattctgcatgtggatggtaagta

SEQ ID NO: 26913 - DNA, 201 bp, Homo sapiens
aaccaggttaactagaagttctactcttgcctgtggtcaatgtgacttctgtgaactaggcttttctacagtgtgaccctgtgaactaggcttttctatastgtgactcctgtgaactaggcttttctacagtgtgagtcgtatgaactaggatttcctacagtgtgactcctgtgaactaggattttctacagtgtgacc

SEQ ID NO: 26914 - DNA, 201 bp, Homo sapiens
tttatcacggacaaagccaaagtgtgcgtgactgacctacatgatgccagatgtgtggcatcccgggtcctccccagcagcaccgatcaccccaggtgtcrctgtcacagcccaaagtgcctgactcatttccaaaggtcccccagacagccccacctggctcgggctgccgcctatcagactctggggcacgcagacatc

SEQ ID NO: 26915 - DNA, 201 bp, Homo sapiens
attcaggttccttggctatttgttttaaacaatacaaaaatactcagtacatgcccatcttaataaatgacagaacagtgagaaccaattaatggtcatcrtcaaaatatttatgtcatttctcatcacgtgacatagtttgagttgtcgttttgtttctcatcccgtgacgtggtttgagagtctgttcgaggcccccgg

SEQ ID NO: 26916 - DNA, 201 bp, Homo sapiens
catgcccatcttaataaatgacagaacagtgagaaccaattaatggtcatcgtcaaaatatttatgtcatttctcatcacgtgacatagtttgagttgtcrttttgtttctcatcccgtgacgtggtttgagagtctgttcgaggcccccgggacagtggccactctcagggtctgtggcaggtgctggagggccagcccc

SEQ ID NO: 26917 - DNA, 201 bp, Homo sapiens
tgtcatttctcatcacgtgacatagtttgagttgtcgttttgtttctcatcccgtgacgtggtttgagagtctgttcgaggcccccgggacagtggccackctcagggtctgtggcaggtgctggagggccagcccctctgtggggtgggggctccctgccaggagcaagggctgtcagaccaccttgccctcaccactgc

SEQ ID NO: 26918 - DNA, 201 bp, Homo sapiens
cagggagacgttgctgggccgggctgggagtgagaggtcggcggctccctagagcaggggccacatcgggacagccaggactctggtgctgcctgaaaacrttccctgagcacccgcagtccctgtggatgctgctgtcccacagtgctctggtctctctgatggcgttcccgcccaggccctccccacctccctgcatac

SEQ ID NO: 26919 - DNA, 201 bp, Homo sapiens
gtctagccacaagctttcttccctgctgtcactctcagaattgacttgaggaattttagaaatcagaatcagagctttgtctagtggtgctattgtttacrctacaaaatgttttatttcttacataattgatctggtttcttctaacgagtaacaatacattacaaaatgttttatttcttacataattgatctggttcc

SEQ ID NO: 26920 - DNA, 201 bp, Homo sapiens
cgctacaaaatgttttatttcttacataattgatctggtttcttctaacgagtaacaatacattacaaaatgttttatttcttacataattgatctggttycttctaacgagtaacaatacattacaaaatgttttatttcttacataattgatctggtttcttctaatgaataacaacagacaaaactgagctattgaag

SEQ ID NO: 26921 - DNA, 201 bp, Homo sapiens
cgctaacgatgttgaaaccgcgtccctgcaggtgctgtgcttgctggcctccctctttggcgggaagattgccgtgttggagatcaacccggccgcgctastcagggctcagcagtgccccagcatggggcagagcctctcggtgccagccaggtagagtgtcttcaagtgtggagtgtgtgtgtgtgttcaccaataagt

SEQ ID NO: 26922 - DNA, 201 bp, Homo sapiens
  misc_feature (1)...(201): n = A,T,C or G, or insertion/deletion polymorphism (see Tables 1-2)
gatctgaatacgtgcctgcagagataagctattggccttctagctctcctttcctggatgtgtggctggcctggcccctccacagtggcttctgtggtgtngggactgagggtgagagcactgggctgtgagaaagggttggggacagggcgccggcccccaccacacactcactgagtcctggaagctggcaccctctcc

SEQ ID NO: 26923 - DNA, 201 bp, Homo sapiens
tttgggaagctgaggcaggaggatcgtttgagcccaggagagcagtctgggcaacatcgtgagacctgatttctacaaaaatgaaaaatcagctgcgtgtrgtggctcatgcctgtagtcccagctacgcgggagcctgggaggtcgatgctgcaagtgagccaggattggaccactgcactccagcctgggcaacagagc

SEQ ID NO: 26924 - DNA, 201 bp, Homo sapiens
ttttttcactgtaaaatataaatctcttaagaaacttagacctcttaatatttgagagtgatattagagttttctttccacagtgtaactatgttttcacyaaagaccaacatcaagagtgaggggaaaggatcttcaaggagcaggagcagctgcgcacggtgtgtgatgtagcgtgcattccaagtacatttgaaataa

SEQ ID NO: 26925 - DNA, 201 bp, Homo sapiens
  misc_feature (1)...(201): n = A,T,C or G, or insertion/deletion polymorphism (see Tables 1-2)
gaagcccacttcgtttcttgcttatgttttacttctaatctcactgtgaatgtctcccgatcaccgttacctgtggccttccctcagggaggcataccccntggagtgcgctgtgcccaccaagcccggcccccaggtcgctgccgcccccacctgcacacgtgtatgctgcatccagtactcaggtgcgccacgtcctgc

SEQ ID NO: 26926 - DNA, 201 bp, Homo sapiens
gcaggttgaagtaacatttcctgtactgagacttgcaccctgtgatctctcactcatcccaaattctgcatgtggatggtaagtatcaaaaactttgcctrtgccacataaaggaaacctcttaaattccttagatgaacattaggttcattttctaagaatgactgagataaaaccaaattattttggtctctgattatt

SEQ ID NO: 26927 - DNA, 201 bp, Homo sapiens
aagtgattaaattttaacatgttgatgttttgggtgtagtttagaaaatattcccatggaaaattaatggatatgtttcatttacagtaatgctataatcyccaaatttgcctccctctacttacaacacttacccttgtggtaagttcacgtgatgtcagagtttttgtcaactggtagtgctatgcaaaatgtaaaata

SEQ ID NO: 26928 - DNA, 201 bp, Homo sapiens
atgtactgtggttcgcaactaacgatagcatttagagtttagaacaaaaccttcagtaagaacaattatataaatagttttaatacagagataacttttcwgtagcaagaaagtgattaaattttaacatgttgatgttttgggtgtagtttagaaaatattcccatggaaaattaatggatatgtttcatttacagtaat

SEQ ID NO: 26929 - DNA, 201 bp, Homo sapiens
  misc_feature (1)...(201): n = A,T,C or G, or insertion/deletion polymorphism (see Tables 1-2)
tctttagcttttcttcttacatacgcttcatttagatcactccttaaaagtggaatttttaaactttttgtcaacaagggtcatctcgtttcagactagcntatgtgatgtactgtggttcgcaactaacgatagcatttagagtttagaacaaaaccttcagtaagaacaattatataaatagttttaatacagagataa

SEQ ID NO: 26930 - DNA, 201 bp, Homo sapiens
aagtgtttcctcttgtttgcttcctcaccagctttggttgttcacacttgcattacgtttgttaattatcaagaaacagtaactcccgattttaatttacygctctttgaatactaatgagattgcacattgtcccacaggctactaggtattggaattcttctaattttttttttttttttttttttgagatggagtctt

SEQ ID NO: 26931 - DNA, 201 bp, Homo sapiens
ttttaggaaatatgaagttaagttctttcaattgattatctcctctttcccactcccttgctctggttctgcacttgaagttgcattgctcccaggtagcytcatgctgggtgttaccttagtgctttcctcgatgcgtgatctgagtgactccatggtgcatacacatcatcctgggtgttacctttgtgctttcctcga

SEQ ID NO: 26932 - DNA, 201 bp, Homo sapiens
acacaatgtagaaacttggggggttctcggagagtttcagtgaaagacaagacacagacgaaggcggaggtctgcgtgcagagcccaggtgcaccccgggwggctcgggctgcaacacaacctcctgggaagggaagaaagcaggagtgcggagggaaggtctgcagggtggcgtgggggacggctctgttttgggggctg

SEQ ID NO: 26933 - DNA, 201 bp, Homo sapiens
ttcccactcccttgctctggttctgcacttgaagttgcattgctcccaggtagcgtcatgctgggtgttaccttagtgctttcctcgatgcgtgatctgaytgactccatggtgcatacacatcatcctgggtgttacctttgtgctttcctcgacgcgtgatccgagtgactccgtggtgcacacgcgtcatgctgggtg

SEQ ID NO: 26934 - DNA, 201 bp, Homo sapiens
aacaaattgacattaaacaatctggaagaagggttctgatgactcaatgcttttgacgtctttcacgacacggatccttctatgatataggcactgaaacyaaagcaaatggtaggagaaggattggtaccatatggaaaaatgtttagagaaatgaaaaagcaaaaatgtcaggcagaaaatacgacgtatttctgtaaa

SEQ ID NO: 26935 - DNA, 201 bp, Homo sapiens
gagctcaaagacacaagatagatgatggaaggaagtgtggttaacagggtagacataggcggggagggggaggaaatggggagatgtgggtcaaaggataygaaacagcagctgcgaggatggagaagtccaggtatctaacgtgcaacatgagtgctcaagttagtaaaaccatggtgtattagggattttcctgaacta

SEQ ID NO: 26936 - DNA, 201 bp, Homo sapiens
caggaccatgtcacactttcacagttggagagcgccttccagcttgaaatctcagaaggacctgcgtttccccactaagcatgctccagggtcagcactgyggagcgatgacaccaacctcccagtaggaggataaaacacacgttagagaaacgcgtttccagaataggggaatcaatgggtgaagatggttggggagag

SEQ ID NO: 26937 - DNA, 201 bp, Homo sapiens
tcctcattgtgtcctcttgatggccttattgaaaattagttgtccatatacatttagatttatttctgagctctatactctgtctaattggtctgtgtttmtgttttttggcagtaccacattgttttagttattatagctttgtaatataatcttaaatcaagtgtgatgcctccaactttatttttcttaagtgaaaaa

SEQ ID NO: 26938 - DNA, 201 bp, Homo sapiens
gttcctgccattcgtatttaaatatttattttaaagttctttttgaaattggaaaaaaaacccaatctagatagacttgccattcatccaaaacctaggcsgtgtttgcaagtgcttccacgctgaaacaactttctggcctctcacattcataagaggactttctggaagataagcccgtgccattgtttttatatccca

SEQ ID NO: 26939 - DNA, 201 bp, Homo sapiens
gtctcccgatcaccgttacctgtggccttccctcagggaggcataccccgtggagtgcgctgtgcccaccaagcccggcccccaggtcgctgccgcccccwcctgcacacgtgtatgctgcatccagtactcaggtgcgccacgtcctgcgggagctgggtagcatttcattgtaagagtctttgattctgcccactgtaa

SEQ ID NO: 26940 - DNA, 201 bp, Homo sapiens
gcaccgagcacccccgtaacgcagggccagcggcgcctgactctccttttcctacctcctcaggtcacagttgggagggcatttccttagatatactatcyttaagtaaattacttctcatttcacatcaagtatattttagatgctttgtagactttgaaaatacattttataaaagttagaaagcaccttagttttatc

SEQ ID NO: 26941 - DNA, 201 bp, Homo sapiens
tgaaaaccgagactgcgtttcactcgactgtagtgagggtgatctccaggcatctcacccctgcgtgggcacagacactggcactcactcactagcagcgmatttgctgttctgtgtccagctcctccggggtttgctctgtttgtctgacccctcctacagacatgttaaggtgggagggcttcggcaggcaaagaagct

SEQ ID NO: 26942 - DNA, 201 bp, Homo sapiens
ggcatttcagaaattcttaactagtcatccattcatgagtcttctaatattccaaagtttttattagtaaaagagagggaactgtcccttccccatgggtragagtgttgagaagagctccctaactggattatcgcagacatcgtactcgcagctggccggaacaggaccgtggaagtgtttgacctcaacgccggctgc

SEQ ID NO: 26943 - DNA, 201 bp, Homo sapiens
caacgaaccctaggtattgatcccccacaaggatgctgcttcagcaacattgtgcattgttgagcctagcgttagcctcttacacatggtgtcaaaccccytatctccctgttgcttgatttttcatgctgaaattgcactttaccagtttgggcatgcactatttttattatcttccagcactaaatattttctcatgtt

SEQ ID NO: 26944 - DNA, 201 bp, Homo sapiens
ttttttatgtgaattggctcatgcagttgtggaggccgagaagtcccaagatctgctgtctgcaagctggagccccaggatagctggtggtggtgttcccrcctgagtccaaaggcctgagaatgggggaagaattggggggtactggtttaagtcccagcccaagggcaggagaacactagtgtcccagctcaaagaggc

SEQ ID NO: 26945 - DNA, 201 bp, Homo sapiens
gcatctgtagatgatttgagtgattagcattacaacgccacccacagcggcatgagactggaaagtgaaattcattttctcttagtgagaaccctcacccycaaatcgtcacagtactcacatgagtttatatgaaacacagcaaatccttgctgttttatatgtaaaatatgtgtcttttttggcaatgtggaatgtaag

SEQ ID NO: 26946 - DNA, 201 bp, Homo sapiens
aaggcagaaataaagatgttctttgaaaccaacgagaacaaagacacaacataccagaatctctgggacacattcaaagcagtgtgtagagggaaatttayagcactaaatgcccacaagagaaagcaggaaagatctaaaaattgacaccctaacatcacaattaaaagaactagagaagcaagagcaaacacattcaaa

SEQ ID NO: 26947 - DNA, 201 bp, Homo sapiens
  misc_feature (1)...(201): n = A,T,C or G, or insertion/deletion polymorphism (see Tables 1-2)
agggctggaggacaggtgggaggggcccgaaagcatttatgcagacgtctatatctatgtatataatttttttcactgtaaaatataaatctcttaagaancttagacctcttaatatttgagagtgatattagagttttctttccacagtgtaactatgttttcaccaaagaccaacatcaagagtgaggggaaaggatc

SEQ ID NO: 26948 - DNA, 201 bp, Homo sapiens
gaaataaatagcaaaaccttagtcagaaaaatcagtttggaatctcagcactgaggctccgtggctttcctggcaaagtgctctctacctgtcatggtttcctcaataaaaaaatggagatttcaataaaatatggatgcaccttggtccgttattgtaaatggtttatgtaacagttgtgttttgtaaatagtgacacac

SEQ ID NO: 26949 - DNA, 201 bp, Homo sapiens
gatggaaggaagtgtggttaacagggtagacataggcggggagggggaggaaatggggagatgtgggtcaaaggatacgaaacagcagctgcgaggatggmgaagtccaggtatctaacgtgcaacatgagtgctcaagttagtaaaaccatggtgtattagggattttcctgaactacatagattttagctgttcttgtc

SEQ ID NO: 26950 - DNA, 201 bp, Homo sapiens
caatgcccctggccacccagaacccaatgagtttaacaccaaaggcgtcaaagtggtcttgcccccaaacatctgtcatccagcctctagatcagagggtccattacacatggaaccctatggaaagggttgtcaatgctatggaagataactttgatagagagaacatcatgaaaatctggaaagattgcaccattgaag

SEQ ID NO: 26951 - DNA, 201 bp, Homo sapiens
cccttcagttaatttcttctgcagaaaatcctatttccaaataagatcacattcttcatattcaggttcagcactagctatgatggaatagcgtgaaactractagggtgcctatcagaactactacacaaaccctggtttaactaggttatgagatgcaaaggggcagctcacattctgtaggtactttttctctgaagg

SEQ ID NO: 26952 - DNA, 201 bp, Homo sapiens
ttagctgttcttgtcacaaatacaagtagcgatgtgagatgatagatatgagagtccacctctccacagtaactagtactattatcttcatatctgtaggyatggatcccataaaatcatattgcaaacttcaaatatacacaatacgcttcattttttaaaaatagtaggtttttgcgggaaaaggaattgtctttgaca

SEQ ID NO: 26953 - DNA, 201 bp, Homo sapiens
tcccagcactttgggaggccgaggcgggtgaatcacctgaggtcaggagtccaagaccagcctggccaacatggcgaaacgccatctctactaaaaaatamaaaaatgagccgaccatggtggtgggcgcgtataatcccagctacttgggaggctgaggcaggagaatcgcttgaacctgggaggcggcggttgcagtga

SEQ ID NO: 26954 - DNA, 201 bp, Homo sapiens
gcacgtggggcccaacgcccacactccccactcctgcggagagctcacagccaggccagggggcgcacgtggggcccaaccttcaggaataagattattgkgtattcttttctttttttccttaaatcagtctttcttctgagaacacccgatgtgtgtggatcggaagctcagtgggcttattcgtatttaacctggcaa

SEQ ID NO: 26955 - DNA, 201 bp, Homo sapiens
acaaaacagactaagacaacactgataatggatttacagcccaccctaaatccaagctgatctcaatacccttcagttaatttcttctgcagaaaatcctwtttccaaataagatcacattcttcatattcaggttcagcactagctatgatggaatagcgtgaaactgactagggtgcctatcagaactactacacaaac

SEQ ID NO: 26956 - DNA, 201 bp, Homo sapiens
atggcgtaaatatagttatacaaaataaagaggaaaaagcaacaagttgtagttgtcatgaaccttgcttcctgacgaagggccgctaaagaacaggcagygagaaaccagttatgtatatgtatacatcacactgattcattaaggataatgatatcatataccgaatttatatatatatatatatgtatatatatatat

SEQ ID NO: 26957 - DNA, 201 bp, Homo sapiens
ttatacaaaataaagaggaaaaagcaacaagttgtagttgtcatgaaccttgcttcctgacgaagggccgctaaagaacaggcagtgagaaaccagttatrtatatgtatacatcacactgattcattaaggataatgatatcatataccgaatttatatatatatatatatgtatatatatatatataaaattcactaag

SEQ ID NO: 26958 - DNA, 201 bp, Homo sapiens
caaaataaagaggaaaaagcaacaagttgtagttgtcatgaaccttgcttcctgacgaagggccgctaaagaacaggcagtgagaaaccagttatgtataygtatacatcacactgattcattaaggataatgatatcatataccgaatttatatatatatatatatgtatatatatatatataaaattcactaagttcct

SEQ ID NO: 26959 - DNA, 201 bp, Homo sapiens
tcctgacgaagggccgctaaagaacaggcagtgagaaaccagttatgtatatgtatacatcacactgattcattaaggataatgatatcatataccgaatwtatatatatatatatatgtatatatatatatataaaattcactaagttccttatttttaaaaatttccttatttttaaaaatttggctggttccttattt

SEQ ID NO: 26960 - DNA, 201 bp, Homo sapiens
cttgttcctgccattcgtatttaaatatttattttaaagttctttttgaaattggaaaaaaaacccaatctagatagacttgccattcatccaaaacctargccgtgtttgcaagtgcttccacgctgaaacaactttctggcctctcacattcataagaggactttctggaagataagcccgtgccattgtttttatatc

SEQ ID NO: 26961 - DNA, 201 bp, Homo sapiens
agaaagtgatactcctaaactagtcagttccacaacaggcacatgcactgttctgccacgcagaccgtctgtgagggtgcccttctctgtaactgcgccarcctggactcctcacacctgcagggaagggccccgttcaaatggtgtttatcacggacaaagccaaagtgtgcgtgactgacctacatgatgccagatgtg

SEQ ID NO: 26962 - DNA, 201 bp, Homo sapiens
aaaaattgcttgcttagtccaagcccagtcctggcagttttaaggggcctgtttgagttacaaccgttggatctgccttcctttttcagtatttcagcagrgccatcgtggacccagaagaactccatgacctgctgctggcgcggacactccaggactcagcctttggctttccatagtggtgacataagagaagcagct

SEQ ID NO: 26963 - DNA, 201 bp, Homo sapiens
tcttggttgttgctgttgtatctgatcaactacactaatctatagatggtccctctgctctgcctagcttacaggtgattcctgactctgagttaacatgrcacacctgctcatcttgtcttgtaggcttacgtgtatgaaatgggctcaagcacgttttctcaccggctggctgggcacacagacactgtcactggagtg

SEQ ID NO: 26964 - DNA, 201 bp, Homo sapiens
gggcaacatcgtgagacctgatttctacaaaaatgaaaaatcagctgcgtgtggtggctcatgcctgtagtcccagctacgcgggagcctgggaggtcgakgctgcaagtgagccaggattggaccactgcactccagcctgggcaacagagcgagaccctatccctaaaaacagaataattttaaaaatgttacttggtt

SEQ ID NO: 26965 - DNA, 201 bp, Homo sapiens
gcactccagcctgggcaacagagcgagaccctatccctaaaaacagaataattttaaaaatgttacttggtttacaaaacttgttctttaacattgactctttaggaacagattaagtaaaggaaatgaagtggcttgtgtgcatgctcgaacccttccagcatctgtgtgattatgaacacacattgtgaacgggacact

SEQ ID NO: 26966 - DNA, 201 bp, Homo sapiens
tgctttcttttggccccattagatattttttgtatttccatttatcatctttttttttggcttcttaggtgtaactctttgtttagttaatttgaggtttstttaatttaaagtataaatctttagctgtggtattctattgttaagtgatatgaaaccacttcatctcacaatagcaaacttccatttctcctctccagg

SEQ ID NO: 26967 - DNA, 201 bp, Homo sapiens
cagagccatccgttactagcatacagtcggtgctcaaaaattgcttgcttagtccaagcccagtcctggcagttttaaggggcctgtttgagttacaaccrttggatctgccttcctttttcagtatttcagcagggccatcgtggacccagaagaactccatgacctgctgctggcgcggacactccaggactcagcctt

SEQ ID NO: 26968 - DNA, 201 bp, Homo sapiens
tatttccatttatcatctttttttttggcttcttaggtgtaactctttgtttagttaatttgaggtttctttaatttaaagtataaatctttagctgtggyattctattgttaagtgatatgaaaccacttcatctcacaatagcaaacttccatttctcctctccaggctgggtgctattattgtcatgcattttacttt

SEQ ID NO: 26969 - DNA, 201 bp, Homo sapiens
taaaattaggtgttggattatacgatctttctgtcccttaagtaggtctcgcctccacagagtggattgatatggtgtgacactctgtgaggggcgtgtgygtatctgcatggggtagtataaaatgtgtagtttacatttttacaatagtttatgttttataaatatgtaatatataaaaacattaataataaagcaatc

SEQ ID NO: 26970 - DNA, 201 bp, Homo sapiens
  misc_feature (1)...(201): n = A,T,C or G, or insertion/deletion polymorphism (see Tables 1-2)
cagaggtcaatttaaacatttacttgcactgattaggtgcttactgtgtcacagtcaccatccttaagtgctttatgtaatcatcacagccttaacaagcngatacctcattaccttcctatcgcaggtaaggaaactgaggcataaagaagttaaaatgcctgaacaaaagcacacagtgggtaagtggacacgcaaggc

SEQ ID NO: 26971 - DNA, 201 bp, Homo sapiens
tgttttctgagtatgtcttagccacagctcgtttctctgtggtgggtgaagtgcttcatgaatccagtgagtacctctaattaaaatgtttctttcacacrtggattgtggttacattgaatcatttgcagagctgttcattaccatcgctctgtgtcatacaagaggcttattgtccttctgtatttatgacactgtgta

SEQ ID NO: 26972 - DNA, 201 bp, Homo sapiens
tctgaacaaggcggggtcagggaaggtgttccccaggaggtggtcctggggctgagccttgaaggaggaggggacagctgcaccagcaggaggggcctggycctgaccccccaccgcccactgtgtggcccagagaaggcagcaggagcctggcacagcctgctgtgttctgcacctagccccacaggcaatgcaaccccc

SEQ ID NO: 26973 - DNA, 201 bp, Homo sapiens
agattccatcttcttggcatggtgcccacctacgcaccacagagctgtataagggcagaagagaggagtgtgttctgctgccaccagcaagcactgggaakcatcttgaagaaaagcggggtgagctgtacggagcctttcggggcagattcaagagcagaaagccgtgtctttcttactatggacactcgggaactggag

SEQ ID NO: 26974 - DNA, 201 bp, Homo sapiens
tgagtcttctaatattccaaagtttttattagtaaaagagagggaactgtcccttccccatgggtaagagtgttgagaagagctccctaactggattatcrcagacatcgtactcgcagctggccggaacaggaccgtggaagtgtttgacctcaacgccggctgcagtgcagcggtgatagcggaagcccactcacggcc

SEQ ID NO: 26975 - DNA, 201 bp, Homo sapiens
tgtaaatactatgtgtttaaaatattctgcaagctctctatgtagaaccaagatcttatgtgtgtcttaaaaggactttcacaacatgcctccaaattacytatcttctctctctatttttttctatatctcctgatttctgtgtcatacaacttctggatatcacagttttttttaataatacaaaaaaaaataaggatg

SEQ ID NO: 26976 - DNA, 201 bp, Homo sapiens
ttgggtcttaatgcattactaaaaataatgaacaacatttaatatgacaaagatgccaatttatgtagaaaatgtcataaacctgtatgcacccaataacrtagtttcaaaatatataaatcaaaaatgatataactctaagaagaaaaagaagtatcttcaatcataatggaagactttaacaaacttctcttaatgact

SEQ ID NO: 26977 - DNA, 201 bp, Homo sapiens
agacctatttgctccgggcattcccccggcagcgctgctgtgctcacagtccggactctgagccaggccaggcatttccttcccgggctgtggcctcctcycctcctgacttgtcacctgcaactcccagagcctgagcaggagccgtggagccctcctgcaagttcatcctctatctcatcggcctcctcacccctcgct

SEQ ID NO: 26978 - DNA, 201 bp, Homo sapiens
  misc_feature (1)...(201): n = A,T,C or G, or insertion/deletion polymorphism (see Tables 1-2)
cctacccagcaccctccacgtccccacctggcctgtgaatcttagacgccacctacacctgcccagcaccctcacatcctcacctggtctcctgcgcatcncagatgccacctgcacccgcccagcaccctcgtactcacctggtctcctgcgcattgcagatgccacatgcacccacccagcaaccttgtcctcacctgg

SEQ ID NO: 26979 - DNA, 201 bp, Homo sapiens
ctcatcttttgctgttggggagcgtcagggagccccccaggagttcctgccctggcttcatttagccaggaagtctctataagaagccaagctacttagarcttgaggacatcttactgggaatttcacactggccagaaagtgatactcctaaactagtcagttccacaacaggcacatgcactgttctgccacgcagac

SEQ ID NO: 26980 - DNA, 201 bp, Homo sapiens
ctcccattactgtccaaagtagcaaggatttacctatggctgacctttccagttttgaggagaccagtgctgatgattttgccatggagatgggattggcytgcgttgtttgtaggtaagttgtaccttgccacagattcttttgttactttataaagaacacatgaccctttccactcctcaacccccaaaatcagaaaa

SEQ ID NO: 26981 - DNA, 201 bp, Homo sapiens; identical to SEQ ID NO: 6766

SEQ ID NO: 26982 - DNA, 201 bp, Homo sapiens
catatgctaggattcaacctacagcaagttttaatggtgttataaacccctgaaaatgggagataactgtggaattgctgacagttccctaactatagcartgcaagtgtgctgcattaatacaatattaacctcaaggatagaagatttcaagccatagtatattgatcaaaggattgaacacaaagaatacatttttat

SEQ ID NO: 26983 - DNA, 201 bp, Homo sapiens
tcaatgtttttgttggtatgtgctttcaaaacaaagatttgaatatttaagatattgaaaaaataaataatataagctgattatttatttatatgtatagyatgtacatgtgattaatatttctattgctaaagaccagaccatgttatgtgcatttttctctttttagttttatctaattctaatatagataaaacaaga

SEQ ID NO: 26984 - DNA, 201 bp, Homo sapiens
aacccgttgtctaaacaatcagcataataatatatcaagccctgccaccactagatctgaggacccattcctccttcctttttcttctcttcccccctcasaggtaaccactattctgaaattgttgtgtattattcccatttatacttttgtacttttacatattatcacagtaaaatagactgcactcagctgccttag

SEQ ID NO: 26985 - DNA, 201 bp, Homo sapiens
tttctagcgtttaagagaacagaagtcaaggtatagtagattctatttttatctaagattatatcttaaagtttagttgactaaaaaatagttgcttgatwaaaaatttaatgagaaactttatatactaaatggctatattttagaaattaagactttactactattatattaggtagaaagggaacatttatatcatta

SEQ ID NO: 26986 - DNA, 201 bp, Homo sapiens
taattactaaaggtgggttttcttttgtgaagttttttgaaagatcatttaaccatatggcagacagttttatgtttaatagcaagaaaaggaaaaaaaawtaggtctttcataactgaaaattaaaggtttacttcttgactaactttttctctcattgctggtatatattcctctaggaataaatggtttatgtagttt

SEQ ID NO: 26987 - DNA, 201 bp, Homo sapiens
tttatataataatgggtataggtatataataatcaacactcagtgaatatatattgatagctatagattttgacttttcaaaaaatgagtaaaatttacarattttaaagttaagtggttaaaagttattgtcaataaatatttgagtcctagggagtatagtaactttgagtgtaaactttaatctatgcctcagagatc

SEQ ID NO: 26988 - DNA, 201 bp, Homo sapiens
tctcactgcttcagcatacacattcatacactctggccactctgacacagactaagtgtgtcattccctgaatatgtggagaactttcatgttcccatatkttctgcttctcagcttcttctcttcatctgggatactgtttattcttttatctgctttgcaaataatatctaatttatcagtaagagcatgtattcattg

SEQ ID NO: 26989 - DNA, 201 bp, Homo sapiens
taaagaaggaagctgaaaagagacctgctgataaagtaagattttattttaatcttgttaaaagaaagtaaattagttgttccataagcagaaagaaacartgttttatgcctatttcttttatataataatgggtataggtatataataatcaacactcagtgaatatatattgatagctatagattttgacttttcaaa

SEQ ID NO: 26990 - DNA, 201 bp, Homo sapiens; identical to SEQ ID NO: 6767

SEQ ID NO: 26991 - DNA, 201 bp, Homo sapiens; identical to SEQ ID NO: 6768

SEQ ID NO: 26992 - DNA, 201 bp, Homo sapiens
agagtgaattaaatttttgaaatgatccctagttatttggagaaaagtctaaaagaattagatgtttaactaaggtcgataatactttgttgggtaaaaastatgttaaagcactaaatctggttttcagatatagcttagaattgaatctaaaagcaattcccaaaaaggaatttcatatattttcttttggaatcatta

SEQ ID NO: 26993 - DNA, 201 bp, Homo sapiens; identical to SEQ ID NO: 6769

SEQ ID NO: 26994 - DNA, 201 bp, Homo sapiens
atgataataatttgtcaaagagcatatatattcattatcatcacactattttttaaaatgttcaactgtatttcatttcagtgatgagtcctgtgagggaytattatctttctgtatattcagttaagattttgtatctgatttaatccactgatttttgcaggctcaaaaaactcagaaaccaccgcagaaaccagcccc

SEQ ID NO: 26995 - DNA, 201 bp, Homo sapiens; identical to SEQ ID NO: 6770

SEQ ID NO: 26996 - DNA, 201 bp, Homo sapiens
gtgccagttactgaatcttcttaaatgctaggccaagaaatttggtctttatttcgaaggtggtagaaagccctaacttctcagcaagaatttttttttttattttaatgaaaaagaagaaaactgggtttcaggaaaattcatatggcaacaatgttgaagtcaaggaaaataacgaggttattgccatagttcaagtaa

SEQ ID NO: 26997 - DNA, 201 bp, Homo sapiens
taatggtatgttttcttaggcaaatgatggtggcatctggcaatcaattagtagaatgtcaggagtgccataatctctaccaccgagattgtcataaaccscaggtgacagacaaggaagcgaatgaccctcgcctggtgtggtattgtgcccgatgtaccagacaaatgaaaagaatggtaggaatcatatttttcttta

SEQ ID NO: 26998 - DNA, 201 bp, Homo sapiens
gaggtctggatgtgttgagggggtatggatgctcctacttatgggggagctgctctgatccatggcctggggtggactggggtctcttgctcttaggtgcrattcctggagcagcagaaccaggtgctacaaacaaaatgggagttgctgcagcaggtgaacacctcaactggaaccaacaacctggagcccctcttggag

SEQ ID NO: 26999 - DNA, 201 bp, Homo sapiens
gtcgtcctgaagaaggtgagggaaaggggagtcctgagggtggctgtggacccaggaggctgaggggagtgaggaatccctatgggatgctctgtgacaayggcagggtggcctctacggccggcttgctgtgtatgatgcctgaatgcggggcccttacattggaactgacactgataatgactcttcaggaagccttga

SEQ ID NO: 27000 - DNA, 201 bp, Homo sapiens
ccctttgtagtatgaagaatacttttcaagtaggaacactttcaattttcaatgtatggggtttgcaagtcgatgccacgggtgatcgaggatggaggagkctgcaggtgcaggggcgggtgcaggtgggggccttgcccggtccctctgaccccgtgtgcactgtcccctacccacagccgtgcagaacagccaggtgag

SEQ ID NO: 27001 - DNA, 201 bp, Homo sapiens
caatcccgagaaaaggaagctctctgacccttggaggagccatcctgattctctgaggtctggatgtgttgagggggtatggatgctcctacttatggggragctgctctgatccatggcctggggtggactggggtctcttgctcttaggtgcgattcctggagcagcagaaccaggtgctacaaacaaaatgggagttg

SEQ ID NO: 27002 - DNA, 201 bp, Homo sapiens
ccctcctggaggggcttgtggtgggcagcacatgctgactatgatgctgcctttggccccagtaccaggagctccagatcatggcagggagacatggagaygacctgaagaacagcaagatggagattgcagagctcaaccgcaccgtccagaggctgcaggcagagatcagcaacgtgaagaagcaggtgggacgggtgc

SEQ ID NO: 27003 - DNA, 201 bp, Homo sapiens; identical to SEQ ID NO: 6782

SEQ ID NO: 27004 - DNA, 201 bp, Homo sapiens
tgcctcgcaggagctgtctcaggtgcagactcacatcagcgacaccaacgtcatcctgtccatggacaataaccgttccctggacctggacagcatcatcratgcagtgcggacccagtatgaactgattgcacagaggagcaaggacgaggccgaagccctgtaccagaccaaggtgggcgtggcccccagatctggtgc

SEQ ID NO: 27005 - DNA, 201 bp, Homo sapiens
tatggcagcggctgcggcggcggtggcgggagctacggagggagcggcagaagcggccgcggatcctcgcgcgtgcagatcatccagacctccaccaacamctcccacaggcggatcttggagtagaggcctcgtttctgccacacatcacgcctgcccctcaccgccctctcctcaaactcctcccctccacgcccttcc

SEQ ID NO: 27006 - DNA, 201 bp, Homo sapiens
agaagctaccgcggaggcggggcacgaggcgggagtggaggcggttatggcagcggctgcggcggcggtggcgggagctacggagggagcggcagaagcgkccgcggatcctcgcgcgtgcagatcatccagacctccaccaacacctcccacaggcggatcttggagtagaggcctcgtttctgccacacatcacgcctg

SEQ ID NO: 27007 - DNA, 201 bp, Homo sapiens
gttctctgaacccaggacagcaaatgtttggggaattccaagctttctgctgtaaggagggacctcagggagccaaggtcagcctgcagcctttctgtgcycctttgcctcgcctgacaggtatgaggatgaaatcaacaagagaactggcagcgagaatgactttgtcgtcctgaagaaggtgagggaaaggggagtcct

SEQ ID NO: 27008 - DNA, 201 bp, Homo sapiens
aaagataagccccacctttttgggaagattggtagcccagggtgagcagaaacattccaattagaggcagaggctgtgtgaatggacaagcctcttcacayagggagaagtcattgttatcattcctccacctccaagtagaatgtccttataccccaatccaagcctctgcagctgggtattcacccccaatgctaaaag

SEQ ID NO: 27009 - DNA, 201 bp, Homo sapiens
tggctgacagtccagtcactaaattctgaacaactagcattgatgactggctttgaggatgatctgtggccaactccaatcctggctgacctctgtcccayggtcctgcacagtgttctggggtggaatggatttcgacattagactaggaagcagatggccaacagtgaaaaatagcagagtgcagattcccttgagtcg

SEQ ID NO: 27010 - DNA, 201 bp, Homo sapiens
tcactttccatccacccatccacccatgcacccatccatccatccccatccacacaatccatttatacacacacacacacacacacacacacacacacacmtccatccattcacttattcatcaatccacccaactatccacccttccgtccatccatccatccacccacccatccacacaatccatttatacacacacac

SEQ ID NO: 27011 - DNA, 201 bp, Homo sapiens
tctcaggtgcagactcacatcagcgacaccaacgtcatcctgtccatggacaataaccgttccctggacctggacagcatcatcgatgcagtgcggacccrgtatgaactgattgcacagaggagcaaggacgaggccgaagccctgtaccagaccaaggtgggcgtggcccccagatctggtgcccagaaaaacagattc

SEQ ID NO: 27012 - DNA, 201 bp, Homo sapiens
tgcctgctattcaggatgtggatgctgcttatgtgagcaaagtggacctggagtccagggtggacactctgactggggaggtcaatttcttgaaatatttrtttttgacggtgagttaagcctttataagaacctcctttcttttctcacatctcacaaggagtatgggctgtaagaggggaggcctgaaacccaacacta

SEQ ID NO: 27013 - DNA, 201 bp, Homo sapiens
ggaggttggtgtcacatctccttctggctaggaaagccaggacttgtgggtcccttattcgagtgcggtgatgaattttttaagtaaggaaataaacctasagtggctctgccactcgcctgagccagccagtgagctggtggcaggcaatgcctgggcaataaagtcaaactgtttctgcctgctattcaggatgtggat

SEQ ID NO: 27014 - DNA, 201 bp, Homo sapiens
agtcagccatcctctccaccccaatcctcagaatccccaggttggggtaatgaagatggaaggctgggagaatcctgagttaggtggaggcgaatgtgtcyctggttcatggcttccaatctgtctgggaaatcacccagacatataaggggcaaaaccaaccagaaatcttcattaattctggggagttgatggagctgt

SEQ ID NO: 27015 - DNA, 201 bp, Homo sapiens
acccaacactacccactagggactcatctccccaggtaccccaactctgtgggcctggagtcagccatcctctccaccccaatcctcagaatccccaggtyggggtaatgaagatggaaggctgggagaatcctgagttaggtggaggcgaatgtgtccctggttcatggcttccaatctgtctgggaaatcacccagaca

SEQ ID NO: 27016 - DNA, 201 bp, Homo sapiens; identical to SEQ ID NO: 6792

SEQ ID NO: 27017 - DNA, 201 bp, Homo sapiens
caaggagtatgggctgtaagaggggaggcctgaaacccaacactacccactagggactcatctccccaggtaccccaactctgtgggcctggagtcagccrtcctctccaccccaatcctcagaatccccaggttggggtaatgaagatggaaggctgggagaatcctgagttaggtggaggcgaatgtgtccctggttca

SEQ ID NO: 27018 - DNA, 201 bp, Homo sapiens
tggcctggctggaaggaagaaggcttctatgacaggtgacttctgactctgctttccaaactggtcttcctgctttcacccttgaccctgtatagcctatwcttgacaccacagcagagccatcctttaaaagcatgtcacgacactcctccatttgaatcctccagtggcttcttgtctcgactgaaagaaaagcccaag

SEQ ID NO: 27019 - DNA, 201 bp, Homo sapiens
agagcagcccagacctactccctcctggaggggcttgtggtgggcagcacatgctgactatgatgctgcctttggccccagtaccaggagctccagatcayggcagggagacatggagacgacctgaagaacagcaagatggagattgcagagctcaaccgcaccgtccagaggctgcaggcagagatcagcaacgtgaag

SEQ ID NO: 27020 - DNA, 201 bp, Homo sapiens
ggagacgacctgaagaacagcaagatggagattgcagagctcaaccgcaccgtccagaggctgcaggcagagatcagcaacgtgaagaagcaggtgggacrggtgcttagggagggctgaccaagccctgcacctcctacaatgccctgccagatcgagctctggaaacttaaccattaaatggtctccaactgtctctgg

SEQ ID NO: 27021 - DNA, 201 bp, Homo sapiens
cttcatgaaaaccctgaaatttctctctgccccactggcttcctgacctctgctcatgcacacacatttccctaaggcttggggacacctctgatccagawgtctgtgggccacagccttctctcctcaggccctgtgggtctggctgaccgtgtgctttggttttacaggatgtcaggagagctgcagagccatgtgagc

SEQ ID NO: 27022 - DNA, 201 bp, Homo sapiens; identical to SEQ ID NO: 6785

SEQ ID NO: 27023 - DNA, 201 bp, Homo sapiens
ctcactatggtggccaagtcagagcaaggcagagtggcagctgcaggagaagtgtgatggggagatggtatctgaacgctccaggtttaggctccttccttctccctggaggcagttaagactctccctattatctctcattgcacacaacaattccaagagcttttcccaagactacctggcccaggcttctggcttccc

SEQ ID NO: 27024 - DNA, 201 bp, Homo sapiens; identical to SEQ ID NO: 6787

SEQ ID NO: 27025 - DNA, 201 bp, Homo sapiens
ttctgctgtaaggagggacctcagggagccaaggtcagcctgcagcctttctgtgctcctttgcctcgcctgacaggtatgaggatgaaatcaacaagagractggcagcgagaatgactttgtcgtcctgaagaaggtgagggaaaggggagtcctgagggtggctgtggacccaggaggctgaggggagtgaggaatcc

SEQ ID NO: 27026 - DNA, 201 bp, Homo sapiens
aggcccccagaggagaatggaaggagtcagcctgtgcgccatgcctcgcaggagctgtctcaggtgcagactcacatcagcgacaccaacgtcatcctgtycatggacaataaccgttccctggacctggacagcatcatcgatgcagtgcggacccagtatgaactgattgcacagaggagcaaggacgaggccgaagcc

SEQ ID NO: 27027 - DNA, 201 bp, Homo sapiens
ttcaattttcaatgtatggggtttgcaagtcgatgccacgggtgatcgaggatggaggaggctgcaggtgcaggggcgggtgcaggtgggggccttgccckgtccctctgaccccgtgtgcactgtcccctacccacagccgtgcagaacagccaggtgagcgtcaacggcggcgcgggaggcggcggcagctacggctca

SEQ ID NO: 27028 - DNA, 201 bp, Homo sapiens
tcagccctcagtgtttgtgctccccctgcagagcaggcactctgcagtgagggcaaaggctcctcgcatctggccccagctccctccagcctcaggtgagyccggtgatgcacctgtgatcccttcttccatgtgatgccccctagctttcccagggcaagtccgtggacttcttaaggctttctctcacaagatgaggaa

SEQ ID NO: 27029 - DNA, 201 bp, Homo sapiens
tggagacgacctgaagaacagcaagatggagattgcagagctcaaccgcaccgtccagaggctgcaggcagagatcagcaacgtgaagaagcaggtgggaygggtgcttagggagggctgaccaagccctgcacctcctacaatgccctgccagatcgagctctggaaacttaaccattaaatggtctccaactgtctctg

SEQ ID NO: 27030 - DNA, 201 bp, Homo sapiens
ctgtgtgtctcaatcccgagaaaaggaagctctctgacccttggaggagccatcctgattctctgaggtctggatgtgttgagggggtatggatgctcctrcttatgggggagctgctctgatccatggcctggggtggactggggtctcttgctcttaggtgcgattcctggagcagcagaaccaggtgctacaaacaaa

SEQ ID NO: 27031 - DNA, 201 bp, Homo sapiens
gttagagggtttcactggagcaaggagtcactactcggaggtcacggctgggccaagagaggagcagggaggagaaagggctgggaaatgaccacaggccrctggcaactgacctcctgaggctcatctgattatggcccctgccatgaacagggtctgtccagttgcatggcatagggcagtgggcagaggctagggtgc

SEQ ID NO: 27032 - DNA, 201 bp, Homo sapiens
ccggaaactggtcacaggggcaagacattcggcttcagtgtttgtgtgtaagggtggggggcggggcatgcaggctctgcactgcacaactgcaggaggcrctgttttgtatgtggcaacccgggtagaatgatattggcagccagctgtcaattgcattgggtggggaggggcaggatagcttcatggatgttgaaacca

SEQ ID NO: 27033 - DNA, 201 bp, Homo sapiens
caggggcgggtgcaggtgggggccttgcccggtccctctgaccccgtgtgcactgtcccctacccacagccgtgcagaacagccaggtgagcgtcaacggyggcgcgggaggcggcggcagctacggctcaggaggctacggcggcggcagcggtgggggctatggcggcggaagaagctaccgcggaggcggggcacgag

SEQ ID NO: 27034 - DNA, 201 bp, Homo sapiens
gtgagctcccaaagtcttggatagctccactcctgtgactttgcagggttcagtccctatggctgctctaacaggctggtaggttggcattgagtgccagmaacttttccaggcaaacataagctggtggatatatcattcttgggatctggaggacagtggcccttttctcacaacatcatgaggcagtgccccagtgag

SEQ ID NO: 27035 - DNA, 201 bp, Homo sapiens
gtggagactccaacttcacactctgcacggccctagtagtggttctccatgatggcttcccactgccctagtagaggttctccatgatggttccacccctscatcaggcttttgcttggacacccaggctttttcatatatccgctgaaatctaggcaatggttcccaagcctcaactttggcactttgtgcacctgcagg

SEQ ID NO: 27036 - DNA, 201 bp, Homo sapiens
cacctgccacactttgtaaggagctctcacatgaccctctcttgcttcctctctctctacatatctttagttaagagtttaggtaagaacgtcctccactktgttggctttgaaaaggagagatctttttttttgtcttttcagcatatagtttggcctagcaagaactcattacttgtttgaatagatagcacagattat

SEQ ID NO: 27037 - DNA, 201 bp, Homo sapiens
tgcaccagggttgaagctccagcagccaggaggcaaaagcagtgtcctgggtctaggcaaggcagcagggctcaaaacctggcccaggaaaccattctgtyctcccaggcctcagggcttctggtgggaggggctgcctcttagatatttgagatgccttccaggcctttttctcattgtcttggctatcagcacttgcct

SEQ ID NO: 27038 - DNA, 201 bp, Homo sapiens
aggttgttactaaacgcgattgaagtgggtatcattttatggaaatgtattttagataaccacacatagtgtatgtacaccagcttccaaatttgtaaacyaagaactattaggtataccttaaaatagaggtaatttaccaatgatcacagctgtcaagagcaactgcgaaattcagaaacgtagtcaaaagaagtttac

SEQ ID NO: 27039 - DNA, 201 bp, Homo sapiens
caggctacatctccagtattggagattccatttcacatgagatttgagcagggacaacatccaaactatattatttaatgatatgagttttctcattagasgcacctgagaaatacaaccttccataagaaaattttccctaggaaatggctatggcacagagccttgaataaattaggacatagatacaaattcaaattt

SEQ ID NO: 27040 - DNA, 201 bp, Homo sapiens
aagagtgcatacaaattatacccttgtaaccttagaaattttgacaattcttaatttttgacattgccattttaatactttaccttgtacatgatacttarcatatttatgctttagtttgttcatctgtaaaatgggaatagtatctgccttagaatggccacatggcagttttcagaatttcgtgtacatgcaaatgac

SEQ ID NO: 27041 - DNA, 201 bp, Homo sapiens
ctaattcttctaatagtaaaaataacaattgtcctcagaaaacagtagaaataattacaggatagtaagagtgcatacaaattatacccttgtaaccttaraaattttgacaattcttaatttttgacattgccattttaatactttaccttgtacatgatacttagcatatttatgctttagtttgttcatctgtaaaat

SEQ ID NO: 27042 - DNA, 201 bp, Homo sapiens
agcaatgggaccctgatatgcttattcttaaaaggtttttataggctgggggaggtggctcacacctataatcctagcactttgggaggccgcggtgggtygatcacgaagtcaggagtttgagaccagcctggccaacatggagaaaccccatctctactaaaaatacaaaaattagcctggtgtaggggtgcatgcctg

SEQ ID NO: 27043 - DNA, 201 bp, Homo sapiens
tgttttagctaccagaaacaatgtttcccaatagctagcatattaaactaaaaaaattaaaatgtatcatgcatgaggcaagccagaacttcaaaaggatwttcatgtttatgttttatttttttttccagcttggcttgcttctgtcattgtatacactacatccgataccttttggaaaccttatttgttcacaaagtt

SEQ ID NO: 27044 - DNA, 201 bp, Homo sapiens
atcttacacatttcacacaaattaactcaaaataaatatcagacctaaatgtaaaactataaactacactaaaactataaacaaaactatagaactcttawggtataacaacaaaatcttcatgaccttggatttggcaaagatcttttgaaaaaaaattaataagatggaattcattaaaattaaaatttctactatacg

SEQ ID NO: 27045 - DNA, 201 bp, Homo sapiens
  misc_feature (1)...(201): n = A,T,C or G, or insertion/deletion polymorphism (see Tables 1-2)
atacatataggactcagttctggtcatttaactttgaaattactctgagacaatcatgcagactggttaaacatccagttgtatgtgtaagtctgcagctntgaaaacaagttggtgctggtaatatacatttgagaatatgaaaatatatggcattcaaagtaatgggaatgagtgagatcaacttccttgacaaaacat

SEQ ID NO: 27046 - DNA, 201 bp, Homo sapiens
  misc_feature (1)...(201): n = A,T,C or G, or insertion/deletion polymorphism (see Tables 1-2)
ggcattcaaagtaatgggaatgagtgagatcaacttccttgacaaaacataagctatttttacataggatcaccaaagcaattcaattatgtgttgaaccntcatggttcatataatcatcaaactttttttagaatttcagacatatgtaatgataaaattttcattgttctctctaatgtcagatactctgaatttgtt

SEQ ID NO: 27047 - DNA, 201 bp, Homo sapiens
  misc_feature (1)...(201): n = A,T,C or G, or insertion/deletion polymorphism (see Tables 1-2)
catttatgaggacagtgagccaatgatgcagaaataattgtagcctctatctctgtggtttgatgtcaaacaattcattagtgatatgaactttctaaaantgattttcctccctaattatttttgcttgaaactcatttcatatttgtcatattttaaaaactgtaacataaatctttaagtaggaaaaataagtatatg

SEQ ID NO: 27048 - DNA, 201 bp, Homo sapiens
taagttctagggtacatgtgcaaaacatgcaggtttcttacatatgtatacatgtgccatgttggtgtgctgcaccaattaactcatcatttacgtcattyacattaggtatatctcctaatgctgtccctcccccctccccccaccccacaacaggccccagagtgtgatgttccccttcctgtgtccaagtgttctcat

SEQ ID NO: 27049 - DNA, 201 bp, Homo sapiens
ttattttaagttaatgttatctaatcttactctttatgctaacagatgttctcttgattttaaagtttgtctgtatattttcattttacctttgctgaaayatacttcaaaatagttcaacaacttgaatatattaatgaaaagaattgtcaaatcttagaaaaagtaattctgaagaaattattactcaactttaaaatt

SEQ ID NO: 27050 - DNA, 201 bp, Homo sapiens
tgaacccttgagatattaaatgctaatatacatttttacatttgattttactaaggtaaaaatatttcataaatattgaatatgacattgaatgactttayatttgagcacctcctgactcattttcatggttttggtacaatataattttccatatatcttaaatccaaatacattactaaaattttatctaacaaatac

SEQ ID NO: 27051 - DNA, 201 bp, Homo sapiens
  misc_feature (1)...(201): n = A,T,C or G, or insertion/deletion polymorphism (see Tables 1-2)
gatttaaaataaataagattttatcaatactttggttgggaaaaagaattggattcacacctatttatggttttacagttaatttagcaatccacaaaaantaatcagtgtttggaagttaaacatcattaaatagaataataatattttgaaataaaatcagacttgatgagttagcagtgatgtgcatgatggcatata

SEQ ID NO: 27052 - DNA, 201 bp, Homo sapiens
ttatccacagatcatggtataacaaaatagaacatttcaatcacaattttttcaaatattaaacaatgtctttcattttcttataaatatgatcccatttwatgagattgcttatgactttatatgtaaaaattaaattattatttcttgaaaatgtattcctatctataagttttctaatattttaagccttaaaattac

SEQ ID NO: 27053 - DNA, 201 bp, Homo sapiens
atgacagagaagcagcaggtttctttgtgtggcagcactgctcacagtaggttttccaaactgagctgaaactagctggaaatcaaacaatcaccatttcrctagaaatatttttactgttaatgaactgagattaatacgaagctatgccaaatatgtcttcagcaagagttgtctctgtatgatctggaagtctcccca

SEQ ID NO: 27054 - DNA, 201 bp, Homo sapiens
aaatcaactcacaatggagtaaagactcaaatgtgaaacctaaaactgtaaaagccctggaaaaaaaattatgaaatacaatcatggaactaggaactggyaaagattttatgatgaagactcccaaagcaattacaacataataaaaaaatgacaactgggacctatggaaattaaagaggtcccttacggcaaaagaaa

SEQ ID NO: 27055 - DNA, 201 bp, Homo sapiens
  misc_feature (1)...(201): n = A,T,C or G, or insertion/deletion polymorphism (see Tables 1-2)
gtctgttattggtagactcaggtatttgaagtaataaactgtgtatttcactttattattcttgacaccaggaaacagctagcttataacaccattcatcnatatttctttaaatatttgtcttagaatttgaacaaaaatagttttaacttaagaattggaaaatgatatggcaatcaatattagttcaatttttctttc

SEQ ID NO: 27056 - DNA, 201 bp, Homo sapiens
catttaaaaatggacaaaggacatgaaaagatacatataaccaacaagaatatgaaaaaaatactcaacattactaatcattagagaaatgctaatcaaayccacaatgagaaaccatcacacattaatagtcagaatggttactattaaagtcaaaaattagcaaatgctggcaaggttctagagaaaagggaatactta

SEQ ID NO: 27057 - DNA, 201 bp, Homo sapiens
attttgcattaaggatctgatgtcagtgctttgagcagattaattagtaagatttaaggcattcaatggattggtattaggcatattttgctctatactgmattagactaatttataaagtgtagttcacaaatgccctccataaataacatataccatttactatgcaattagactgccacgctttttattaaaaatgtt

SEQ ID NO: 27058 - DNA, 201 bp, Homo sapiens
  misc_feature (1)...(201): n = A,T,C or G, or insertion/deletion polymorphism (see Tables 1-2)
agtcagggagaattcagaatattttcccccctctactttaaatgccaaaagccttctaggtaataggtttactatcaattatatcacagattttggtaacngaaacagactgaactattggtagaaatgtagcatcatcaaccaatcactattatttccagattctgggacttcggggtttgttagtcaagcacaaatgat

SEQ ID NO: 27059 - DNA, 201 bp, Homo sapiens
taatcccgttcactactagtcatctcagttctaagatgatttcacttacagtaagcctgatacagcaaagagccaatgcgaatcttagtgatgatggtgttcctttcactaccatattccctgtatttttgaaaagtggtgcatcctattggttctcccatggaacatgagaagaaacctgagaacacgaaacgagggtaa

SEQ ID NO: 27060 - DNA, 201 bp, Homo sapiens
aagcaggatagtagagtgactagtatataacttgatgctaggaatgaggtggtgctggaagacatatttacatgatgtagagatggcttaattgttcattkgtgagtagtgagaaaaacatcagaagctggaaagatgaaaatccaggtcatgctgtggtaatttgtaaagtgttgtgtatagtaacttataaagtacagc

SEQ ID NO: 27061 - DNA, 201 bp, Homo sapiens
agtcaatgttgcagatgacttctgctttgtcagtatagattctaaagtgaggagaatgcagggcagatacaccagttaatctgtgatatatatgcagtatstgtagaaaataagcatggactgttttaaaccactgggttttgcaacacaacctagactattctagcaggtgcattcaattaaatttgaattaaagacagc

SEQ ID NO: 27062 - DNA, 201 bp, Homo sapiens
  misc_feature (1)...(201): n = A,T,C or G, or insertion/deletion polymorphism (see Tables 1-2)
gaaaataagcatggactgttttaaaccactgggttttgcaacacaacctagactattctagcaggtgcattcaattaaatttgaattaaagacagctttcntgattttgtcagtttatttttaaagatccttcaatcattagaagaacctgtaacaaagacagtgtgacagcagctttctatatcattgtaacatatttct

SEQ ID NO: 27063 - DNA, 201 bp, Homo sapiens
aaatgggaggcatatttataaagtgttttattgttcacataagagcattcaataaactggctatatgagttaatctatccagtctctgttaatgtcttcartgaatgtacctactatatactaggatctctagtcaataatattgagaatagagacagcagaaatgagcttatcttaaatatataaagttgtatcaaaaga

SEQ ID NO: 27064 - DNA, 201 bp, Homo sapiens
tttatcctacttgtgcaagcctagtccaacatttaaaaagcaattaatgtggttcatcacatcaccaggataaagtaaagaaaatcacacaattttatcarcagatacagagaaatcatttgacaaaatccaacactcctccataataaaagtctcaataaagtaggaatagagggggaacttcctcaacttcatcaataa

SEQ ID NO: 27065 - DNA, 201 bp, Homo sapiens
ctaccaattctatattaggacgtgtgagttttgttctattgatacatcattttcatttctttaaggaagagaatgatcaacttgatgaggcctgtaaaaaattaacaatatttaaatattgtaaaagtggatcattgcaagctgtcctccctcgaccccttgctttagtcattggtaattggtatcattccacaatgacag

SEQ ID NO: 27066 - DNA, 201 bp, Homo sapiens
acctataaattccattattatttttgatgtatagtcaacttatttctataatgaaattgcccttctggaaatgttggaattcaattcatgggtcgaattcrtgtattatctcttcaaggcctggctgtgcaccacaacataatgtgatatattcctaagacttactccatagttctcaattaaattaactatattcaatca

SEQ ID NO: 27067 - DNA, 201 bp, Homo sapiens
  misc_feature (1)...(201): n = A,T,C or G, or insertion/deletion polymorphism (see Tables 1-2)
agtatatgaccatcacttcaaaatttgaagtgctctaaatttttgaaatcaattttaaatctgttatctctcagggatataggatgtgaggtttctttacntcagtagatttattctagttatcttaaaataaaaccacactacttggacaatacaattaataagaggactgctcagtttaaagtaagcaatgactccaaa

SEQ ID NO: 27068 - DNA, 201 bp, Homo sapiens
ttaaatctgttatctctcagggatataggatgtgaggtttctttacttcagtagatttattctagttatcttaaaataaaaccacactacttggacaatayaattaataagaggactgctcagtttaaagtaagcaatgactccaaataatcaataatgtacaataacaaaagtctaatgctcacttatatgacatgctca

SEQ ID NO: 27069 - DNA, 201 bp, Homo sapiens
  misc_feature (1)...(201): n = A,T,C or G, or insertion/deletion polymorphism (see Tables 1-2)
ggatagaacaaatatttgctaaaataacctaatttgtcaccaattttcagtttccaagaacaatttaaattatctttcatttttgaataggcatatatttntttaaaaattgaatcaataattaataatctatcaaaacagtagtaccaggaccagatggattaattggtgaattctactacatatttaaggaagaaatca

SEQ ID NO: 27070 - DNA, 201 bp, Homo sapiens
ggtgttgttccagaaaggcagagggattctcatgtggtcctaattctagtacttcgtaagtcctccagtatgcacatttgaaagtgttttctcctccatcrtcccatattatcattagaagcctatttaggtcattcaacggtactgctgtctttccaactggataaggccttcccttgtctctggtattatgtgagatat

SEQ ID NO: 27071 - DNA, 201 bp, Homo sapiens
acacacacacacacacatatttctttcctaacttaatttttactgaatatcaaccctgtgtttaagtcagtttgagctactgtaacaaaaatataaaataycaagtggcttataaacaacagaaatctgtgctagattcagcagcacattggaacaataaagagattagcatggctgctatatagcaatgacatacaaatc

SEQ ID NO: 27072 - DNA, 201 bp, Homo sapiens
ataaaacagttcaaattaaatataagtcattgggcacattttttaggacacacttgaaactatcagaaatacacacacacacacacacacacatatttctktcctaacttaatttttactgaatatcaaccctgtgtttaagtcagtttgagctactgtaacaaaaatataaaataccaagtggcttataaacaacagaaa

SEQ ID NO: 27073 - DNA, 201 bp, Homo sapiens
gaataagcataaaacagttcaaattaaatataagtcattgggcacattttttaggacacacttgaaactatcagaaatacacacacacacacacacacacmtatttctttcctaacttaatttttactgaatatcaaccctgtgtttaagtcagtttgagctactgtaacaaaaatataaaataccaagtggcttataaac

SEQ ID NO: 27074 - DNA, 201 bp, Homo sapiens
  misc_feature (1)...(201): n = A,T,C or G, or insertion/deletion polymorphism (see Tables 1-2)
atagctcttttagccttgctgtttggtggatcctgagttcttgtcccacaaacagcaagaatgaggtatgaagacaagtggagggtgggcaagatgaagangagcttggactgagcaatagaacagctcagagaaaacctatagggagaagctcctttctgccaccagggtctcccaacaagtgttcagctcttagcagag

SEQ ID NO: 27075 - DNA, 201 bp, Homo sapiens
tcaccgctgggattccagaactccatagtgagagtaggccattccacacctatcgcactcaccctttccccaggagccattcagggccaggaatgagtccraatgcttggccaccccatgaagagttcccagttccttccccttttaacccaggatctgtgtcctccctctgtccatactcaatgacttccttctttctga

SEQ ID NO: 27076 - DNA, 201 bp, Homo sapiens
gcagttctatctgccagctcagatgtccatggacagtatacagtctctcaccgctgggattccagaactccatagtgagagtaggccattccacacctatrgcactcaccctttccccaggagccattcagggccaggaatgagtcctaatgcttggccaccccatgaagagttcccagttccttccccttttaacccagg

SEQ ID NO: 27077 - DNA, 201 bp, Homo sapiens
aaaataatgtttaatgaaatatacacattgtaataaaatttttaaagataaataattactttttaatatatgtgtttataaacagtgtttggggaataagyataaaacagttcaaattaaatataagtcattgggcacattttttaggacacacttgaaactatcagaaatacacacacacacacacacacacatatttct

SEQ ID NO: 27078 - DNA, 201 bp, Homo sapiens
ggagttctgtctctgccaattccccaggcagttctatctgccagctcagatgtccatggacagtatacagtctctcaccgctgggattccagaactccatygtgagagtaggccattccacacctatcgcactcaccctttccccaggagccattcagggccaggaatgagtcctaatgcttggccaccccatgaagagtt

SEQ ID NO: 27079 - DNA, 201 bp, Homo sapiens
  misc_feature (1)...(201): n = A,T,C or G, or insertion/deletion polymorphism (see Tables 1-2)
aaagaaaatgtgatataaaatactggaaatctttatccaacaccctaatggggtgtcagggactggagccagtccaaaggcctttgcgtaacaccaagatntagcctctgccagataccttcagttgccccaggatatccttctaagtcccacacaacggctagagctccatgaagggaaactgttttggaacagaataaa

SEQ ID NO: 27080 - DNA, 201 bp, Homo sapiens
tatttaaaaacacttcctaaattattttaacagtaaaagatataataataattaaagagcaactatgacaaggtaacaaaaaaggaaatagtatatattaragctgttttcagcaaagcaggtataatcttaataaataatcatatttaaggaagatgaaatgaaacacttcaattaaacaaatcagtaattcttttaatt

SEQ ID NO: 27081 - DNA, 201 bp, Homo sapiens
attaaagtccatagaactattattatatatgaaaaatgcatacagaaatggttgaaaagaacaaaatccgatatattttatgagattaataacattaaagrcactgagtttaatgggtgctcaacttttgggatatattacaagttgaatgacttcaaacaataacaattttgaataacatgttctgttatcagtaacata

SEQ ID NO: 27082 - DNA, 201 bp, Homo sapiens
  misc_feature (1)...(201): n = A,T,C or G, or insertion/deletion polymorphism (see Tables 1-2)
agacataagtaatttcagatataaagaccaaaaacagggaagtggggaaacaataacaggcagaaaatactaggatctgctccatctggcagtatttttangagatttttagggtgttgcttttctggctggaaacttgtggctagtgatgcctttgcctgagttttccttgggcctgctgggctcattctgcccactcgg

SEQ ID NO: 27083 - DNA, 201 bp, Homo sapiens
ttgaaaaacagcatgttgtatacatatttccatcacatattctactagagtttattttccatacttcttgaataatagttaaatacaactaaatgaaatasattatcaaaattgtaaaactgcccaatggcaggaacattttaatatacccaaatcagaatgtatatgttcaaaaatcttaatatataaatgtctactatc

SEQ ID NO: 27084 - DNA, 201 bp, Homo sapiens
tttttattgattgataacatctcctatatcacaatttttgcaataaaataattgtttcatgcaaaaaataagttcataaaatatattaaaatattaatacrtatttcacattatgtaataatataaatgcaatatctgaacttttatttagagtcttaccattatttattttgaaaactgaaaatatattggttagtacat

SEQ ID NO: 27085 - DNA, 201 bp, Homo sapiens
atttatacttattgactgaaaacaaagtctagtactctgtgtgttttcatcatttgccattttgctctcatctcaaatttcctgaagcatctgatataaaraataacatacacaggaatcaatttttatacttaaatttttggggatcactacttattaaaaatttattttgcaaactagttgactaattaaagatataaa

SEQ ID NO: 27086 - DNA, 201 bp, Homo sapiens
tagcagtatgaaaacagactactacggtaaattggtacctggagtggggcactgctataaacataacatgaaaatgtggaagcaactttggaactgggtartgagtagaagttgacacagtctagaggctcagaagaagacaggaagatgtgagaaagtttgaaacttcctagagacttgctgactggttgtcgtcaaaat

SEQ ID NO: 27087 - DNA, 201 bp, Homo sapiens
attaatttattttcatctccctcttgttttttctactactattctgagttttctaacatattaagcaaaataaattgtaaggaaaacaaaataatttacawtgtatacataatatgttgtaaaatcaggttcctatttggtggaaaattcttccattttggtgaggttttttctatctctattatatccaaagaaatagtc

SEQ ID NO: 27088 - DNA, 201 bp, Homo sapiens
gggaccctgatatgcttattcttaaaaggtttttataggctgggggaggtggctcacacctataatcctagcactttgggaggccgcggtgggtggatcaygaagtcaggagtttgagaccagcctggccaacatggagaaaccccatctctactaaaaatacaaaaattagcctggtgtaggggtgcatgcctgtaatgc

SEQ ID NO: 27089 - DNA, 201 bp, Homo sapiens
aggtcataaatcacctgccacactttgtaaggagctctcacatgaccctctcttgcttcctctctctctacatatctttagttaagagtttaggtaagaaygtcctccactgtgttggctttgaaaaggagagatctttttttttgtcttttcagcatatagtttggcctagcaagaactcattacttgtttgaatagata

SEQ ID NO: 27090 - DNA, 201 bp, Homo sapiens
atttaaatatcattatgttaataacaaaagtacatgtgaataaaaagtcaacactttagattgcaaaagtatcatcccaaaaggtgaattacatactagayagttctattgattatagaatttatacccaataaatactgcctgaattatgtctatatatttgacaatccaaactatgagtatctgcatgacatattcttt

SEQ ID NO: 27091 - DNA, 201 bp, Homo sapiens
aattctaaatctgccttcaaggagtttaataatacaaattaataatatattccatttgtaatttaaatatcattatgttaataacaaaagtacatgtgaawaaaaagtcaacactttagattgcaaaagtatcatcccaaaaggtgaattacatactagatagttctattgattatagaatttatacccaataaatactgc

SEQ ID NO: 27092 - DNA, 201 bp, Homo sapiens
  misc_feature (1)...(201): n = A,T,C or G, or insertion/deletion polymorphism (see Tables 1-2)
tgaagaggcaaaagatccagcctagctaaaacaatattgacaaataagaaccaggttgaagaactgacgtcaccttacttcaaggattcctctatagctanagcaagcaagaaaatgtgatattagtgaaagaaaaaacaaatgtatcaatgatacagaattgaaaacccacaaataaagttatctaaatacagtcaactg

SEQ ID NO: 27093 - DNA, 201 bp, Homo sapiens
tgtgatataaaatactggaaatctttatccaacaccctaatggggtgtcagggactggagccagtccaaaggcctttgcgtaacaccaagatatagcctcwgccagataccttcagttgccccaggatatccttctaagtcccacacaacggctagagctccatgaagggaaactgttttggaacagaataaacattccca

SEQ ID NO: 27094 - DNA, 201 bp, Homo sapiens
ctattaacccatgaaaagacattcagggaatttaaatgtgcattactaagtgaaaaaatgcaatctgaaaaggttgcatactatgatttcaaccatatgaytttctgggaaggcaaaacaatgatgacagctaaaagattagtggttggcagtggggatggggtgtgaagcacagaggatttttagtgcagtgaaaacact

SEQ ID NO: 27095 - DNA, 201 bp, Homo sapiens
agtgaaaaaatgcaatctgaaaaggttgcatactatgatttcaaccatatgattttctgggaaggcaaaacaatgatgacagctaaaagattagtggttgscagtggggatggggtgtgaagcacagaggatttttagtgcagtgaaaacactgtgcataatattataatgttagatatatgtcattataaatttgtccaa

SEQ ID NO: 27096 - DNA, 201 bp, Homo sapiens
acacacacacacacacacacaccatacacgttaaggaggggatgaactagtaagcaggtaaaatattaataaaggttgttactaaacgcgattgaagtggrtatcattttatggaaatgtattttagataaccacacatagtgtatgtacaccagcttccaaatttgtaaactaagaactattaggtataccttaaaatag

SEQ ID NO: 27097 - DNA, 201 bp, Homo sapiens
tatatatgatggaaaagagagtgctagaagattacgccacccagtggtacagtaagtgatacacacacacacacacacacacacacacacacacacacacmccatacacgttaaggaggggatgaactagtaagcaggtaaaatattaataaaggttgttactaaacgcgattgaagtgggtatcattttatggaaatgta

SEQ ID NO: 27098 - DNA, 201 bp, Homo sapiens
agagattttagaaaagagtgtttggtcttcaaaggttaaaatattcacagggtctttgtccacatttacaacgaaaagggaactctgtttacagaaattgygtcagggtgagcagcattaaaccattaaatcattagaaatttcagcttcatcacttggataagcactgagaagaaaacacactatagtggaattatttga

SEQ ID NO: 27099 - DNA, 201 bp, Homo sapiens
ataaatttgtccaaacttatagaacgtacaacaccatgagtgaaccccattgtaaactgtggactgtggggattatgatgtgtcattgtagatatatccgytgtaaaaaatgtaccatactggtgagagatgttgataataggggatgctatgcatgtgtaaaggcaaagagtaccttggaaatctctggtccttctcttc

SEQ ID NO: 27100 - DNA, 201 bp, Homo sapiens
attttttcttcatttttagtttctcctttttctctttcctcaatagtacagtaaaatagtactattttactgtacagtaaatagtacagtaaatagtacartaaaatagtaaagtagaaccctcagttttcccttataaaatagaataagagttttatgtatcattctgtggcctttcaacatttattgtactatattcaa

SEQ ID NO: 27101 - DNA, 201 bp, Homo sapiens
aatatgtaacatataccagatacgtagcagagcatgaaaaaagttttctttagtgtcattctcaaaggaattgactcatatttacatttttttttttttttgagagagggtcttgctctgtagcccaggctagagtgcggtggctcaaattatggctcactgcagcctcactcttcagggctcaagccattttaccacctc

SEQ ID NO: 27102 - DNA, 201 bp, Homo sapiens
tgtcataaaaatagagcttaaaagacaatgaaggataaatcctctaataagcaaaagaaaaattacacaggaaaaactacatatccaaaaatcacttcccrtactttgtcctctacgctgacatatatatatgcatacagctgactcatgaacaccattggtttgaaatgcatgggtccacctataaatggattttcttcc

SEQ ID NO: 27103 - DNA, 201 bp, Homo sapiens
caaaacagcattgcattggtacaagaatagaaatagacctatggaacatagaacccagatataaatccttgcatttatagtcaactgattgtcttcaaagwtgccaacaatatacattgaagaaaagacaacttctttaataaatgatgctaaaaatactggatatctatatgcagaagaatgtaattagaccccatcttt

SEQ ID NO: 27104 - DNA, 201 bp, Homo sapiens
ctgattgtcttcaaagatgccaacaatatacattgaagaaaagacaacttctttaataaatgatgctaaaaatactggatatctatatgcagaagaatgtrattagaccccatcttttatcaaacactaaaactcaactgaaaattgattggaaacttatatgctaagaccccaaaccataaactactaaaagaaaacata

SEQ ID NO: 27105 - DNA, 201 bp, Homo sapiens
tctgagtagatatttctctaaagaagacatacaaatggccaacagatatataacaaagtggtcaacatcactaacataagggaaatacaaatcaaagctayaattagatattaacttaccctggtatgaatggctattatggaaagacaaaggcaaaacaaatgctggtgaggctgcagatcaaaggaaattcttatacac

SEQ ID NO: 27106 - DNA, 201 bp, Homo sapiens
  misc_feature (1)...(201): n = A,T,C or G, or insertion/deletion polymorphism (see Tables 1-2)
tgtgaaaaaaaggaaataaagagtttacagataggcaaggaaaaattaaaagtctttgaagatggcatgtttgtctatgtagaatatctgaaataattggnctggaaaaacccaaggaaacaaacagtaaaagaaaacagaaagaacccctggaattatgatggatttgcagcaaggtttcaggataccaggttaatatat

SEQ ID NO: 27107 - DNA, 201 bp, Homo sapiens
tgaaataattggcctggaaaaacccaaggaaacaaacagtaaaagaaaacagaaagaacccctggaattatgatggatttgcagcaaggtttcaggatacmaggttaatatatgaaagtcagtcatgttactatattgtatatcctactaatgaataagagcaattcaaaattatatataaaacaatcatgtgtaattgtt

SEQ ID NO: 27108 - DNA, 201 bp, Homo sapiens
ttatgagattgcttatgactttatatgtaaaaattaaattattatttcttgaaaatgtattcctatctataagttttctaatattttaagccttaaaattrcctgttaaagccacaaatgaacaaattactagattccatttatgtatgtgctaatttaagttttaatataacagattggatcatggattagtttcacagt

SEQ ID NO: 27109 - DNA, 201 bp, Homo sapiens
atggtataacaacaaaatcttcatgaccttggatttggcaaagatcttttgaaaaaaaattaataagatggaattcattaaaattaaaatttctactataygaaaataagtaccaaactggtgccaagaaaataaaaagacaagaaacaaactggaaaaaatatttgcaaaagtcttatctgataaaagacatatatgtat

SEQ ID NO: 27110 - DNA, 201 bp, Homo sapiens; identical to SEQ ID NO: 6793

SEQ ID NO: 27111 - DNA, 201 bp, Homo sapiens
gtggacctctaactttcacaactggcttttaattgccaattagcagtttgttttagatgtgtttgttgagccattcagtcccacttgtaatattagaccayatagaatattgttttcaaccactataacataacaatataccagtagtaaaagatttttacacttggattgctaccctgtaccattagctgtctgtctgaa

SEQ ID NO: 27112 - DNA, 201 bp, Homo sapiens
attgtataaaaattattttctatagattgtctacttatctgagcaatctgaaggttacttattagtaaaataacatttgcttactgagaaaatccttgtcyattctgaataaaatatgcaaatatacattctatttgctaatctactaccttatttatctttgtttgtttgtttgtttgagacagggtctccctctgtcac

SEQ ID NO: 27113 - DNA, 201 bp, Homo sapiens
cgatatttctttaaatatttgtcttagaatttgaacaaaaatagttttaacttaagaattggaaaatgatatggcaatcaatattagttcaatttttctttcagggctaggtaggccttgatccaaatgcttaacataaatgcttattttgcattaaggatctgatgtcagtgctttgagcagattaattagtaagattta

SEQ ID NO: 27114 - DNA, 201 bp, Homo sapiens
agtaattttataattcatatttacttttacaaatgtcacagctccaagttcaacctgaaatcattaaaaatttgttatctaaaatgtttcttaaaaacaaktgaaaggggaaaataattaacaaaaataaagtgacaatatgtgaagtataatgagagatgtaactatcaatcctgactgctgaacagaaacgtggtatct

SEQ ID NO: 27115 - DNA, 201 bp, Homo sapiens
  misc_feature (1)...(201): n = A,T,C or G, or insertion/deletion polymorphism (see Tables 1-2)
gaggctgctgccaggacaaagagagttaaagtacacactcccacaagcctgagagctgcctgtttgcagccactgcaacattgcaccattgacctccctancaacaggctgctccaaacctgcatgctccagggtgtctggggactggccaaattggacactatcctggggcctgaagacaggcctggctcacacaacaat

SEQ ID NO: 27116 - DNA, 201 bp, Homo sapiens
ataacagattggatcatggattagtttcacagtcatgacacaaacactgccaggtaagacctagatatactgataattaatcaaaataaatgcatctttargataaatggtctctgagaaaaagttattatagtactaaagtatagcatgattgtaaaaggatttcatagtttcatactgagtttgatttttagcagtatt

SEQ ID NO: 27117 - DNA, 201 bp, Homo sapiens
aaatatctgagtatctataatttattttggcataaagaatgaataaaattctcataatttttattttaacttttcatagttttaaattttattataattgytaatgaatttgtgtgacagctttcagataaacttatattaatttctttgttttcaaaataatatctgaatatcagagaattaattctactttaaaaattg

SEQ ID NO: 27118 - DNA, 201 bp, Homo sapiens
acagaggcctgagaaacttcagcatgtgttttaaataaagagaagatgataagggaaaacaaggagaatgtaccagagagataggaacacggggaatgttbatcacagaaacctcaccaagataatttaagtaaaaaggacaagattagtggtgtcaaatatggctaagaagcacagagaaatgcaataagtatcccttat

SEQ ID NO: 27119 - DNA, 201 bp, Homo sapiens
ttgtttagaagaagttttgataacaacgcatttcgcttgaaacttcttgtgcatgtgcacaggcatgtgtatgtgttttgtcttcaaaggaagagttgggktgtatgagagttcatcttgaatactgagcattttaacacacactaagaagttgaattgcatgatttccatatagtagaagggacatatgtaatgtccatt

SEQ ID NO: 27120 - DNA, 201 bp, Homo sapiens
taatttctagttttattttctacataaaatatctgagtatctataatttattttggcataaagaatgaataaaattctcataatttttattttaacttttyatagttttaaattttattataattgctaatgaatttgtgtgacagctttcagataaacttatattaatttctttgttttcaaaataatatctgaatatca

SEQ ID NO: 27121 - DNA, 201 bp, Homo sapiens; identical to SEQ ID NO: 6795

SEQ ID NO: 27122 - DNA, 201 bp, Homo sapiens
ccttattaacttttattgttaaagaatatttttacataaaaataagtttatgttggcagttctcttttcttgacttcacaatattttatttttttaatttstgaattccattgtttctgttgaaaagtcagctttactcctttgaaagtaatgtgtcttttctaaacaattcttgtttggttttgttatcggcaatttgac

SEQ ID NO: 27123 - DNA, 201 bp, Homo sapiens; identical to SEQ ID NO: 6796

SEQ ID NO: 27124 - DNA, 201 bp, Homo sapiens
tgctccatcacttcatctctttcagggattccaataagttgtaggtttggtctctttacatattctcacatttctgaggttttgctcatatttaaaaattmtttttctttatttttgtctgcctgtgttgatttaaatgagcagtcttcgagctctgagattcttttctcagcttggtcaattatattatgaatgctttct

SEQ ID NO: 27125 - DNA, 201 bp, Homo sapiens
aatcagatcctgcaagaactcactcactatgaagaggacagtgccaagagaatggtactaaaccattcatgagaaatcttcccccatgatccaatcacttyccaccaggccccacctgcaacactggggattccatttatacatgagatttgggcagggacaaattcccaaactatattttttctgcccttggtccctcca

SEQ ID NO: 27126 - DNA, 201 bp, Homo sapiens
tgatcagtttttctcactagactcattagtattctgtgtttgaattatatagaatagaaatctccattatatgttatttatctgtcaaactacaaaaaaamcacaatctttatctagcaggatactaacttcaacagtattcattaagtacaaagtgatcttactgtattacaagtgataaatgctcccaaaactttatgc

SEQ ID NO: 27127 - DNA, 201 bp, Homo sapiens; identical to SEQ ID NO: 6797

SEQ ID NO: 27128 - DNA, 201 bp, Homo sapiens
  misc_feature (1)...(201): n = A,T,C or G, or insertion/deletion polymorphism (see Tables 1-2)
gcatctgcttctggggaggcctcaggaagtttccaattgttgcagaatgctaagggggagcaggcacttcacatgaccaaagcaggagaaaagaggaaganaggggagatggcacacacttttaaacaatcagatcctgcaagaactcactcactatgaagaggacagtgccaagagaatggtactaaaccattcatgaga

SEQ ID NO: 27129 - DNA, 201 bp, Homo sapiens
tatctttgttttcactagtttcgaagattttttttttaatttctgccctaattttattatttacccaaaagttattcaggagcagattgtttaatttctaygtagatatatggctctgagagatcttcttagtgttgatttctatttttattttgctgtgctctgagtgtaactggaataatttcagtttttcataatttg

SEQ ID NO: 27130 - DNA, 201 bp, Homo sapiens
  misc_feature (1)...(201): n = A,T,C or G, or insertion/deletion polymorphism (see Tables 1-2)
agttctgcaggctgtacaggaagcctagtggcatctgcttctggggaggcctcaggaagtttccaattgttgcagaatgctaagggggagcaggcacttcncatgaccaaagcaggagaaaagaggaagaaaggggagatggcacacacttttaaacaatcagatcctgcaagaactcactcactatgaagaggacagtgc

SEQ ID NO: 27131 - DNA, 201 bp, Homo sapiens
gtgttctagtttctgtgcacataggtatttgtaatagtctctgagtttctttttgtatttctttggggtaatgttatctatatcatttctgctcatgtttrtttggaacttctctcttttgttcttcattatctagctagccatctatcaatcttatttattattttaaaaaataaacttttggtttcattgatcttttat

SEQ ID NO: 27132 - DNA, 201 bp, Homo sapiens
atgtttaattggctcacagttctgcaggctgtacaggaagcctagtggcatctgcttctggggaggcctcaggaagtttccaattgttgcagaatgctaasggggagcaggcacttcacatgaccaaagcaggagaaaagaggaagaaaggggagatggcacacacttttaaacaatcagatcctgcaagaactcactcac

SEQ ID NO: 27133 - DNA, 201 bp, Homo sapiens
ggatttcaatttatttttttcaatttcaatctggggaggctgtatgtttccaggaatttatcgatttcttctaggtgttctagtttctgtgcacataggtrtttgtaatagtctctgagtttctttttgtatttctttggggtaatgttatctatatcatttctgctcatgtttatttggaacttctctcttttgttcttc

SEQ ID NO: 27134 - DNA, 201 bp, Homo sapiens
ttcttattttgttatgtctctgccagattttggtatcagaataatgctggcctcatagaatgagttagggaggagtccttcttcctcaatgaaaaaaaaaatagttttagtagcactggtgccagttcgttttgaaagtctggtagagtttggctgcaattctgtctggctagggctttttctggttggtaggttttgtat

SEQ ID NO: 27135 - DNA, 201 bp, Homo sapiens
tgactattgctggttttgttagtgatcacaacacagagttgtgaagattttaactaatctttccctaactttatgtttttataaccttgtattttcatagwgttattttttcagaaaacgtgtctcaggaatgcatatatcatgttttagcagaaatgcttccacctatacaaaagaccaaaagtttttaatgttgcttta

SEQ ID NO: 27136 - DNA, 201 bp, Homo sapiens
atttgtcaatgtcaacttctgatagccggtcactatgctcctcatcttcaaggctctcacaaaacttcttaaaccaccactgcattgtgtgttcattagcrgttcttgggccaaatgtcttgttgatgttgtgagttgtctccactgcttcatgacccattttgtatttcttttcttttttttttttttaagatggagtct

SEQ ID NO: 27137 - DNA, 201 bp, Homo sapiens
gaaccatgactcaatgaaagctcctttgttcataaattacccagtcttgggtagtgttttatagcagtatgaaaacagactactacggtaaattggtaccyggagtggggcactgctataaacataacatgaaaatgtggaagcaactttggaactgggtaatgagtagaagttgacacagtctagaggctcagaagaaga

SEQ ID NO: 27138 - DNA, 201 bp, Homo sapiens
ttctctaaagaagacatacaaatggccaacagatatataacaaagtggtcaacatcactaacataagggaaatacaaatcaaagctacaattagatattawcttaccctggtatgaatggctattatggaaagacaaaggcaaaacaaatgctggtgaggctgcagatcaaaggaaattcttatacactatcagtggaaat

SEQ ID NO: 27139 - DNA, 201 bp, Homo sapiens
tttcatataaaagagcattattcagataaaaactttctttggtaaatactttgacaaaatcaatttatatgttaatttttacatttttttcaatagaaacrgcataattgatattaaccaaattgttattgcaatataaaaagaaacattttgtatgatacaaaaacaggatatgtgtgtatgcatacatatatatgtata

SEQ ID NO: 27140 - DNA, 201 bp, Homo sapiens
  misc_feature (1)...(201): n = A,T,C or G, or insertion/deletion polymorphism (see Tables 1-2)
ttaggaataaacagtaacttctcttagaagcaaaatttattcaaatacctgtgctaacattcttaaatatctgctagccataataaagaaatcaatgtacnttatgttcttagctcccacactttagcctaaatatttgccctgacatgcttatactggtccaagcaagcattaggttatagcctgttcctcttccttatt

SEQ ID NO: 27141 - DNA, 201 bp, Homo sapiens
aataaacagtaacttctcttagaagcaaaatttattcaaatacctgtgctaacattcttaaatatctgctagccataataaagaaatcaatgtacattatyttcttagctcccacactttagcctaaatatttgccctgacatgcttatactggtccaagcaagcattaggttatagcctgttcctcttccttatttaaaa

SEQ ID NO: 27142 - DNA, 201 bp, Homo sapiens
atgatacaaaaacaggatatgtgtgtatgcatacatatatatgtatatacatatagttttacttaacaaagaactaattttaaataatttagtttataaayaaataaaattgatacaatataaaacatttcaatttcttagataaataaaattcagttaaatttaaaaggcgaaaaatttatatgatctgaagagaaacca

SEQ ID NO: 27143 - DNA, 201 bp, Homo sapiens
agtctcattatattgcccaggctagtcttgaactccaagggtcaagtattcttcctgtcttggcctcccaaagtgttgtgattacaggtgtgaaccaccasgctcagctgattaattaaagtttaacattaattaacatcttttttacttgagatatattttactcctattataatgttaacaccaccctatgggctatca

SEQ ID NO: 27144 - DNA, 201 bp, Homo sapiens
ttttacttaacaaagaactaattttaaataatttagtttataaacaaataaaattgatacaatataaaacatttcaatttcttagataaataaaattcagwtaaatttaaaaggcgaaaaatttatatgatctgaagagaaaccatagtataattcagttaaaatttaaacatttaaaccttgttaaaactcatatttctt

SEQ ID NO: 27145 - DNA, 201 bp, Homo sapiens
tattattttaaaaaataaacttttggtttcattgatcttttatgtggtttttaacatatcaatttcattcggttcagctgtgatttttgatatttctttcygcctactagctttggatggtttgctactacttttctctagatgttcctctagatgtgacgttgttaatatgagagcttaccaacttcttaatatagatgt

SEQ ID NO: 27146 - DNA, 201 bp, Homo sapiens
taaagccatttggaaggcaatttgatggtttctcacgaaactaaatatattcttaccatacagtacagcagtcatgctccttggtatctactcaaatgagytgaaaacttatgtccacacataaatctgcataaagatgtttatggcagctgcatccacaattgccagtacttgcaaacaaccaagatgtctttcagtagg

SEQ ID NO: 27147 - DNA, 201 bp, Homo sapiens
attgtctagtgctctgaggattcacttgttccatctgtcaccaccagtgcctgcatgtgcctcttgaaagcctgaggatggcccctcccagcctgccaccwccacagttaacagcactcatttgcatatgccaacttggggcctcaggactggcccattcatccagttgccaccactgctgacacctgtgcatgctaccag

SEQ ID NO: 27148 - DNA, 201 bp, Homo sapiens
  misc_feature (1)...(201): n = A,T,C or G, or insertion/deletion polymorphism (see Tables 1-2)
atgaacaatccatgttcttctgaattgagttaatcaattttcaatattgatcaaataccatagtaaagctaaatcagtgagtgtgaccttgggtgaggttncttccaactatagggagtactgaaagttgaagtttctctgccagtagcactccctgaagaaatggaataaaccttatatgcctaaagaagaatctggtgg

SEQ ID NO: 27149 - DNA, 201 bp, Homo sapiens
gctgacacctgtgcatgctaccagaggtcttaagggttggcccacagacaggactggcatgaacaccccaaagcaagaggcctgagtacccacctgcctamccagctgaatactgtcactgtaagcacatgagaagccaccaagaggcccaagaatcatcctacctggaatataccacctgggtgcctgcatacaccacct

SEQ ID NO: 27150 - DNA, 201 bp, Homo sapiens
ttgcaggccttttggtaagtcattcaactctaaaatgccattccaacatctgctttttgtgccattcctggtgccaactatgtaagctgggttttctggawtgcaaatgccaggatggagattaatactcaggaggattgttaaggagtagttttctggatagaagaaataaatcatatttaggtaggaaattgagagcga

SEQ ID NO: 27151 - DNA, 201 bp, Homo sapiens
gaaatgttactgattattgtacattggttttgtattgtaaaatttgctgaggtggtttattaattctaggagcctttgagcccagactatggagttttccygatacagaatcatatcctctatgaagagagatagtttgacttcctctcttcctatttagatgccttttttcctttattttgcctaattgctctggctagg

SEQ ID NO: 27152 - DNA, 201 bp, Homo sapiens
ataaaaattttgagaaaagtcctaggatgaaagaaaatatatttattatgttctttaacttaattacacacatacacacacacacacacacacacacacgmgcgcgcgcctaacaaataaaaaagctttctcttgcctctgctgtcgtctctagtttttgcccatttctctcattactttccttaggtattcatattgtca

SEQ ID NO: 27153 - DNA, 201 bp, Homo sapiens
gatcatggattagtttcacagtcatgacacaaacactgccaggtaagacctagatatactgataattaatcaaaataaatgcatctttaggataaatggtytctgagaaaaagttattatagtactaaagtatagcatgattgtaaaaggatttcatagtttcatactgagtttgatttttagcagtattaaaatatattg

SEQ ID NO: 27154 - DNA, 201 bp, Homo sapiens
attgctatgaagaaatatctgagactgggtaatttatatagaaaagatgtttaattggctcacagttctgcaggctgtacaggaagcctagtggcatctgyttctggggaggcctcaggaagtttccaattgttgcagaatgctaagggggagcaggcacttcacatgaccaaagcaggagaaaagaggaagaaaggggag

SEQ ID NO: 27155 - DNA, 201 bp, Homo sapiens
ttcaataattctctaattcttctaatagtaaaaataacaattgtcctcagaaaacagtagaaataattacaggatagtaagagtgcatacaaattataccyttgtaaccttagaaattttgacaattcttaatttttgacattgccattttaatactttaccttgtacatgatacttagcatatttatgctttagtttgtt

SEQ ID NO: 27156 - DNA, 201 bp, Homo sapiens
agtttgttactgttttgtcgacaattttgaacatatcttcatcggggttattgtcctcaggttttcttattttgttatgtctctgccagattttggtatcrgaataatgctggcctcatagaatgagttagggaggagtccttcttcctcaatgaaaaaaaaaatagttttagtagcactggtgccagttcgttttgaaag

SEQ ID NO: 27157 - DNA, 201 bp, Homo sapiens
caaacatggttttcattattttgaggtatgttccttttatgtatagttttttttttttttaacatgaagcaatactgaatttaacgaaaagcctttttgcrtctattgagatgatcatgtgagttttggttttagttctgtttatatgataaattgcatttattgacttgtgtaccttgaaccacctgttcaatatcctgt

SEQ ID NO: 27158 - DNA, 201 bp, Homo sapiens
ccagaacgagaagcaaaacagtagcgataaatttttcagaagtaaggacagggtttagtttgtaaagaacctaaaagcaaacatatgaaaaaagtccttcrtatccaggagactaggagaaacttgcagtccagtgctgcagtaccaggccactcatgttcagggaaagccacacttaatcaccaagacaatggggacaat

SEQ ID NO: 27159 - DNA, 201 bp, Homo sapiens
gatgagcttctaggttgatttcataactttgctattgtgaatagtgctgcagtgaacatgagtacatgtgtctctttggtagaatgacttatattccttcrggcatatacatagtaacggtattgctgggccaaacgatagttctgttgtaaattcattgggaaatctccaactgtgactgaaccaatttacaccaccacc

SEQ ID NO: 27160 - DNA, 201 bp, Homo sapiens
gataaaaattttgagaaaagtcctaggatgaaagaaaatatatttattatgttctttaacttaattacacacatacacacacacacacacacacacacacrcgcgcgcgcctaacaaataaaaaagctttctcttgcctctgctgtcgtctctagtttttgcccatttctctcattactttccttaggtattcatattgtc

SEQ ID NO: 27161 - DNA, 201 bp, Homo sapiens
gttacatgagtaaattgcttgttgttggggttggtgtacaaatgattttattacccatgttgtgaacatagtaacgaataggtagttttctgaccctcacctccttcaaacctccaccctcaagcaggctccagtgtctattgttcctctcttagtatccatgtgtacttagtgctttgctcccacttataagtgagaaca

SEQ ID NO: 27162 - DNA, 201 bp, Homo sapiens
ggccaaggcgggcggatcatgaggtcaggagtttgagaccagcctggtcaacagggcgaaaccccgtctctactaaaaatacaaaaattagctaggtgtggtggtggcgtgcccctgtaatccaagctactaaggaggctgaggcaggagaatcacttgaatctggtaggcagaggttgcagtgagccaagatcgtgccat

SEQ ID NO: 27163 - DNA, 201 bp, Homo sapiens
cggaggccaaggcgggcggatcatgaggtcaggagtttgagaccagcctggtcaacagggcgaaaccccgtctctactaaaaatacaaaaattagctaggtgtggtggtggcgtgcccctgtaatccaagctactaaggaggctgaggcaggagaatcacttgaatctggtaggcagaggttgcagtgagccaagatcgtg

SEQ ID NO: 27164 - DNA, 201 bp, Homo sapiens
tttcggaggccaaggcgggcggatcatgaggtcaggagtttgagaccagcctggtcaacagggcgaaaccccgtctctactaaaaatacaaaaattagctaggtgtggtggtggcgtgcccctgtaatccaagctactaaggaggctgaggcaggagaatcacttgaatctggtaggcagaggttgcagtgagccaagatc

SEQ ID NO: 27165 - DNA, 201 bp, Homo sapiens
ttttatacaccaatgagaaactggctgaaaactaaatcaataattttatctcatttacaataggtaccaaaaaaaattgaataaatttaaccaggaagggkaaagaactttacaaggaaaactgcaaaactctgatgaaagaaattgaagaggacacaaacaaatggaaagacatctgatgctaatggattagaagaatta

SEQ ID NO: 27166 - DNA, 201 bp, Homo sapiens
actggcacacatggcctgctgctgacactactgatgtctaagcattacccacctgatgttctaatttccagtaaagcctcaccacagccttcacctacaartgcagcctaagcctctgagtaccacacagacaatacggatgctgattacagcataaatcatacagagactacaatactgcacccaccaagaatcaaaggc

SEQ ID NO: 27167 - DNA, 201 bp, Homo sapiens
gaataatgaaaattgataagaaattatgcaacatttgagaaacatcttaaaagctaaacatgctagggatccttttcctaatataacttatttcatagaamtaagaaagaaataataattatttcttttttcttctagttggaatttttacacttctgatgagtatccagatgtctttgtgggcacaaaagaaacataaga

SEQ ID NO: 27168 - DNA, 201 bp, Homo sapiens
  misc_feature (1)...(201): n = A,T,C or G, or insertion/deletion polymorphism (see Tables 1-2)
tgatgccattttctatatgtatctttcttacctatgtgtttgcctacatctaacaataatgtagcttgatgtatacagtattttgaaaatctgctcattangtaacttcctgaattccaattctttttatctaatatgtaacatttttgcatgaatactgacacaaaataatacagggcaagtggtttgcctttagagtcc

SEQ ID NO: 27169 - DNA, 201 bp, Homo sapiens
cagcgagaaaacatgtgagcaaaggaatctgtgtcacaataagttcaaggggaggtactatgcctggatatgcatgtaggccagattcatgtttctctccrcctaaacatctcagtggagtaaagaataacaaagcagcattgctgccgacatgtcctgcctcccaccacagggtggtttttctcctatctcagaattgaa

SEQ ID NO: 27170 - DNA, 201 bp, Homo sapiens
ttctgttattccaaaaataatattgcgtcaatgcctcatttataaaaacaatttttaaaattcaatttgtgtatgttatgttgggaaggcatcagattcawtacaatgagtttatttttgaaagataataatagcttcagttttcaatataataagatatatataccaaatacttttcccaaaatacaaattacaaagaat

SEQ ID NO: 27171 - DNA, 201 bp, Homo sapiens
ctactgatgtctaagcattacccacctgatgttctaatttccagtaaagcctcaccacagccttcacctacaaatgcagcctaagcctctgagtaccacayagacaatacggatgctgattacagcataaatcatacagagactacaatactgcacccaccaagaatcaaaggcaaagtgccctgcccaacaaacactaca

SEQ ID NO: 27172 - DNA, 201 bp, Homo sapiens
acaaatgctggtgaggctgcagatcaaaggaaattcttatacactatcagtggaaatgaaattagtacagacattatggaaaacaatagagagtgtctcaraaaacaaaaatagaatttttataaattccagacttccaccctgggtatttatccaatggaaaacaaatcagtatatcaaagggatacctgcatcctcatg

SEQ ID NO: 27173 - DNA, 201 bp, Homo sapiens
  misc_feature (1)...(201): n = A,T,C or G, or insertion/deletion polymorphism (see Tables 1-2)
tagctgtctgtctgaacctaccatcagctatggagtactcattgcaggccttttggtaagtcattcaactctaaaatgccattccaacatctgctttttgngccattcctggtgccaactatgtaagctgggttttctggaatgcaaatgccaggatggagattaatactcaggaggattgttaaggagtagttttctgga

SEQ ID NO: 27174 - DNA, 201 bp, Homo sapiens
ctctcccttggtttaaattctttctaactttcaacacaatttgatcctcagatatgttcgggtatcacaaatctacaggaaaaattaaggagaatcaaatrcaggcaaatttatgaagacatcagaataactttccacacaaattttagatgcaatcttattgtctgatgtaaatattgtgaataaattttataatttagt

SEQ ID NO: 27175 - DNA, 201 bp, Homo sapiens
tgttgtagtcatctctaaaggttgattagaattatttgaaatacaataaatatttgaaaaatttatactcactgatgctactgtgtgcacatttaccaacytataaagagcaaaaattttttgcaaatcttacagacaaacaccccaaaaacactttggcataattgttaatttaactaattcaagatgaactcagagtta

SEQ ID NO: 27176 - DNA, 201 bp, Homo sapiens
gtggagaggaaatttttattattatctgcaatgatgattttacagtcactatacatagcaggtcatgttggtaatgaaagtgacgttataattcacataasaaaatagttgatagtatatttttaacatcagatgagctgaccatttttatttatcttattttgcccaagaaatgaatgtcttggttaaagatggagagaa

SEQ ID NO: 27177 - DNA, 201 bp, Homo sapiens
taggactagtacctttggctgccttttctacattaaagtctgtggaatgaatacattctggaggcgcatgtccactacaattatcgaagattaagctttcwactttcaaaagacactaataaaattaatgtttaaaaatctagctacacaacaatgaggaaaatggtgctattatgtttgatagttgtctcttctatacca

SEQ ID NO: 27178 - DNA, 201 bp, Homo sapiens
gctgagacatccagaattaaggcaccagcagattcagtacctaatcagggccagcttcctggttcatagtttatggccatcttctgcttgtgtattcacakggctgaagtagtctgggagttttctcaggcctcttttgtaagggtgctaatccctaataacctcacaaaggcgccacctcccaataccatcatctgggtg

SEQ ID NO: 27179 - DNA, 201 bp, Homo sapiens
  misc_feature (1)...(201): n = A,T,C or G, or insertion/deletion polymorphism (see Tables 1-2)
ctcatattcatgggaccacattttaaaaatagaatgccaatgatctgttctttgaagttggcaagcatgatagaagggtagaaactaaccccttttctaanggtgctaatagatgtatattggaaacatattttcagcacactttcaagtgatacaaagccagctgaattttttgtcctttttaacattttcttgttctta

SEQ ID NO: 27180 - DNA, 201 bp, Homo sapiens
ttgcatatgccaacttggggcctcaggactggcccattcatccagttgccaccactgctgacacctgtgcatgctaccagaggtcttaagggttggcccayagacaggactggcatgaacaccccaaagcaagaggcctgagtacccacctgcctacccagctgaatactgtcactgtaagcacatgagaagccaccaaga

SEQ ID NO: 27181 - DNA, 201 bp, Homo sapiens
ggcaaaacaatgatgacagctaaaagattagtggttggcagtggggatggggtgtgaagcacagaggatttttagtgcagtgaaaacactgtgcataataytataatgttagatatatgtcattataaatttgtccaaacttatagaacgtacaacaccatgagtgaaccccattgtaaactgtggactgtggggattatg

SEQ ID NO: 27182 - DNA, 201 bp, Homo sapiens
tttgacaaaggaacaaaggcaacataatgtagaaaatatagtcttttcatcaaatagtgctggagcaactagacatccacatgcaaaaaaaaaaaaaaaaaggatttagactcatcttacacatttcacacaaattaactcaaaataaatatcagacctaaatgtaaaactataaactacactaaaactataaacaaaact

SEQ ID NO: 27183 - DNA, 201 bp, Homo sapiens
ctttgacaaaggaacaaaggcaacataatgtagaaaatatagtcttttcatcaaatagtgctggagcaactagacatccacatgcaaaaaaaaaaaaaaaaaggatttagactcatcttacacatttcacacaaattaactcaaaataaatatcagacctaaatgtaaaactataaactacactaaaactataaacaaaac

SEQ ID NO: 27184 - DNA, 201 bp, Homo sapiens
tctttgacaaaggaacaaaggcaacataatgtagaaaatatagtcttttcatcaaatagtgctggagcaactagacatccacatgcaaaaaaaaaaaaaaaaaggatttagactcatcttacacatttcacacaaattaactcaaaataaatatcagacctaaatgtaaaactataaactacactaaaactataaacaaaa

SEQ ID NO: 27185 - DNA, 201 bp, Homo sapiens
gtgtatgttatgttgggaaggcatcagattcattacaatgagtttatttttgaaagataataatagcttcagttttcaatataataagatatatataccayatacttttcccaaaatacaaattacaaagaataaagtattatacacttactgctagcattttcattaatatgatgacccatctcttctgatagacacaaa

SEQ ID NO: 27186 - DNA, 201 bp, Homo sapiens
atctttgacaaaggaacaaaggcaacataatgtagaaaatatagtcttttcatcaaatagtgctggagcaactagacatccacatgcaaaaaaaaaaaaaaaaaggatttagactcatcttacacatttcacacaaattaactcaaaataaatatcagacctaaatgtaaaactataaactacactaaaactataaacaaa

SEQ ID NO: 27187 - DNA, 201 bp, Homo sapiens
atatcgatacattttggtagtctgacaatgaatctgtcaaatcattagctaacttggttctgtgatcttagtgtgtacttaaatataacacattgtgatcrtgttagttgttccttttcactaaagttttgtgctcaaacttatctaatgatctagtgacaactttctttcctcataaaattagcatttaataaatgagca

SEQ ID NO: 27188 - DNA, 201 bp, Homo sapiens
  misc_feature (1)...(201): n = A,T,C or G, or insertion/deletion polymorphism (see Tables 1-2)
ttctccccagcttattctgaaaacaaatacatataatttaactttgtgttagtgtataattcattaatagacagtcatgttctgatgacaattttaataanattttcataaagcagatgggaatatttatttagctcatttagctagttcccatgaatgattaaaataactaatcatggataacaaaatggagagcagatt

SEQ ID NO: 27189 - DNA, 201 bp, Homo sapiens
  misc_feature (1)...(201): n = A,T,C or G, or insertion/deletion polymorphism (see Tables 1-2)
attcactgtgcgctgtcaattttattcatagtgaaaattcttgctattctacaaaatactgaacacattttgattgtataaaaattattttctatagattntctacttatctgagcaatctgaaggttacttattagtaaaataacatttgcttactgagaaaatccttgtccattctgaataaaatatgcaaatatacat

SEQ ID NO: 27190 - DNA, 201 bp, Homo sapiens
aagactgaaactggacaccttcctgttgccatatacaaaaatcaactcacaatggagtaaagactcaaatgtgaaacctaaaactgtaaaagccctggaaraaaaattatgaaatacaatcatggaactaggaactggtaaagattttatgatgaagactcccaaagcaattacaacataataaaaaaatgacaactggga

SEQ ID NO: 27191 - DNA, 201 bp, Homo sapiens
attactacatgtgtcaacattctatactacttatcaggctcaatacacattttgtaatttttatttcttgagtttcaggaaaatttgattcccttgcttgragtgtgttccgtcacaatctgtatagttcatattcattccgtattgtccaaaagagatgacaactcctttatgtgccacttagggtctcctataagcaga

SEQ ID NO: 27192 - DNA, 201 bp, Homo sapiens
  misc_feature (1)...(201): n = A,T,C or G, or insertion/deletion polymorphism (see Tables 1-2)
aatatacattctatttgctaatctactaccttatttatctttgtttgtttgtttgtttgagacagggtctccctctgtcacccaggttccagcatagctgngactacagacacacccctccatgccctgctaatttttttttcttttggagagatgggatttccgccatgttgcccaggctcgtcttgaagccctgggctc

SEQ ID NO: 27193 - DNA, 201 bp, Homo sapiens; identical to SEQ ID NO: 6794

SEQ ID NO: 27194 - DNA, 201 bp, Homo sapiens
  misc_feature (1)...(201): n = A,T,C or G, or insertion/deletion polymorphism (see Tables 1-2)
tgaatgaatacaattaatactggaaacactagtttaaaaacatacataaagcttaaataacatttctgtctacggaaactagcagtgaagtggtgactatntcaagagagacgtacacatttgagagagctatgcctgctttgttattcaaatagtttagattacacgaagcttataatgaaatgtatttgctaaccttaa

SEQ ID NO: 27195 - DNA, 201 bp, Homo sapiens
atcttttactttggttttatttctgtacttttacttttagacaagttctttgttttaataaagtttagtgacaaatttaggtttttatactacaaaaaccycatcaaatgaatgtcaagtggttgctgttttttcttatactttaatttttattgctgtaatcaggatgagcagtattttggagacagctgttcatcttaa

SEQ ID NO: 27196 - DNA, 201 bp, Homo sapiens
aaccagtgagaacaaagacacaacataccagaatctctgggacacatttaaagcagtgtgtagagggaaatttatagcactaaatgcccacaagagaaagstggaaagttctaaaattgacaccctaacatcacaattgaaagagctagagaagcaagagcaaacacattcaaaagctagcagaaggcaagaaataactaa

SEQ ID NO: 27197 - DNA, 201 bp, Homo sapiens
taataataacatgaaaattctcacatccattaaatgtatcaaactactataaaataatgtttaatgaaatatacacattgtaataaaatttttaaagataaataattactttttaatatatgtgtttataaacagtgtttggggaataagcataaaacagttcaaattaaatataagtcattgggcacattttttaggaca

SEQ ID NO: 27198 - DNA, 201 bp, Homo sapiens
ctccatgtcactcagtcaagagctacctgactcacattggcctggtgtgtgaaataataaatgtcttattgtttaagacaacaaaaacagacaaacaaacraaaaacaagatggagaataaaaatctatctgaaacgttttcagattgtcattttgtttttctgttttctcttaccaattcctctttgctgagagctatgg

SEQ ID NO: 27199 - DNA, 201 bp, Homo sapiens
acaggcaatccaccttaaagtaatgaaaaactcatgatgtttaaatgttcttttacttaattacacacacacacacacacacacacatgccaattagttcytaattatttgccttacacatttaaattttttcttattcatattttatttgaaggtaagacagggatttttatatttttacgtgttaattaaattgtgaaa

SEQ ID NO: 27200 - DNA, 201 bp, Homo sapiens
caatgcataatcaggtgttgctaagcagcacattatgactttattattttaggtagcatataaacatattttggttactttaagccatgatagacgtttcyctgattttttcttcatttttagtttctcctttttctctttcctcaatagtacagtaaaatagtactattttactgtacagtaaatagtacagtaaatagt

SEQ ID NO: 27201 - DNA, 201 bp, Homo sapiens
tgggccatacaggaagtatagtggcatggcacctgcttatggggaggcctcaggaatcttacaattagacagaaggtgaagagggaccaggtgtatcatayggtgaaaataagaacaaagagacagagagaagagatgggacacacctttaaacaaccagatcttgtgagaactcactcacttttttgaggacagtaccaa

SEQ ID NO: 27202 - DNA, 201 bp, Homo sapiens
gaaatggctatggcacagagccttgaataaattaggacatagatacaaattcaaatttacaaatttaataataacatgaaaattctcacatccattaaatktatcaaactactataaaataatgtttaatgaaatatacacattgtaataaaatttttaaagataaataattactttttaatatatgtgtttataaacagt

SEQ ID NO: 27203 - DNA, 201 bp, Homo sapiens
aaatacgtgatgacatttcatgtggtacacagttattttggggaacttagtattatataataagcatatgatcagatttgcaatgtgtagcatcattgacrttttactttcctttgaaaaaggaaacaatgcctgtttcccaagtccaaattataaccccttcacatggatgtttttcctggtttcatgtcctaactacac

SEQ ID NO: 27204 - DNA, 201 bp, Homo sapiens
ttaataataacatgaaaattctcacatccattaaatgtatcaaactactataaaataatgtttaatgaaatatacacattgtaataaaatttttaaagataaataattactttttaatatatgtgtttataaacagtgtttggggaataagcataaaacagttcaaattaaatataagtcattgggcacattttttaggac

SEQ ID NO: 27205 - DNA, 201 bp, Homo sapiens
tttaataataacatgaaaattctcacatccattaaatgtatcaaactactataaaataatgtttaatgaaatatacacattgtaataaaatttttaaagataaataattactttttaatatatgtgtttataaacagtgtttggggaataagcataaaacagttcaaattaaatataagtcattgggcacattttttagga

SEQ ID NO: 27206 - DNA, 201 bp, Homo sapiens
atttaataataacatgaaaattctcacatccattaaatgtatcaaactactataaaataatgtttaatgaaatatacacattgtaataaaatttttaaagataaataattactttttaatatatgtgtttataaacagtgtttggggaataagcataaaacagttcaaattaaatataagtcattgggcacattttttagg

SEQ ID NO: 27207 - DNA, 201 bp, Homo sapiens
cttgaataaattaggacatagatacaaattcaaatttacaaatttaataataacatgaaaattctcacatccattaaatgtatcaaactactataaaatartgtttaatgaaatatacacattgtaataaaatttttaaagataaataattactttttaatatatgtgtttataaacagtgtttggggaataagcataaaa

SEQ ID NO: 27208 - DNA, 201 bp, Homo sapiens
tcaccctgcattaggctgttctcacattgctataaaaaatacctgagactgggtaatttataaaggaaagaggtttaattgtcccatagttctgtgggccrtacaggaagtatagtggcatggcacctgcttatggggaggcctcaggaatcttacaattagacagaaggtgaagagggaccaggtgtatcatacggtgaa

SEQ ID NO: 27209 - DNA, 201 bp, Homo sapiens
gaataaatcaatggaatagcttcaacagcaagaggaaatgttaatatgatatttagtaacagaggcagtgaaaaattaataaacagttttgatatacaaakaataatgagctccttttctttcaattacattaaacttctgttatttgtattatttaaactatgaaagtttttctttgcatttacattccactccatattt

SEQ ID NO: 27210 - DNA, 201 bp, Homo sapiens
aagtatagactcaaaatattcatgagataaaaattttgagaaaagtcctaggatgaaagaaaatatatttattatgttctttaacttaattacacacatamacacacacacacacacacacacacgcgcgcgcgcctaacaaataaaaaagctttctcttgcctctgctgtcgtctctagtttttgcccatttctctcatt

SEQ ID NO: 27211 - DNA, 201 bp, Homo sapiens
tctttttttataccagtaagaatcatctttctctgtttaaaaccctccacttaattatcaagatatatatgcctttgggctaagaaaattttcctcactcyttcaatctgtactctcattttttctatataatttaaatattatagttaatcacaatgtgtagcacttgttgtcaaatacaatgtcttataacatcactac

SEQ ID NO: 27212 - DNA, 201 bp, Homo sapiens
gctcgacaaagttttgagattacagatgtgagccttcacacctgtcctaaaattacactttaaaaaaattcctgtatgttatttgtttaggtcctaatatracatgttctcagaaataataggatagtaactaatggtagtctaaattttgggtagatggtattgggaaaccactgtgcatttgaagagttgctagatata

SEQ ID NO: 27213 - DNA, 201 bp, Homo sapiens
attatagttaatcacaatgtgtagcacttgttgtcaaatacaatgtcttataacatcactacatgtcctactctactttgcattaacatttataatactaktaataaaaacaattaacttttttcaaaatttattatgtgccacggacctaaaatatttctattgtagcacagttttaaaataattgtgacaatactatga

SEQ ID NO: 27214 - DNA, 201 bp, Homo sapiens
tatttcaggacttctataatttacttttattttagtatcaaggtgaagttttgagatttttaaatatcatacaaaatatttaatatttaaatatattacayaaatattttatatttaaatatcataagaaaaataaaaaaataaaattactcttcagaagttgctaatgtttataatattccactatgaaaaacacaaatc

SEQ ID NO: 27215 - DNA, 201 bp, Homo sapiens
aaaaagataaattacaccattctcccggtgctttggagggaccattcatctatccaccactaatttatgctcttataaaatcatttagaaagtagttgagrtgtagttctactaacactcaaaattacactttttgttgttttgttttgttttcattttgaggcagggtctctttgtcgcccagactggagtacagtgaag

SEQ ID NO: 27216 - DNA, 201 bp, Homo sapiens
attatccttatgtactctgcagtgttacagcaacatagctgtagacatggtatgaaaatgacagctattttatttgagtcaaaaggttataacatttaaakctgggtctcttctgagtaatttgcaaaataggttgctataaatacgtgatgacatttcatgtggtacacagttattttggggaacttagtattatataat

SEQ ID NO: 27217 - DNA, 201 bp, Homo sapiens
agactttaaaacgatagtatagaatttattttaagataaagttatattctgataattgtgaatcaactcttcattatggcagtgtataataaagatgattygatttttctatagcgacagaattatttagtgctctctttattcctaacggtagtacaaaaagaaaatttcaagtgatgcttctgctatgaccaataaact

SEQ ID NO: 27218 - DNA, 201 bp, Homo sapiens
tttctcctttttctctttcctcaatagtacagtaaaatagtactattttactgtacagtaaatagtacagtaaatagtacagtaaaatagtaaagtagaamcctcagttttcccttataaaatagaataagagttttatgtatcattctgtggcctttcaacatttattgtactatattcaatcttacaaatatttattat

SEQ ID NO: 27219 - DNA, 201 bp, Homo sapiens
tgttgtttcctgactttttaatgatctccattctaactggtgtgagatgatatttcattgtggttttgatttgcatttctctgatggtcagtgatgatgarcattttatcatgtgtctgttgaatgcataaatgtcttcttttgagaagtatctgttcatatcctttgcccactttttgatggggttgtttgtttttttca

SEQ ID NO: 27220 - DNA, 201 bp, Homo sapiens
acaaaggacatgaactcatcattttttatggctacatagtattccatggtgtatatgtgccacattttcttaatccagtctatcattgttggacatttggsttggttccaagtctttgctattgtgactagtgccacaataaacatacatgtgcatgtgtcttcatagcagcatgatttatattcctttgggtatataccc

SEQ ID NO: 27221 - DNA, 201 bp, Homo sapiens
cttttctttagatcttaactgttaacatttcctggaggcttttcctgactactaagagagcaaagctagccaacattttttattatgcttccttgttttayttctttactagacttattgccaactaaactactatttatttttctttctttagttcattatttggcctacccttagtatataagcacaaaaatatcagat

SEQ ID NO: 27222 - DNA, 201 bp, Homo sapiens
  misc_feature (1)...(201): n = A,T,C or G, or insertion/deletion polymorphism (see Tables 1-2)
catcaaatcaaattattgttagaatatttgttcatacattcacataaaaagacattctctcaaacccttttacctactgctcaaattctccccagcttatnctgaaaacaaatacatataatttaactttgtgttagtgtataattcattaatagacagtcatgttctgatgacaattttaataatattttcataaagcag

SEQ ID NO: 27223 - DNA, 201 bp, Homo sapiens
ggccacatggcagttttcagaatttcgtgtacatgcaaatgacagtatcttttttttttgtctttcttttcatttttccttctcttttgctccatctactyttctgcctcttcctcatattcctgccccccttttcctcctccccatgccccctcagtcttctttttcctatttcttatggtgtttcatgatataagaatt

SEQ ID NO: 27224 - DNA, 201 bp, Homo sapiens
gcatggtctggtatctctgacttttattcattttttatggaacaggaaggctttcctggagaagttatatttatgtgtgtcctagatagtttataagaagratataacagggagatatgcctgaggctaaaataatttactaagtctatgtgtgtgtgtgtgtgtgtgtgtgtgtgcgctcagggagggaagaatattgtt

SEQ ID NO: 27225 - DNA, 201 bp, Homo sapiens
tatcttgggttcagaaaaaagaataggtcatatccaggcttttcttgaatttgattctaaagtttgtatttcccttggtaggcaagggaaaagtaactctsaaatgtttgttttgtacatataaaaaaatagcaaaaatgatctaaattttttagaccaatgaaaagtgaataaattgtgttttctttggaaattttctac

SEQ ID NO: 27226 - DNA, 201 bp, Homo sapiens
  misc_feature (1)...(201): n = A,T,C or G, or insertion/deletion polymorphism (see Tables 1-2)
tcttgaatttgattctaaagtttgtatttcccttggtaggcaagggaaaagtaactctgaaatgtttgttttgtacatataaaaaaatagcaaaaatgatntaaattttttagaccaatgaaaagtgaataaattgtgttttctttggaaattttctacttaaaatggtaaatctgagaagatgaggtaaacaaagaaatg

SEQ ID NO: 27227 - DNA, 201 bp, Homo sapiens
tgcaacactggggattccatttatacatgagatttgggcagggacaaattcccaaactatattttttctgcccttggtccctccaaaatctcatgcccttstcacatttcaaaataccatcatgccttcccaataatcccccaaagtcttaactcattttagtgttacctcaaaagtccaaagtctgaagtctctctgaga

SEQ ID NO: 27228 - DNA, 201 bp, Homo sapiens
tttagtgttacctcaaaagtccaaagtctgaagtctctctgagacaaagcaagtcttttccacctatgagcctgtaaaatcaaaaacaagttagttacatscaagatacaatggaggtacaagcattgagtaaacactcccattccaaaaaggagaaacccactaaaagaaagtggctacagggtccatgcaagtccaaaa

SEQ ID NO: 27229 - DNA, 201 bp, Homo sapiens
  misc_feature (1)...(201): n = A,T,C or G, or insertion/deletion polymorphism (see Tables 1-2)
gctggcaaggttctagagaaaagggaatacttatgtactcctggtggaaatgtacattcattcaatcattgaggaaagcagttggagatttctcaaagaanttaaagcagaactaccattcagcccagaaattccattcatatttccacaggaatataaattgttctactagaaagacaaatacatgcacatgtatattca

SEQ ID NO: 27230 - DNA, 201 bp, Homo sapiens
aatgtagcatcatcaaccaatcactattatttccagattctgggacttcggggtttgttagtcaagcacaaatgatactacagcaccacctcattcctagsaccaagttatgtactaagcaggatagtagagtgactagtatataacttgatgctaggaatgaggtggtgctggaagacatatttacatgatgtagagatg

SEQ ID NO: 27231 - DNA, 201 bp, Homo sapiens
  misc_feature (1)...(201): n = A,T,C or G, or insertion/deletion polymorphism (see Tables 1-2)
agcagagtttaagtcttaaattcaaaatatctatcagcctcgactaaaaaaaatactttataagccttaaaattattgttttctccccaaatgcttggggntaggtaatgggctctaggaaagcagataatgtcttttagttcataggttgctaggttaaataggcatatcttatatcattcagagagtctggagtttgag

SEQ ID NO: 27232 - DNA, 201 bp, Homo sapiens
tgcattcaatgcataatcaggtgttgctaagcagcacattatgactttattattttaggtagcatataaacatattttggttactttaagccatgatagaygtttctctgattttttcttcatttttagtttctcctttttctctttcctcaatagtacagtaaaatagtactattttactgtacagtaaatagtacagta

SEQ ID NO: 27233 - DNA, 201 bp, Homo sapiens
aatcctgatattttgtcttcctacgttttctcagacttatcagctttacatttttctttgttttattttagaactttttttactgtaatatgtcttttctwtacagtgacaatcttaatgttcttccaaggtttgtaatttttaagttctgctttgttataagaataatctcttagtttactctagtaatgccacagtaat

SEQ ID NO: 27234 - DNA, 201 bp, Homo sapiens
aaaaatatttttctattattgtttcaaatggtttagcaattatatacttacatctggttttcattacatatatattcagtatatagatcttgtcatcataygtctttaattatatatcaatatatgtgtatgtgtacattttattttatatatctatatagttatttacagtaattctttaatatttatcttgatatattt

SEQ ID NO: 27235 - DNA, 201 bp, Homo sapiens
ctaaatgaatcttttttaacaaaataaacccagctaatttaacaatattaaatcagcagccaatatctttagcacatcaaggaagaattttgggtaatatytgatgtttattacttaagaagaaagacaagaattcatgtgcctgccccttttcttaggtctgtaggcttccactgtttagaaggagtataacaattctaa

SEQ ID NO: 27236 - DNA, 201 bp, Homo sapiens
  misc_feature (1)...(201): n = A,T,C or G, or insertion/deletion polymorphism (see Tables 1-2)
actgtttctgcaaagtaaaattgggaggactgtcactgagttaaagggtcctctgggagacttgcacagcggatagtatctaatgtaaatggggacatagntatgatgaccaatcttgcttcttccttagatgatgttgggtaattcagtgagcacactggttacaaattttaaccagtgagcataaataaatagtttggt

SEQ ID NO: 27237 - DNA, 201 bp, Homo sapiens
cttattttaatgagtactattttttacatcttgaaatgtggtaatttattcttataatacatttacattgacagagcttttagtcatagtatcatttaacmcataggagggtgatattatatggcattatataagaactatctgcattttaatatataggtctcagttatgggtgctagtttatatgtatttgtgtgtgta

SEQ ID NO: 27238 - DNA, 201 bp, Homo sapiens
aataggtattttttacatattcactgtctgtgagttttagaagcagattctgaaactaaaatatttttgtttgtgaagctttaactggtcgtctgtgaagytttaactggtcaccttctcattctactgctccataatatattcttaaggttaatgcttagctttttcaattttttctttttctttttgctgttataaagc

SEQ ID NO: 27239 - DNA, 201 bp, Homo sapiens
  misc_feature (1)...(201): n = A,T,C or G, or insertion/deletion polymorphism (see Tables 1-2)
catggagcatgcagtcctggcttcacctccctactgcagctggcatgatggcaacagcctctacagatgacctgatgctgccatcagtatcaggaaaattntctctgtatagagtaattcagtaactcagaaagtcaaatagttgagtaaaacgaggtttacggttgctcatagtgagaccaagagagaagagggcaaagt

SEQ ID NO: 27240 - DNA, 201 bp, Homo sapiens
actccttcactagagctctattaaagaaaatcacaacaatcatgcccctccagcgaatttgttcattctctgctatatcacttagagctttcaccaatatmtttaagattatttacttctcctattttgggcaattttggaaaaattttccagaaatctgtcatgttattcaagctacttgtcctgctgtaaaagagagat

SEQ ID NO: 27241 - DNA, 201 bp, Homo sapiens
  misc_feature (1)...(201): n = A,T,C or G, or insertion/deletion polymorphism (see Tables 1-2)
ggtatttcctgtcctcttggccctatatattcctctccctttgataagggacataatcatggaaagccaaggacaatggtccctttttcttgagtctgaangctatgattattgatacatctagattttatcaagtcattttttcaaaatctcatattcatgggaccacattttaaaaatagaatgccaatgatctgttct

SEQ ID NO: 27242 - DNA, 201 bp, Homo sapiens
cattggagaaaagcaatattattatgaatcatgcaggcttcctgtaaaatttagatactatctctatctatgtatctgtctaatctatctatccacttatytatctatctattcctctctcaggacagatttggaatacaataattgttttttaatgatgactcaagactctgttcaatattaatttcttatcctagtttc

SEQ ID NO: 27243 - DNA, 201 bp, Homo sapiens
taatcatggaaagccaaggacaatggtccctttttcttgagtctgaatgctatgattattgatacatctagattttatcaagtcattttttcaaaatctcwtattcatgggaccacattttaaaaatagaatgccaatgatctgttctttgaagttggcaagcatgatagaagggtagaaactaaccccttttctaagggt

SEQ ID NO: 27244 - DNA, 201 bp, Homo sapiens
  misc_feature (1)...(201): n = A,T,C or G, or insertion/deletion polymorphism (see Tables 1-2)
agctctcagcaaaaaggaggccctggagtgggttgttcctctctgcagctggtagttcccgcctctcctcagctctgcctgagcctggggcctttatgggnttcagatggaaggaagtgtactctgattggtccataggcagccaagggagggcccagaaaagacaccacaagttcacatcccagtctgtgagactggcag

SEQ ID NO: 27245 - DNA, 201 bp, Homo sapiens
gtcaggagtttgagaccagcctggtcaacagggcgaaaccccgtctctactaaaaatacaaaaattagctaggtgtggtggtggcgtgcccctgtaatccmagctactaaggaggctgaggcaggagaatcacttgaatctggtaggcagaggttgcagtgagccaagatcgtgccattgcactccagcctgggcgacaac

SEQ ID NO: 27246 - DNA, 201 bp, Homo sapiens
  misc_feature (1)...(201): n = A,T,C or G, or insertion/deletion polymorphism (see Tables 1-2)
atgcactaatattgtactttgaattttttgtgtgtctgttattggtagactcaggtatttgaagtaataaactgtgtatttcactttattattcttgacancaggaaacagctagcttataacaccattcatcgatatttctttaaatatttgtcttagaatttgaacaaaaatagttttaacttaagaattggaaaatga

SEQ ID NO: 27247 - DNA, 201 bp, Homo sapiens
  misc_feature (1)...(201): n = A,T,C or G, or insertion/deletion polymorphism (see Tables 1-2)
ttgaattttttgtgtgtctgttattggtagactcaggtatttgaagtaataaactgtgtatttcactttattattcttgacaccaggaaacagctagcttntaacaccattcatcgatatttctttaaatatttgtcttagaatttgaacaaaaatagttttaacttaagaattggaaaatgatatggcaatcaatattag

SEQ ID NO: 27248 - DNA, 201 bp, Homo sapiens
tagctgtagacatggtatgaaaatgacagctattttatttgagtcaaaaggttataacatttaaagctgggtctcttctgagtaatttgcaaaataggttrctataaatacgtgatgacatttcatgtggtacacagttattttggggaacttagtattatataataagcatatgatcagatttgcaatgtgtagcatcat

SEQ ID NO: 27249 - DNA, 201 bp, Homo sapiens
ggtacaagcattgagtaaacactcccattccaaaaaggagaaacccactaaaagaaagtggctacagggtccatgcaagtccaaaacctagtagaacaatmattaaatcttaaagctccagaataatctcctttgatatcatgtctcacatccaagacacactggtttgataaagtgagctcccaaagtcttggatagctc

SEQ ID NO: 27250 - DNA, 201 bp, Homo sapiens
gatgacattattccagagagggagttcacattgcgttccacacatctcttaagactcaaattagctgctgcactgctccattttgagagctcagtccccaytaaattatatcctgccttggggcccaacaacccctgcatctccacattcctagagccccactgacatcccctcatatccacctagaaagctatggcaaca

SEQ ID NO: 27251 - DNA, 201 bp, Homo sapiens
cctagtagaacaatcattaaatcttaaagctccagaataatctcctttgatatcatgtctcacatccaagacacactggtttgataaagtgagctcccaargtcttggatagctccactcctgtgactttgcagggttcagtccctatggctgctctaacaggctggtaggttggcattgagtgccagaaacttttccagg

SEQ ID NO: 27252 - DNA, 201 bp, Homo sapiens
aaacatggtggaacctcaagtctacaaaaaaaaaaaatacaaaaattagctgggcatgatggtgggtgcctgtaatcccagctactcaggaggctgaggcrggagaatcacttgaatcagggagctggaggctgcagtgagctgagattgcaccattgcactccagcctaagcaacagagcaaggctcagtctcgaaaaca

SEQ ID NO: 27253 - DNA, 201 bp, Homo sapiens
gtgcttgtcctgacccctctgagcacactttaaagtttatgaattcattccttcctttgccatttccagaaggtctttgtattttgcacaaggactctagytctttgtgctggcatcaattaaagactgtttgttttctgttttcccgggttaatggtaaatgttttaagggtaaagatcttatctttacatagcattgat

SEQ ID NO: 27254 - DNA, 201 bp, Homo sapiens
aggcacgtttgaaggggacctagcatgaaactataaggcttggctgggtgcagtggctcatgcctgtaatcccagcactttgggaggccaacgtgggtggrtcatttgaggtcaggagttcaaggccagactggccaacaaggtgaaaccctgactctatgaaaaatacaaaaatgagctgggtgtggtggcaggtgcttg

SEQ ID NO: 27255 - DNA, 201 bp, Homo sapiens
ctttggaatctcttgtagaggacccatgctccatgatccttacagcaaggatggtaaatctgcagtggtgtaggactgtctgtctgtctgcatatctcctrgaatggtaagacggagtgtgcttgtggtgatcgcttaaaggaacagggagaggcagcatggcacactgttcaagaataaggactctggatccaggctgcc

SEQ ID NO: 27256 - DNA, 201 bp, Homo sapiens
cacttgtgagtgagaacatgtggtgtttggttttctgtccttgtgatagtttgctgagaataatgttttccagcttcatccatatccctgcaaaggacatraattcatacttttttatggctgtatagtattccatggtgtatatgtgccacattttcttaatccagtccatcattgatggacatttgggttggttccaag

SEQ ID NO: 27257 - DNA, 201 bp, Homo sapiens
tcagatcaccagaattacttagatgcttttgttatgctagcatgacctaaaaatctgcttgggaactaaatatttggcgctctcttttgtttttgctgacyagtgcgtgacatcatgatttctgccagcgtgccctgctttctggtaattcagctcttacccccattgctcctctccttttcacatcctggctaacctctg

SEQ ID NO: 27258 - DNA, 201 bp, Homo sapiens
gcacactttaaagtttatgaattcattccttcctttgccatttccagaaggtctttgtattttgcacaaggactctagctctttgtgctggcatcaattaragactgtttgttttctgttttcccgggttaatggtaaatgttttaagggtaaagatcttatctttacatagcattgatttttgaacatttgattacttgc

SEQ ID NO: 27259 - DNA, 201 bp, Homo sapiens
tattttaatattgataattcataaattatattgctaggaaattaagtgaaaatttgttggagtgagtctccaatgaaccagtaagtctccaataaaccagytggaaacttactccattactgactaccttgctatgtgagacaagttattcaggcctcagtcctccaagtataaaacaaaggtactaagaaaatgttcagg

SEQ ID NO: 27260 - DNA, 201 bp, Homo sapiens
tcagtgcgtggtgagggcccatagacggcaccttctcactgcatcctcacatggtggaaggggcaaggcagctctctgaggcctcttttttatgttattattatttttttttttgagactgagtcttgttctattgcccaggttggagtgcagtagtgcaatctcaacctctgcctcccaggttaagcgattctcctgctt

SEQ ID NO: 27261 - DNA, 201 bp, Homo sapiens
agtgcgtggtgagggcccatagacggcaccttctcactgcatcctcacatggtggaaggggcaaggcagctctctgaggcctcttttttatgttattattwtttttttttttgagactgagtcttgttctattgcccaggttggagtgcagtagtgcaatctcaacctctgcctcccaggttaagcgattctcctgcttct

SEQ ID NO: 27262 - DNA, 201 bp, Homo sapiens
cagtgggagccctgagcttgttttactgaaactagacggtcccatctgggggtgatgggagacagtgacagatcatcaggcattagattctgataaggagsagggaacccagatccctcgtatgtgcagtttgcaatagggttcgtgctcctatgagaatctaatgcccagctgatctgacaggaggcggagctcaggtgg

SEQ ID NO: 27263 - DNA, 201 bp, Homo sapiens
ccacatacgcaaaatatgcatttaattagtttgctagtgttgcagtgtcttgtctcgaaacagttcaaggcatcaaatttagaactataaacttcatcgtytgctgtacatcatgaaactgaggtcaagtagaggaaacgtgaaaggtgtcagacggagaggaaagaatgatgcggtgtgcgaatagaaaattaaaacctt

SEQ ID NO: 27264 - DNA, 201 bp, Homo sapiens
aatagggttcgtgctcctatgagaatctaatgcccagctgatctgacaggaggcggagctcaggtggtgatgtgagccatggggagcagctgcagatacaratgaagcttcactcacctgcctgccactcacctcctgctgtacggcctagttcctaacaggccacagactggtaccagcccatggcccaggggttgggga

SEQ ID NO: 27265 - DNA, 201 bp, Homo sapiens
gaaacatggtggaacctcaagtctacaaaaaaaaaaaatacaaaaattagctgggcatgatggtgggtgcctgtaatcccagctactcaggaggctgaggyaggagaatcacttgaatcagggagctggaggctgcagtgagctgagattgcaccattgcactccagcctaagcaacagagcaaggctcagtctcgaaaac

SEQ ID NO: 27266 - DNA, 201 bp, Homo sapiens
ctgtctttttaataaaatttcatgaggaaacaaatacaaatgtgtgtgtctcccatccttaaccagaagtccaccttcttctctctttaaaattctgatawagaaaaaacaaaaacaggccaggcacagtggctcacgcctgtaatcccagcactttgggagactgaggcgggtggatcacctgaggtcaggagttcaaga

SEQ ID NO: 27267 - DNA, 201 bp, Homo sapiens
tcattagaagctctgagactgtagacggacttgtccactgagaagctcacagtggacatttgtaatgagccattttactagggaaacttcaatgtcagtayctttaagttgttccttatgaaactgtccattctctagagatggatctcacagtcagtctcttgtatacggagtttaggcctggctgccaatgttttgtgt

SEQ ID NO: 27268 - DNA, 201 bp, Homo sapiens
catggacttggagtaaagattgcagcaggcacatggcaggcagtattgcactttatgttcagtggctagttcctctaaaagtccttcctttcccaccacgyatctgggaagatttttcttccgagctacaatcatttgacagaactgcaatctgtaaagagtttcatcgtgttctgctatttctctatttttcccttttgt

SEQ ID NO: 27269 - DNA, 201 bp, Homo sapiens
gcatggacttggagtaaagattgcagcaggcacatggcaggcagtattgcactttatgttcagtggctagttcctctaaaagtccttcctttcccaccacrtatctgggaagatttttcttccgagctacaatcatttgacagaactgcaatctgtaaagagtttcatcgtgttctgctatttctctatttttcccttttg

SEQ ID NO: 27270 - DNA, 201 bp, Homo sapiens
ctttgtcttctaaaccttccattgtgtttttatctcaactatggtttttttaatttccgagagagtgtttgtgtgcattctccgaatgttctttagctgtkcttatctcatggatgcaatattttcttttatttctgtgaaaatattaattataattgttagattttttttctccccatctaacgttttctccatgttagt

SEQ ID NO: 27271 - DNA, 201 bp, Homo sapiens
  misc_feature (1)...(201): n = A,T,C or G, or insertion/deletion polymorphism (see Tables 1-2)
agtccaatgagcggaggagctacagagttgtgatggtggcagatgatgttttttcacagtgaaaggcacctttcactgtggaatttcactatatggaattngtagtctgatttgggatggaatccatgtctgccactttctaactcacctctggtaagtcacataacctttgtgtgcctcagtttcctcactggtgaatat

SEQ ID NO: 27272 - DNA, 201 bp, Homo sapiens
agtttcgcttttttttcccaaataatttagggtttaagattgttatttcttgggttatcaggacatagctctcccttgaaactagcttattagatgtgaasagttggtactgctttttaataattctggtgaggaaaacattgtaaattatcctagagtcaaatgtgatataattattatagaaggtcactttcactattt

SEQ ID NO: 27273 - DNA, 201 bp, Homo sapiens
agacccagatagccctgcagcacaatgattgctatgaaagaagccttcattatcctgttttgctaaaaataagtttgttttgctgtttttgatagccacgrtgttagtgaaattgttttctgtatggaaatatttcacactacacaatggaaggtcactgtccttgcagtctgcatttgtgggagtctaaagtgtttacaa

SEQ ID NO: 27274 - DNA, 201 bp, Homo sapiens
gactgacaggcttcccctctctgtcttgcctctacctgctgtctgggctctggctggggagctcgaggactgaagtttaaaatacagctggttcagcattyggcagcggagacccagatagccctgcagcacaatgattgctatgaaagaagccttcattatcctgttttgctaaaaataagtttgttttgctgtttttga

SEQ ID NO: 27275 - DNA, 201 bp, Homo sapiens
gaaccatcagatcttgtgagactcacgatcacaaaaacagcatgggaatgacccgcccccatgattcaattacctcccaccgggtccctcccacgacacaygggaattgtaggagctataattcaaaatgagatttgagtggggtcacagccaaaccatatctctcttctttccagtttcacattgactcagacacttcct

SEQ ID NO: 27276 - DNA, 201 bp, Homo sapiens
aaaaattctgattcaggataatcaaaaacgggacccaggaatttgcattttaagcaaacaacccacgtgaattctgctgcatggggtcctcagaacacacrttgagaaatattcaatagacacgctattcacattcaagagtaccaatgaaggcccataagctatgttgaaatacttagaagttatctatcaagtgaataa

SEQ ID NO: 27277 - DNA, 201 bp, Homo sapiens
agcctagacagatgagatgggcagcaggtaattagtcacatatgctcatggcccagggaaggacgacactgccccacagagagccacgtgggggttgcagytgggaacagagtgaaccaccaggagctgtgggaggcaggctttgtagtaacaagagggcgaggtgcccctggttcctgtaagaggatgtgtttggtttgc

SEQ ID NO: 27278 - DNA, 201 bp, Homo sapiens
atttagtttgcctccacttcaccccactggtgagggagggattccgccctagagttgagaggatggttgaatgtacaacatccaagcctagacagatgagrtgggcagcaggtaattagtcacatatgctcatggcccagggaaggacgacactgccccacagagagccacgtgggggttgcagttgggaacagagtgaac

SEQ ID NO: 27279 - DNA, 201 bp, Homo sapiens
ctcatcctccagctgcctttctctgggtggcgtctcagtgaagccagcctggggtctatcctcatgtgctctcatgatcccaagcccacctgcatgggtcragggtccctgcatctctctctctctctctgtctctctctgtccctctctctccctctttccctctctctctctctctccctcaccctctctccctgtcgg

SEQ ID NO: 27280 - DNA, 201 bp, Homo sapiens
gtgctgggtggtcttctatgcttgtcacaaatctctgccatctaattccacccccatcgcccagattgcttccttccgtgtgccactccccttctgggcayttgtggtgataggacatatgaggggaggagctggtttgggaggcgcaaaggcatgataaactcgattttgaatgtgtcaaatatgacttacaggcaggtt

SEQ ID NO: 27281 - DNA, 201 bp, Homo sapiens
ccaactttcactgttgtaagccaccgagattctagggctgttattgactgcagaataaccttattaaaattgactaaacaacttgcatctagctttgtgcrcctgtactttcccatgcagtgaggatttctcctcactgattctgggtctataaatcctcttatttggatgttggatctcctggatcgttcttctatattc

SEQ ID NO: 27282 - DNA, 201 bp, Homo sapiens
gccacgccatgcagggacacccggggcagcacgagggctggtcaagaggcagagggagaagagaacgtggccagagcccttattatggtttccacaggaargagtgggcaaggcagggttagctagctcaggactggctagtttaaatcatttcagcaggctctggggcatacaggctgttcctatttgtcagatacctgg

SEQ ID NO: 27283 - DNA, 201 bp, Homo sapiens
caggtgattgcccgcctcggcctcccaaagtgctgggattacaggcatgagccaccactcctggcctatttgtactcttttaaattaaagctatcttagtrtgtttgaaatggtaactcattattattttgatttgcattttcctaatgactaatgatgttgaacatcttttcatatgtttattggctatttacatatctt

SEQ ID NO: 27284 - DNA, 201 bp, Homo sapiens
aattccagcactttgggaggctgaggctggcagatcacttgagtcagaagttcaagaccagcctggccaacatggcaaaacaccatatcaactaaaatagaaaaaaaaaatagctggacatggtggtgcatgcctgtagtcccagctacttgggaggctgaggcatgagaatcgcttgagcccagggagctgaggttgcag

SEQ ID NO: 27285 - DNA, 201 bp, Homo sapiens
cactcttgttgcccaggctggagtgcaatggcacagtcttggctcactgcaacctctgcctcctgggttcaagcaatcctcctgcctcagcctccccagtrgctgggattacaggtgccggcttccatgccctgctaattttgtatttttattagagatgggatttcaccatgttggtcaggctggtctcaaactcctgac

SEQ ID NO: 27286 - DNA, 201 bp, Homo sapiens
gtttctttgtggtttcgatgatttgtcagtccttgatttgttatgtaggttgcaatctcacaccattgttcatcttttaaatttatgatgccttttctcayacaggactttgaaatttgtaatagaatcatatttatcagcctgtttttttgatgactttccttctgtggcttaagatggcatttcttaccgcaaaacaaa

SEQ ID NO: 27287 - DNA, 201 bp, Homo sapiens
ggaatatagtgtgtgtgtgtgcacgtgcgtacgcgtgcatgtgtgtgtgtttgttcagatgaacatgcgtatgcctgtgctctagtgagtgcattcacacscatgataatagaccccaccatattaaccctaaccctaaacctaatcagaactaataccagattaatctttctaggttattaataaaggctcttggtctac

SEQ ID NO: 27288 - DNA, 201 bp, Homo sapiens
gtctcagcctcccaagtagctgggattacaggcatgtgccaccatgcccggctaattttttttgcatttagtagagacagggtttcaccatgttaggctgrtcgcgaactcctgaactcaggtcatccaccctcctcggcctcccaaagtgccgggattacaggtgtgcgccaccgcgcccagccatcttatcattttagt

SEQ ID NO: 27289 - DNA, 201 bp, Homo sapiens
gaaacatggttaatacagaagcagaaaaggaatgcaaaacagagaacaactgcaaaggtgcacatgcggaaacacaggttgatgtcctgccaaccctactstggatggtctgtggaccagcagcacctgggacttagagaggcagcgtctcaacccctcaccccagactgaacgaatctgaatctgcaacaccctcaggta

SEQ ID NO: 27290 - DNA, 201 bp, Homo sapiens
aaaggagaaacatggttaatacagaagcagaaaaggaatgcaaaacagagaacaactgcaaaggtgcacatgcggaaacacaggttgatgtcctgccaacyctactgtggatggtctgtggaccagcagcacctgggacttagagaggcagcgtctcaacccctcaccccagactgaacgaatctgaatctgcaacaccct

SEQ ID NO: 27291 - DNA, 201 bp, Homo sapiens
gtgattagggcagggggatagtggcctggagtgtgagagccagataagggaattggttgggatgcgagctctgggttggttttcatttgaaaagcatatcmcccggaggactccttccagggggagggggacagtgagggagacatattattgggttgcacagagcaaggtgtgtcctgcagatgcacgcggggcagatgt

SEQ ID NO: 27292 - DNA, 201 bp, Homo sapiens
aagctcctgaaatctaatataaaagtactctatgaatatgatgtatttgtcaggcataagaattttctagaaaataaaacatttcatgacagggatcattktttaaagctcaagaattcttggaacatctacagaattaggatttgacaaccagtttttcaagaacttggtccaattttttcatacatctgaaagtcagtc

SEQ ID NO: 27293 - DNA, 201 bp, Homo sapiens
cccgaaggccccacctcccaacgccatcaccttgggcatttggatttcaacgtgtgaattttggagggacacagatattcagaccatagcagctgtgggtraagattcaaagactcagaaacagatgggacctcccaggcagtgtgtgaagggcaaggctggaaccctgaacaccagtgacaagtaggagatggagagaga

SEQ ID NO: 27294 - DNA, 201 bp, Homo sapiens
cagcagactgagccttgcattctggctcctttatgacttgctgtgagaccttgacttcagcaatgacatcttctgtgcctcatccataaattaagagaacrgatctccaagagttccttcaggtatctttcaacctagagttcaattccagaacttcacaatgcttcgccacctggcagtagaagtttcccaaagaattat

SEQ ID NO: 27295 - DNA, 201 bp, Homo sapiens
tgatgtatttgtcaggcataagaattttctagaaaataaaacatttcatgacagggatcattttttaaagctcaagaattcttggaacatctacagaattrggatttgacaaccagtttttcaagaacttggtccaattttttcatacatctgaaagtcagtcaactgtaagaactcaaaatagcaaggagtaaagtgaga

SEQ ID NO: 27296 - DNA, 201 bp, Homo sapiens
tttgccatacggaagatataatgtgctgtaccaggaccagagaacagagaaacagaggaatcagatggtttgagagcaagaccaggagtgtgcaggtctgyccggtgggtggggtgaacagggagggtgcgcctaggatccttctcccctcccatccccatttggcttcctgggccacgttcctcagcgcttcgttggttc

SEQ ID NO: 27297 - DNA, 201 bp, Homo sapiens
actgccctggcacagggctgcaactgcagcctaagtggcttcctgtgcgtaaggtttaaggaactttcattttattagccagtggttaagtgcctgtgagmgcaatcatcagcaggtgcagtggtagaagataacaagcttcctaataaatagtggccaccggccgggtgcagtggctcatgcctgtaatcccagcacttt

SEQ ID NO: 27298 - DNA, 201 bp, Homo sapiens
agattaaatagtattataaaatataagaaacagcattgaagtccaactctttgagaattttgaagctcatagcttgaggcagaatggatccacagagaccragcagcatattatggtttgtattgactggaggatttggattcagactaaaagacaacttcaaatgaatggctgtgttttgagagcacattgctttgtgaa

SEQ ID NO: 27299 - DNA, 201 bp, Homo sapiens
ttgagtggggtcacagccaaaccatatctctcttctttccagtttcacattgactcagacacttccttcggtagagcagtctctgaaggccctgtattagrggagaatgcccttgcccaatcctggcagaaaacctctctccacagctcacacccagagctgggctcaggccagatgaggaagagagataatgagagaaat

SEQ ID NO: 27300 - DNA, 201 bp, Homo sapiens
gtcttttgtaggacactgataatctcttttctttccctacttgtctacatgaagtgtgcaaaaatctctggtcatatccaggatttttatacaaataagtrggttacagttaatattccagtttcgcttttttttcccaaataatttagggtttaagattgttatttcttgggttatcaggacatagctctcccttgaaac

SEQ ID NO: 27301 - DNA, 201 bp, Homo sapiens
gcatctctgggtctaggtaaagaggaaagggagaggaaagcttaacaacataagaagtaaatgagattcagacatgaaaatcatccatggaaatcacccaygaaaatcagatatgaaaagcgtatgaaaatctaaagtgcaaagaaagagttgctcatgcaatcaaaactttctgtttttctttacaatgtttggggaata

SEQ ID NO: 27302 - DNA, 201 bp, Homo sapiens
tcttttctttccctacttgtctacatgaagtgtgcaaaaatctctggtcatatccaggatttttatacaaataagtaggttacagttaatattccagtttygcttttttttcccaaataatttagggtttaagattgttatttcttgggttatcaggacatagctctcccttgaaactagcttattagatgtgaagagttg

SEQ ID NO: 27303 - DNA, 201 bp, Homo sapiens
ccctgaagctcctgcccactgggagccagctcctgtccaccctaccccagtttcaagagttcctaaaactctggtgtgaaccagaaccactgggaaacttrttagaatgcagatcccttggctccaccctcaaaaattctgattcaggataatcaaaaacgggacccaggaatttgcattttaagcaaacaacccacgtga

SEQ ID NO: 27304 - DNA, 201 bp, Homo sapiens
ttaagtaaataattgctatgaatacaaatgtatacaaatgaaatagtaggaaggaactccagcttcatagtaatagaatatttctcatctgtatcggttgrccagtagcccagaagtttgtacagtatcatgacattacatcctacaccttcaggcagattaaatagtattataaaatataagaaacagcattgaagtcca

SEQ ID NO: 27305 - DNA, 201 bp, Homo sapiens
tttataatttcaaaattacatgtgctaaaatatttaagtaaataattgctatgaatacaaatgtatacaaatgaaatagtaggaaggaactccagcttcayagtaatagaatatttctcatctgtatcggttggccagtagcccagaagtttgtacagtatcatgacattacatcctacaccttcaggcagattaaatagt

SEQ ID NO: 27306 - DNA, 201 bp, Homo sapiens
cccttctccgcggccctttggctcaggggagcgcaggccggccttcctcccgcacgcgggcgcgggccagctgcagatggagaacccggggggcgaccgcragccctctgaggcccctcaagggacagggcatgggtgtgaggggtcgcgtgcgccccctggcgccgggtccgctgggcggggtggtgggcggggacggtg

SEQ ID NO: 27307 - DNA, 201 bp, Homo sapiens; identical to SEQ ID NO: 6799

SEQ ID NO: 27308 - DNA, 201 bp, Homo sapiens
gacctacagggaaaatgtgttgaacaaatgccctctgcgtagtgcattagtatgagtacaccagcaagatcaagatcgtcaggatgccccatctgctgctrtcttgactttaggcctgtgccacgcaccgttttgccatgactttccgcatagcaccaggccaaaaagaactgcagagttttgagggcaaggccggtttcc

SEQ ID NO: 27309 - DNA, 201 bp, Homo sapiens; identical to SEQ ID NO: 6800

SEQ ID NO: 27310 - DNA, 201 bp, Homo sapiens
gtgtccttgttctctcatttatgcccagatttgtggcctcaggagccagaagtacaccttgatctttatgtttaccttgagacagcaatgaagggatgaargaatgaatgagtttatatttcaattaggcgtgagagatggaggtggtttaaaaaaaaataaaagacaagatagcagttttgactgggataacagcatcct

SEQ ID NO: 27311 - DNA, 201 bp, Homo sapiens
tgtcctctgctcagcttctcgtcccagtgctgtctccccttgatttcccacttcttctcttctttatctttatttcttgccccttgcttttctctttgcartttctgttccccttactctctctgccttatcattggtcacttctttcatttatttttacttttttagagacaggcaggctggtcttgaactcctagctca

SEQ ID NO: 27312 - DNA, 201 bp, Homo sapiens
acagcaagaaaaatttgaaagcggttaagtgaaagaaaatgctgtttactttcccctttggttacctgattttatttatctaagaatacatggggcaagcyttcatcgttgtgcatattagaaactctattacaagtgtacgtatctcaaagagggaacatatattttttaaggacattttcatactccagaatgccttca

SEQ ID NO: 27313 - DNA, 201 bp, Homo sapiens
ctttgtttgcactgtctgaaggggaggaggagacaatattctcccattgcattttttattacttcctctatcactagatctaggcagagcttttgagactygttttgacacactcactttttttccacactcactttttagacgggaaaaatgggcccaatcaaatgtaaatgaacagcaaggtagtgacagctagaatag

SEQ ID NO: 27314 - DNA, 201 bp, Homo sapiens
aggtatcggtagagccatgtgaccttgagtaaattgcttaatctctctgcacctcagtgtcctgtaggagagctgttctggggtatcaaagagcacaacayacatcaggtatttagtgtagtgtcaggcacatcatacaagttcattagagcttagtgtattagttaagaattgaatttacttgcagatatagaaaacaca

SEQ ID NO: 27315 - DNA, 201 bp, Homo sapiens
cagtgtcctgtaggagagctgttctggggtatcaaagagcacaacatacatcaggtatttagtgtagtgtcaggcacatcatacaagttcattagagcttrgtgtattagttaagaattgaatttacttgcagatatagaaaacacaggtaacagtggcttaaagatctgggctttttctgtcaccaaacaagaagtgtga

SEQ ID NO: 27316 - DNA, 201 bp, Homo sapiens
gaggtaattaggtcacaaggatggagccctcgggatgggattagtgcccttatagaagacaccccagagaggtccctcccttatcccttccaccacatgaggatacagtaagaagacattgtctatcagttaggaagccaaccctcaccaggcatcaaatttgctggtgccttgactttggccttcccagcctctagaatt

SEQ ID NO: 27317 - DNA, 201 bp, Homo sapiens
ctttaacaggaaattggctgggggtcaggtctgacatcgaggaaaattgagcataatgagatcacccctgaaattccttaattcagaggtgagtggcagcwgtacctgcaggcagtgcgaaaattcattaaagaattgttttggatctgctccagtgaacagaaacaagtgactgggtgacatagcaaagcaacaataatt

SEQ ID NO: 27318 - DNA, 201 bp, Homo sapiens
cccatctctactaaaaatacaaaaatgagctgggcgtgatggagcatgcctgtaatcccagctactcaggaggctgaggcaggagaattgattgaaccccrgaggcggaggttgcagtgagctgagattataccactgcactccagcctgggtgattgagcaagactctgtctccaagaaaaaaagaaaaaaaaaaaagat

SEQ ID NO: 27319 - DNA, 201 bp, Homo sapiens
ttacatgagtggttgtgtagacctctgattgtatcatgtctatgacatcccattggtcaaagcaagtcatatggccaaacacagagtcaagaggtagagawatagcctccgtgtttttgttgttcttgttgttttgttttttgagacaaagtgttgctctgtgacccaggctggagtgcagtggtgatcatggctgtatta

SEQ ID NO: 27320 - DNA, 201 bp, Homo sapiens
acagtaggcttgcctgagcatatacttttcatggcaaaaacacagcaaaacaagctcaattacatgagtggttgtgtagacctctgattgtatcatgtctrtgacatcccattggtcaaagcaagtcatatggccaaacacagagtcaagaggtagagaaatagcctccgtgtttttgttgttcttgttgttttgtttttt

SEQ ID NO: 27321 - DNA, 201 bp, Homo sapiens
gctaatctaggctggactttgctgatctcaactggactcaacttatgcacctggggtctaatgggggttggctgaccttagatgaggttggctggggtgayttggttctgctctacctgtctacctcctagaacagtaggcttgcctgagcatatacttttcatggcaaaaacacagcaaaacaagctcaattacatgagt

SEQ ID NO: 27322 - DNA, 201 bp, Homo sapiens
ggtgaaaccccatctctactaaaaatacaaaaatgagctgggcgtgatggagcatgcctgtaatcccagctactcaggaggctgaggcaggagaattgatygaaccccagaggcggaggttgcagtgagctgagattataccactgcactccagcctgggtgattgagcaagactctgtctccaagaaaaaaagaaaaaaa

SEQ ID NO: 27323 - DNA, 201 bp, Homo sapiens
tggtgaaaccccatctctactaaaaatacaaaaatgagctgggcgtgatggagcatgcctgtaatcccagctactcaggaggctgaggcaggagaattgawtgaaccccagaggcggaggttgcagtgagctgagattataccactgcactccagcctgggtgattgagcaagactctgtctccaagaaaaaaagaaaaaa

SEQ ID NO: 27324 - DNA, 201 bp, Homo sapiens
cgagcccagaggaaggcgcttgactggtttgggaacagagagtttctttctagtcctctgctgaccttctgcctacttggctccaaactgacaggcaggtrgatcacttgaggtcagcagtttgagaccagcctggccaacatggtgaaaccccatctctactaaaaatacaaaaatgagctgggcgtgatggagcatgcc

SEQ ID NO: 27325 - DNA, 201 bp, Homo sapiens
caacatgaagaaaaacagaatagatacgttgccatgcactgaactgctggtcctgaagggtggagcatgggctaaacattatctctagaaatagacaggawcattgttttgagtgtggagcgtgtcctgctggtctacagtgattcttccaatctaagttttgatgattctatgtccagcttcctctcttctccagtcacc

SEQ ID NO: 27326 - DNA, 201 bp, Homo sapiens
cttccactctttcctttggagtcacactgagcattccaaaaggcctgtaaggtaatccgtatgtctccttacatctactttatcctagattcctgataacraaggaaggaattctattttcagaagggtttccacgttttttttaatgtttgtcacagcctagatataaaacaaaacgaaacaaaaaaccatattgaatga

SEQ ID NO: 27327 - DNA, 201 bp, Homo sapiens
agagtaggacttacttcgtgttctcagagcacagattacaacattcgggtagacattgaagagagacagatttggggctcaataggaagaaaagctttttwaaagggctgtcaaaacaacatgaagaaaaacagaatagatacgttgccatgcactgaactgctggtcctgaagggtggagcatgggctaaacattatctc

SEQ ID NO: 27328 - DNA, 201 bp, Homo sapiens
gggagcatctctgggtctaggtaaagaggaaagggagaggaaagcttaacaacataagaagtaaatgagattcagacatgaaaatcatccatggaaatcayccatgaaaatcagatatgaaaagcgtatgaaaatctaaagtgcaaagaaagagttgctcatgcaatcaaaactttctgtttttctttacaatgtttgggg

SEQ ID NO: 27329 - DNA, 201 bp, Homo sapiens
tctcagcctcccaaagtgctgggattacaggcataagccaccgctcccggctagtatttacatttttaaaaagataaaggaatagatctgcgcttacacakgtgtttgattttccacaaaggcaccaaaacagtccaacaggaatttaaacaaatggtgctaaagtagccagagagccatatggaaaaatgaatctaacct

SEQ ID NO: 27330 - DNA, 201 bp, Homo sapiens
tttctaactcagtccttgttcaagctattagttcctaactcttaacagtgcaccaagctgccacagggcaagtctttgctgtagactcaaggatgagtttyaagacaacaaataaaagcattaatggaagtcagtatcattaaatctaaatttaaataatgtgctctaacatactgggagcatctctgggtctaggtaaag

SEQ ID NO: 27331 - DNA, 201 bp, Homo sapiens
aggtttagccatgtgacactatttacagcagtcagtcagaactgaaggaagttcactctctgcctccacatggacaacatcatctcttggcagtgacccartacacaggctaaggacttgcctctttttgtctttggacaaaaagagttgtccaaaccctcttttttggacaactcagctagggctatcatttctttgtgc

SEQ ID NO: 27332 - DNA, 201 bp, Homo sapiens
  misc_feature (1)...(201): n = A,T,C or G, or insertion/deletion polymorphism (see Tables 1-2)
tatggattgtttgtggtgtttcccatcccttttaagttgaaattgtgtgttgcaatctctacagtaatagaatatttcttttttcaaagtattcaacaatnagtttaatattctttcttcctgtgatgcataccaccatccgttatgctaaattaactgtttatacacacatacacagagctcaactggtcagagctgtgg

SEQ ID NO: 27333 - DNA, 201 bp, Homo sapiens
ctccttccttgatggccagcccgctaggcgccctctcgcccccaatacccccagcgggacccctagactggactcctctgaggcccgacccgtctctcccmacagggccttagggagccagggacgctcctggtgcccgccctctcctgatggctgtctcgcggggcgcctgttcgagcctgggaccccgggaggggggac

SEQ ID NO: 27334 - DNA, 201 bp, Homo sapiens
tactcttaaaaaactaactgcttggtaaaattaatatttcattttaaggatgcaaaacccaaattgtgcaattaatcctccctttcttgtcctttcaatataattaattaattaattaattaatttttttttttagatggagtctctctctgttgcccaggctggagtgcagtggtgcaatctcagctcactgcaacctcc

SEQ ID NO: 27335 - DNA, 201 bp, Homo sapiens
gtctcactctgtcacacaggctggagtgcagtggtgctatctcggctcactaccacctgctcctccagggttcaagtgattctcgtgcctcagcacagatrtgcatcaccattcctggctaatttttgtatttttagtagagacagcgttttaccatgttggccaggctggtctcgaactcctgacctcaggtgatccacc

SEQ ID NO: 27336 - DNA, 201 bp, Homo sapiens
ggaaacaggctattgaattactggactcaagagcaggcaaatccatctggggtggcaagcccaggaaaggctgccaagaaggacttagaaccactcttcgyccttccctgcctgagtatactcatcgaaaggaccctgtgtgtctatcttcattagggcaaagagatcaaatcccaaatttcataaaggagaatgttaatg

SEQ ID NO: 27337 - DNA, 201 bp, Homo sapiens
gaagaaattttcacaatgccatacaagtagtcagtaagtggcagacacaaatttctaactcagtccttgttcaagctattagttcctaactcttaacagtrcaccaagctgccacagggcaagtctttgctgtagactcaaggatgagttttaagacaacaaataaaagcattaatggaagtcagtatcattaaatctaaa

SEQ ID NO: 27338 - DNA, 201 bp, Homo sapiens
cctcaaaccacatgcatataatgctttttagtgcccacaaacaccaaccagaaagtgtgtgattaggttcactttttcaagcacctttatttgtttcctcytgattcacctaatcactttgacaggggggaaatggggagggggagcagcttcaaaaagtttccacagtggaccatgagttatttaaatccatctcacaga

SEQ ID NO: 27339 - DNA, 201 bp, Homo sapiens
gttagctagaagttatacagcagttgatcaacctagatcttcataatagccctggaggtaggaatgggaggtattatttctattttacagatgtagaaacmttggccagagaggtgaagaaattttcacaatgccatacaagtagtcagtaagtggcagacacaaatttctaactcagtccttgttcaagctattagttcc

SEQ ID NO: 27340 - DNA, 201 bp, Homo sapiens
ttgctctgttgatccatttatttcttcaatcagtaagttagtggtgctttcttttcctttgattggcaggtgtttcatcagatcttctgggatacttctakttaggagtaagatttctaactaattaaagtgaataaacacatttttttcaaaataatgtaccctgttacatagaaaacagggcttgaaaggaattgttaa

SEQ ID NO: 27341 - DNA, 201 bp, Homo sapiens; identical to SEQ ID NO: 6802

SEQ ID NO: 27342 - DNA, 201 bp, Homo sapiens
tgcaaaaaaaattatagatatatatttatatatgaatggtgatgcaatggtgagaataactgttcattctgtaactattcctatcactctgtagctttcaygctaagtagattacaaatatcattggatttgcataagcattaagataaatgaaatgttagggaaaatggaaggaaaaagaacacagatatgctcttttaa

SEQ ID NO: 27343 - DNA, 201 bp, Homo sapiens
cgcggcatgtaagggataccatcgagggcagatcattttggtctttttaaaaaaattttttttaattcttaattttctttttttttcttttttacagagtmttactctgtcacccaggctggagtgtagtggcgtgatctcagccactgcaacctccacctcctgggtttaagcgattctcctgcctcggccttccaagta

SEQ ID NO: 27344 - DNA, 201 bp, Homo sapiens
ggcagatcattttggtctttttaaaaaaattttttttaattcttaattttctttttttttcttttttacagagtattactctgtcacccaggctggagtgyagtggcgtgatctcagccactgcaacctccacctcctgggtttaagcgattctcctgcctcggccttccaagtacctgggattacaagttcatgccacca

SEQ ID NO: 27345 - DNA, 201 bp, Homo sapiens
cattttggtctttttaaaaaaattttttttaattcttaattttctttttttttcttttttacagagtattactctgtcacccaggctggagtgtagtggcrtgatctcagccactgcaacctccacctcctgggtttaagcgattctcctgcctcggccttccaagtacctgggattacaagttcatgccaccacgcctcg

SEQ ID NO: 27346 - DNA, 201 bp, Homo sapiens
ttgtgtgcctcagtttcctcactggtgaatatggaaataacactcagatctatcctgaggattccccataaaccgcacttcacagtgtgtgacctagaatwggcactccctgtagattaacttgctttcctttcttgcttgtcttgccacatgttttcaccatcacagttatctttttggaaaacaaacatccagaatgac

SEQ ID NO: 27347 - DNA, 201 bp, Homo sapiens
aaaacaaacatccagaatgacaacgtaaaatgaggatttctccctggacagccacatgctttatgtaacgtaaatgacctactctaattgcaggttatatmcaggcatgtagaggacttatgatcgctgctgtcagcctgggcttctttggttccatatttgcgctctttggaatgaagtgtaccaaagtcggaggctccg

SEQ ID NO: 27348 - DNA, 201 bp, Homo sapiens
gtggtggcgcatgcctgtaattccagctattcaggaggttgagacacaaaaattgcttgaacctgggaaacggaggttgcagtgagccaagattgcaccaytgcactccagcctgagtgacagaatgagactgtctcaaaaaaaaaaaaataaataaatataaaagaagtctaattttagaaagttcaacttcctgatgac

SEQ ID NO: 27349 - DNA, 201 bp, Homo sapiens
ttattcttttttattatcatgtcctcacagagaatctttataggcagggccaagatgttactcaaactgttttgggtccacttcaagaaacctagaaaaaytgatgatctaagtcacaaagttctgttatagatcatatccacaattatttacatgagaacatttgcaaaacctggatttaccaactgcagtcattaagaa

SEQ ID NO: 27350 - DNA, 201 bp, Homo sapiens; identical to SEQ ID NO: 6801

SEQ ID NO: 27351 - DNA, 201 bp, Homo sapiens
tatatttaaatcaaaaaagatattaaaggtgaataaatttcacatattaaaacctcaaaccacatgcatataatgctttttagtgcccacaaacaccaacyagaaagtgtgtgattaggttcactttttcaagcacctttatttgtttcctcttgattcacctaatcactttgacaggggggaaatggggagggggagcag

SEQ ID NO: 27352 - DNA, 201 bp, Homo sapiens
ttacattacctgccatagggttgtgaggttagaatgagtgaatgcgtgtaaagtgattagaagcatgcctagcacatagttagcactcagtgtttagtcgytattcttttttattatcatgtcctcacagagaatctttataggcagggccaagatgttactcaaactgttttgggtccacttcaagaaacctagaaaaac

SEQ ID NO: 27353 - DNA, 201 bp, Homo sapiens
tggcaggtgtttcatcagatcttctgggatacttctatttaggagtaagatttctaactaattaaagtgaataaacacatttttttcaaaataatgtaccstgttacatagaaaacagggcttgaaaggaattgttaagaaccattcgccttattaatatgttatttttttggtgctgccaagggcattgggaacttcagt

SEQ ID NO: 27354 - DNA, 201 bp, Homo sapiens
gaatccctgaaactttatctgccaattgataagcactggtggctatcaactagaacccaaaactacatccttcagtggcaacatacaaacagcactaaatkagggcaaatgcagagctaaattcatagccctttttatgcaccagtctaaaacaacgttgccaagaagatctgcagaaatttttggtagagaaccaacatg

SEQ ID NO: 27355 - DNA, 201 bp, Homo sapiens
tccattttatatataaagcagctgaggttcactggggaccatatttctaacttcctatgggcttctgcaaatctttttggggaaatggccagcatttggtrctagctcccaaatttgtgtttaagtcccagcttggccatgttttgtggaccttaggtgaatccctggcatttgcccttgtttccctttcttagctgtagg

SEQ ID NO: 27356 - DNA, 201 bp, Homo sapiens
agcgccactgctcctaaatgaacttgggataattggcttgaattgcagaaggcagcaggtctacaattaagcttttgccagatttttgtgtgcattgcagraaaaattgattaccaaaggttaataatttggcaaatcattcagcagattcctggtgcagaatataggctctgaggactcagggaggaacaggacaggggc

SEQ ID NO: 27357 - DNA, 201 bp, Homo sapiens
taggtcattaagacaccacagtcactaatatttagagcttgaacatagtatgaattggttgtctacagagagttagaaaaggtgccaagacacataactgrgtgatggccaatcaagggtgttttgtttctttctgaaacaaagctgggaacaatgtttttcttgttgttgttgttgttgtttttaatgtagaactggtgg

SEQ ID NO: 27358 - DNA, 201 bp, Homo sapiens
cacgcctggctaattttgtacttttagtaaagatgaggtttctccatgttggttagagtggtcttgaactcccaacctcaagtgatccacctgcctcggcytcccaaagtgctgggattacaggtgtgagccaccaagcctggccaaaaaactttttttaaatagccagatgtggtgtcgtatgccggtggtcccagctac

SEQ ID NO: 27359 - DNA, 201 bp, Homo sapiens
tggctgttaactctctgaagactgagtgcttaatcaaagtgccaagatttgcctaggaaggatggggtgtatgagtattggctgaaagaatgacatttatyttatttgacaaaggagatgtaagaataaccttacagggcttttggaatacccagtgtgactccaaagggaagagtggaagtgactggattgttttaaaag

SEQ ID NO: 27360 - DNA, 201 bp, Homo sapiens
aatatttgttagggctgtgctcaatgactggatgttccctatatgcaaacaaaatcacaacggaattctttgatcctctctttgttgagcaaaagtaagtrctcttctcagtctgtttccagctcacaggaagtgtatataaattaatattctcaaccaagagacatgaatttcctatatgacttttgaaagtaagacata

SEQ ID NO: 27361 - DNA, 201 bp, Homo sapiens
tggctgtgactacttttgctttgactttgcccccgtggatgccctcatctcctttcaggatgttgggatggtctaatggctataaaaacactttgggaagmgtttacagcattttacagacacaaggtgttattatttcctttacaattttcaatagcaaaaaaacataataagcatttagtaaatgttgactatcagtgt

SEQ ID NO: 27362 - DNA, 201 bp, Homo sapiens
attacagatagttcatatgattcttagaaacttccaaaatccggaattggaaaaggttagcagtacagttaattttttaaagttttaccattactatattycaaagaaaattctaacgtagaaataagggtctgaatatgaggacatgttcttcacgttggcctcatcataattttcctctaggtaggcaggaatgttgat

SEQ ID NO: 27363 - DNA, 201 bp, Homo sapiens
catgcctataattccagcactttgggaggctgaggctggcagatcacttgagtcagaagttcaagaccagcctggccaacatggcaaaacaccatatcaamtaaaatagaaaaaaaaaatagctggacatggtggtgcatgcctgtagtcccagctacttgggaggctgaggcatgagaatcgcttgagcccagggagctg

SEQ ID NO: 27364 - DNA, 201 bp, Homo sapiens
agatcgcgccattgcactccagctggacaacaagagcaaaactccacctcaaaaaaaaaaaaaaaaaaaaagagagattgagcatatgtttgataatcaaygaacagtccattttaaaagttagacaggacatattcctgaagccagcctttcagggttcaaattctttttcttccattttatagtgattaagaagtctgg

SEQ ID NO: 27365 - DNA, 201 bp, Homo sapiens
gccaggcgtggtggcgggtgcctgtaatcccagctactcaggagggtaaggcaggagaatcacttgaacccaggaggcagaggttgcagtgagctgagatygcgccattgcactccagctggacaacaagagcaaaactccacctcaaaaaaaaaaaaaaaaaaaaagagagattgagcatatgtttgataatcaacgaac

SEQ ID NO: 27366 - DNA, 201 bp, Homo sapiens
aggcgggtggatcacctgaggtcaggagtttgagaccagcctggtcaacatggtgaaaccccatctactaaaaatgcaaaaattagccaggcgtggtggcrggtgcctgtaatcccagctactcaggagggtaaggcaggagaatcacttgaacccaggaggcagaggttgcagtgagctgagatcgcgccattgcactcc

SEQ ID NO: 27367 - DNA, 201 bp, Homo sapiens
cctccacatggacaacatcatctcttggcagtgacccaatacacaggctaaggacttgcctctttttgtctttggacaaaaagagttgtccaaaccctctkttttggacaactcagctagggctatcatttctttgtgccatttatgggtttatctgaaatacacagctgctgaaattgtctgaattaaatttcactctgt

SEQ ID NO: 27368 - DNA, 201 bp, Homo sapiens
cactgtaacattgaactcctgggctctaggaatcctcctactttagcctctgagtagctgggactataggtgcacaccaccatgctagctaatttttaaattttttttttttttttctttttgaggcagaatcttgctctgtctcccaggctggagtgcagtggcacaacctccgctcactgcaagctccgcctcccgggt

SEQ ID NO: 27369 - DNA, 201 bp, Homo sapiens
acaccaccatgctagctaatttttaaattttttttttttttttctttttgaggcagaatcttgctctgtctcccaggctggagtgcagtggcacaacctcsgctcactgcaagctccgcctcccgggttcacgccattcccctgcctcagcctcccgagtagctgggactacaggcgcccgccaccacgcccggctgattt

SEQ ID NO: 27370 - DNA, 201 bp, Homo sapiens
acagaatgtggacatttgtgaggtgggcaggggaaaatggaagacaattttcttcttatcttactacggccatatgttctcctttatttccaccggcaagycttgagccagtcatatgaggggattttagcctgctctggaggactcctacaaacgtccccactaaactgattctactgcagtggccgaggtccttccttg

SEQ ID NO: 27371 - DNA, 201 bp, Homo sapiens
tgcttcagctccttcaccaggacttgctttctctcaccccacaccttgggaagaactgtcaaagcatggctcctagctgtgagaatttgggggaaaacgasaagggggagtgcacatgcgtgtgtgtgtgtgtgtgtgtgtgtgtgtgtgtatccattttttcatctggaaaaatatgcatgttatcctagtggctccctc

SEQ ID NO: 27372 - DNA, 201 bp, Homo sapiens
ccgttccactaagccatactctaaatcaccttacttccttccaggtctcccagcttggagtctggcaaattgtaaatactccataatgatccatttccctcctccattccttccagatcacagacctcaaagcctgatgtcctgttggaatcccaggactgctgctactagctttactaccgacctagtgacttaaactct

SEQ ID NO: 27373 - DNA, 201 bp, Homo sapiens
tttgggaggctgaggcgggtggatcacctgaggtcaggagtttgagaccagcctggtcaacatggtgaaaccccatctactaaaaatgcaaaaattagccrggcgtggtggcgggtgcctgtaatcccagctactcaggagggtaaggcaggagaatcacttgaacccaggaggcagaggttgcagtgagctgagatcgcg

SEQ ID NO: 27374 - DNA, 201 bp, Homo sapiens
agattatacagagatccttctcctgctgcaagtctcaaggacttcttcagggcagcagtgaaacctgtcaggcagctatggaaaaggctttggatctctgygtgtgcacagaagggcacggaggggaatctcatcttcttaagatcttcatccttaatataagtttctgaattctttgctctataaaccaaaaatttaatc

SEQ ID NO: 27375 - DNA, 201 bp, Homo sapiens
tggttacatgagtaaattctttagtggtgatttgtgagattttggtgcatccatcacccgagcagtatacactgcaccatatttgtagtcttttatccctygccaccctcccactcttccccccaagtccccaaagtccattgtatcattcttatgcctttgcatcctcatagcttagctcccacatatcagtgagaacat

SEQ ID NO: 27376 - DNA, 201 bp, Homo sapiens
tttggtgcatccatcacccgagcagtatacactgcaccatatttgtagtcttttatccctcgccaccctcccactcttccccccaagtccccaaagtccaytgtatcattcttatgcctttgcatcctcatagcttagctcccacatatcagtgagaacatatgatgtttggttttctgttcctgagttacttcacttaga

SEQ ID NO: 27377 - DNA, 201 bp, Homo sapiens
tccccccaagtccccaaagtccattgtatcattcttatgcctttgcatcctcatagcttagctcccacatatcagtgagaacatatgatgtttggttttcygttcctgagttacttcacttagaataatagtctccagtcttatccaggtcactgcaaacactgataattcatttctttttaggtctgcgtagtattccat

SEQ ID NO: 27378 - DNA, 201 bp, Homo sapiens
cccaaagtccattgtatcattcttatgcctttgcatcctcatagcttagctcccacatatcagtgagaacatatgatgtttggttttctgttcctgagttmcttcacttagaataatagtctccagtcttatccaggtcactgcaaacactgataattcatttctttttaggtctgcgtagtattccatcatatatatata

SEQ ID NO: 27379 - DNA, 201 bp, Homo sapiens
catttgggttggttccaggattttgcaattgtaaattgtgctgctgtaaacatgcatatgcaagtatctttttggtgtaatgatgtaatgacttcttttcytctgggtagatacccagtagtgggattgctggatcaaatcatagttctactttttgttcttttttttttttttttttgaaacggagtttctctcgtcacc

SEQ ID NO: 27380 - DNA, 201 bp, Homo sapiens
cccaggctagagtgcaatggcatgatctctgctcactgcaacctccggctcctgggttcaagtaattctcctgcctcagcctcccgagaagctgggattcaaggcactcaccaccacgccaggctagttttactttttagtagaaatggggtttcaccatgttggccaggcttgtcttgaactcctgaccacaggtgatcc

SEQ ID NO: 27381 - DNA, 201 bp, Homo sapiens
tctgttgcccaggctggagtgcagtggcgcaacctcggctcactgcaaacttcatctcccaggttcaagtgattcttctgcctcagcctcccgagtagctrgaattacaggcatgcaccaccacacccagctaattttgtatttttagtagagatggggtttcaccatgttggccagactggtctcgaactcctgacctca

SEQ ID NO: 27382 - DNA, 201 bp, Homo sapiens
tctgtatatatctgttaagtccatttgttccaaggtatagtttaaatcctttgtttctttattgactttctgtcttgatgacctgtctagtgctgttagcrgagtattgaagtcctccactgctattgtgttgctgtttatctcatttcttaggtctaatagtaattgttttataaattttggagctccagtgttaggtgc

SEQ ID NO: 27383 - DNA, 201 bp, Homo sapiens
tagtttaaatcctttgtttctttattgactttctgtcttgatgacctgtctagtgctgttagcagagtattgaagtcctccactgctattgtgttgctgtytatctcatttcttaggtctaatagtaattgttttataaattttggagctccagtgttaggtgcatatatgtttaggattgtgatagcttcctgttgaaca

SEQ ID NO: 27384 - DNA, 201 bp, Homo sapiens
ttgagcttttactatctgcctacccggtgagatacagagacatccaagacttagttagatcttacctgcaggggccacactctcacttggcagccatgaaraatgaagcaaaggtcaggcctgcgggcaatgcagggtaaggataaggacccacatgctcagcagtaccttcaaggccccaaccctgcttctcccctccac

SEQ ID NO: 27385 - DNA, 201 bp, Homo sapiens
cagcagtgaaacctgtcaggcagctatggaaaaggctttggatctctgtgtgtgcacagaagggcacggaggggaatctcatcttcttaagatcttcatcyttaatataagtttctgaattctttgctctataaaccaaaaatttaatcagaatgtgtgtgggaggggagagtgtctcctacatccaggcgtatgagatga

SEQ ID NO: 27386 - DNA, 201 bp, Homo sapiens
cacactcccttaccaacctcaggcctggctgaaggaagattcttctaatccaaaacatcctgcaattttaatttaattatgaaacagcatgttgtgctagmtaagttagacttcaagatgacttagcagaaatcccctggtttgataataaatacagatgccatccagtgcaataaaaatgactgcatcaggccagaggca

SEQ ID NO: 27387 - DNA, 201 bp, Homo sapiens
ccagcctccatggtcaaggcagcacttagttttgaatcttaatttcaggccttacaccacaggtctatgagtcattggagctgaatttcctatccaaaggyattcaaaattattttcaaatctgatctggccaaacagaattctaccattcatcactgctggttttcaagcccgggcccactccagattccctagaatggc

SEQ ID NO: 27388 - DNA, 201 bp, Homo sapiens
caaaggaaaccaatttttaaaaacccttaaagccctattattaggcaaacaaagattatacagagatccttctcctgctgcaagtctcaaggacttcttcrgggcagcagtgaaacctgtcaggcagctatggaaaaggctttggatctctgtgtgtgcacagaagggcacggaggggaatctcatcttcttaagatcttc

SEQ ID NO: 27389 - DNA, 201 bp, Homo sapiens
gccccaaccctgcttctcccctccactctgatcttctctctttctcccaccacaggtccctctacccagactctacccagagctctgtctgccaggctctsctccccggcaccaggcttgagtattccgcctcactcaccaagcctcagcccccgcccatttcctcagggacatgctccctgacccagagcagagatcacg

SEQ ID NO: 27390 - DNA, 201 bp, Homo sapiens
ctgaaatccaagaggataatgtttttaccaaaaatatttacaaggaaatgggaaatttaaatgatccccaaaggaaaccaatttttaaaaacccttaaaghcctattattaggcaaacaaagattatacagagatccttctcctgctgcaagtctcaaggacttcttcagggcagcagtgaaacctgtcaggcagctatgg

SEQ ID NO: 27391 - DNA, 201 bp, Homo sapiens
gtccattgcatgaaatgcctttttccacccctttactttaagtttatgtgaatccttatgtgttaggtgagtcttctgaaggcaacagagagttggttggygagttcttatccattctgtggttcttcttttaaatggagcatttagaccatttatattcaatattgtattgaaatgtgaggtcttcctcctcaggaacat

SEQ ID NO: 27392 - DNA, 201 bp, Homo sapiens
tccattgcatgaaatgcctttttccacccctttactttaagtttatgtgaatccttatgtgttaggtgagtcttctgaaggcaacagagagttggttggcragttcttatccattctgtggttcttcttttaaatggagcatttagaccatttatattcaatattgtattgaaatgtgaggtcttcctcctcaggaacatt

SEQ ID NO: 27393 - DNA, 201 bp, Homo sapiens
gtcttcctcctcaggaacattgattattcttaggtttggtcatttaacataatcccagacttcttggaggctttgttcatattttattattcttttttctwggtctttgttggattgtgttaatttgaagaccttgtcttcaagctctgaatttctttcttctgcttgttcaattctattgctgagactttccaaagcacc

SEQ ID NO: 27394 - DNA, 201 bp, Homo sapiens
tcttcctcctcaggaacattgattattcttaggtttggtcatttaacataatcccagacttcttggaggctttgttcatattttattattcttttttctakgtctttgttggattgtgttaatttgaagaccttgtcttcaagctctgaatttctttcttctgcttgttcaattctattgctgagactttccaaagcacct

SEQ ID NO: 27395 - DNA, 201 bp, Homo sapiens
ctccttctcacttggataggctctgtcagagggaaggtctagggctgaaggctgttgttcagattcttttgtcccatggggtgttcccttgatgtagtacwcccccctttttcctgtggatgtggcttcctgtgagccaaactgcagtgattattgtctcttttctgggtctagccacccagtgagtctagccagctccag

SEQ ID NO: 27396 - DNA, 201 bp, Homo sapiens
gctgttcatgctggagaaaggtacctcattttccaaatccgggttctggttggcacaaaagaaggacctgaccagatcagaatctgccctgcccacttctyctctcatgcttgtgtcaagagaccaaagtgggtcctgctgccaataccagggctgggacggggcatctcagagtgagaaactcgggaaaaatgttatcag

SEQ ID NO: 27397 - DNA, 201 bp, Homo sapiens
ggaggttgtctgcacagagtcctgtgatgtgaaccgtctgtgggtctctcagccatggataccagcacctgttccagtggaggtggaggagggtataatgkactccgtgagggtccttaacttcggtggtttaatgctctatttttgtgctggttggcctcctgccaggaggtggtgctttccagaaagcatcagctgtag

SEQ ID NO: 27398 - DNA, 201 bp, Homo sapiens
gtatttggggtgtctcctgtgtcctgcaggggcagtccgcttccttcagagggtctgcggctcctctcaggattgctggtttgttcttgcagttgatctgkagggttattctccagctgagggtaagggtcagtggaccctgcaactctgcagttccacctctgccacccctgccgctaccgccaagccagtgacctcagg

SEQ ID NO: 27399 - DNA, 201 bp, Homo sapiens
aaggatggtaaatctgcagtggtgtaggactgtctgtctgtctgcatatctcctagaatggtaagacggagtgtgcttgtggtgatcgcttaaaggaacasggagaggcagcatggcacactgttcaagaataaggactctggatccaggctgcctgagagtaaaccctcgctctgccactttctagctgtgtaactttga

SEQ ID NO: 27400 - DNA, 201 bp, Homo sapiens
tgtctgcacagagtcctgtgatgtgaaccgtctgtgggtctctcagccatggataccagcacctgttccagtggaggtggaggagggtataatggactccrtgagggtccttaacttcggtggtttaatgctctatttttgtgctggttggcctcctgccaggaggtggtgctttccagaaagcatcagctgtagtcatgt

SEQ ID NO: 27401 - DNA, 201 bp, Homo sapiens
gtctcctgtgtcctgcaggggcagtccgcttccttcagagggtctgcggctcctctcaggattgctggtttgttcttgcagttgatctggagggttattcyccagctgagggtaagggtcagtggaccctgcaactctgcagttccacctctgccacccctgccgctaccgccaagccagtgacctcaggtaccttccctg

SEQ ID NO: 27402 - DNA, 201 bp, Homo sapiens
cttgacacacagggattatggggattatggggatcacaattcaagatgagattttgggtggggacacagccaaaccacatcattctgccccagcccctccmaaatctcatgtcctcacatttcaaaacataatcatgcctttccaattgtcccccaaattcttaactcattccagtattaacccaaaagtccaaatccaaa

SEQ ID NO: 27403 - DNA, 201 bp, Homo sapiens
gggggatgggggtgggattcctaggtcactggaattgtgtacctaggaggattatggctgcctctgttgagtcatacaggttgtcagggaagttggggaargctggcaatcacaggcctcacccagctcccacagaaaccgaagggtcggcctcactcccaccgtgcctcccccaacagcctcgagtctgtttcctggtgg

SEQ ID NO: 27404 - DNA, 201 bp, Homo sapiens
tgcggctcctctcaggattgctggtttgttcttgcagttgatctggagggttattctccagctgagggtaagggtcagtggaccctgcaactctgcagttycacctctgccacccctgccgctaccgccaagccagtgacctcaggtaccttccctgccccacccacccagacgggtgccccttccttgccagcccaggtg

SEQ ID NO: 27405 - DNA, 201 bp, Homo sapiens
tcattaaatcttagagctccaaaatatctcctttgacgccatgtcctacatccaggtcacactgatgcaagaggtggtctcccatggccttggacagctcygttcctgtggcattgcagggtacaaccccactcctggctgctttcacaggctggcgttgagtgtctgcaacttttccaggtgcatggtgtaagccgtcag

SEQ ID NO: 27406 - DNA, 201 bp, Homo sapiens
aaaacttgcccaaggctttttcccttccagctgtggaagaaaagggcttcagttcttccccctgcatgtgaagtctgcacaccagattcatgctctccccyaggttctggtcaggaggcttcttgcccctttcaaattgttataaagttcagctagagaattccttctccctatggagttttacccccttctcctctggcc

SEQ ID NO: 27407 - DNA, 201 bp, Homo sapiens
cgtgccctgctttctggtaattcagctcttacccccattgctcctctccttttcacatcctggctaacctctgatcagccttcagaacctgcattttgggyggggtgtccctgttttgggtgctccctttctacctcgtgcttccatcctaaccctactgggtggtttgcacctgcttatttattggttgttctcctaaac

SEQ ID NO: 27408 - DNA, 201 bp, Homo sapiens
actttatcctagattcctgataacgaaggaaggaattctattttcagaagggtttccacgttttttttaatgtttgtcacagcctagatataaaacaaaaygaaacaaaaaaccatattgaatgataaaataacagcaagaaaaatttgaaagcggttaagtgaaagaaaatgctgtttactttcccctttggttacctga

SEQ ID NO: 27409 - DNA, 201 bp, Homo sapiens
ctactcttaaaaaactaactgcttggtaaaattaatatttcattttaaggatgcaaaacccaaattgtgcaattaatcctccctttcttgtcctttcaatwtaattaattaattaattaattaatttttttttttagatggagtctctctctgttgcccaggctggagtgcagtggtgcaatctcagctcactgcaacctc

SEQ ID NO: 27410 - DNA, 201 bp, Homo sapiens
caccagaattacttagatgcttttgttatgctagcatgacctaaaaatctgcttgggaactaaatatttggcgctctcttttgtttttgctgactagtgcrtgacatcatgatttctgccagcgtgccctgctttctggtaattcagctcttacccccattgctcctctccttttcacatcctggctaacctctgatcagc

SEQ ID NO: 27411 - DNA, 201 bp, Homo sapiens
gaaagcttgattaaaatccaaagccaattcactatctttagacactaagtctaccataagctaggtctcgttttgttgtgttttgtttttctgtcatatcwacgttaataggaatgctttcactatgaaagtaaagcatctctcatcgtagggagaaaagcagttctttctgagggggaagactgaatccaagaagcatgg

SEQ ID NO: 27412 - DNA, 201 bp, Homo sapiens
caccttgtcgcctctaatttcactgggcacccatttggttaaaaaaaaaaagtgacaaagggaaattaagaaattcttcacattgaaccagagtgtttctrcctaaagatagtgacacagagggttagcacgagatttatcacagcagactgattgataggttttagacctttccttacttttggcaacaagtgaaacctg

SEQ ID NO: 27413 - DNA, 201 bp, Homo sapiens
aaattgtattcctggaggaaggatggagtgtgctgaattgaggagcgagtgaggaaatgagcgcaggcaacccaaagggaggtcagtggattatgactcakcagactgagccttgcattctggctcctttatgacttgctgtgagaccttgacttcagcaatgacatcttctgtgcctcatccataaattaagagaacgga

SEQ ID NO: 27414 - DNA, 201 bp, Homo sapiens
ggagctggcgatacagacaaataagtcggggcagccattgcccttggggagctcttcccacagacaaacaatgggagtgtgttggggtagacaccccccgmacctagggatccggtggtgggagaagggtgcaatccaggaaggaaagttgatgtttgaattaaatattaaaagctaaacaaaagcttagttccaaaggga

SEQ ID NO: 27415 - DNA, 201 bp, Homo sapiens
tgcccttggggagctcttcccacagacaaacaatgggagtgtgttggggtagacaccccccgaacctagggatccggtggtgggagaagggtgcaatccargaaggaaagttgatgtttgaattaaatattaaaagctaaacaaaagcttagttccaaagggaactaagacactgtagtcccaaacaatgaaactggcttg

SEQ ID NO: 27416 - DNA, 201 bp, Homo sapiens
agtttacacacattcactggacaacttgtgtttttggcatactcagctgtatgtttttcctcactctatttcctccagataaggactagaaattctagccrtgctttgaggccaactcaaatgtaacctcctctggggtgactttcctgggcattgcaggataagtgcctggatggccttgataacccagctcttccccca

SEQ ID NO: 27417 - DNA, 201 bp, Homo sapiens
gattctcctgcctcagcctcctgagtagctgagattacaggagcaagccaccaatgcccggcttatttacatttttgaaagatatgttacggcatgatttmttgactttggcacgctttatatttttggccagataactgttgttggggctgtcttgtgcattgtaggacattaagcagtttccttgacctctacacatga

SEQ ID NO: 27418 - DNA, 201 bp, Homo sapiens
tttgaaagatatgttacggcatgatttcttgactttggcacgctttatatttttggccagataactgttgttggggctgtcttgtgcattgtaggacattwagcagtttccttgacctctacacatgagatgaccgtatcacttcccttctcagttgtgtcaactaacagtatctcctggggagcaaaattaccttggttg

SEQ ID NO: 27419 - DNA, 201 bp, Homo sapiens
cagataaggactagaaattctagccgtgctttgaggccaactcaaatgtaacctcctctggggtgactttcctgggcattgcaggataagtgcctggatgrccttgataacccagctcttcccccatttttcacttgtagttctcagaataatgctagaatgtgctggaaacaacattctgagataaggaaaagctgtcca

SEQ ID NO: 27420 - DNA, 201 bp, Homo sapiens
gacaaacaatgggagtgtgttggggtagacaccccccgaacctagggatccggtggtgggagaagggtgcaatccaggaaggaaagttgatgtttgaattraatattaaaagctaaacaaaagcttagttccaaagggaactaagacactgtagtcccaaacaatgaaactggcttgagtcaaggatatggatacacttcc

SEQ ID NO: 27421 - DNA, 201 bp, Homo sapiens
atatttttggccagataactgttgttggggctgtcttgtgcattgtaggacattaagcagtttccttgacctctacacatgagatgaccgtatcacttccyttctcagttgtgtcaactaacagtatctcctggggagcaaaattaccttggttgggaacaactggtctactgaatatagaattctaatttcatttaacat

SEQ ID NO: 27422 - DNA, 201 bp, Homo sapiens
ctcctctggggtgactttcctgggcattgcaggataagtgcctggatggccttgataacccagctcttcccccatttttcacttgtagttctcagaataaygctagaatgtgctggaaacaacattctgagataaggaaaagctgtccagaacatgccagattctgtttctgttcctcttaggacaagatgtcctccaatg

SEQ ID NO: 27423 - DNA, 201 bp, Homo sapiens
aaatattaaaagctaaacaaaagcttagttccaaagggaactaagacactgtagtcccaaacaatgaaactggcttgagtcaaggatatggatacacttcmtattcttcagaaaattgtcaatgatgattgtatcttgacatcacactttaaaacatgcagggagaatttcctgacaagattctgaagtatagacactctg

SEQ ID NO: 27424 - DNA, 201 bp, Homo sapiens
tgataacccagctcttcccccatttttcacttgtagttctcagaataatgctagaatgtgctggaaacaacattctgagataaggaaaagctgtccagaayatgccagattctgtttctgttcctcttaggacaagatgtcctccaatgctgtggtccagtgatcccagtttccccccagggtataaaacccagagtggag

SEQ ID NO: 27425 - DNA, 201 bp, Homo sapiens
gagtgtgctatggtctgaatatttgtgtccctccgaaactcgtatgttaaaatgctaacccccaaggtgatggtattgggatgtggggcctttgggaggtrattaggtcacaaggatggagccctcgggatgggattagtgcccttatagaagacaccccagagaggtccctcccttatcccttccaccacatgaggatac

SEQ ID NO: 27426 - DNA, 201 bp, Homo sapiens
gctgagctggccaagcccttatgctccaccatccattggtcactcgatatgaccttccccaggcacgagtgtgctatggtctgaatatttgtgtccctccraaactcgtatgttaaaatgctaacccccaaggtgatggtattgggatgtggggcctttgggaggtaattaggtcacaaggatggagccctcgggatggga

SEQ ID NO: 27427 - DNA, 201 bp, Homo sapiens
gagttaggtggacttttagaaacatgccaagcatggctgagctggccaagcccttatgctccaccatccattggtcactcgatatgaccttccccaggcaygagtgtgctatggtctgaatatttgtgtccctccgaaactcgtatgttaaaatgctaacccccaaggtgatggtattgggatgtggggcctttgggaggt

SEQ ID NO: 27428 - DNA, 201 bp, Homo sapiens
accaagagctctggagttaggtggacttttagaaacatgccaagcatggctgagctggccaagcccttatgctccaccatccattggtcactcgatatgascttccccaggcacgagtgtgctatggtctgaatatttgtgtccctccgaaactcgtatgttaaaatgctaacccccaaggtgatggtattgggatgtggg

SEQ ID NO: 27429 - DNA, 201 bp, Homo sapiens
tcttgtaagggcactaatcccaccacgggggccccaccctcatgacctcatgtaaacctaattatttcctgaagactccacctcaaatgccatcacattgrgggttacagcttcaacatatggatctgagggggacccaagcctccagtacatgacactccttttgttttcctcattgcaccatctgctactgggttctgt

SEQ ID NO: 27430 - DNA, 201 bp, Homo sapiens
aaatacttactgactgcctgctatgtgccaggcactgttctaaaatttgagaatatatcctcgaataaagcccaaaggctccccattctcctagagtctacattccattctattgaagtggagagacacactctaaacagataaataaacaaggctgagaggtcagtaaaacagcatgttgcatgcgagtgaggcggggtc

SEQ ID NO: 27431 - DNA, 201 bp, Homo sapiens
caaggcgggaggatcacctgaggtcaggagtctgagactagcctggccaacatggcaaaactccacctctactaaaaatacaaaaattagctgggtgtggwagcaggcacctgtaattccagctatttgggaggctgaggcaggagaatcgcttgaacccaggaggtagaggttgcagtgaaccgagattgtgccactgca

SEQ ID NO: 27432 - DNA, 201 bp, Homo sapiens
aatacttactgactgcctgctatgtgccaggcactgttctaaaatttgagaatatatcctcgaataaagcccaaaggctccccattctcctagagtctacattccattctattgaagtggagagacacactctaaacagataaataaacaaggctgagaggtcagtaaaacagcatgttgcatgcgagtgaggcggggtct

SEQ ID NO: 27433 - DNA, 201 bp, Homo sapiens
aaggcgggaggatcacctgaggtcaggagtctgagactagcctggccaacatggcaaaactccacctctactaaaaatacaaaaattagctgggtgtggargcaggcacctgtaattccagctatttgggaggctgaggcaggagaatcgcttgaacccaggaggtagaggttgcagtgaaccgagattgtgccactgcac

SEQ ID NO: 27434 - DNA, 201 bp, Homo sapiens
atacttactgactgcctgctatgtgccaggcactgttctaaaatttgagaatatatcctcgaataaagcccaaaggctccccattctcctagagtctacattccattctattgaagtggagagacacactctaaacagataaataaacaaggctgagaggtcagtaaaacagcatgttgcatgcgagtgaggcggggtcta

SEQ ID NO: 27435 - DNA, 201 bp, Homo sapiens
cactgcactccagcctgagtgacagaatgagactgtctcaaaaaaaaaaaaataaataaatataaaagaagtctaattttagaaagttcaacttcctgatractgctctaagacagagtggttgcaacatggaccctaggtaactcaatgatgtgatcagcgctatagaatattggctgatgttggtcacaaaagtatttt

SEQ ID NO: 27436 - DNA, 201 bp, Homo sapiens
ctcctgtttaaacctggaccgcagacctctcacttttttcctcgcggctgatgtctggttccaggtggtagatctgtcttacgacggtcccataccctaamtccagcatgcctggtggctcagttctgacccagtgcctgtcctaaacattatgttctggacgctattgatctgcctgatccccagggcctctcctttgcc

SEQ ID NO: 27437 - DNA, 201 bp, Homo sapiens
tacttactgactgcctgctatgtgccaggcactgttctaaaatttgagaatatatcctcgaataaagcccaaaggctccccattctcctagagtctacattccattctattgaagtggagagacacactctaaacagataaataaacaaggctgagaggtcagtaaaacagcatgttgcatgcgagtgaggcggggtctaa

SEQ ID NO: 27438 - DNA, 201 bp, Homo sapiens
tcctgggctctaggaatcctcctactttagcctctgagtagctgggactataggtgcacaccaccatgctagctaatttttaaattttttttttttttttytttttgaggcagaatcttgctctgtctcccaggctggagtgcagtggcacaacctccgctcactgcaagctccgcctcccgggttcacgccattcccctg

SEQ ID NO: 27439 - DNA, 201 bp, Homo sapiens
acttactgactgcctgctatgtgccaggcactgttctaaaatttgagaatatatcctcgaataaagcccaaaggctccccattctcctagagtctacattccattctattgaagtggagagacacactctaaacagataaataaacaaggctgagaggtcagtaaaacagcatgttgcatgcgagtgaggcggggtctaaa

SEQ ID NO: 27440 - DNA, 201 bp, Homo sapiens
ttggttcccagagtgacctcttgtgctaggagctttacccatgcccgttttgcaggtgaggtaactacacagagcttggagaagggccataacttgctcaktgtcatggctaaggtagtggccatggcaggatgcaaatgtgagactgtataattcttgagtcctaaagtcctatcacttatccatcaaggactctcagaa

SEQ ID NO: 27441 - DNA, 201 bp, Homo sapiens
tgaggcagctctccggagccttctgtataagggcactaatcccattaatgggggctccaccctcaagatctaatcacctcccgaaggccccacctcccaaygccatcaccttgggcatttggatttcaacgtgtgaattttggagggacacagatattcagaccatagcagctgtgggtaaagattcaaagactcagaaac

SEQ ID NO: 27442 - DNA, 201 bp, Homo sapiens
ggaggagccgggtagtctggtgggttccaggctgaagcacaaagagctggtggctatggaggattcatgagcaatgggactgaggaactagatgagcgttktttcataaggccttgtgggttgacaagaagagtctgaactttatctgaaaattctagaaaactttgaggaaacccctgttggtttgacatgatcagctgt

SEQ ID NO: 27443 - DNA, 201 bp, Homo sapiens
tcctggcacacttttcaaaagagaaagtatttaatacacatctcttgctcttagcggctcaccctggttctcaacaggagccccttttatctctaaggttyaaacaccatctctttaatgatctattctggaattttcctatcatttgctaccaagctatcaatgctattatcaaagctaccaattgttatcaatggcaat

SEQ ID NO: 27444 - DNA, 201 bp, Homo sapiens
cttgctatgtgagacaagttattcaggcctcagtcctccaagtataaaacaaaggtactaagaaaatgttcagggtgttggaaacgctctgtcagccaaamaaatgtaaagctcctgaaatctaatataaaagtactctatgaatatgatgtatttgtcaggcataagaattttctagaaaataaaacatttcatgacagg

SEQ ID NO: 27445 - DNA, 201 bp, Homo sapiens
ctcttagcggctcaccctggttctcaacaggagccccttttatctctaaggttcaaacaccatctctttaatgatctattctggaattttcctatcatttkctaccaagctatcaatgctattatcaaagctaccaattgttatcaatggcaatttccgaaacatacccttttgaaatttgggacattttcttaaccccta

SEQ ID NO: 27446 - DNA, 201 bp, Homo sapiens
catggagatggcgctgaagatggtaaagaggagacagatttgagatacactatggaaggtgaacttgcaggagacttggctgcaacttgcaatcattattmgatggggtcttgctatgttgaccaacctggagtacagtgactattcacagacttgatcatagcacactatagccttgaactgctgggctcaagcaatcct

SEQ ID NO: 27447 - DNA, 201 bp, Homo sapiens
tctccaagggagatttaaatttgcaggcaggattgaagcagaatgagaaataggaaaaagatggagctgatatgtacaaatatgtaagacagatggagtcyctgccaggctgtaaatagcataggtcctaaaccaaactcatcatgttcctctgcaaaagcacttcctcccacagccttcctgttgcgtctcggtcccgca

SEQ ID NO: 27448 - DNA, 201 bp, Homo sapiens
aatttttttttttagatggagtctctctctgttgcccaggctggagtgcagtggtgcaatctcagctcactgcaacctccacctcctgagttcaagcgatkcttctgcctcaacctcctgagtagctgggaccacaggaacatgccacaacctctggctaatttttgtatttttttgtagtgacggggtttcatcatgttg

SEQ ID NO: 27449 - DNA, 201 bp, Homo sapiens
ccacctttcccttccacactaccctaccagaggttctccatgagggctccacccctgccacaaacttcttcctggacatctgggcatttccatacatcctytgaaatctaggcagaggttctcaaacctcaattattaacttctgtgcacctgaaggcccaacacaatgtgtaaactgccaaggcttgggacttgcaccct

SEQ ID NO: 27450 - DNA, 201 bp, Homo sapiens
aaattaacatttaatactggactgttctttctgttcttaaaatcagctcctccagccaggacaggccctaaactctgctcttgaaagtaggttctcaccaratttatcccaagaacaacttccttttatcttccccagatgttccggaatatttgggctcttttccctgaaatggcacttcccacatgttggatacggccc

SEQ ID NO: 27451 - DNA, 201 bp, Homo sapiens
tgccatacaagtagtcagtaagtggcagacacaaatttctaactcagtccttgttcaagctattagttcctaactcttaacagtgcaccaagctgccacagggcaagtctttgctgtagactcaaggatgagttttaagacaacaaataaaagcattaatggaagtcagtatcattaaatctaaatttaaataatgtgctc

SEQ ID NO: 27452 - DNA, 201 bp, Homo sapiens
tccggtgatccacccgcctcagcctcctaaagtgctggaattacaggcatgagttacagcgcctggacaagttcatgttttaaattgtttggatgagggcrggcgtggtggctcacacctgtaatcccagcacattgaaaggcagaggcaggtggatcatgaggtcaggagaccaagaccatcctcgccaacatagtgaac

SEQ ID NO: 27453 - DNA, 201 bp, Homo sapiens
ggggtgcagcaaggctcaggacgaacccaggcagcactgggtggccttgatctgataccgaagcctggcctcagctcttgaacttggctcccctgcacccygaggaaggaactaaccctgggccctgtcttgccttctcctggacctcttactttcttgcctcatctcccctatggattctgtgcaatcaaaacagaccct

SEQ ID NO: 27454 - DNA, 201 bp, Homo sapiens
tagtaatataccacaagtttcccttacttaacagaaattcatttaaccaaattctttacttgaaatatataaattagggtaccacttcactccacagaatsgcatttccaaatttgaagtcctgtgcttattcttgcttctgtaactggcttgaattccaaattccaggttttccatcataactacctgcctggtaatttg

SEQ ID NO: 27455 - DNA, 201 bp, Homo sapiens
gaggctgaggcaagagaatcgcttgaacccaggaggtggaggttgcagtaagccgagatcacgccactgcactccagcccaggcgacagagcaagactctrtctcaaaaaaagaaaaaagaaaaatcatccaagggacaatttatccttaaccatacaaaacttacagcctcaagaggaagatgagctttggctactgttt

SEQ ID NO: 27456 - DNA, 201 bp, Homo sapiens
taaaagacaacttcaaatgaatggctgtgttttgagagcacattgctttgtgaatgctttcaagctttttctattttaacttcctctgaaatccaagaggataatgtttttaccaaaaatatttacaaggaaatgggaaatttaaatgatccccaaaggaaaccaatttttaaaaacccttaaagccctattattaggcaa

SEQ ID NO: 27457 - DNA, 201 bp, Homo sapiens
aaaagacaacttcaaatgaatggctgtgttttgagagcacattgctttgtgaatgctttcaagctttttctattttaacttcctctgaaatccaagaggataatgtttttaccaaaaatatttacaaggaaatgggaaatttaaatgatccccaaaggaaaccaatttttaaaaacccttaaagccctattattaggcaaa

SEQ ID NO: 27458 - DNA, 201 bp, Homo sapiens
aaagacaacttcaaatgaatggctgtgttttgagagcacattgctttgtgaatgctttcaagctttttctattttaacttcctctgaaatccaagaggataatgtttttaccaaaaatatttacaaggaaatgggaaatttaaatgatccccaaaggaaaccaatttttaaaaacccttaaagccctattattaggcaaac

SEQ ID NO: 27459 - DNA, 201 bp, Homo sapiens
gttctcaaacctcaattattaacttctgtgcacctgaaggcccaacacaatgtgtaaactgccaaggcttgggacttgcaccctctgaaacaatggtctgmgctgtacattggcccattttagccatggctaggatgcagggcaccaagtcctgagactggacaaagtagcaagaccctggatctggcccatgaaaccagt

SEQ ID NO: 27460 - DNA, 201 bp, Homo sapiens
ttccttccttccttccttccttcctccctccctctctcccttttttctttctctctccctttttcattctttctctttccttccctgtcctcctccctccygccctccctctcttcctttctctttctttctctcccttcctcccttctttccttctttccatctctttctgttttttcattcttaaatttttctctttcc

SEQ ID NO: 27461 - DNA, 201 bp, Homo sapiens
tccattctcacattgctataaggaaatacctgagactgggtaatttataaagggaagatgtttaattgactcatggttcctgtggctgggaaggcctcagsaaacttacaatcatggtagaaggcgaaaaagccaccttcttcacatggcaaaaaggaaagagccccttataaaaccattagatctcatgaaaactcactc

SEQ ID NO: 27462 - DNA, 201 bp, Homo sapiens
tccctccctctctcccttttttctttctctctccctttttcattctttctctttccttccctgtcctcctccctcccgccctccctctcttcctttctctytctttctctcccttcctcccttctttccttctttccatctctttctgttttttcattcttaaatttttctctttcctaacttccttccctctctcctttc

SEQ ID NO: 27463 - DNA, 201 bp, Homo sapiens
gattacaattcaagatgagatattgggtgaggacacagccaaaccatatcaatggctcactgcagcctcaacctcctgggttcaagcaatcctcccacctsagcctctctcctctggagtagctgtgattacaggcacataccaccgcactcagctaaaattttaatttttagctgggtgcggtggctcacacctgtaatc

SEQ ID NO: 27464 - DNA, 201 bp, Homo sapiens
gagggtaaggcaggagaatcacttgaacccaggaggcagaggttgcagtgagctgagatcgcgccattgcactccagctggacaacaagagcaaaactccmcctcaaaaaaaaaaaaaaaaaaaaagagagattgagcatatgtttgataatcaacgaacagtccattttaaaagttagacaggacatattcctgaagcca

SEQ ID NO: 27465 - DNA, 201 bp, Homo sapiens
gtagctgtgattacaggcacataccaccgcactcagctaaaattttaatttttagctgggtgcggtggctcacacctgtaatctcagcattttgggaggcygaggccggcggattgcctgaggtcaggggttcaaaaccagtctggccaacatggtgaaaccccatctctactaaaaatacaaaaaagttagctggatgtg

SEQ ID NO: 27466 - DNA, 201 bp, Homo sapiens
cagccaggacaggccctaaactctgctcttgaaagtaggttctcaccaaatttatcccaagaacaacttccttttatcttccccagatgttccggaatatytgggctcttttccctgaaatggcacttcccacatgttggatacggccctttgccctttctcaggctgtgtctgcattcttctctcctcttttcaactacc

SEQ ID NO: 27467 - DNA, 201 bp, Homo sapiens
gctattcaggaggttgagacacaaaaattgcttgaacctgggaaacggaggttgcagtgagccaagattgcaccactgcactccagcctgagtgacagaaygagactgtctcaaaaaaaaaaaaataaataaatataaaagaagtctaattttagaaagttcaacttcctgatgactgctctaagacagagtggttgcaac

SEQ ID NO: 27468 - DNA, 201 bp, Homo sapiens
tcagctcactgcactccagcctgggtgacacagcgagactctgtctcaaaagaagaaaaaattattttttagagacacagtctccctatgttgcccaggcyggtctcaaactccaaagcaatcctcccacctcagcctcctaaagtgctgggattacagatgtgagccaccatgcccagccttgcattctgtgttcttaaa

SEQ ID NO: 27469 - DNA, 201 bp, Homo sapiens
tattccatagtcaaaaagtttgagaagcaattgtttaaacaaatttaaatagcttcctttactgcaggacttttcagagtctttgatttcaataggcatcrttggtcctttaagataggaagatagtactgtatggggcattttcaaaattgatttgattaaaaagcactaccccttgtcttactgtgctcaggctgcgat

SEQ ID NO: 27470 - DNA, 201 bp, Homo sapiens
tcctcccacctcagcctcctaaagtgctgggattacagatgtgagccaccatgcccagccttgcattctgtgttcttaaataatagtgtgaccttgagtgragctcagctagaacactctagtacttctactccaccccattctattgctctttgatttctatccctcataatggagtcattcaggagaggaaagaacaga

SEQ ID NO: 27471 - DNA, 201 bp, Homo sapiens
attgagaaggtaaacttgaacatttttctttaaaataaaaacacaacaaaaagagaaacaatacaagatgattttaaaaagcaaaccaaggggaaattttyacagtctattaatttctagatgtaataaaattaaaacacagattcttgcttaacagatcccaggagcattcagagttatggatcaggttcttcctgagag

SEQ ID NO: 27472 - DNA, 201 bp, Homo sapiens
caaaaattgcttgaacctgggaaacggaggttgcagtgagccaagattgcaccactgcactccagcctgagtgacagaatgagactgtctcaaaaaaaaawaaataaataaatataaaagaagtctaattttagaaagttcaacttcctgatgactgctctaagacagagtggttgcaacatggaccctaggtaactcaat

SEQ ID NO: 27473 - DNA, 201 bp, Homo sapiens
tgatttttatggtcttggatgttgttcatgatgacaagggtgtacatgtcccagacgccatgctgcagtgctgcacatttcaaagatactgtgtttttgcttttttttttgagacagggcctcactctgtcacccaggctagagtgcagtggcgtgatcttggctcagtgcaacctctgcctcccaggctcaagtgatcct

SEQ ID NO: 27474 - DNA, 201 bp, Homo sapiens
aatttacttgcagatatagaaaacacaggtaacagtggcttaaagatctgggctttttctgtcaccaaacaagaagtgtgaaggttggtgaccctgagctsgaccagagacctaaacaagcagatggatgcaaggtctctgtgactctctgggcctttctctcatgtctggtcacaaaagggctgccgccgccattgcatc

SEQ ID NO: 27475 - DNA, 201 bp, Homo sapiens
ataaatcccatttagtcatggtgtatgtttatgtttatttatttattttactattttaaaaatatttttatgttatatatattttaccactatttatttaytttactattaaaaatagtggtaaaatatatataacataaaatttgccatttgaaccattttcaagtgtaaaattctttttatatgtgtctggattcggtt

SEQ ID NO: 27476 - DNA, 201 bp, Homo sapiens
gtgggcagattgcttgaggtcacgagtttgaggccagcctggctaacatggtgaaaccccatctctactaaaaatacaaaaattagccaggtatggtggcrtacacttgtaatcccagctacttgggaggttgaggtgggaggatcatttgaaccccagaggtggaggtttcagtgagccaagatcacgccactgcactcc

SEQ ID NO: 27477 - DNA, 201 bp, Homo sapiens
cttattgattctaatgctatatggtattatcactctcactctgaaccaaaataaaatctcagaacactttaatttcatttactctcagcttgacctatatrcaattcttgtaattttaattctatatgtattttaaaccacataaggaattgttactgttgcttaatgttattatcatccgtttaagtttactcacacatt

SEQ ID NO: 27478 - DNA, 201 bp, Homo sapiens
tttcttttacctgaaaagatcaggtaaatatttgccgtttatttcctttgatgtagatctactgatagccaattatctcaacgttcatttgtctgcaaatwttttttcattttatatgcgttcttcttttttagagatagggtctcactacatggcccagactgttttcagactcatggccttaagtgattctcctgcctc

SEQ ID NO: 27479 - DNA, 201 bp, Homo sapiens
tacctgaaaagatcaggtaaatatttgccgtttatttcctttgatgtagatctactgatagccaattatctcaacgttcatttgtctgcaaatattttttcattttatatgcgttcttcttttttagagatagggtctcactacatggcccagactgttttcagactcatggccttaagtgattctcctgcctcagcctcc

SEQ ID NO: 27480 - DNA, 201 bp, Homo sapiens
cactacatggcccagactgttttcagactcatggccttaagtgattctcctgcctcagcctcctgagtagctgagattacaggagcaagccaccaatgccyggcttatttacatttttgaaagatatgttacggcatgatttcttgactttggcacgctttatatttttggccagataactgttgttggggctgtcttgtg

SEQ ID NO: 27481 - DNA, 201 bp, Homo sapiens
aacatatttaagatataatttcattgtcctctggctttcactattaccattgaaaagtaagctatatgtccaacgtttggtcttaggtactttgactggctttttttttttttttgagacagagtctcactctgctttgactggcttttaacatttttatctctgattttggtattctgtagcatcacaatgatggctata

SEQ ID NO: 27482 - DNA, 201 bp, Homo sapiens
ggctcattttaatactttcagcaggctttggagtgtaggagccccaagttgtctggttgccaccctggggtgattagggcagggaaatatctgcttaatgkgtaaacacttgggaaaggaggtagttgggggtgtggtctttgggctggttggtttgcttatgaaagatgtgcttgtggggggtcatttgctatctgtaat

SEQ ID NO: 27483 - DNA, 201 bp, Homo sapiens
atgaaggcccataagctatgttgaaatacttagaagttatctatcaagtgaataaactgtcaaatatatatacataactacatggcaggctagaattcctrggctctatagcccaagccagaaggtaatgggacagcaagagctaacccccagctgccatccttcccctttgtcttcccactttatgccatgaggaacttg

SEQ ID NO: 27484 - DNA, 201 bp, Homo sapiens
tggggaagagtttccaggaggacgcatgcccttgaccttgcagactcataattttaaaacatttatgactaactataatgttaaatctgtgactcagtgcrgaccttgcctgcactgaggggaagggcagcagaggatggccggggcagaaccctctaagctgacatttctccaacattcatgggaatagaaatttcctgg

SEQ ID NO: 27485 - DNA, 201 bp, Homo sapiens
gcatgcccttgaccttgcagactcataattttaaaacatttatgactaactataatgttaaatctgtgactcagtgcagaccttgcctgcactgaggggargggcagcagaggatggccggggcagaaccctctaagctgacatttctccaacattcatgggaatagaaatttcctgggatctgaatcagtaggtctaggg

SEQ ID NO: 27486 - DNA, 201 bp, Homo sapiens
taatttcattcccttttcggttaaatgatattccattgtatggaaataccacatgttgtttatccattcttcagtttatagaaatttaggttatttccacstttgggctattgtgaataatactgctaagaacattcatatacaagtttttgtgtgaacatacattttcaattaccttggatatataccaagaagataata

SEQ ID NO: 27487 - DNA, 201 bp, Homo sapiens
gctcaggctgcgattacaaaataccatagactgggtggcttaaacagcagacatttacttctcatggctctggaggctgggaagttcacggtcaagggccrgcagattgagttcctggagagggcactcctcctggcctgcagatggctgccatctcactgtgtgctcatgttctggagagtgacccagcccttgtctctt

SEQ ID NO: 27488 - DNA, 201 bp, Homo sapiens
ggaattgtgtaatatgtggtctttgcgtccgggttctttcaactaatataatgctttcaaaagtcattcatgttgtagcatgtaatttcattcccttttckgttaaatgatattccattgtatggaaataccacatgttgtttatccattcttcagtttatagaaatttaggttatttccacctttgggctattgtgaata

SEQ ID NO: 27489 - DNA, 201 bp, Homo sapiens
gcagattgagttcctggagagggcactcctcctggcctgcagatggctgccatctcactgtgtgctcatgttctggagagtgacccagcccttgtctcttyctcttcttgtaagggcactaatcccaccacgggggccccaccctcatgacctcatgtaaacctaattatttcctgaagactccacctcaaatgccatcac

SEQ ID NO: 27490 - DNA, 201 bp, Homo sapiens
agtctcactctgctttgactggcttttaacatttttatctctgattttggtattctgtagcatcacaatgatggctatagttgtgaatttttctttatttrgtttggaatttgttgggcttcttgagtctatgaatgaggcctttcacacgttttgaaaagcagccattaactctgtttttctatttaattattttgagat

SEQ ID NO: 27491 - DNA, 201 bp, Homo sapiens
tcatgacctcatgtaaacctaattatttcctgaagactccacctcaaatgccatcacattgggggttacagcttcaacatatggatctgagggggacccargcctccagtacatgacactccttttgttttcctcattgcaccatctgctactgggttctgtggaatgcacatagggacacacaaactccagtgcaggctc

SEQ ID NO: 27492 - DNA, 201 bp, Homo sapiens
gaaaacacacagaaagcattgggtgtcttttttttccttcaaataggaaagaaaaagaagaagaaaacatggttataaccatatgaagctactgccaggaygatatgttaataaaataaatttaagaaaagatttgttaaaatcaaaagaggaaaaatatttgtagaattataaaatcttatgtggtaagggatattgtgg

SEQ ID NO: 27493 - DNA, 201 bp, Homo sapiens
gaagtgtgaaggttggtgaccctgagctggaccagagacctaaacaagcagatggatgcaaggtctctgtgactctctgggcctttctctcatgtctggtmacaaaagggctgccgccgccattgcatccatgcttgctgctttaggcaggaacatacaaatctgaggtctgttcattttaacagaaaattggaaagaatt

SEQ ID NO: 27494 - DNA, 201 bp, Homo sapiens
gaccctgagctggaccagagacctaaacaagcagatggatgcaaggtctctgtgactctctgggcctttctctcatgtctggtcacaaaagggctgccgcygccattgcatccatgcttgctgctttaggcaggaacatacaaatctgaggtctgttcattttaacagaaaattggaaagaattggtatggaagtgttagc

SEQ ID NO: 27495 - DNA, 201 bp, Homo sapiens
tgctattttcattgtccttcctgcctcttcaattttacttgtgggattattttcttttacctgaaaagatcaggtaaatatttgccgtttatttcctttgwtgtagatctactgatagccaattatctcaacgttcatttgtctgcaaatattttttcattttatatgcgttcttcttttttagagatagggtctcactac

SEQ ID NO: 27496 - DNA, 201 bp, Homo sapiens
cattttcaattaccttggatatataccaagaagataataattgctgagtcatatagtaattctaggtttaactttttgagaacctgccagactcttttccrcagcggctgcatcattttacattttcaccagcaatgtatgagggttctaatttctccaagctctcaccaacatttgttattttgtactcttttatttttt

SEQ ID NO: 27497 - DNA, 201 bp, Homo sapiens
aggtatggtggcatacacttgtaatcccagctacttgggaggttgaggtgggaggatcatttgaaccccagaggtggaggtttcagtgagccaagatcacrccactgcactccaccctgggtgacagagtgagaccctgtctcaaaaaaaaaaatgaagaaagaaaacggcctgggtgctaaggacacacttagctactct

SEQ ID NO: 27498 - DNA, 201 bp, Homo sapiens
gagaatcacttgaaccgggaggtggaggttgcagtgaaccaatgttgcgtcactgcactccagcctgggcaataagagtgaaattccatctcaaataaatwaataaataaataaataaataaataaataaataaacatggcgagaaggaaaggagagctgtcttagcatttagtgtaaaatttttagttaatcacactgtt

SEQ ID NO: 27499 - DNA, 201 bp, Homo sapiens
ctaaggacacacttagctactcttagtcaaggtatctaggccttttcaacagacagagctaagaatagtgtattttaccataaaacacatcatgtgttctyattaatatttccaattcaaacttaggatagaaggtttttatttaacttctttgatttgatatttatatttttcttgcactgaaaaccttagctcctaatg

SEQ ID NO: 27500 - DNA, 201 bp, Homo sapiens
tgcagtgagctgagattgcaccattgcactccagcctaagcaacagagcaaggctcagtctcgaaaacaacaacaacaaaaataaataaataaacaaaatwaaaaaactctgtggcgagtgtatatcatcttatggtgaaatattctatgcatccaaaggcagagtgtgtcagctatagccattcattctaacaggagtgt

SEQ ID NO: 27501 - DNA, 201 bp, Homo sapiens
taaggacacacttagctactcttagtcaaggtatctaggccttttcaacagacagagctaagaatagtgtattttaccataaaacacatcatgtgttcttrttaatatttccaattcaaacttaggatagaaggtttttatttaacttctttgatttgatatttatatttttcttgcactgaaaaccttagctcctaatga

SEQ ID NO: 27502 - DNA, 201 bp, Homo sapiens
caccatgtttgccaggctggtctcaaactcctggccttaagtgatccacccatctcagcctctgaaaatgctgggattacaagcatgagccatcgtgcccrgcctattcctctcctttataatttttaaattgtgataaaattaaaatatgcacaacataaactttaccacattgaccatttttgagtgtatagctcaata

SEQ ID NO: 27503 - DNA, 201 bp, Homo sapiens
gctcatggcagcagaaaaaagtacagacaccacggcaaagccactgaaggagatctgactgcattaatgagccattttattaaatgggtagttggcaagamaaaaagtttattcaataagttggcaacaccaagttaaagagagaagttaagtaggtcattaagacaccacagtcactaatatttagagcttgaacatagt

SEQ ID NO: 27504 - DNA, 201 bp, Homo sapiens
cctctcctttataatttttaaattgtgataaaattaaaatatgcacaacataaactttaccacattgaccatttttgagtgtatagctcaatagtgttaastacgttcacattgttgcacaagcaatttccagaacttttttatcttgcaaaactgaaactctgtacccattaaagaactcatttctgcctctgccactgc

SEQ ID NO: 27505 - DNA, 201 bp, Homo sapiens
ttgagatggagtctcactctgtcacccaggctgagtgcagcggcacaatcttggctcactcagcctcccgggttcaagcgattctcctgcctcagtctccygagtagctgggactacaggcgtgtgccaccacacccggcttattttttgtatttttagtaaagacggggtttcaccatgttagccaggatggtctcgatc

SEQ ID NO: 27506 - DNA, 201 bp, Homo sapiens
cagcagtgtctagcaacttacctaagatctcaccactagttagtagcagggatagaactggaaaataatctgctgtctcctttccattgatctgtgctgtkcccttgctctccttgtgtaaatgctgaagcggatcatcatgagcccaggatgagcaagggaggcccgttctgaaagttcaatctcaagactgaacacact

SEQ ID NO: 27507 - DNA, 201 bp, Homo sapiens
ttttcacttggcataatgtcttcaattttcatccatgttgtagcatgagtcagagcttccttgcttttcaagactgaataacattccatcgtatggatagrccacatcttgtttatccattaatccgtccatgccaggaatacgttttaagaagtccatgaaaatgcttggagttgtgtttaaaagagttttataagtcat

SEQ ID NO: 27508 - DNA, 201 bp, Homo sapiens
tcattggcctcccaaagtgttgggattacaggcatgagccactgcacctaaccttttttttctcttttaaacagagacagagtctcactcttgtcaccagsctggagtgcaggggcgccatcacagctcactgcagcctcagcctctggggctcaatcatcatggctcactgcagcctcagtcttcccgcctcagcctccc

SEQ ID NO: 27509 - DNA, 201 bp, Homo sapiens
tcaaaagaaaaactaaatattaatatctagctagtgatatgcttgctgaaggatttaggagaaattgtactgaggcctgcaatttatttttaaatattccaaaaaaaaaaaaaaagattgatagagggagggagagggggaagaagagagacagagcgagagagcaaagcaaataaaatgtttatggtagaatgtaggtgt

SEQ ID NO: 27510 - DNA, 201 bp, Homo sapiens
gagcacactctagaagcagatatggtagtactaggccatgggagaaaatccagtgatagcaagcagccctcccactacagagctcataaaatgaggttctytctttttcaaactccagatactgataacaaatacattcaaaaaccaacagacaaaaaataaaaggctaaaagaaactcatcatcaactcctttagaccaa

SEQ ID NO: 27511 - DNA, 201 bp, Homo sapiens
ttaaaaggaattctccaggctaattaagcaaaaaaggcatcctgggtggaagaacactgccatgcatgcttgctatgatccagcagagtattccaaggtgcagcatggcaggtgatgggctgaagatcctaggataccttttgtgtcatgataaaatacacagatttcattctgcaagtaatgaggagcccgtgaagggtt

SEQ ID NO: 27512 - DNA, 201 bp, Homo sapiens
gatactgataacaaatacattcaaaaaccaacagacaaaaaataaaaggctaaaagaaactcatcatcaactcctttagaccaaattttaaaatatagtgmgataggccagacacagtggctcacatctgtaattccagcactttgggaggccgaggtgggtagatcacttgaggtcaggagtttgagaccagtgtgtcca

SEQ ID NO: 27513 - DNA, 201 bp, Homo sapiens
gcccaggagtttgaggctgcagtgagctacgatcgtaccacagcacttcaagctgggtgacagagtgaaaacctatctcaaaaaaaaaaaaaaaaaaaaggagagagagagagaatcaagggtctctctttgggcattgggttcctccctagaacttccgtgtgtattactaacaacacaattgagagcactaggaaaaat

SEQ ID NO: 27514 - DNA, 201 bp, Homo sapiens
cccaggagtttgaggctgcagtgagctacgatcgtaccacagcacttcaagctgggtgacagagtgaaaacctatctcaaaaaaaaaaaaaaaaaaaaggagagagagagagaatcaagggtctctctttgggcattgggttcctccctagaacttccgtgtgtattactaacaacacaattgagagcactaggaaaaata

SEQ ID NO: 27515 - DNA, 201 bp, Homo sapiens
gactcataattttaaaacatttatgactaactataatgttaaatctgtgactcagtgcagaccttgcctgcactgaggggaagggcagcagaggatggccrgggcagaaccctctaagctgacatttctccaacattcatgggaatagaaatttcctgggatctgaatcagtaggtctagggcagggaccaagattctgcg

SEQ ID NO: 27516 - DNA, 201 bp, Homo sapiens
cacacaaagagggaggcaggcctgcccatcctcccggctttgtgcagatagatttggactcgtggtagtgtcatctttgaatgtgcattgcagtttcacawccatacctacctcaccaaataatcctagaatagtgaacttcaacacaaatgtcccctgcaatttcaggggcttaagtggtccctttatgtaacaggcaaa

SEQ ID NO: 27517 - DNA, 201 bp, Homo sapiens
ttgtgctcatgatgtgaaggatattggactatagtttgcacttaggatttgctattttgtataaggcaagaccaccttgcatttcgatgtcagttactcaytaaagatgtggatctattccttgagtcaatcacacgttctaatagcttggaatggggagaaaaggccccctttgggctccacaggggaaggcagggctcc

SEQ ID NO: 27518 - DNA, 201 bp, Homo sapiens
ttttttttctttcttttttattaaaattttttgtagagacatggtctcactatgttgcccaggctggtcttcaactactgagctcaagcaatcctcctgcyttggcctcccaaagtgctaggattataggcatgacccactgtgcccggcctcttaattttttaagcatcacaggttgtatccccagaaaccagactctaa

SEQ ID NO: 27519 - DNA, 201 bp, Homo sapiens
tttatgtaacaggcaaaggattagggccagctgggaaaatccaagtgtttaaaacctgttcagcacttttgcagccaaagagtaagttgccaaacattttyctctcaaaagaaaacaggccactgaatactagaaaggggaattctggaaggaaagaaaaaatcaaagaagagaagagaagtgaagggacatcttgggaaa

SEQ ID NO: 27520 - DNA, 201 bp, Homo sapiens
gttgtcagggttaaatgaaatgataatgtaaaacgctttacatcatgagcagctgtcacaatcataagttagccgtcatgttattcattgatgactttaaycatgtagcataaggtcactggtttttaaatgaatgtatacagtgtgttttacgaagtgctttcacatacattgtcatagttctccagaagactgatactc

SEQ ID NO: 27521 - DNA, 201 bp, Homo sapiens
ttatatataaagcagctgaggttcactggggaccatatttctaacttcctatgggcttctgcaaatctttttggggaaatggccagcatttggtgctagcycccaaatttgtgtttaagtcccagcttggccatgttttgtggaccttaggtgaatccctggcatttgcccttgtttccctttcttagctgtaggataacg

SEQ ID NO: 27522 - DNA, 201 bp, Homo sapiens; identical to SEQ ID NO: 6803

SEQ ID NO: 27523 - DNA, 201 bp, Homo sapiens
ctgaatatagaattctaatttcatttaacatatttaagatataatttcattgtcctctggctttcactattaccattgaaaagtaagctatatgtccaacrtttggtcttaggtactttgactggctttttttttttttttgagacagagtctcactctgctttgactggcttttaacatttttatctctgattttggtat

SEQ ID NO: 27524 - DNA, 201 bp, Homo sapiens
ctactgaatatagaattctaatttcatttaacatatttaagatataatttcattgtcctctggctttcactattaccattgaaaagtaagctatatgtccwacgtttggtcttaggtactttgactggctttttttttttttttgagacagagtctcactctgctttgactggcttttaacatttttatctctgattttgg

SEQ ID NO: 27525 - DNA, 201 bp, Homo sapiens
tctagagtacttgccctaaaactccaagccattcactacaaaaatactcactggccacctggcaggtgaataaccatgccagcggcaaaggagaaatacayacacttcctatcatttaagagttttcattctacactcctcttagatcttggataagtcattcatgctggcattgtttatgataaaagtagatttacaaag

SEQ ID NO: 27526 - DNA, 201 bp, Homo sapiens
aatttttggtagagaaccaacatgacaacaagagccaagcattatttccagctttcatttgattacaaatctgtgacccattgacaaactgtttatttcttttttttttttttttttttttttttttgagacatgcaatggcacaatcttggctcactgcaacctctgcttcctgggttgaggcgattctcctgcctcagc

SEQ ID NO: 27527 - DNA, 201 bp, Homo sapiens
atttttggtagagaaccaacatgacaacaagagccaagcattatttccagctttcatttgattacaaatctgtgacccattgacaaactgtttatttcttttttttttttttttttttttttttttgagacatgcaatggcacaatcttggctcactgcaacctctgcttcctgggttgaggcgattctcctgcctcagcc

SEQ ID NO: 27528 - DNA, 201 bp, Homo sapiens
ggtgctttcttttcctttgattggcaggtgtttcatcagatcttctgggatacttctatttaggagtaagatttctaactaattaaagtgaataaacacatttttttcaaaataatgtaccctgttacatagaaaacagggcttgaaaggaattgttaagaaccattcgccttattaatatgttatttttttggtgctgcc

SEQ ID NO: 27529 - DNA, 201 bp, Homo sapiens
ctccatatgtgatgatagagtgatatcaattgattcatcatattgatttcctcttgtcagtggccaaacctgccttcatcacgcaccccatgcagctgcarggtcaatgtgtgtgttcgctctgaaatcctcacgctgcatcttggccagcttcctcctttcctgaccataagatctgatctcttcttctatagggtagag

SEQ ID NO: 27530 - DNA, 201 bp, Homo sapiens
tgttatatatattttaccactatttatttactttactattaaaaatagtggtaaaatatatataacataaaatttgccatttgaaccattttcaagtgtawaattctttttatatgtgtctggattcggtttgctattactttattgaggattttactattcactaaaatgtggatattagtctgtagttttctttttctt

SEQ ID NO: 27531 - DNA, 201 bp, Homo sapiens
actcacctgcctgccactcacctcctgctgtacggcctagttcctaacaggccacagactggtaccagcccatggcccaggggttggggacccctgcaataaaacaaagtctcaaatggaggttagaggaggctgctatgagcacagagcggagaaataggcccacctcagtcagggaagataagaacaggttagccacgg

SEQ ID NO: 27532 - DNA, 201 bp, Homo sapiens
cagtgattcttccaatctaagttttgatgattctatgtccagcttcctctcttctccagtcaccttgtcgcctctaatttcactgggcacccatttggttaaaaaaaaaaagtgacaaagggaaattaagaaattcttcacattgaaccagagtgtttctacctaaagatagtgacacagagggttagcacgagatttatc

SEQ ID NO: 27533 - DNA, 201 bp, Homo sapiens
cctgaccagccctgctgccagtggaggtggaaggttcccaggaaggcctgagagtctgggagggaaactgcctaagggggtgataaatggaatcagcagcrgagccccaacactgacccaggcactgacaaagcaagcctgacacgttgggaagggatttagcactagaaaaaagttcctttataccaagggtatccgatc

SEQ ID NO: 27534 - DNA, 201 bp, Homo sapiens
tctgggtggcgtctcagtgaagccagcctggggtctatcctcatgtgctctcatgatcccaagcccacctgcatgggtcgagggtccctgcatctctctckctctctctgtctctctctgtccctctctctccctctttccctctctctctctctctccctcaccctctctccctgtcgggacttgagcaccatggctctg

SEQ ID NO: 27535 - DNA, 201 bp, Homo sapiens
tctgaacactcttctgttgtaactctattgttctctgagatagtgtgccagataggtacgcttccttctgtaggacagttgggggacaagggagagaaggaaatgaatgctctatgaatattattaagtgcagaataataaagttttctcctacatgtctgcagtgagagtggaggtggtaccatacctgtttgggggcag

SEQ ID NO: 27536 - DNA, 201 bp, Homo sapiens
ccaggctggtcttgaacacctgacctcaagtgatccgcccgcctcagcctcccaaagtgctgggactacaggcatgagccactttgcccaaccggcagcawgttttaagtgagggggatgtgcactctcccgatgcattatgctcactcagtaaaaaggtcttcagcaaagatgtcctgtttctggagcatctatctcttc

SEQ ID NO: 27537 - DNA, 201 bp, Homo sapiens
tttaatggactcacagttctacgtgactggggaggcctcacaatcatggcagaaggcaaaagacacttttgccttttggtggcagaaagagagaatgaggyagaagcgaaagtagaagccccttattaaaccatcagatcttgtgagacctattcacaaccattaaaacagtatggggaaaaccgcccccatgattcaatt

SEQ ID NO: 27538 - DNA, 201 bp, Homo sapiens
attttaatattcagttcatactgtcaaattactttccactgacagtgtatgagaatacctgcttctccacattctcaccactctgtgttaatccagttttktttttttttttttttttgagacggagttttgctcttgttgcctaggctggagtgcagtggcacaatctcagccgactgcaacctccgcctcccaggtaca

SEQ ID NO: 27539 - DNA, 201 bp, Homo sapiens
attatgctcactcagtaaaaaggtcttcagcaaagatgtcctgtttctggagcatctatctcttctgatggacacatttgtatggatgaatgaaagggatrggagtaaaacttaaagtctcaacaggttcccagtggccacccaagcatactgttctaactgttggttggctctatcttgtggtagggttaaatttgctca

SEQ ID NO: 27540 - DNA, 201 bp, Homo sapiens
catccgcctaccttggcctcccaaagtgctagggtaacaggttgtattagtccattttcacactgctgataaaggcatacctgagactgggaagaaaataratttaatggactcacagttctacgtgactggggaggcctcacaatcatggcagaaggcaaaagacacttttgccttttggtggcagaaagagagaatgag

SEQ ID NO: 27541 - DNA, 201 bp, Homo sapiens
attccagcactttgggaggctgaggctggcagatcacttgagtcagaagttcaagaccagcctggccaacatggcaaaacaccatatcaactaaaatagaaaaaaaaaatagctggacatggtggtgcatgcctgtagtcccagctacttgggaggctgaggcatgagaatcgcttgagcccagggagctgaggttgcagt

SEQ ID NO: 27542 - DNA, 201 bp, Homo sapiens
cgggttcaagcaattctcctgcctcagcctcctgagtagctgggattacaggcacccactgccacacctggctgatttttgtatttttagtagagacaggktttcaccatgttggccaggctggtcttgaactcctgacctcaagtgatctgcccgcctctgcctctcaaagtgctgggattacaggcatgagccatgcgc

SEQ ID NO: 27543 - DNA, 201 bp, Homo sapiens
tgtatacccagtaatgggatggctggagacccgtgatttttatggtcttggatgttgttcatgatgacaagggtgtacatgtcccagacgccatgctgcartgctgcacatttcaaagatactgtgtttttgcttttttttttgagacagggcctcactctgtcacccaggctagagtgcagtggcgtgatcttggctcag

SEQ ID NO: 27544 - DNA, 201 bp, Homo sapiens
attctgattcaggataatcaaaaacgggacccaggaatttgcattttaagcaaacaacccacgtgaattctgctgcatggggtcctcagaacacacattgagaaatattcaatagacacgctattcacattcaagagtaccaatgaaggcccataagctatgttgaaatacttagaagttatctatcaagtgaataaactg

SEQ ID NO: 27545 - DNA, 201 bp, Homo sapiens
aggatcgcttgaggccaggaattcgagactaatctgggcattacagcgagacactgtctctataaaaatttaaaaattagccataggtgggggcaagcgcytatggtttcagctactcagaaggctaaggcaggaggatctcttgaacccaggaatttgaggctgcagtgagctatgattatgccacttccctccagcctg

SEQ ID NO: 27546 - DNA, 201 bp, Homo sapiens
ccgcaataaacatacatgtgcatgtgtctttatagcagcatgattgatattcctttggtgtatacccagtaatgggatggctggagacccgtgatttttayggtcttggatgttgttcatgatgacaagggtgtacatgtcccagacgccatgctgcagtgctgcacatttcaaagatactgtgtttttgctttttttttt

SEQ ID NO: 27547 - DNA, 201 bp, Homo sapiens
tgttgcaaaatattcttcttttgggttctttccattatttaaaaatgtaaaaactcgatcaggcacagtagctcacgcctgtaatcccagcattttgggargccgaagtgagtggatcacctgagatcaggagttggagaccagcctgagcaacatggcaaaaccccatctctactaaaaatacaaaattagctgggtgtg

SEQ ID NO: 27548 - DNA, 201 bp, Homo sapiens
agcttttacatatggctagccagttttcccagcatcatttattaaatagggaattcattccccatttcttgtttttgtcaggtttgttaaagatcagatgsttgtagatgtgtggtgttatttctgaggcctctgttctgttccattggtctatatatctgttttgttattagtaccctgctgttttggttactgtagcct

SEQ ID NO: 27549 - DNA, 201 bp, Homo sapiens
aacatggcaaaaccccatctctactaaaaatacaaaattagctgggtgtggtggtgcatgtctgtaatcccagtaacttgggaggctgaggcaggaggatyacttgaacccaggaggcggaggttgcaatgagcaaagatcgcaccactacactccagcctgggcgacagagtgagactctgactcaaaaaagtaaaaact

SEQ ID NO: 27550 - DNA, 201 bp, Homo sapiens
aactggagtggatattatgttcatctctttctcaaccctgtctttcaataacacacgtcagttttttttgatatttttaaatttatttttatttttatttkgtgtgtgtgtgtgtgtgtgtgtacctctaagttctagggtacatgtgcacaacatgcaggtttgatacacaggtttacatgtgccatgttggtttgctgt

SEQ ID NO: 27551 - DNA, 201 bp, Homo sapiens
aggctgaggcaggaggatcacttgaacccaggaggcggaggttgcaatgagcaaagatcgcaccactacactccagcctgggcgacagagtgagactctgmctcaaaaaagtaaaaactcaatcataacgtaacttaattgtacatgtaaaaataaaagagtataattggattgtttgtaacactaaggataaatgcttga

SEQ ID NO: 27552 - DNA, 201 bp, Homo sapiens
atcgcaccactacactccagcctgggcgacagagtgagactctgactcaaaaaagtaaaaactcaatcataacgtaacttaattgtacatgtaaaaataamagagtataattggattgtttgtaacactaaggataaatgcttgaggggatggataccccatgttacatgatgtgcttatttcacatcgcatgcctgtatc

SEQ ID NO: 27553 - DNA, 201 bp, Homo sapiens
catgtaaaaataaaagagtataattggattgtttgtaacactaaggataaatgcttgaggggatggataccccatgttacatgatgtgcttatttcacatygcatgcctgtatcaaaacgtcccatgtaccccataaatatatacacctactatgtacccacaacaattacaaatttaaaaatttacaaaagatttttaaa

SEQ ID NO: 27554 - DNA, 201 bp, Homo sapiens
tgcaaaaatctctggtcatatccaggatttttatacaaataagtaggttacagttaatattccagtttcgcttttttttcccaaataatttagggtttaakattgttatttcttgggttatcaggacatagctctcccttgaaactagcttattagatgtgaagagttggtactgctttttaataattctggtgaggaaaa

SEQ ID NO: 27555 - DNA, 201 bp, Homo sapiens
gatgatgtctagttacatgcttcaaaagctggtggggaaggtcaaggaaaagaatcttattgtatgacgtagactaacctgtgtttaaaatgaactggggmtttgttttaatcgggtgtggtaagatgcacagacatggaaataactgtcaggaaagaagttttatactcgtcgatcccgagaagcgggagacatggcatg

SEQ ID NO: 27556 - DNA, 201 bp, Homo sapiens
accattcctggctaatttttgtatttttagtagagacagcgttttaccatgttggccaggctggtctcgaactcctgacctcaggtgatccacctgcctcrgcctcccaaagtgctgggattacaggcaggagccgccacgcctggcctgagcactcccatctgttaaatggaaatgttatctacttcagaggatgatggt

SEQ ID NO: 27557 - DNA, 201 bp, Homo sapiens
attattatatatattttttgagatggggtttctctatgttgccaaggctggtctcgatctcctgagctcaagagagtcacctgtctctgactctcaaaatrctgagattataggcctgagccaccttgcccggcctcatcttaaaaaaaaaaaaaagaaaattgtcttaatatgtttcattctgtatttcttaatgaaacc

SEQ ID NO: 27558 - DNA, 201 bp, Homo sapiens
aagtctattgagatggtcagttaaagaagaaaaatgaagaatatgttttaaatgtctctcaagatatctttaaatacatttgtgtattttcctaaatttgaaaaaaaaaaaaagtccttaatatctgcttcatctaagcagaaagatcacctgaggtcaggagttcaagaccaacctagtcacatggtgaaactccatctc

SEQ ID NO: 27559 - DNA, 201 bp, Homo sapiens
ttcaacagataaacatttttgagttgggggaagagtagggttaaggctcgggtaaattctaccagctttattctgatgtctccttctacatctataaagartatggtataatgagaagcatgtggtcttgtgaagtaataaaccagggtttgaatcccacatcacccactaagaaggcatgacttcatgtatgttatttga

SEQ ID NO: 27560 - DNA, 201 bp, Homo sapiens
ggataaatgcttgaggggatggataccccatgttacatgatgtgcttatttcacatcgcatgcctgtatcaaaacgtcccatgtaccccataaatatatayacctactatgtacccacaacaattacaaatttaaaaatttacaaaagatttttaaaatgtaaaaaacattttttacataggctatacagaaacaggtctg

SEQ ID NO: 27561 - DNA, 201 bp, Homo sapiens
catattggaaaagatctatagctttttgtaaagactaaactattgttaactaagatgttactttgaataatttagaggaggcaaccttttttgatgtattyacttttatatttaaattaagaatagtctcttatgaaatttcagtgaactgaatcctaaagaaaataaggaagcatttatcagtcgaaagtactctgtaaa

SEQ ID NO: 27562 - DNA, 201 bp, Homo sapiens
ctgctttgcattattttctgtatcatatgtacccctgtattctcaagctaactatcccagctacagggaaaatcaagtccaggacaaaccattgtccaaayatacatcaagcatcaattaagtgctagtaaaaagggacacaaggtcaaagaggacatggttcttgccatgaggtaaggaaggcggacaaccgcccaactg

SEQ ID NO: 27563 - DNA, 201 bp, Homo sapiens
ctgacaggaggcggagctcaggtggtgatgtgagccatggggagcagctgcagatacaaatgaagcttcactcacctgcctgccactcacctcctgctgtrcggcctagttcctaacaggccacagactggtaccagcccatggcccaggggttggggacccctgcaataaaacaaagtctcaaatggaggttagaggagg

SEQ ID NO: 27564 - DNA, 201 bp, Homo sapiens
gaggaggggagagtgaggaggttggtttatgtaaaaggtgtggcactgccactctgtgcagattcctggaggattcacctgactacttattgatttttcaytgaacagctttctcctcgttcagactgtgggctctctgagaagatggggaaacattatttgggagatttacccttagggtgaaaattatctaagcttatt

SEQ ID NO: 27565 - DNA, 201 bp, Homo sapiens
taatactggctttgcaatgtcctcacacctgttctttctcgtcctttcccacggtccttacaataaaactgtttattttttaaaaactgcatgcctttttaaaaaaagttcatattgaaatgtcttaacaatctttatccaaaagagggcgcaaatttctcatgaaatatagtgcggtattttacaaaatgtctttgctgc

SEQ ID NO: 27566 - DNA, 201 bp, Homo sapiens
aagaagcaggatgaggccaggtgtggtggctcacgcctgtaatcccagcacattgggaggccaaggtgggcagatcacttgaggtcaggagttcaagaccrgcctggccaacatggcgaaaccccgtctctactaaaaatacaaaaaaaaaaaaaaaaaacccacaaaaattagccaggtgtggtggcaagcacctgtagt

SEQ ID NO: 27567 - DNA, 201 bp, Homo sapiens
cagtggcacaatctcggctcactgcaaccaccgcctcctgggttcaagtgattctctggcctcagcctcccgagtagctgggtttacaggcacccgccatmatacctggctaatttttgtatttttgtagagatggggtttcaccatgttggccaggctgcccttgaactcccgacctcaggtgatccacccaccttggcc

SEQ ID NO: 27568 - DNA, 201 bp, Homo sapiens
ccaggtgtggtggctcacgcctgtaatcccagcacattgggaggccaaggtgggcagatcacttgaggtcaggagttcaagaccagcctggccaacatggygaaaccccgtctctactaaaaatacaaaaaaaaaaaaaaaaaacccacaaaaattagccaggtgtggtggcaagcacctgtagttccagctactcgggag

SEQ ID NO: 27569 - DNA, 201 bp, Homo sapiens
gatagcaatgtaaaagtagagggtacaaaggaaccaaagtcactggactcttaaaacaacacagaagaaaaagtgaggatgctggcattacaattggattktgaatctgttttcaccttcagtatttatattgagacatgtgggaatacagtattgtttcaatatgccttctctcaaatgatcattttttagttggtacat

SEQ ID NO: 27570 - DNA, 201 bp, Homo sapiens
tatctgccctgaacacctgattagcacaatacctggcatgtcatttctgtgtaggtaaccagaggaggttacaccagctccccatggatggcaaacctaaytcagaatagggatttgggtgccaggaagacaaaagcaggaggtgaaagtaagttgttcagcattccatttccttaggattactctaaatggctaaactac

SEQ ID NO: 27571 - DNA, 201 bp, Homo sapiens
ggccacagactggtaccagcccatggcccaggggttggggacccctgcaataaaacaaagtctcaaatggaggttagaggaggctgctatgagcacagagyggagaaataggcccacctcagtcagggaagataagaacaggttagccacggcttctagcagggaagagagtaagagaacaaatccaagaagaagctgtgt

SEQ ID NO: 27572 - DNA, 201 bp, Homo sapiens
tcccagcacattgggaggccaaggtgggcagatcacttgaggtcaggagttcaagaccagcctggccaacatggcgaaaccccgtctctactaaaaatacaaaaaaaaaaaaaaaaaacccacaaaaattagccaggtgtggtggcaagcacctgtagttccagctactcgggaggctgaggcacaagaatcgcttggacc

SEQ ID NO: 27573 - DNA, 201 bp, Homo sapiens
cccagcacattgggaggccaaggtgggcagatcacttgaggtcaggagttcaagaccagcctggccaacatggcgaaaccccgtctctactaaaaatacaaaaaaaaaaaaaaaaaacccacaaaaattagccaggtgtggtggcaagcacctgtagttccagctactcgggaggctgaggcacaagaatcgcttggaccc

SEQ ID NO: 27574 - DNA, 201 bp, Homo sapiens
ccagcacattgggaggccaaggtgggcagatcacttgaggtcaggagttcaagaccagcctggccaacatggcgaaaccccgtctctactaaaaatacaaaaaaaaaaaaaaaaaacccacaaaaattagccaggtgtggtggcaagcacctgtagttccagctactcgggaggctgaggcacaagaatcgcttggaccca

SEQ ID NO: 27575 - DNA, 201 bp, Homo sapiens
atgatccgcccgcctcggcctcccaaagtgctgggattacaggtgtgagccactgcgcccagccagggagatacttcttaaactcagtttttaagtttagkttaccagtgaacctaacatgatacatcaggacaagctggggttcagagcagaacagtagggtaaccatgtctgcattgtcacccttgtacccattcacga

SEQ ID NO: 27576 - DNA, 201 bp, Homo sapiens
ataaagacatacccaagactggggaatttataaaggaaggaggtttaatggactcacagttccacatggctagggaggcctcacaatcatggtggaaggcgaaggaggaacgtcacatcctacatggtggcagggaagagaaaacttgtgcgggggagctccttcttatagaaccatcagatcttgtgagactcacgatca

SEQ ID NO: 27577 - DNA, 201 bp, Homo sapiens
cagcacattgggaggccaaggtgggcagatcacttgaggtcaggagttcaagaccagcctggccaacatggcgaaaccccgtctctactaaaaatacaaaaaaaaaaaaaaaaaacccacaaaaattagccaggtgtggtggcaagcacctgtagttccagctactcgggaggctgaggcacaagaatcgcttggacccag

SEQ ID NO: 27578 - DNA, 201 bp, Homo sapiens
gctgatttgtagcatttgtcattttctgtggtgtaaatactcccaacttggctgattctaaactaccaaaactaccaatgtgttgtcattcacttccccarattgcaacgggaaagctctcttgagcttttgcaagcaagttccagcacaccacagcttctgagactgagatgagtcacatttaatgtggtggtgttcctt

SEQ ID NO: 27579 - DNA, 201 bp, Homo sapiens
gccaaggtgggcagatcacttgaggtcaggagttcaagaccagcctggccaacatggcgaaaccccgtctctactaaaaatacaaaaaaaaaaaaaaaaamcccacaaaaattagccaggtgtggtggcaagcacctgtagttccagctactcgggaggctgaggcacaagaatcgcttggacccaggaggtggaggttgg

SEQ ID NO: 27580 - DNA, 201 bp, Homo sapiens
cacaccacagcttctgagactgagatgagtcacatttaatgtggtggtgttccttccctttccccagagggacaccctggaatgatagcgagagtctggcytccagtgaagaacacttgacaagggagaaaatctggacatttctgcctttgagttttgcttaggccaatcttgcaattctccctcaatccacgtggtcac

SEQ ID NO: 27581 - DNA, 201 bp, Homo sapiens
gcctggccaacatggcgaaaccccgtctctactaaaaatacaaaaaaaaaaaaaaaaaacccacaaaaattagccaggtgtggtggcaagcacctgtagtyccagctactcgggaggctgaggcacaagaatcgcttggacccaggaggtggaggttggaatgagccaagattgtgccactgcactccagcctgggtaaca

SEQ ID NO: 27582 - DNA, 201 bp, Homo sapiens
ggacccctgcaataaaacaaagtctcaaatggaggttagaggaggctgctatgagcacagagcggagaaataggcccacctcagtcagggaagataagaamaggttagccacggcttctagcagggaagagagtaagagaacaaatccaagaagaagctgtgtattcagaaacagcagggaggcctgcaagggcaatggcc

SEQ ID NO: 27583 - DNA, 201 bp, Homo sapiens
ggaggctgaggtgggtggatcacctgaggtcaggagtttgagaccaccctggccaacatggtgaaacccccatctctactaaaaatacaaaaaattagctkggcatggtggcgtgtgcctgtaatcccagctactccagaggctaagacaggagaatctcttgaacccaggaggcagaggttgcaatgagccaagatcgtg

SEQ ID NO: 27584 - DNA, 201 bp, Homo sapiens
gctgaggtgggtggatcacctgaggtcaggagtttgagaccaccctggccaacatggtgaaacccccatctctactaaaaatacaaaaaattagcttggcrtggtggcgtgtgcctgtaatcccagctactccagaggctaagacaggagaatctcttgaacccaggaggcagaggttgcaatgagccaagatcgtgccac

SEQ ID NO: 27585 - DNA, 201 bp, Homo sapiens
attttattaagtatatactaatttagaatttttatatattactaatgaattgggtttttttacatcattaaaagtgactctctttaactgtgtgatgatgytttttgccctaagtagtttgtctaatattaatagacatcagtcttattttaggtagcattcacattatatatctttttcattttttatctatcaactttt

SEQ ID NO: 27586 - DNA, 201 bp, Homo sapiens
ttgagaccaccctggccaacatggtgaaacccccatctctactaaaaatacaaaaaattagcttggcatggtggcgtgtgcctgtaatcccagctactccrgaggctaagacaggagaatctcttgaacccaggaggcagaggttgcaatgagccaagatcgtgccactgtactccagcctgggcaacaagagcgaaactc

SEQ ID NO: 27587 - DNA, 201 bp, Homo sapiens
ttattgagatttgtttgtgacctagcttacaaagtaaatgttccatggatgcttgattcaaaatgtgattcttgggtgatgtatagccatccagaaggtaragattgctggtagtgtttctcaagccttatatatctttactgattttttagattgtacactaaaaccccccattatggttgtagatttatctatctcctg

SEQ ID NO: 27588 - DNA, 201 bp, Homo sapiens
gaggttgcaatgagccaagatcgtgccactgtactccagcctgggcaacaagagcgaaactccatttcaaaaataaataaatacataaataagcccattaracatcacgaatttaatgtgaggccaacattcttactggtgagaaatgattctccatcgttcttgggagaaagtgacgctgcccgtcctcaggcctgggag

SEQ ID NO: 27589 - DNA, 201 bp, Homo sapiens
aagaaacaacttttagctttcttgatgttctctgtttcctgtttcatgaaggcttgctttactatttctttggttttaatttgctattctttttctgtttrtttgagatcatgcttgggtgatgaattctcattcttcttttttaaaatacattttatggttataactttcctctaaatactgcttcacttgcattccaca

SEQ ID NO: 27590 - DNA, 201 bp, Homo sapiens
actccatttcaaaaataaataaatacataaataagcccattaaacatcacgaatttaatgtgaggccaacattcttactggtgagaaatgattctccatckttcttgggagaaagtgacgctgcccgtcctcaggcctgggagctgctgaggaggggagagtgaggaggttggtttatgtaaaaggtgtggcactgccact

SEQ ID NO: 27591 - DNA, 201 bp, Homo sapiens
acagcatgttttctggctacatcaagtagttgtttctaggctttgttcaaatctttttcctttccctgtgtgactggctgtatctgtctctataatgccascatatacaagttgatatggtttggctgtgtcctcacccaattctcatcttgaattgtggctcccataatgcccacgtgttgtgggagggacacagtggga

SEQ ID NO: 27592 - DNA, 201 bp, Homo sapiens
aaattagccaggcttggtggccggcgcctataaactcagctactcaggagcctgagacatgagaattgcttgaacccaggaggtggaggttgcagtgagcmgagatcacattattgcactccagccagggcgacagagcgagactccatctcaaaaaataaataaaaataaataaataaataaatgtgtatctaattacct

SEQ ID NO: 27593 - DNA, 201 bp, Homo sapiens
agttcctttacctcttctggtttgttcagaaaagaaaggtctgaaatgtgaaatagaattacaggcacaaatgccagagagtgtaactgcgaactgtctayactaccccataaatacagcctaaatggggaaaaaaaatgatttactgaaatagtctgaagatgcacttgatttcttcctccagatactctacattttatc

SEQ ID NO: 27594 - DNA, 201 bp, Homo sapiens
ttacctgttagctagtgactttttaaatttttttcacttttttagaaatggagtctttctatgttggccaggttggtcttgaactcctggcctcaagcaawcctccttccttggcatgagccactgcacccagcctagtgactttcatataattctgtattcaagttaaatatgttgatgtagtatctccaagaagttggg

SEQ ID NO: 27595 - DNA, 201 bp, Homo sapiens
actgcacccggcccaggctgttcttataacaggatcatatgcatacctttattcatctagaatatcatcatctaactcatagtctgagatttcacttatgygatcaattatactgtaattattagagtctacagtggttctgcttcatcttctgatttgcctaataattgtgaagagtcttcctcttgtcaattttctact

SEQ ID NO: 27596 - DNA, 201 bp, Homo sapiens; identical to SEQ ID NO: 27150

SEQ ID NO: 27597 - DNA, 201 bp, Homo sapiens; identical to SEQ ID NO: 27216

SEQ ID NO: 27598 - DNA, 201 bp, Homo sapiens; identical to SEQ ID NO: 27167

SEQ ID NO: 27599 - DNA, 201 bp, Homo sapiens; identical to SEQ ID NO: 27153

SEQ ID NO: 27600 - DNA, 201 bp, Homo sapiens
ccatgttctctcagagttaacactctcatcctataaataaaagatatattctcaaattctaaaattcttgtgtgtgtattttcaacagttgttatttttasgtcaagaaaaatattatgataatattagcaactgttaaattctatgctttgagatgtataggcctcatttctaatttaataaggtatgtatatatttgat

SEQ ID NO: 27601 - DNA, 201 bp, Homo sapiens; identical to SEQ ID NO: 27116

SEQ ID NO: 27602 - DNA, 201 bp, Homo sapiens; identical to SEQ ID NO: 27119

SEQ ID NO: 27603 - DNA, 201 bp, Homo sapiens; identical to SEQ ID NO: 27203

SEQ ID NO: 27604 - DNA, 201 bp, Homo sapiens; identical to SEQ ID NO: 27248

SEQ ID NO: 27605 - DNA, 201 bp, Homo sapiens
  misc_feature (1)...(201): n = A,T,C or G, or insertion/deletion polymorphism (see Tables 1-2)
cactctcatcctataaataaaagatatattctcaaattctaaaattcttgtgtgtgtattttcaacagttgttatttttacgtcaagaaaaatattatganaatattagcaactgttaaattctatgctttgagatgtataggcctcatttctaatttaataaggtatgtatatatttgatattttcataaaagcaataca

SEQ ID NO: 27606 - DNA, 201 bp, Homo sapiens; identical to SEQ ID NO: 27108

SEQ ID NO: 27607 - DNA, 201 bp, Homo sapiens; identical to SEQ ID NO: 27052

SEQ ID NO: 27608 - DNA, 201 bp, Homo sapiens
ttaagatattttaataaaatatcagataataaaaatatacctttgtgtttgaagagtcaagtcacacaaatacgtaagagcaaatcaattgtttccagctrtaatcagcgataataacccaagtacgtgacagcatgagaaagacgatcagtttccttttgaggttacatgataagcagcagctaagcagcctttttctct

SEQ ID NO: 27609 - DNA, 201 bp, Homo sapiens
gatcagtttccttttgaggttacatgataagcagcagctaagcagcctttttctctaagaactcgccgtctgacctcgtggcaagaggaggccagcccctytcactggcgccctttatagcgttcgctttcagttctccactctagtgaggacgggggcgggggaagctaagagcctgttttctaaaatgcagaatacggt

SEQ ID NO: 27610 - DNA, 201 bp, Homo sapiens
tgtctaacagaagcaaaaaaatattccacccagccagatatttctttagatgtcagatttaaatagaggaaatatatattaccaaatgcttaaaatttacrtaactgtcatcctctttgggacagcaccttcagccactgcagcgaattcactaatcccaatgaagagaatctctaatccattctatttagaaatgtgctt

SEQ ID NO: 27611 - DNA, 201 bp, Homo sapiens; identical to SEQ ID NO: 6811

SEQ ID NO: 27612 - DNA, 201 bp, Homo sapiens
caacccctgagaacatcctccgaaggatggtgtccagctgaaagttgtaccagtcgctgttgaaaaggctcacctcaggtcccagctcttgggcgttggcygtccggatgaccaccacggtctttgggcttcgatcgaggagccgaaccactgctcgacggatgttcctgagccgccggatgtacacttccaaagggaagg

SEQ ID NO: 27613 - DNA, 201 bp, Homo sapiens
tgtacacttccaaagggaaggtgctgaagtgagaccatacagctatggcaaccactgtgttcttccctcccacaatgccattcagctcattcgccacatamtggagctcattgctaaagacagtcgtgaagcggatgggtggaccatggcagcggtatttgagcaggatgttgtgcttctggtccactgcaaggaagggac

SEQ ID NO: 27614 - DNA, 201 bp, Homo sapiens; identical to SEQ ID NO: 6808

SEQ ID NO: 27615 - DNA, 201 bp, Homo sapiens; identical to SEQ ID NO: 6809

SEQ ID NO: 27616 - DNA, 201 bp, Homo sapiens
aatgtcaagttctttcacgacaagaaaaactctcagctgggcacagtggctcacacctgtaatcccagcactttgggaagctgaggtgggcagatgcttgrgctcaggagtttaagaccagcctggacaacatggcaaaatgtagtctctacaaaaagatacaaaaattagctgggcatggtggtacatacctgtagtccc

SEQ ID NO: 27617 - DNA, 201 bp, Homo sapiens
ctctttcgaaccgggttgcgtgggcactgaggagggccagaggaggcagggagggggcagcgaggcctagatttgtggattttttttctgcacactggaarttcccagaccaaaaaggtaccgacccgagtcccggacattcccctcgagggccggctccaagacctggactggagccgcagggaggaatcagaggcaaca

SEQ ID NO: 27618 - DNA, 201 bp, Homo sapiens
ccactggaggagcaatgcccgctttctttttaaaattctcctgggaaaattactcctcagcctcctttataaatccttgaggaaatgtcaagttctttcargacaagaaaaactctcagctgggcacagtggctcacacctgtaatcccagcactttgggaagctgaggtgggcagatgcttgagctcaggagtttaagac

SEQ ID NO: 27619 - DNA, 201 bp, Homo sapiens
agcactctgtaatgttgtcagggtcattaaactgacgcatcttaaactttctgggcctccactggtctttataataatacccagaaggaaaagttcctgasccttgagatagttctagactgttagtttctgcaaagaaaaaagaaaaacaaatattttaatattctcctccaacaatagatgaaaaatgtcccaagaaac

SEQ ID NO: 27620 - DNA, 201 bp, Homo sapiens
ttgcccgaaggatctcagtgatggtttaacatcagtagtgacatcagagtgacattactctcctccagtactgtgggtgattccactgtgtggatggactmcaatttcgtggcatcaaaaatgtggactctgattttgtgcctaatggaatatcatggcactaattttatcttaccaacagtaacactgcaataaataatc

SEQ ID NO: 27621 - DNA, 201 bp, Homo sapiens
ggaaattctctcttcctgttctagatgctctaaggaacccaaggattggtgtctctctaggagacggcacaggtaggacagagccccctccctggggctgrgggagcagggcctgcagcttggggcagggctgggctactgcttcttcctggactcaacttcgtaacctgagaccctcttgtaagtgaaacagaggtcttc

SEQ ID NO: 27622 - DNA, 201 bp, Homo sapiens; identical to SEQ ID NO: 6813

SEQ ID NO: 27623 - DNA, 201 bp, Homo sapiens
tatgtcctggaggcctggctgagcaggggaactagaaggacacaagctctgtcttttgacattcctgtggcttctggggtaggggaggagtacctactttyacctcatctccaccccaaagaaagggaaattctctcttcctgttctagatgctctaaggaacccaaggattggtgtctctctaggagacggcacaggtag

SEQ ID NO: 27624 - DNA, 201 bp, Homo sapiens
catgtgcctctcttggtatctctcttgctgagtttctcttctcccctctattcccagcacctgtagccttggagaatgccacctccctgtcagtcctgaakaaccaatccctgcgttttgtttatgtgactgacagcaacccacctgccaggctgagctggacctgggaaggccaagccctgaatctctcccagtcgtcag

SEQ ID NO: 27625 - DNA, 201 bp, Homo sapiens
gcctgtgattcatggggaactggccaggtggcacctgtttctccagtcacttgtgcacaagtccaggaggcaggacttggggactccggtccttcgttgcygccttacttagggcaagcctcttgccttgtctgagcaacatgcagaaatggaactcagttttcttaaagagttaattacaatggactcattgtgtgtctg

SEQ ID NO: 27626 - DNA, 201 bp, Homo sapiens
catatttatatttatgtttatatttaatttacatttatatttatatataatcttgccaaaggttcctcttttcaccctgttctccacatgattatgcacayttctatcctcttcccttacaggattaatttccattccctgaaactccaaggccatttctagtcacagttgtctttgcactgctcttcctttctcccagca

SEQ ID NO: 27627 - DNA, 201 bp, Homo sapiens
tttggtggttacccaggagacttttccccctcagacatccctttatgcctgagctgtcttatctgtgtttcactgtctgctctttccggctgcttgttgtyagaagataagtgatttccttgaaatgcacgaggctagaaagggagctggaacttaaagtggcagtgttagtctgagatgatggtgctcctgctctgtcat

SEQ ID NO: 27628 - DNA, 201 bp, Homo sapiens
ctgggaggtggaagttgcagtgagccgagattgtgccactgcaccccagcctgggtgacagagcgagactccatctcaaaaaaaaaaaaaaaaaaaagaaagaaagaaagaaaagaaaagaaaagaaaaacctggaagagaggacctgggccaaagctaacctcctcagagacccaaggacccacagttgctctcagagca

SEQ ID NO: 27629 - DNA, 201 bp, Homo sapiens
caccatctcggctcactgcagcctctgcttctcaagcttaagcaattctcctacctcagcctcctgagtagctgggactactggtgcgagccaccaatgcytggctaatttttgtatttttttgtagagacagggaatcaccatgttgcccaggctggtctcaaactcctgagctcaaagcgatctgctggcctcagcctc

SEQ ID NO: 27630 - DNA, 201 bp, Homo sapiens
gacatggggaactgtcatctccctgggccctaggacccctcacttctcagagatcaccatcatcccacttccctggagccacggctccagtatcaccttcsaagtgactttcccaaggtttcatgtgaccacagagatgaccatccaactcaatgtctcctgtgagtctgagttattttgggcagtgactgtgggaagaga

SEQ ID NO: 27631 - DNA, 201 bp, Homo sapiens
gtgtgttccccacccctcccactggggccttctgtttccccttggtgaacacatccacctcccctgagtacaactccaataggctttgtgaaactccctayccctccctctccagcccagacctgcccccaagccctgacggttcatctcaccagctctctgccatgacacccccaagtccctgctgcttgagtcggggct

SEQ ID NO: 27632 - DNA, 201 bp, Homo sapiens
aacctgggaggtggaagttgcagtgagccgagattgtgccactgcaccccagcctgggtgacagagcgagactccatctcaaaaaaaaaaaaaaaaaaaaraaagaaagaaagaaaagaaaagaaaagaaaaacctggaagagaggacctgggccaaagctaacctcctcagagacccaaggacccacagttgctctcaga

SEQ ID NO: 27633 - DNA, 201 bp, Homo sapiens
gaaagtcactcatcttttcctggacatggggaactgtcatctccctgggccctaggacccctcacttctcagagatcaccatcatcccacttccctggagycacggctccagtatcaccttccaagtgactttcccaaggtttcatgtgaccacagagatgaccatccaactcaatgtctcctgtgagtctgagttatttt

SEQ ID NO: 27634 - DNA, 201 bp, Homo sapiens
gcccacaattaagcttaagattgtgtgttccccacccctcccactggggccttctgtttccccttggtgaacacatccacctcccctgagtacaactccartaggctttgtgaaactccctatccctccctctccagcccagacctgcccccaagccctgacggttcatctcaccagctctctgccatgacacccccaagt

SEQ ID NO: 27635 - DNA, 201 bp, Homo sapiens; identical to SEQ ID NO: 6812

SEQ ID NO: 27636 - DNA, 201 bp, Homo sapiens
cctgcttcagcaccagggacagcgccactctccctgatgcctgtggctcgccaggaccaaaacgtgtctggatgtgcagcgagagccaccagcctctttgsgcggtccctgatggtagacatgggagagaacggcgcaggataggaaaacctcccagtctgtgtctgcccttctcgggctctcggtcacgcccaggagatg

SEQ ID NO: 27637 - DNA, 201 bp, Homo sapiens
ttttatctttttgtgaacagccattctaataagtgtgaggcagtatctcattgtagttttgtccattcatattgagcagcttttcatatacctgttggtcwttttcatgtctctacagaaaagtgtcaattcaagtcccttgcccaatttgaagttgggtttttgtttgtttgtttgtttgtttgctattaggttgtatac

SEQ ID NO: 27638 - DNA, 201 bp, Homo sapiens
cagaaataatctctgtccagtttcatatcctatctcctgaactgtactgctgggcgagatggatggatggatggatggatggatggatggatggatggatgaatgaatgattggatggatggatgagtggctggctggatagttgatggttggatggaccgtccatgactgctctgctctcagaacctttccttgcacctc

SEQ ID NO: 27639 - DNA, 201 bp, Homo sapiens
acccccagactgacatctgttccctgagcatcagagacaccaggaggaaagatggcggagtgtatttatttcggttggagaggggtcctgtcgtgaaattyagcttcaagcaaaagacactgtctttgaacgtgataggtaggcgtgctgtgtccaggagcctagggctcagatgggggagccattcctggggctgggaca

SEQ ID NO: 27640 - DNA, 201 bp, Homo sapiens
ccagaaataatctctgtccagtttcatatcctatctcctgaactgtactgctgggcgagatggatggatggatggatggatggatggatggatggatggatgaatgaatgattggatggatggatgagtggctggctggatagttgatggttggatggaccgtccatgactgctctgctctcagaacctttccttgcacct

SEQ ID NO: 27641 - DNA, 201 bp, Homo sapiens
ccccatggccccaggaccacagcaccaacctcacctggcaggtgaagttccctggagctggtgtgactacagagagaaccatccagctcagtgtctcctgwgagtgctggggccaggatgcctgggttcctgagggtgtagggggtagaggagggtcagggcaggggacactttgtggctatgtcctggaggcctggctga

SEQ ID NO: 27642 - DNA, 201 bp, Homo sapiens
ccaaggttgtgcccacttccaagtgggagaggctaatcagtgaagacagcctagttctctcactgtttggggtgctacttgtagactgcccaatcctgtcrctgttcggggcaccgcttgtaaactgcacggaccttgggggactgaacaaagggggacgaacgcgggaacaaagacaagagaacaaaagaatgtgtttgg

SEQ ID NO: 27643 - DNA, 201 bp, Homo sapiens
tccagaaataatctctgtccagtttcatatcctatctcctgaactgtactgctgggcgagatggatggatggatggatggatggatggatggatggatggatgaatgaatgattggatggatggatgagtggctggctggatagttgatggttggatggaccgtccatgactgctctgctctcagaacctttccttgcacc

SEQ ID NO: 27644 - DNA, 201 bp, Homo sapiens
agctttcatttcccctgtagtggtctgagggcaaaagtagcgtttgctgaaggcagaaatttgggagaggaacaatacattcaatccaggaagagaatctrtcactccaaggttgtgcccacttccaagtgggagaggctaatcagtgaagacagcctagttctctcactgtttggggtgctacttgtagactgcccaatc

SEQ ID NO: 27645 - DNA, 201 bp, Homo sapiens
ggaagaaattgaagaagacacaaataaatgaaaaatatccatgtttgtggattagaagaattaatattgttaaaatatccatactacccaaagtgatatayggatttagtgtaatctctatcaaaattccaatggcattgttcacagaaaaaaataattgccaaattcttatggaattgcaaaagactctgaatagccaaa

SEQ ID NO: 27646 - DNA, 201 bp, Homo sapiens
aagtcctttcctctattcctgtacctcacggcgtctgcatctaaactaacagaataacggagaaggggaagagaccaaactgcatcatgaaggggaagggrgacccctctgtacatctgaacccaaggcctgcatgtgcctctcttggtatctctcttgctgagtttctcttctcccctctattcccagcacctgtagcct

SEQ ID NO: 27647 - DNA, 201 bp, Homo sapiens
ttgactgggattctcatcaaggacaaagtcctttcctctattcctgtacctcacggcgtctgcatctaaactaacagaataacggagaaggggaagagacsaaactgcatcatgaaggggaagggggacccctctgtacatctgaacccaaggcctgcatgtgcctctcttggtatctctcttgctgagtttctcttctcc

SEQ ID NO: 27648 - DNA, 201 bp, Homo sapiens
ctaaaccagggacacagtcctgcttcagcaccagggacagcgccactctccctgatgcctgtggctcgccaggaccaaaacgtgtctggatgtgcagcgasagccaccagcctctttgggcggtccctgatggtagacatgggagagaacggcgcaggataggaaaacctcccagtctgtgtctgcccttctcgggctctc

SEQ ID NO: 27649 - DNA, 201 bp, Homo sapiens
cccagcccacaattaagcttaagattgtgtgttccccacccctcccactggggccttctgtttccccttggtgaacacatccacctcccctgagtacaacyccaataggctttgtgaaactccctatccctccctctccagcccagacctgcccccaagccctgacggttcatctcaccagctctctgccatgacaccccc

SEQ ID NO: 27650 - DNA, 201 bp, Homo sapiens
tgatgaaggtgggcttgctgcttgctcaggacagaagtggaggcccagagctccgacaggagaggactgaagacatcccaatgagtcccactccccctcaycccgctgccccctgcagtctgcccctcccacccatccctgataaaattctcaccactgctgtcaccaatgtgcagctccttctcctcctacctccctggc

SEQ ID NO: 27651 - DNA, 201 bp, Homo sapiens
ctgggtgacagagcgagactccatctcaaaaaaaaaaaaaaaaaaaagaaagaaagaaagaaaagaaaagaaaagaaaaacctggaagagaggacctgggscaaagctaacctcctcagagacccaaggacccacagttgctctcagagcatcagatgttccagatgcaggaaagtaggaacacatctctaggtcagagat

SEQ ID NO: 27652 - DNA, 201 bp, Homo sapiens
taagcaagaaaaacaaagttggaggaatcacattcctgatttcaaattacattacaaagctacagtaatcaaagccgtatggtgctagctatattccaaawgacatatggaccagttagaccaatggaacagactagagagcccagaagtaaacctaagcacatgcagtttgttaattttcaagaagacattgaattcttt

SEQ ID NO: 27653 - DNA, 201 bp, Homo sapiens
gaagaagaggtcagctgctccgtctagagtaggcttgcaagactgtattccttgaacagtaggccctagatgtcccagaagataacttcaaggagccggcrccagggagtgaccgccctcagcaaaccttctggcggcaggtgcagtcgtgagtttgctcacatcctgtattcatgataaacagtttgctgtttgatcata

SEQ ID NO: 27654 - DNA, 201 bp, Homo sapiens
atggggaccagctgcacattcatctgtggattcacctggatctgctgcactaggtgagcagtgccttgctcagatgacccagtctctgagcccccaaattycaaggaaaagtggcctggtctgtcttcctcagggtgagctctctgcagccctaactgctaacctcctcttacattttctcacaggatcagagggtcccag

SEQ ID NO: 27655 - DNA, 201 bp, Homo sapiens
cctctagtggacaagggccctgaactttacacagccctccatatttattaggcaaaagagatagcgagaaggaggggtggaagaagaggtcagctgctccrtctagagtaggcttgcaagactgtattccttgaacagtaggccctagatgtcccagaagataacttcaaggagccggcaccagggagtgaccgccctcag

SEQ ID NO: 27656 - DNA, 201 bp, Homo sapiens
aagatatgagtaaatcgggacctttgtgttctgatggtgggagtgcagtttgttgaggcattttcagagctggcaatacctattttgtgagctgaatgtgctcgctgtgtgataaatcattaagctgtacacttaatgatttgcatcccttctgcatgacagtaaaaaattcttaagctattattgtgtgaagtagctagg

SEQ ID NO: 27657 - DNA, 201 bp, Homo sapiens
tccctccttctaagcagggttcatcctggggcccttttctccatcttggccctggtcatgcctggggcctcgcctcctccctgaacactgagccctcctcrcctcctgcctccatctctcccaacacagactccagactccgtttccagatgcctcctcatccagttcctccacagtctgagcagccgtgtttcctctctg

SEQ ID NO: 27658 - DNA, 201 bp, Homo sapiens
tgcataggctgcggggacagcagcccccactcaggaggctccagagcccaaggcttagtcttttcctcactccagggctcctggcttaggttctgggattmcagctgcagttccaggaacctgtgatggtgcagaagggcctgtgtgtcctcaggctgcagaaatttccctactcctggacttactatggaaccctccacc

SEQ ID NO: 27659 - DNA, 201 bp, Homo sapiens
aattacttaatcaatgatgctggaactttggtttaaattttattttttaagtttcttttctcccccacctcctctcttttttaacgtttattttaggttcrgaggtacatgttcaggtttgttacataggtaaacttatgtcacgaggtggttgtacagatcatttcatcactcaggtactaagcctagtacccaatagtt

SEQ ID NO: 27660 - DNA, 201 bp, Homo sapiens
agggttcatcctggggcccttttctccatcttggccctggtcatgcctggggcctcgcctcctccctgaacactgagccctcctcacctcctgcctccatytctcccaacacagactccagactccgtttccagatgcctcctcatccagttcctccacagtctgagcagccgtgtttcctctctggtgctggagaacaag

SEQ ID NO: 27661 - DNA, 201 bp, Homo sapiens
atccagaaataatctctgtccagtttcatatcctatctcctgaactgtactgctgggcgagatggatggatggatggatggatggatggatggatggatggatgaatgaatgattggatggatggatgagtggctggctggatagttgatggttggatggaccgtccatgactgctctgctctcagaacctttccttgcac

SEQ ID NO: 27662 - DNA, 201 bp, Homo sapiens
gtcaaatcttatagacactttcctggacctcacttacctagacctctctgggggatttgttttgttttgttttgtccgatgactttttttttttttttttttttttttttgagacagggtctcactctgtctcccaggctggagtgcagtggcaccatctcggctcactgcagcctctgcttctcaagcttaagcaattct

SEQ ID NO: 27663 - DNA, 201 bp, Homo sapiens
gaaatcagttcttaaatgcaaaatagttgggtcatatgttctttctaattttgaaaaaatatggccatggagaacccatgaaggtgaacaaggttacacgygcaacagggaggggtaaaagtgtatgtattcacctacccattgtggggcaaaacttttttttttattttttgagatagagtctcactctgttgcccaggc

SEQ ID NO: 27664 - DNA, 201 bp, Homo sapiens; identical to SEQ ID NO: 13742

SEQ ID NO: 27665 - DNA, 201 bp, Homo sapiens; identical to SEQ ID NO: 13744

SEQ ID NO: 27666 - DNA, 201 bp, Homo sapiens; identical to SEQ ID NO: 13746

SEQ ID NO: 27667 - DNA, 201 bp, Homo sapiens; identical to SEQ ID NO: 2287

SEQ ID NO: 27668 - DNA, 201 bp, Homo sapiens; identical to SEQ ID NO: 13743

SEQ ID NO: 27669 - DNA, 201 bp, Homo sapiens; identical to SEQ ID NO: 2271

SEQ ID NO: 27670 - DNA, 201 bp, Homo sapiens; identical to SEQ ID NO: 6824

SEQ ID NO: 27671 - DNA, 201 bp, Homo sapiens; identical to SEQ ID NO: 2272

SEQ ID NO: 27672 - DNA, 201 bp, Homo sapiens; identical to SEQ ID NO: 6828

SEQ ID NO: 27673 - DNA, 201 bp, Homo sapiens; identical to SEQ ID NO: 13745

SEQ ID NO: 27674 - DNA, 201 bp, Homo sapiens; identical to SEQ ID NO: 13738

SEQ ID NO: 27675 - DNA, 201 bp, Homo sapiens; identical to SEQ ID NO: 13739

SEQ ID NO: 27676 - DNA, 201 bp, Homo sapiens; identical to SEQ ID NO: 13740

SEQ ID NO: 27677 - DNA, 201 bp, Homo sapiens
ataatgtcatggtgggtttttgttaacttttattgcatagaatgtttcaaatggcactactgagtttaattctatctcaatcaatgcttagtgtccgctcyatgcctgcaattggtttggtgctggcgattccagcagtgagcaggactcagttcctgtcctggtccgagtgacaggattattgtgcagaggggtctttgg

SEQ ID NO: 27678 - DNA, 201 bp, Homo sapiens
  misc_feature (1)...(201): n = A,T,C or G, or insertion/deletion polymorphism (see Tables 1-2)
caagcgatgggcatggtggcatggcattgtcttctctcctgtgagaggtaggacttatcacaaggacagaggagggagaaaaatggttgcttcttagacantttattatctcagcctcaaataatctttatttaaagtactactaaatcaactagattcgcctttagaatattttcaaaacctgtttggccctatgatacg

SEQ ID NO: 27679 - DNA, 201 bp, Homo sapiens
acatgttggctatagttaattatactatactatatatttcaaaattgccaggagagtaaatttcaaatgtttgcaccacaaaaataaatatgggaggtaakcgatatgttattaacttaattatcctgcaatgtgatttgattttatatatatatgtaaaatcatcactttgtaccctataatatatacaattatacaatt

SEQ ID NO: 27680 - DNA, 201 bp, Homo sapiens
gaatcagttggtattttccaacctggagaatcagtagatgaaattaggaaaagtctgtacggaaggaataagtgtttgagatcaaatatacaacatgttgkctatagttaattatactatactatatatttcaaaattgccaggagagtaaatttcaaatgtttgcaccacaaaaataaatatgggaggtaatcgatatgt

SEQ ID NO: 27681 - DNA, 201 bp, Homo sapiens
gggagaaaattatacaaaattatgcaaaaggtagtgggagtcatttaaaattctgctctgcatgtgattttgaaacactaatatgccatggatgtctttcytgcctagtcaatatagatctgcatttttatggctgaatagcattctattctgtttcaaaatacttgatcacatgttggacagttaggctgcttccatgct

SEQ ID NO: 27682 - DNA, 201 bp, Homo sapiens
aaataaataaatagtcctcagtgtttcggagggaacctaatacatgtttattatgcagtattttaaatgttgcagaaaaaataccaaagtaagaagtatcyattttctaactactcagaacatctgtaacatttccttaacccttctgtaatatgtctctttgtgtgtcgtatgcatgtttttaatgctgcataccaaagt

SEQ ID NO: 27683 - DNA, 201 bp, Homo sapiens
acacgtaatcacaccatggggaaaaatgaaaggagaagaaaaaaagaaagctggataatcagcccctaattttctaaaaattgctattaacaaagctgctktacaattctcttgataaatatccaagaaatctgttcttggaagcttaagaagagagtggaaaggctgtactctcaggactaaggaaggactcactcccta

SEQ ID NO: 27684 - DNA, 201 bp, Homo sapiens
gaatgatatttcattgtgtggataaaccaggttttatttatccattcatcagttgtacatttgggttgtttccatttttggctttcatgaataatgttgtwatgaacattcaggtaaaagtttttatgtgaacatatgttttttatttctcatgggcatatatttagagtggaatttctgggttgtatggtaactctatgt

SEQ ID NO: 27685 - DNA, 201 bp, Homo sapiens
gctgaccccagagcccactctttttaaaatgacatccttattgactgggcgtggtggctcacacctataatcccagcactttgggaggccgatgcaggagkatcacttgagatcaggagtttgagaacagcctgaccaacacggtgataacctgtctctactaaaaatacaaaaaaattagctgggcgtggtggtgcatgc

SEQ ID NO: 27686 - DNA, 201 bp, Homo sapiens
gttggaaaaaacattatttgccaccttcaaagaataagagtagctcatgttcacaaaaatacttttttttgcaatgccctgatttaagtgctgacatgtaytaatttacttctacctcttaacagcatgttaaggtaattactgttagtggcacggtaacttaaccaaggtcccagccaataagtggcagaacctgaatta

SEQ ID NO: 27687 - DNA, 201 bp, Homo sapiens
ttcttgttaaccatatttctggccaagttggttttaggaaaatcacctggagttagaccatgagccttagcattagaggactgagaatatacactgaaggyacacaatagtgttggaaaaaacattatttgccaccttcaaagaataagagtagctcatgttcacaaaaatacttttttttgcaatgccctgatttaagtg

SEQ ID NO: 27688 - DNA, 201 bp, Homo sapiens; identical to SEQ ID NO: 6840

SEQ ID NO: 27689 - DNA, 201 bp, Homo sapiens
  misc_feature (1)...(201): n = A,T,C or G, or insertion/deletion polymorphism (see Tables 1-2)
atcttaaaaagagacacacatgagaataaccaatctcacattccagtcctgtaatcccagtatgtttgggctactgattctctttttaaaagtggcatctntcatttttaaaagagaaaatcctagatagtgactcctattatcatcaagtaatatatatcaaggccccaaggctaccttgtcacattttactctggcata

SEQ ID NO: 27690 - DNA, 201 bp, Homo sapiens
atcacactggttccattgccaaaaaaataactgtatcataaaactctagtaaaagtgatgatggttaagacaacaagagagcagaacgaggttttatttgstgctaatgacctgcattctctctcttaggtccgtggcactcaggtagttggttctgacatgactgtgacaattcagtttaccaatcctttaaaagaaacc

SEQ ID NO: 27691 - DNA, 201 bp, Homo sapiens
actgggcacaacatatagaaggcaatggcagccatagcttgcgccatgcatagcctggagtagacaaacctaaatgaactttcttccttctcacttctcayggactcatttaggtgaatgccaaagatgacgaaggtgtcctcgttggatcctgggacaatatctatgcctatggcgtccccccatcggcctggactggaa

SEQ ID NO: 27692 - DNA, 201 bp, Homo sapiens
  misc_feature (1)...(201): n = A,T,C or G, or insertion/deletion polymorphism (see Tables 1-2)
aggggtgagactgtcgcccaagtgaaaaagatagcagaagataagaaggaaaactgtttccagaaattgtcaaaagacagccaggtgaacaagattgtggnccgaggtggcacaggatgctgggctgaaaattacagcagcatgcacagcacttattgataggagaatgctcagctgtgctcctgagggcccttcagcctg

SEQ ID NO: 27693 - DNA, 201 bp, Homo sapiens
atattccagatgctgagcctgggaacaaggtctatcccaagggagttggcaaaagctaattcgagtgtcagggcctcagcaaaggcagctgggggattcayataggactgtaattccaggaggaaactagtggcaaaaactgagctgaggctcagaagatcagtcacatagataaggctactatggagggcttggagacaa

SEQ ID NO: 27694 - DNA, 201 bp, Homo sapiens
ccaatttggtggttgaaataggaatttgaattacagaacatgaagattctcaaagtcaaatggcagcaggcagggctatattccagatgctgagcctgggmacaaggtctatcccaagggagttggcaaaagctaattcgagtgtcagggcctcagcaaaggcagctgggggattcatataggactgtaattccaggagga

SEQ ID NO: 27695 - DNA, 201 bp, Homo sapiens
  misc_feature (1)...(201): n = A,T,C or G, or insertion/deletion polymorphism (see Tables 1-2)
ttgggcttaaactttaagtttctcaaataggacagaagctaaggtctagacgcacagaggacaaaccatgggcagttgcagtttattgtaataataatctnatttgcctgcgtgcattcaagatgataaatggccggtatctcctgatggctcagcacgttactgagaatcgtttatcacaacatccatccccagaaaata

SEQ ID NO: 27696 - DNA, 201 bp, Homo sapiens
ggctagatttctctttcctatcttgtgaagaatactaatatcaagaaactgtgcacaaagctcaatcaagcctaggtagctaaggttggaaaagagtaacrtcacaaatggaattaaagattttcatcttcttcctcctacatcccagctggggggattaaggtaggtctgtgtaaggagagtgaggccctcagtaaaggg

SEQ ID NO: 27697 - DNA, 201 bp, Homo sapiens
tttgggtttcaacaaatgaatgtgtgaggaccacaaacatttagtccgtaacagtcctcaatctctctttttaagttttttttactgacacattgtaattstacatatttatgtggggcaatttgatgtttcgatacatatatatgttgtataatgatcaaatcggagtatttagtgtatccatcaccccatgcatttatc

SEQ ID NO: 27698 - DNA, 201 bp, Homo sapiens
tattgagcacctactacgttccaaacatcatgcaagctgctgggtatacaaagttaaacaaaactccatctctgtcttcacaaagtttccccccaaccctwcctaagtttgcctgagctagaataaacatggccaggaaggtctcttttctttaggaaacatctggaaatatgtatgtaatctgccaatggcaacttagca

SEQ ID NO: 27699 - DNA, 201 bp, Homo sapiens
  misc_feature (1)...(201): n = A,T,C or G, or insertion/deletion polymorphism (see Tables 1-2)
tagtcagcatcaggtgacagccttatgatttctttctgattcactcaaaaaacctagcacgatgctggtttcatgtatatcccacaaaattacgccttacntttactccaaaagaggctttaagtgatgtaggaagcactgaaagaaaagtaaaataaaatcaaggtagaaaagacaccttaacaagtacctagcttccat

SEQ ID NO: 27700 - DNA, 201 bp, Homo sapiens
aaagacttcaagctctccatcaccttccggaacaacagccacaaccgttacaccatcacagcttatctctcagccaacatcaccttctacaccggggtccygaaggcagaattcaagaaggagacgttcgacgtgacgctggagcccttgtcctgtaagctaacaatggtgtggttctttgtgagactcgctgtctggccc

SEQ ID NO: 27701 - DNA, 201 bp, Homo sapiens
gtcctcatgttcacattcctgccttggttagccatctaagtggtgcacttcttaaagccagggaccaggtagtcagcatcaggtgacagccttatgatttmtttctgattcactcaaaaaacctagcacgatgctggtttcatgtatatcccacaaaattacgccttacatttactccaaaagaggctttaagtgatgtag

SEQ ID NO: 27702 - DNA, 201 bp, Homo sapiens
gcatttaagcaggctcaaatatctgctgtgttaaaaacaaaaattacaaaaatctttttcaccactgtctcttcctcctcgcctccttgccgtcctggagygctgcctggacttgcgtcctgctgtgttccttctccactccttccgcgcacactctgtcctgatttctgctaccagcacttccttgaagttgttctcaag

SEQ ID NO: 27703 - DNA, 201 bp, Homo sapiens
  misc_feature (1)...(201): n = A,T,C or G, or insertion/deletion polymorphism (see Tables 1-2)
tttattgagtatgtattgtaaatatccacttgtaggttaatactagatggactgtaccatactccttagaatgttttctatgttgatttttgtttctccantaattgctttaatctctggcaatgcaaactcatttaacacttgcttttatatattgcattcatatatactccaaagacaaacaaatgctttatcagaatt

SEQ ID NO: 27704 - DNA, 201 bp, Homo sapiens
  misc_feature (1)...(201): n = A,T,C or G, or insertion/deletion polymorphism (see Tables 1-2)
agaacaattgtgttcccccacaaggcatcattaggcaaggatggtccaacctcaatacggtttctttacatccctgtgtttcagctacatccgtggtctcntgtattgtttatctatgtcacttgcaaaaaactaggcttgaatacagttttttaaaagtgatgcttttaaatataagcggtaatcaacttatgaaggaac

SEQ ID NO: 27705 - DNA, 201 bp, Homo sapiens; identical to SEQ ID NO: 6836
  misc_feature (1)...(201): n = A,T,C or G, or insertion/deletion polymorphism (see Tables 1-2)

SEQ ID NO: 27706 - DNA, 201 bp, Homo sapiens
  misc_feature (1)...(201): n = A,T,C or G, or insertion/deletion polymorphism (see Tables 1-2)
cagtggggaacacatgaccagaggaaatgagagaagattggaatatattctaaggccttaaaaagatgtcaagaacaattgtgttcccccacaaggcatcnttaggcaaggatggtccaacctcaatacggtttctttacatccctgtgtttcagctacatccgtggtctcctgtattgtttatctatgtcacttgcaaaa

SEQ ID NO: 27707 - DNA, 201 bp, Homo sapiens
ctcttgtcctccatacatttttttttttttttttttttttgagacggagtctcactctgtcgcccaggctggagtgcagtggcatgatctcggctcactgmaagctctgcctcccgggttcataccattttcctgcctcagcctcctgggtagctggggactacaggcgcccgccaccaggcctggctaatttattgtatt

SEQ ID NO: 27708 - DNA, 201 bp, Homo sapiens
atgaggacaaagggatggggctttgttcctccatagtgatcagtcactggatgtgagccacccctggaatgaggtgtgaccctggatgaggcagttttctyctgctaaggcaactcccaaggaggcctgaaccaccaaggactattttctgtcatcactcccagcagctgaggataagcctgtcggtcatttccgaaggtg

SEQ ID NO: 27709 - DNA, 201 bp, Homo sapiens
attttagagcagaaattaaccagctttcacacctgggacactgccctaatcagtgtataatcctaattctcattatgtcctcagtactcatatggtgtttyacacattgtaggtgcatttttgaaattgagattgttcttctatacattattttatttttatttttatttatttttattattatactttaagttttagggt

SEQ ID NO: 27710 - DNA, 201 bp, Homo sapiens
gtgtcctcctctcagcttttccccaccggaatgcacccacccacagggggagcagtgtctgatctattttatttttgttgttttgtcagcatgtaacagtrtgcagggcatagagcaagcactgaataaacagaattgcttggaaaaaatttttaatgcataaaaactccatgctgcaatgggtggtcttaatctataaac

SEQ ID NO: 27711 - DNA, 201 bp, Homo sapiens
gggcagagtaattagatcccagggtagcaaatgaaaccccaagtgggcaaatgcaaagtagcagatcccagaaggagcaatttcggccgcctgtccccagygtgctgatgagttctgaattatgtgtaacctctggggggaaggcagctatgaatcactggacagtttaatgaagacgcttgctcaatgtttagctgcagt

SEQ ID NO: 27712 - DNA, 201 bp, Homo sapiens
agaggtaggcctgatgctgatttaattattattggtcactggtaagaagcaggggctgcctgagcatagggctggtgaggaagggtgagggtgagggtgarggtggaggctaaacaggggctgaggtgggggtgggaatgatttgctgggcatcagctgacctctgtgaggtcagtgcggtgtagactggcgacacatggc

SEQ ID NO: 27713 - DNA, 201 bp, Homo sapiens
gctgtgtggctttgagaaaatgacttcacctctctgagcttcattttcttcatcagtagaatgaaagtaatcttagtagttaccatttcccgatggagtgrctataatgattaaatcaggtcatccaggtagagtgcttaccatagaggtaggcctgatgctgatttaattattattggtcactggtaagaagcaggggct

SEQ ID NO: 27714 - DNA, 201 bp, Homo sapiens; identical to SEQ ID NO: 6845

SEQ ID NO: 27715 - DNA, 201 bp, Homo sapiens
agcacatcagaatcacctggagggtcaccacgcttggagcacatcagaatcacctggagggtcaccacgcttggagcacatcagaatcacctggagggtcsccacgcttggagcacatcagaatcacctggagggtcaccacgcttggagcacatcagaatcacctggagggtcaccacgcttggagcacatcagaatcac

SEQ ID NO: 27716 - DNA, 201 bp, Homo sapiens
aatccatctgaaagtgctgagatgacaggcatgagccaccgcacctgactgacttcaggttttacctgttggcatacttctggggtcttgcgtccctactyctgtgattcttcccttaagtggtgtgtctgcgtgtgcagtggcctgctagcgcttagaagcggagcatgcacagtgcgtttactagtgttgtactcgtga

SEQ ID NO: 27717 - DNA, 201 bp, Homo sapiens
cttgcgtccctactcctgtgattcttcccttaagtggtgtgtctgcgtgtgcagtggcctgctagcgcttagaagcggagcatgcacagtgcgtttactastgttgtactcgtgaccacttgatgcattttttccttaccagttgagtgtccctggaggaaggccacatactggttaaattccgccattttggctcttagt

SEQ ID NO: 27718 - DNA, 201 bp, Homo sapiens
  misc_feature (1)...(201): n = A,T,C or G, or insertion/deletion polymorphism (see Tables 1-2)
ttagagggacagtcactatatgaggtctcctactattttgggtgcaaactaagtagtgtgaagcaccttcctgtgatacacctgagagctctttattttcnaaatgcacgaggattcacattactttcgaggtcctaagactctggcctgactttggtaaatgattcattccttcttcttgggtacaggagccaatatgtt

SEQ ID NO: 27719 - DNA, 201 bp, Homo sapiens
attggagtggagcaaagtggagtgaatcgggagaaaggatggataaggccagtcccttcttggacacagatgtcctgcccacacactggcttaaggtactrttagtagttactgcaacacgtaagtctaggcagacaagtagatagacagagagctagctgctcttagtcagtttgagctgctgtaacagaaatgccatag

SEQ ID NO: 27720 - DNA, 201 bp, Homo sapiens
tatttgggaggcctcaggctcaaaataggttaaatctccagatggtttgtttattgttaatgtctgacattggagtggagcaaagtggagtgaatcgggaraaaggatggataaggccagtcccttcttggacacagatgtcctgcccacacactggcttaaggtactgttagtagttactgcaacacgtaagtctaggca

SEQ ID NO: 27721 - DNA, 201 bp, Homo sapiens
  misc_feature (1)...(201): n = A,T,C or G, or insertion/deletion polymorphism (see Tables 1-2)
tcaggcaaagtgaaacacgtttcctcttccatacagccccctgctgtatccaactttttccttcccagacagtaaacccacaagctttatctgagtgtacnggaaacttctctatctttacaccttggctatccccctagaattccaccttggtcaaggccaacacatgaaaaaagacactgtgtgtcttagacaaaagat

SEQ ID NO: 27722 - DNA, 201 bp, Homo sapiens
attcatttggtatacatagctcctaaacaaacaaacaagtcttatagccacctggcattttgcggcacattgcgtttatgttggaaaagcatatggttctraagtgtgtggcatacagtaaacacagcttaaggtatagtaataataagagcattctacatagatcgccccataaaagtgtcagcccattttaaagacaag

SEQ ID NO: 27723 - DNA, 201 bp, Homo sapiens
tgccgttttatgagcatttttcattccaaacctttcttgcaagggaagaactattattcttatcttattcccaagttacttagagcttatacagatccatycatttggtatacatagctcctaaacaaacaaacaagtcttatagccacctggcattttgcggcacattgcgtttatgttggaaaagcatatggttctaaa

SEQ ID NO: 27724 - DNA, 201 bp, Homo sapiens
  misc_feature (1)...(201): n = A,T,C or G, or insertion/deletion polymorphism (see Tables 1-2)
ccatatattttctcccatattatatagtggctaaaggaacatggaatagtaatggctgtgttgtcatctggaagatccagacatccagtaaattccatttntgagccattgacttaatttaataaatatttactggacattggtattgaagtactaagtattggagttaaaagtgggctgaaatataaggtgaataagaca

SEQ ID NO: 27725 - DNA, 201 bp, Homo sapiens
  misc_feature (1)...(201): n = A,T,C or G, or insertion/deletion polymorphism (see Tables 1-2)
caagggtcctcttctctgggcaatgtccttcctctttacgtccattcttaaaaacgcctcatttccatatattttctcccatattatatagtggctaaagnaacatggaatagtaatggctgtgttgtcatctggaagatccagacatccagtaaattccatttttgagccattgacttaatttaataaatatttactgga

SEQ ID NO: 27726 - DNA, 201 bp, Homo sapiens
gatcagatcaggaagattttattcttgactgtagcataagtaagcaagggtcctcttctctgggcaatgtccttcctctttacgtccattcttaaaaacgsctcatttccatatattttctcccatattatatagtggctaaaggaacatggaatagtaatggctgtgttgtcatctggaagatccagacatccagtaaat

SEQ ID NO: 27727 - DNA, 201 bp, Homo sapiens
  misc_feature (1)...(201): n = A,T,C or G, or insertion/deletion polymorphism (see Tables 1-2)
gtgctggactccctgcctggcacacgatccatgctgtctaggtgcacctgctgttgttgctaccatgaccatcgtctgcccctctcctagttcccctgaanccagctctccaccactgccctccaggagatgcggatttaaatgtaacaaagtttagggagttggctgaaagtttcgtttttcttatagacttaagaaatc

SEQ ID NO: 27728 - DNA, 201 bp, Homo sapiens
tgccccagtggctggccctctgccatttgtaggccatctcagggatgacagctcacgtgattaaagggctaaatgaagccctttttggtggggaaagaggsggcttggactcaaggcagtgcccagtcagaacccgagctccaccatggatagcagtgacagaatcactttaccccaccccccatcacattactgtttcct

SEQ ID NO: 27729 - DNA, 201 bp, Homo sapiens
tattttacctgtacatattttagcgtgtagctttttaaaaatagacatatatacagtatacatagatacatatgtacatatgtgtgtatgtatgtgtttawgtgtgtttgtgtataattattgcagctaatacaaatcaacaagagctccttggtattatctaatgaaccatctttaatctaattttcccaatgtccaaaa

SEQ ID NO: 27730 - DNA, 201 bp, Homo sapiens
actgaggattgctggttaaagtgctggactccctgcctggcacacgatccatgctgtctaggtgcacctgctgttgttgctaccatgaccatcgtctgccyctctcctagttcccctgaatccagctctccaccactgccctccaggagatgcggatttaaatgtaacaaagtttagggagttggctgaaagtttcgtttt

SEQ ID NO: 27731 - DNA, 201 bp, Homo sapiens
cagaagcctctgtagtagcattttaggtagagtattaagatctgatttttttctactttttagattactatagcagaagtgtggaagataaattggaggamcgagattttgttagggacattagtaagagactcaagggggaaaaaaatctcactaataaatgataggataaatggatgctgcatgagtttgtatgatttt

SEQ ID NO: 27732 - DNA, 201 bp, Homo sapiens
  misc_feature (1)...(201): n = A,T,C or G, or insertion/deletion polymorphism (see Tables 1-2)
tgagactgtcgcccaagtgaaaaagatagcagaagataagaaggaaaactgtttccagaaattgtcaaaagacagccaggtgaacaagattgtggcccgangtggcacaggatgctgggctgaaaattacagcagcatgcacagcacttattgataggagaatgctcagctgtgctcctgagggcccttcagcctgctttg

SEQ ID NO: 27733 - DNA, 201 bp, Homo sapiens
ctttggagggagtgactgatggcaagaatagttgaaagaatcctccagaaagtgctatttgaggcgggtctcaaaaaacgaatagaaattgacccaggggratggaaattgtatacattctagaaaaaaaaaaatagaaaagttcagtggagcatgacattttggaagcacactgatgtctttgtatgacttgataagaag

SEQ ID NO: 27734 - DNA, 201 bp, Homo sapiens
gggccttctctctctctcacctctgagcctgcagcctcgacaaatcatgaaaggcaaggaggggagtggtaatcacaggttttactaacctgtggctgagrctgtgaaagcttgggagcagcttctggtgttaatttgctgttactttgacatgggcccctgcttttttgatacccagttgagggtgaaatcccaagctgt

SEQ ID NO: 27735 - DNA, 201 bp, Homo sapiens
  misc_feature (1)...(201): n = A,T,C or G, or insertion/deletion polymorphism (see Tables 1-2)
gtcacacagctggaatttcttagaggcaatatgtttccatcaacccaagtacatcaaagcggtcagaaaaagagggatgcccagtgtcctaagatgactgngctatttctgttactttggggtatttttaaagaaaaagcagacacttggcctcaccagtgcaaacacccatgcaccttagaagttataggtggtccagga

SEQ ID NO: 27736 - DNA, 201 bp, Homo sapiens
  misc_feature (1)...(201): n = A,T,C or G, or insertion/deletion polymorphism (see Tables 1-2)
tgtcacaggagcaaattctggccaagacagcaaattccaccaaggacctactctgtaaattcctaacttcctattagtgggtttttaaaattgtattttcnggaacatagtcccattcatgggactaaaataatactacgttgatgatcaaacgcttagaaacgaaacaattagaaccctgttgggattctactctagttg

SEQ ID NO: 27737 - DNA, 201 bp, Homo sapiens
atatgagattttatctgtttgcttgtttgtttttacataaatgatgcagaaataactgactctccaactggaagaaagtttaaaaattgaccctcatcttrtcccatatacagtagtaaatctcagatggaatgagtattaatgtaaaaaagacaattttttgaggaaatttaacagacttaactaaaaactggaaactct

SEQ ID NO: 27738 - DNA, 201 bp, Homo sapiens
  misc_feature (1)...(201): n = A,T,C or G, or insertion/deletion polymorphism (see Tables 1-2)
ctgcagttttatgcttgtgtgtgtgttaatgcataacaaaggattcagcgctatggcctggtaactggaaagtaggtcaaaagagaggggtgagactgtcncccaagtgaaaaagatagcagaagataagaaggaaaactgtttccagaaattgtcaaaagacagccaggtgaacaagattgtggcccgaggtggcacagg

SEQ ID NO: 27739 - DNA, 201 bp, Homo sapiens
tcattaataaagaatttttacctagctaacattttttaaatcaaaaacaaagggaggggttggaggctggagggaggtcatttaaaaaaatgattacaaawcctatttgttttagctcaaagtctcaacagtctaagacttggtgatctaaatttaaaaaaaaaaagtcatgagttttgttttgttttattttcccatagt

SEQ ID NO: 27740 - DNA, 201 bp, Homo sapiens
tttaaatccaaagatgtttttgaaatgtttcttaatgcaggaaaaaatatattggacacacttgagaatgaaatcagggacaccatgtaaagtattctgawgtattgctacaccttcaatatctaaattgattgaggcagggcctctgggaagaaagtgaaaaattcagtctgtcttccacatgttttgtctataccagtg

SEQ ID NO: 27741 - DNA, 201 bp, Homo sapiens
atatttagtaggacataatagagaatccagaaatggatttcagtatatgagttaatatgattgttggtttcatgaagtaagaagaccatatgagattttawctgtttgcttgtttgtttttacataaatgatgcagaaataactgactctccaactggaagaaagtttaaaaattgaccctcatcttgtcccatatacagt

SEQ ID NO: 27742 - DNA, 201 bp, Homo sapiens
tatctaagtggaaaaaagttaacaaatttcactgtaatcagaaattagaaagaaatgcctgctatcatcattccctttttaaaaagaagtactttaaaggytttagtaaatgaacaatgtaagagatacatctgctataaatgctggaaactaagaagtaaaactatatatttgctaatactatgattgtgtatgtagaaa

SEQ ID NO: 27743 - DNA, 201 bp, Homo sapiens
tacaaagggaaaaagaagctctgggccaggcatggtgacttatgcctgtaattccaactctttggaaggctgaggcaggagaatcacttgagcccaggagktcaagactagcctgggcaacatagggagaccctggctctacaaaaaaaataaatttaattagccgagcatacacctgtagtcctagctactcgggagcct

SEQ ID NO: 27744 - DNA, 201 bp, Homo sapiens
ctaaatttcaatttcacgtaaacagaatgggattaataatcatgtctacccccaagaccatagggctgtagagaagattaaataaggtagtgtaagtaaartgatgaacagaatgcctgcattactaagtaaacactaactaaataaatgtaagttacttgttattattgttgtcattaaccagagtcaggatcacgtgtt

SEQ ID NO: 27745 - DNA, 201 bp, Homo sapiens
tgtaatgtcaatgtaaacattgttgaaatggcaccagtttttggaaaagctcctggactccccacctaaactcttctgactgtaattaaacatgatcaacrttacaccaagagaggtagattcagcagtgcccagaaaaaaactggcaagatgccttgaaactgttacctcttggcctttgttttactatgtaaacacaaa

SEQ ID NO: 27746 - DNA, 201 bp, Homo sapiens
tgcttctaaacgaatgtgcacacaaatcacccagtgatcttgttaaaatgcaaattcttattcaagagttctgggaggggcctgagattctgaattcctamcaagctcccagggaatgccaatattgctgatccatgaatgcctcaagtagcaaggctccacaccattgtaatgtcaatgtaaacattgttgaaatggcac

SEQ ID NO: 27747 - DNA, 201 bp, Homo sapiens
acagtgatttctgcatttccatctgaggtatggggttcatctcactagggagtgccgcacagtgggcacaagtcagtgggtgcgtgcactgtgcgcgagcygaagcagggcgaggcattgcctcactcaggaagtgcaaggggtcagggagttccctttccgagtcaaagaaaggggtgacggacggcacctggaaaatgg

SEQ ID NO: 27748 - DNA, 201 bp, Homo sapiens
gtcttattcttactcaaatatacatttcctatatgtttgttgactatataagtgattattgaacaactacagagcatccagtctttgctaacacttggtaraactcagaaagacggagattttttttctttgttcccaatgaattgataaaccagcggggaagacagacttctctacaactagacacagcaagtcaaaaag

SEQ ID NO: 27749 - DNA, 201 bp, Homo sapiens
tctgtcttttttctttttgagttggagtctcgctctggtgcccatgccggagtgcagtggcgtgatctcagctcactgcaacctctgcctcccaggttcawgtgattctcttgcctcagcctcctgagtagctgggattacaggtgcccgccaccaggcctagctaatttattttttgtatttttagtagaaacgggattt

SEQ ID NO: 27750 - DNA, 201 bp, Homo sapiens
tttcttgaccatctctctccaggcataaggtcttattcttactcaaatatacatttcctatatgtttgttgactatataagtgattattgaacaactacakagcatccagtctttgctaacacttggtaaaactcagaaagacggagattttttttctttgttcccaatgaattgataaaccagcggggaagacagacttc

SEQ ID NO: 27751 - DNA, 201 bp, Homo sapiens
ctgacctcaagcaatctatctgcctcatcctctcaaagggctgggattacatgcctggccaaaaagatcagcattttgattatatttattactttctagawtttaaaatataaattagaaatctcaggtttttgttgactagctggtaagatggttaaggttaggagctgagccatgttgcctctctgctttactccatag

SEQ ID NO: 27752 - DNA, 201 bp, Homo sapiens
  misc_feature (1)...(201): n = A,T,C or G, or insertion/deletion polymorphism (see Tables 1-2)
gtatcccatgtacctagatcacagcctggcatgtcataggccctcaataaatattggttgaattaaattgcaaatgtaaacgctttagaagacaacatttntctggacatggttgtgtgcgtttattcttaaaagtgacttataatctcataaatctgtatgaaatgaacatagatacagcacatgcatataacaggaaac

SEQ ID NO: 27753 - DNA, 201 bp, Homo sapiens
acctagatcacagcctggcatgtcataggccctcaataaatattggttgaattaaattgcaaatgtaaacgctttagaagacaacatttgtctggacatgsttgtgtgcgtttattcttaaaagtgacttataatctcataaatctgtatgaaatgaacatagatacagcacatgcatataacaggaaacatttcttgcga

SEQ ID NO: 27754 - DNA, 201 bp, Homo sapiens
tcatttacattacagctaagaaagatggcactcatgtggtggaaaatgtggatgccacccacattgggaaattaattgtgaccaaacaaattggaggagayggcatgatggatattactgatacttacaaattccaagaaggtaatttactaccactgaatgaagatttatttgcccaagtccattgagtacttattcatt

SEQ ID NO: 27755 - DNA, 201 bp, Homo sapiens
  misc_feature (1)...(201): n = A,T,C or G, or insertion/deletion polymorphism (see Tables 1-2)
cctggcaccagtgatcctgccctagaaaacctccttcttcttaagggaataactattattatagtctgatcgagctgatacaaatatagcccttgtgttgngaggcttatgtgagaatatatgtgaattatggttgtcagctggggctggttctttgtaatcaacaggggtgcctcaaataaatgaattacaggatccacc

SEQ ID NO: 27756 - DNA, 201 bp, Homo sapiens
aacatcgtacctggcacaggacagctctgcaacaaagatgcatccagcccgatatgtcagtagtgttgatgctgagaagccctgatctagatcatgattastgtttttgccacagccttcaaaccaggcttctctctccacaccccatgtgccagccagcctaaaagtaacttctggttcatgttctagtttgcctgtcat

SEQ ID NO: 27757 - DNA, 201 bp, Homo sapiens
gtccattgagtacttattcattgtcactcagagatgagttccagagaatgcactggcatttgcagcatttggtagcaacagcagaagtataaactttcacytgtgaaagacacgtcacatatgcaatttttcattgtagttttctttgctagcttgctttgggcagaattctcattcacgtggcttgtaaaatgatttggt

SEQ ID NO: 27758 - DNA, 201 bp, Homo sapiens
gctactatcagatatacttttgaaggggcttatgcccatccttatatagcataccatggagaagacagatggctccaaaatattttttccagaaagaatawagtgatcatagcaaacacttttgccaataatgtctctgtggcagctccatcttcttcagtttagagagcttttgtaaatgctatctttattttgtatttt

SEQ ID NO: 27759 - DNA, 201 bp, Homo sapiens
tactggtatgggaagggttcttaatctagggttcatgggcccctagaaaaccatgtatggacttcataggtctatagtgcatcccctaaaaatacatgccyatattgtatatatcttgtatttgtcactgtgtatgtctgtgtagaggaaaggtcagtagctactatcagatatacttttgaaggggcttatgcccatcct

SEQ ID NO: 27760 - DNA, 201 bp, Homo sapiens
tcagatgcaagaatcgttcaggcaaagtgaaacacgtttcctcttccatacagccccctgctgtatccaactttttccttcccagacagtaaacccacaayctttatctgagtgtaccggaaacttctctatctttacaccttggctatccccctagaattccaccttggtcaaggccaacacatgaaaaaagacactgtg

SEQ ID NO: 27761 - DNA, 201 bp, Homo sapiens
gaggcttcatgtagagccagtctactggtatgggaagggttcttaatctagggttcatgggcccctagaaaaccatgtatggacttcataggtctatagtrcatcccctaaaaatacatgcccatattgtatatatcttgtatttgtcactgtgtatgtctgtgtagaggaaaggtcagtagctactatcagatatacttt

SEQ ID NO: 27762 - DNA, 201 bp, Homo sapiens
catcagtgacctggaagggtgtatttcactttccacagcgtaggaggcttcatgtagagccagtctactggtatgggaagggttcttaatctagggttcaygggcccctagaaaaccatgtatggacttcataggtctatagtgcatcccctaaaaatacatgcccatattgtatatatcttgtatttgtcactgtgtatg

SEQ ID NO: 27763 - DNA, 201 bp, Homo sapiens
atactaagcattccttctcactgtcatcagtgacctggaagggtgtatttcactttccacagcgtaggaggcttcatgtagagccagtctactggtatggraagggttcttaatctagggttcatgggcccctagaaaaccatgtatggacttcataggtctatagtgcatcccctaaaaatacatgcccatattgtatat

SEQ ID NO: 27764 - DNA, 201 bp, Homo sapiens
aatactggaagcaaactgattaggcatgacatatgaaattacctgagaaggtttaatgtcctgaacatattcagatctgaagcctatctatgatggcccarttgcatgggccagtttctcaaatactaagcattccttctcactgtcatcagtgacctggaagggtgtatttcactttccacagcgtaggaggcttcatgt

SEQ ID NO: 27765 - DNA, 201 bp, Homo sapiens
atcaacacataacgtgaaaacactatgtgttggcagcattttcctcaaaagaagcaaggagagggagacacctccagttacatttcccaagcagaacacastgatgtcgagcattgggtaggtttttacatttagtttggtttgagtgtctaaggctcattatcatcagtagtcagggacaggaagtttacattctcggtg

SEQ ID NO: 27766 - DNA, 201 bp, Homo sapiens
cttgacaccatgggttgcattgtagagagaggtgggtacaggcacagttgtgtgatttcctagtgtcatatgtcaacagtggcaggagctggaatgacatscagcccctgaattaccctgtgctctaagactggtctgtatagtgccaaatattgataacttgggcccacccaaggagaaaatctcatataaataaaagta

SEQ ID NO: 27767 - DNA, 201 bp, Homo sapiens
ggtaccatagcatggtgcatcactgaaatcaacacataacgtgaaaacactatgtgttggcagcattttcctcaaaagaagcaaggagagggagacacctycagttacatttcccaagcagaacacagtgatgtcgagcattgggtaggtttttacatttagtttggtttgagtgtctaaggctcattatcatcagtagtc

SEQ ID NO: 27768 - DNA, 201 bp, Homo sapiens
gccatgtgcaagctccagtcttgacaccatgggttgcattgtagagagaggtgggtacaggcacagttgtgtgatttcctagtgtcatatgtcaacagtgkcaggagctggaatgacatccagcccctgaattaccctgtgctctaagactggtctgtatagtgccaaatattgataacttgggcccacccaaggagaaaa

SEQ ID NO: 27769 - DNA, 201 bp, Homo sapiens
tagcaatggaaagggcggatttctacagtcctcaaagagatgatttgcttttgaatacttgtgtttctctcctcttagttgctatcatccatgatttctgygcctttttgattgtttcttttttggtggtggcattttgtttttgtagctggtaacctggtatttctaagagttatttggtgacttattcccacttggtct

SEQ ID NO: 27770 - DNA, 201 bp, Homo sapiens
gttggcatcagacagtccaggttttgacttttgaactggcccattagtagctaaggaaagctgaggatagtttctgtgtcactgaaaacaatcacacttayctcatggaaatcttagtgtcctttctccagacctgctccctctctttcctgcatttgagggatgagatctacttttagaattacagagggaggaggcatt

SEQ ID NO: 27771 - DNA, 201 bp, Homo sapiens
acggggattgtggtcttaataagaccagaggacttaggagaaaggcagcttggaatagagaggtctagagaattaaacatctttagctcacagcataatgsaaagaaagtgcccttcaggggaacatgtatacaacagggttctgagaagaggtaaaaataaaactgcatcctgcactttctgcttgccgtaatgctgcag

SEQ ID NO: 27772 - DNA, 201 bp, Homo sapiens
tgatttgacacttttgaacattacaaggcagtaatttttagaatgcccctccatttgggtttgactgatgtttcctcacttgatgttaaaatcaagtcacrtatctttcacaggaagattgcagaaatgatgctgtgttcttcttggtgcctcctacctggttgcacataacttttacagatcccattactgatgatgtta

SEQ ID NO: 27773 - DNA, 201 bp, Homo sapiens
ggcatctaagaaagtaggacagtgtttcccagagtgtgttctctatgaacacctgtcatgtgagattctccttgggggaaaaaagttccatcatcaaatayagttggatcatgctgtgttttgtgtctcttctcatagaggcccaaggcacattaatatataaaaggctatgagtagacacgtagtcaaaaaatgaatctt

SEQ ID NO: 27774 - DNA, 201 bp, Homo sapiens
cctgtgctaagaaagaggaccagaggagttgattgctaagctccttttcaacaggaacatttgtgctcctccagctcattcttgggctggtttatcacggrgattgtggtcttaataagaccagaggacttaggagaaaggcagcttggaatagagaggtctagagaattaaacatctttagctcacagcataatggaaag

SEQ ID NO: 27775 - DNA, 201 bp, Homo sapiens
cttcctctgcatgcagtttcttttccctatatttatgctcaaacttgcatcattcttgtctctagacgttctatttgctgtaataaatgaaattcttctcmatctaaggttagtttgatctcacttctgaactacaatttgaggccaatgtaccacattctatctactcttcagtactctgcaagagattggagtgaggac

SEQ ID NO: 27776 - DNA, 201 bp, Homo sapiens
ctaataatggcatctaagaaagtaggacagtgtttcccagagtgtgttctctatgaacacctgtcatgtgagattctccttgggggaaaaaagttccatcrtcaaatacagttggatcatgctgtgttttgtgtctcttctcatagaggcccaaggcacattaatatataaaaggctatgagtagacacgtagtcaaaaaa

SEQ ID NO: 27777 - DNA, 201 bp, Homo sapiens
aaaaaaaaaaagaatgtgttttaagggttttgctttatcagatgcataatataaatcaacagtgagttaagagtatccaagacactgacaatatcttgatktgaaataatagactgtttattttaaaagatgtaatggtctcttttttttttttttacagaaaaaccacaactagagtaatgtacttaattccagaaaata

SEQ ID NO: 27778 - DNA, 201 bp, Homo sapiens
ctgctgtgggggatgggggtgagatttctaggtcactggagctgtgtacctaagaggattatggctgcctctgctgagtcatgcaggttgtcagggaagtkgggggaagctggcagtcacaggagtcacccagctgccatgcaaaccaaagggccagtctcactcccaccgtgcccccctcaacagccctaagtccatttc

SEQ ID NO: 27779 - DNA, 201 bp, Homo sapiens
  misc_feature (1)...(201): n = A,T,C or G, or insertion/deletion polymorphism (see Tables 1-2)
accgtggctcccactagtacatttcagccaaccatcatctttcaatttcttaagcaactatgcactctcttgcctcagtcttcacctatccttctttctcngcctgaagcattcctctccacccccctttccacatggacaactgactcctcttttgctcactgcttatgtctcacttccttcagagaaattccttatttt

SEQ ID NO: 27780 - DNA, 201 bp, Homo sapiens
cttggtaatggtgaattatctcagcatttgtttgtctgaaaaaggctgtatctttctttcatatatgatgcttagtttcgctggatacaaaattcttggcygataattgttttgtttgaagaggctgaagatagggttccaatcccttctagattgtagggtttctgctgagaaatttgctgttcatctgataggttttct

SEQ ID NO: 27781 - DNA, 201 bp, Homo sapiens
tccctgtgaaggtctcaggagagaggcttcccaagctgtgaagtgctcaaaccacagcagaaaatagaatttaattgcaccactgataataaaccggatgkatgaaggaaactgataactttcatcttttaggcactattaatttgcaggattatttgttagttatcttctgggtttacttaaagagcagtttaattcccc

SEQ ID NO: 27782 - DNA, 201 bp, Homo sapiens
  misc_feature (1)...(201): n = A,T,C or G, or insertion/deletion polymorphism (see Tables 1-2)
tgatgtgtgattttcacatacataacatactttctctattgagaaatgtcttgccccaaactgtgcagcttgtaacgtgtagataactatttcttagcctntactctttcaactattttgtgctgcattttggtgaaaatagacagcctatttcatcattttgaagcaacatttatatagaatgtcatttcagatttttgc

SEQ ID NO: 27783 - DNA, 201 bp, Homo sapiens
tttcacatgaatcactatttgcccatgtttgccactatttctcctatgttttatttttgaagctttataatttgaacttttacattgtggtctatgatccrtcttgagttaccttttggtgttgtgtgaggtagggatcaaatcttattttttccaaatttatccatttgttccaccagcatttgttgaaaagactgttgg

SEQ ID NO: 27784 - DNA, 201 bp, Homo sapiens
tatgatgctacgagagcccctaatgaggagatcactctgaaatccacaaagccttgttttcagctttttattacactttattgctgcaaagaaggagaagraggacctccctccacaagcaagctgcctaatagctgtaaatgcaaacactttttgctattattaaatatagatcggggtgttatgaatgtcatcaggatt

SEQ ID NO: 27785 - DNA, 201 bp, Homo sapiens
tgctggtagcactgggggtgggtcatgagttgcctggccccactaattcacacacaatgttctatttcccctggatttgtcctctgtctgtcctctctccmggtcacatgagctccttggatacagatataatgccttttacatgtcctgtctgattcaatccttctctttcaggtgggggcagtggggggacgatgaact

SEQ ID NO: 27786 - DNA, 201 bp, Homo sapiens
tgatcctacagataaacagaaaataaagttattttccctttgtccatcttttcctccccctctttttgtcccagtatttagaaagatttttttctttccaygcatgaaaaagacagtaatgacataactacttttatatcttgccaagcagctcctcaaggggttaactataaaaccatgttttgttcattttctttcaat

SEQ ID NO: 27787 - DNA, 201 bp, Homo sapiens
actgaagaacttggagtctgatgttcaaaggcaggaagcatccagcatgggagaaagatgtaggctgggaggctaggcccatctctccttttcaagttttkctgcctgctttatattcactggaagctgattagcttgtgcccaccagattaagggtggatctgccttccccagcccactgactcaaatgttaatctcttt

SEQ ID NO: 27788 - DNA, 201 bp, Homo sapiens
ataaggaaaagggagctttgcagattcctaaaataatgtgatgcaaacagatattttctccccaaatagtcattgttctcagcattttgtaggtaccatarcatggtgcatcactgaaatcaacacataacgtgaaaacactatgtgttggcagcattttcctcaaaagaagcaaggagagggagacacctccagttacat

SEQ ID NO: 27789 - DNA, 201 bp, Homo sapiens
  misc_feature (1)...(201): n = A,T,C or G, or insertion/deletion polymorphism (see Tables 1-2)
catatgcttagtggaagatatcttgtgatttctaaaaaagtaatttctttccaaaaagtttatataagagaaagagagtatgtgtgtgttagtaactttcntgtttaccaaagaatcagagtagcagctcattatcatgaattagtataaaggacaggaatgtcaatatcagtaagtgatatgtaacttgaaaaagcatac

SEQ ID NO: 27790 - DNA, 201 bp, Homo sapiens
tgactttgcagaatttataacataggaataatgacggcaccctcctcctggggaggtctgaagcttgtattatagaaacaccccaacaagtgcagtacacrgtgcatccattaatgtgactttctctctggtggattgtatttttgcctgtcattatctctggatctcccccaggtcaagaagaagagagattggccctag

SEQ ID NO: 27791 - DNA, 201 bp, Homo sapiens
ggatttcagaaaataaagaagctattccagcaaaaaaaaaagtttctatttttacctgtattctgtcagggatcacagtatatgtagttttgaagatgaawgttttagagtcagaaagacctggatttatatccaacttccgccagattcctaactctgtaggctttttatttatcttctaaatttcaatttcacgtaaac

SEQ ID NO: 27792 - DNA, 201 bp, Homo sapiens
gattatacaggaaagttttacttatcactgccttagtttttccccacttatagtaccactgtgattttatgtttttcctgaggcattggcttgttgaagtkatattgcaacagagaatcaaaagatcacttagaaaaagtaacatgttagaaaacatcatgcttagaattaaatgtctaaagtataccagtatagatgata

SEQ ID NO: 27793 - DNA, 201 bp, Homo sapiens
  misc_feature (1)...(201): n = A,T,C or G, or insertion/deletion polymorphism (see Tables 1-2)
cttagccaggatagatgatcgtaaactatgtctatgagtgagccctcctcatcgaaggtgttcatttccatctctctcttcaggacagctacagaacagtncacattttagaatgaaaatgaggagtcactggtaactgcggtacctaaaacataatttgctctgtgcatttcatgtttgctatttttttgaatcttaaaa

SEQ ID NO: 27794 - DNA, 201 bp, Homo sapiens
aggagtgcagttgctctgttttaacctgagctaaccagcacttacacagagcctggggtgctcctcttgcaaagacagtgtacatggggcctgtgaaagakgcttaacccacagaaatcgacttcaacaagcagaatatctgcatgaccagcactgattggtggggaattgtatagataacacaagatccatgggaagtat

SEQ ID NO: 27795 - DNA, 201 bp, Homo sapiens
aagatagactcaatctgatgtttctgttctattttgaggaccattcaacagcacaggcagaaaactctgattgtcaaagaatgttctagcaaatgattagwaatgttactgaagagacagtttgggttcctagtgataaaaatcaatcattccttataatagcaaccaccaaaaaaaggtcatagttttagctgctgcata

SEQ ID NO: 27796 - DNA, 201 bp, Homo sapiens
ttcccttgagatgtatgcatttatttttaaccctggccttttgctaatatcgaaccacaatgccatcattaatccccattaatactttgctctgactatgmcttttgggaactaactcatgactaaacttttttaaccaatcgatgttcgatgtactctttagcattgtaaaaaaatcttgaacttcagctagtaaatcaa

SEQ ID NO: 27797 - DNA, 201 bp, Homo sapiens
agggcatagagcaagcactgaataaacagaattgcttggaaaaaatttttaatgcataaaaactccatgctgcaatgggtggtcttaatctataaacaaasctttttcaaagcacattttagagcagaaattaaccagctttcacacctgggacactgccctaatcagtgtataatcctaattctcattatgtcctcagta

SEQ ID NO: 27798 - DNA, 201 bp, Homo sapiens
gccaggaactaggcttggacaggggaagcaaattcatttcctgtttgtggcaaacggagtctggatgatgataagactttttccatctaaactgccttgtkaacccagtaaacaaagcaaaaatcaatatgctagattcatcaatgcttgctggaacacactccatggcaagggacatttcctaggcaaaatggacaatgg

SEQ ID NO: 27799 - DNA, 201 bp, Homo sapiens
gagaaaagaaaaaaaagagaagcaattagaaaaaatgaagaaacttgcccacagttatacttctccctttaaattgcattgcttgattgctgctttctttycaatgcatttctgatgtgacagttcccaccaggaaaattgccagagaaagctaaggagaatgcttaactttgtgccatccgaacacttacttccctcaca

SEQ ID NO: 27800 - DNA, 201 bp, Homo sapiens
attataactcagacctgtgcttctaaacgaatgtgcacacaaatcacccagtgatcttgttaaaatgcaaattcttattcaagagttctgggaggggcctsagattctgaattcctaacaagctcccagggaatgccaatattgctgatccatgaatgcctcaagtagcaaggctccacaccattgtaatgtcaatgtaaa

SEQ ID NO: 27801 - DNA, 201 bp, Homo sapiens
aacagacttaactaaaaactggaaactctgacactgtagaagaaagcaagaaccatgtacagttatgtgccacatagcaacatttcagtcaatgacagatyatgcataggtgatcttatgagattctgatggagctgaaaaattcctgttacatagtgatgtcatagctatcataatagaatagtgagattacttattttt

SEQ ID NO: 27802 - DNA, 201 bp, Homo sapiens
aaatacgttacagacaagcaaatgctaagagattttgtcaccaccaggcctgccctaaaagagctcctgaaggaagcgctaaacatggaaaggaacaaccrgtaccagccactgcaaaatcatgccaaaatgtaaagaccatcaagactaggaagaaactccatcaactaatgagcaaaatcaccagctaacatcataatg

SEQ ID NO: 27803 - DNA, 201 bp, Homo sapiens
ggagggggagaatttgggtgttaaggggtagaggtcctgacctgagacattttgagcaatatttccatttccgtcatacccttgtttatatacacaaaatrttcaatggttttcaaaaacactttcacctctattagctcctttaaaccttagaatacctctgtgaatctttccaaaatctgttccgttttaataatttta

SEQ ID NO: 27804 - DNA, 201 bp, Homo sapiens
catttttttcagtggccactcttccagttagcaagctgctcttgtaatactgactgagaaatgcagagaggcaagaagaggaaaaggggggaaatggcggstttttcatttctaatagttctgtagcagtgagtcctgcccatcactgtgtgtgatatatacagtgttctaaggtatactgagtgtatataacgcccttaa

SEQ ID NO: 27805 - DNA, 201 bp, Homo sapiens
ggacgtggattaaatgggatgtccaggacccatgcagtcctggattatatcaatgtacccaacatggagagccagatgttggtacagagaagtagacccartctggctgaagagtagattatttctgaagaaatgttaaactgggtggtatttcaaacaatcaaagactgaaaaaaagaaatacttatattaccaatttcc

SEQ ID NO: 27806 - DNA, 201 bp, Homo sapiens
  misc_feature (1)...(201): n = A,T,C or G, or insertion/deletion polymorphism (see Tables 1-2)
gattgtcgtgagcatctagtgagcagtgtctgtgatcaagtctgacccacagcacgtgaccaataagtgttcattgactgggaatgtgcaacttatcatancccagcaaggtcaggaaagcactccagggaatacttgttcctatgaggaatatgtacgacctgtagcccccataaatctgacatctgaacaaaatgctgc

SEQ ID NO: 27807 - DNA, 201 bp, Homo sapiens
  misc_feature (1)...(201): n = A,T,C or G, or insertion/deletion polymorphism (see Tables 1-2)
tgaggtacagtataggtaaaatcttcctgtcttgctatttgatctttattcctttttaagaaaattctggtattgcctgtggctagcagttctttctaagnagactgaactggtaccagactcctcccttgatagtgtaatctactttctgcagccttctgccctctccttgatcctggggtccaccttgtctcagaagag

SEQ ID NO: 27808 - DNA, 201 bp, Homo sapiens
gtcagaaacttccaggaccgcctttggaggcagaagagcagttccacccaataactctaatgcagcggaagatgacctgcccacagtggagcttcagggcktggtgccccggggcgtcaacctgcaaggtatgagcataccccccttccccaccactctgggtccaggcacagccgggccctggcccctcttccctgcagg

SEQ ID NO: 27809 - DNA, 201 bp, Homo sapiens
cagaataaccagccaagcatgtttacagtgatgcagggaatcaatccgttctatgactatttccttaactctccagttagttgctatcctgcccagcaaayacagctgagagaagctgcttaataagaaccaaaatactgagctatttgcatacctgaagaactagtgcaattacccattactgcatccatcctgtcagtt

SEQ ID NO: 27810 - DNA, 201 bp, Homo sapiens
cctttgggtaggcaccctggagcacagtcacttgattgtatcttctgccactcaaagaggctattggtgtgtatcctttggccagaataaccagccaagcrtgtttacagtgatgcagggaatcaatccgttctatgactatttccttaactctccagttagttgctatcctgcccagcaaacacagctgagagaagctgc

SEQ ID NO: 27811 - DNA, 201 bp, Homo sapiens
tcctcagtgacatgcaacctttgactatactgcctactgcctgatgcccttgtcttgggtccccaatttctagcctttagcctggtgattctatttatggyccaaatatgacaatctatagatagctaacaaggggaaaagtcatcaaggtgggcagcaaggaggtctggaaaagtgtcccaagcccagtcagggcactct

SEQ ID NO: 27812 - DNA, 201 bp, Homo sapiens
gtgggggccaatattcaacattcttaaagaaaagaattttcaaccccgaatttcatatccagccaaactaagcttcataagtgaaggagaaataaaatackttacagacaagcaaatgctaagagattttgtcaccaccaggcctgccctaaaagagctcctgaaggaagcgctaaacatggaaaggaacaaccagtacca

SEQ ID NO: 27813 - DNA, 201 bp, Homo sapiens
tactccagaagcatgttgtaaggattaatgagggaataactggaagctctttgaactgcttcgtgatagttccttcctaataagatgacccaattaccagscttattttcaatattgcaactatgtaggaaagctaaattcttatggtattccttaaggaaggataaccttcataaaatgctactataacagcagccagag

SEQ ID NO: 27814 - DNA, 201 bp, Homo sapiens
gttgctatcatccatgatttctgtgcctttttgattgtttcttttttggtggtggcattttgtttttgtagctggtaacctggtatttctaagagttattyggtgacttattcccacttggtctcagcacactccctttccatcctaagactgttagcacaagttttgcttccttttccaaagcaactgtattcacacttc

SEQ ID NO: 27815 - DNA, 201 bp, Homo sapiens
tgatttatttagccaacacttactgagcacctcctaatgactgggccctgctctagtgctggagatgtgtagaagaataagaccaacagagctcccaaagkagatttatgcactctacaaatgcatgatggaattgcaagatgaaaacagaaaaactcttatggatctagataaagaagctttagaataaaaagtagcatt

SEQ ID NO: 27816 - DNA, 201 bp, Homo sapiens
gacacggtaccttttgactgtatagtgagaacttaagtttcaaatgaaggctccgagaacataaaaaaccatgaatcttaaagagaaacaaacaagcaaargtttaataagaacttccttgctagatgtcctcatgatttatttagccaacacttactgagcacctcctaatgactgggccctgctctagtgctggagatg

SEQ ID NO: 27817 - DNA, 201 bp, Homo sapiens
  misc_feature (1)...(201): n = A,T,C or G, or insertion/deletion polymorphism (see Tables 1-2)
gatccagttcaatatgttatttcaagagaaaaactcccccactttgtgatttgggcttaaactttaagtttctcaaataggacagaagctaaggtctagangcacagaggacaaaccatgggcagttgcagtttattgtaataataatcttatttgcctgcgtgcattcaagatgataaatggccggtatctcctgatggc

SEQ ID NO: 27818 - DNA, 201 bp, Homo sapiens
ggggtagggaaacttggagaaaagtaaagcagaccctgtctcaagtcttgatgccaggcctgtgtgtgttttctcctactagtcaagaaagaggcggtgcwgatccaagccggcgagtacatgggtcagctgctggaacaagcgtccctgcacttctttgtcacagctcgcatcaatgagaccagggatgttctggccaag

SEQ ID NO: 27819 - DNA, 201 bp, Homo sapiens
  misc_feature (1)...(201): n = A,T,C or G, or insertion/deletion polymorphism (see Tables 1-2)
attctgttttgttctctgatgtatcccatgtacctagatcacagcctggcatgtcataggccctcaataaatattggttgaattaaattgcaaatgtaaangctttagaagacaacatttgtctggacatggttgtgtgcgtttattcttaaaagtgacttataatctcataaatctgtatgaaatgaacatagatacagc

SEQ ID NO: 27820 - DNA, 201 bp, Homo sapiens
actcacccagccaggcgtgcacctggggctccccccttctcccccttagcactgtgtctcccgacagcgcgccacactgttctgcacccctggcaatgccrcagcctaccttcggtatttctcactagaggatggctctcgcagccttctccctatcattaaccctttttcgctcttctccctcccttcccccgtcagctc

SEQ ID NO: 27821 - DNA, 201 bp, Homo sapiens
tacatacacgggtagattcaagggctgtttaagaggtaggatagaaaatatttgctcaaggatcggatttgatgattgagggagagaaacaaggaagcctsaagaatgatgcccatgtgtctggtgtaccacctgcgtgcaaagtgatggtattcattgaggtagggaactcctgagatgcaccaggttttccaggaaagt

SEQ ID NO: 27822 - DNA, 201 bp, Homo sapiens
ggtagacagtttgaaagctgtcactttgaaagagcgagctgccaagtttctagctaccgtatttaaaaaaaaaaaaaaaaaaaaggcggcttagcaatgarctgttccattttgccaggaactaggcttggacaggggaagcaaattcatttcctgtttgtggcaaacggagtctggatgatgataagactttttccatct

SEQ ID NO: 27823 - DNA, 201 bp, Homo sapiens
cattttgattatatttattactttctagaatttaaaatataaattagaaatctcaggtttttgttgactagctggtaagatggttaaggttaggagctgakccatgttgcctctctgctttactccatagtcctcatgttttgttgggaccatgttttgaagtttattgcattatgctgataatgacttttaggggttttt

SEQ ID NO: 27824 - DNA, 201 bp, Homo sapiens
agtccattttccgatatgtttggaattaggctaaattgtgttaggtagacagtttgaaagctgtcactttgaaagagcgagctgccaagtttctagctacmgtatttaaaaaaaaaaaaaaaaaaaaggcggcttagcaatgagctgttccattttgccaggaactaggcttggacaggggaagcaaattcatttcctgtt

SEQ ID NO: 27825 - DNA, 201 bp, Homo sapiens
atatcatatataaatatattgtttataatatgtaaacaatatatacataaataatatataaaaactatatattatatatgtaaacaatatatttttaaaamccaaactcatgggtttatagttttttcatagtgaaaacaaacaaatatatagtttgcttatatctattatatataaacagtatataatatataaagatat

SEQ ID NO: 27826 - DNA, 201 bp, Homo sapiens
catccagcagggagttttcatggaatctggtggtcacagggtactttcttggctccggatgccttgctttgacttccatatgggatctccctgtgttcctyacccactgctccagtacccgtgttatcctgcctacctggctttgtgaacagcttccctgactccggagaattacatgcccagtgctcaggcttccccgcc

SEQ ID NO: 27827 - DNA, 201 bp, Homo sapiens
  misc_feature (1)...(201): n = A,T,C or G, or insertion/deletion polymorphism (see Tables 1-2)
gggtccagcttgtataggccttgtcagtttcagcttgcaatttatccaaaaagcaaagagaagtagccatataagggctttgtgcaaataatttgatttcngattttagccctgaaatgctcattctgactgcactgtagagaatggactggaaaggggtacatacacgggtagattcaagggctgtttaagaggtaggat

SEQ ID NO: 27828 - DNA, 201 bp, Homo sapiens
ggccaacctcttcccatcttccccttcatgttctcctcctcagtctctggtaaccactgttctgctctttgcttctatggtataataatttttttttttttagtgtctacatgtgagtgaaatcatgtagtatttgtctttccatgtctggtttatttcacttaccatgatgcccttcctccaagtctaattcatgttgtt

SEQ ID NO: 27829 - DNA, 201 bp, Homo sapiens
gagttttggctgggatggctggaactgtgcatcattgcgctgggcatccagcagggagttttcatggaatctggtggtcacagggtactttcttggctccrgatgccttgctttgacttccatatgggatctccctgtgttccttacccactgctccagtacccgtgttatcctgcctacctggctttgtgaacagcttcc

SEQ ID NO: 27830 - DNA, 201 bp, Homo sapiens
caaaatccaggtcttgttcagctggaaaaaaccagcagcgtccagacatgactgggttttttgtttgtttgtttgagatgtgaagttttgcatgtaaatcraatagagtttgccagaaaattcattgcctgaacaaatatggtctgctccttgggtattgccaagtaggagaaagatggtttgtctggagagactgcagag

SEQ ID NO: 27831 - DNA, 201 bp, Homo sapiens
aacatggtaaagccccatctctactaaaaatacaaaaattaggcgggcatggtggcatgcacctgtagttccagctacttgggaggctgaggcagaagaaycacttgaacccgggaggtggaggttgcactccagcctttgcaacagagcaagacttcatctgaaagatagaaagatgaaagaaagaaagaaagaaagaaa

SEQ ID NO: 27832 - DNA, 201 bp, Homo sapiens
tctcttttccatctgatggtttgcaaatgtttgcaaacagctgtctcatcttccttgaatcttttctacctggggacaaatatctgtcctgactttatttycctctcctctaacatggtttcagctctctctctctctctcccacacattccaatttgtcactactcctcttaaagtgtgacacccagaatggatcccaat

SEQ ID NO: 27833 - DNA, 201 bp, Homo sapiens
accaaatacttggttgacctgtgggtggctgactcatgggcaatgaaataaattttgttttatacgtataactttatatatatgtaactttatatatatawaaaaagtttgcttatatataatatatatacacatatcatatataaatatattgtttataatatgtaaacaatatatacataaataatatataaaaactat

SEQ ID NO: 27834 - DNA, 201 bp, Homo sapiens
ttagcgacacaagcgggggcgaatgtcatttctcaggagttttggctgggatggctggaactgtgcatcattgcgctgggcatccagcagggagttttcayggaatctggtggtcacagggtactttcttggctccggatgccttgctttgacttccatatgggatctccctgtgttccttacccactgctccagtacccg

SEQ ID NO: 27835 - DNA, 201 bp, Homo sapiens
tccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttcaa

SEQ ID NO: 27836 - DNA, 201 bp, Homo sapiens
atccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttca

SEQ ID NO: 27837 - DNA, 201 bp, Homo sapiens
atgtacatcagcatcatagaattctgaaactactgatgcaacagaatcataaaatgtttaatgagacatatcaatttaattctgctgcttggaacttaaaragccagagttcgtcagcattttgctaacaaatgtcatcatttacagactgaatttggtgctgattatgttcaccattactaaaaatattgggaaatgagc

SEQ ID NO: 27838 - DNA, 201 bp, Homo sapiens
ttgtgttccagaatctctacctcttttaaggtgcagatactttttcactcgtttctccacagcaggtgtttccaccattctgttcagaacaataaaaagakcagcttttttttttttttttttttttgagacaggatctcactctgttgcccaggctggagtgcagtggtacaatcagctcactgcaacctctgcctcccc

SEQ ID NO: 27839 - DNA, 201 bp, Homo sapiens
tatccattctcagtcttgtcagtgtggcttcaaatccaatgttgctcccaccggtttgaaaatctcccttactttctgactgccgttttttttttttttttttggacgtcagtacgaaacagttttggttgtcttgttattgctgagttgttggcttttccagctcctctgacctcagagtagcactctatcttagagttc

SEQ ID NO: 27840 - DNA, 201 bp, Homo sapiens
  misc_feature (1)...(201): n = A,T,C or G, or insertion/deletion polymorphism (see Tables 1-2)
tctcacgtgtcccagatttgttttaaaaatcattttcaattcatctagttttctattaatgttaaaaggttggaaattatattttaattagtgttagagangtacatcagcatcatagaattctgaaactactgatgcaacagaatcataaaatgtttaatgagacatatcaatttaattctgctgcttggaacttaaaga

SEQ ID NO: 27841 - DNA, 201 bp, Homo sapiens
  misc_feature (1)...(201): n = A,T,C or G, or insertion/deletion polymorphism (see Tables 1-2)
attaaaaggagatgacctactgcttccctcctgccagtgatgggccacaaaacagacatgacacgtgggccttctcacgtgtcccagatttgttttaaaantcattttcaattcatctagttttctattaatgttaaaaggttggaaattatattttaattagtgttagagatgtacatcagcatcatagaattctgaaac

SEQ ID NO: 27842 - DNA, 201 bp, Homo sapiens
ccaatgtccaaaaattatctttttagttagtttatttggattaaggtctgtagattaaatttggttggtatgtcacttaaatcttttcctctagagtaatyctcttcatctgtttcttcatgccacaaacttatggctgaaactgagtcattttttatgtagaactttccatattctgaattttgctgattccatcccccg

SEQ ID NO: 27843 - DNA, 201 bp, Homo sapiens
tccttattttttgccttagcattttcaagtaaattctagtaatcatattattttacctgtacatattttagcgtgtagctttttaaaaatagacatatatrcagtatacatagatacatatgtacatatgtgtgtatgtatgtgtttaagtgtgtttgtgtataattattgcagctaatacaaatcaacaagagctccttg

SEQ ID NO: 27844 - DNA, 201 bp, Homo sapiens
caacagccacaaccgttacaccatcacagcttatctctcagccaacatcaccttctacaccggggtcccgaaggcagaattcaagaaggagacgttcgacrtgacgctggagcccttgtcctgtaagctaacaatggtgtggttctttgtgagactcgctgtctggcccctgtcttgctaggtgttaatgcccgttatagc

SEQ ID NO: 27845 - DNA, 201 bp, Homo sapiens
aatgtcatcatttacagactgaatttggtgctgattatgttcaccattactaaaaatattgggaaatgagctatgcttggtgaaacaaagggcattttttwaaaatttggctgattaaatgtagtttagaaacaaaataaacttgcataaacttgcaagtgtttggaaacagtctggtttggtaatagtcactatgtttaa

SEQ ID NO: 27846 - DNA, 201 bp, Homo sapiens
gaccgcctttggaggcagaagagcagttccacccaataactctaatgcagcggaagatgacctgcccacagtggagcttcagggcgtggtgccccggggcrtcaacctgcaaggtatgagcataccccccttccccaccactctgggtccaggcacagccgggccctggcccctcttccctgcaggtaaacatcctctgtc

SEQ ID NO: 27847 - DNA, 201 bp, Homo sapiens
ctggaatctgtgggataaatgcaaggcctcacttataccctctggggcaactttattgcccataaagggctctccgcatttctttcaaattacaatgctcytagcttctgcatctcatcatttaagagatgccttattgcagatgcaataaacaacagagaaaataatcttagtgcttttgaaacaacgcaagcacaaaac

SEQ ID NO: 27848 - DNA, 201 bp, Homo sapiens
ggcacaatcagaataccttatcccacaagttagcagacctgggcatgtagagagtactttaaatggagagttatattgttttgtgtttccttccacaaagsaaccagagatgctgttcctggaggaaacttatttagaggtagggacatttgatagggaagagagcatgagagagatggagattctggcttctgtccatgc

SEQ ID NO: 27849 - DNA, 201 bp, Homo sapiens
  misc_feature (1)...(201): n = A,T,C or G, or insertion/deletion polymorphism (see Tables 1-2)
ttacttaaagagcagtttaattccccagggcacaatcagaataccttatcccacaagttagcagacctgggcatgtagagagtactttaaatggagagttntattgttttgtgtttccttccacaaaggaaccagagatgctgttcctggaggaaacttatttagaggtagggacatttgatagggaagagagcatgagag

SEQ ID NO: 27850 - DNA, 201 bp, Homo sapiens
  misc_feature (1)...(201): n = A,T,C or G, or insertion/deletion polymorphism (see Tables 1-2)
cctgtcccagctgcttggtggaagcagcttttgctacccttctgggctattgcgcaggtttcatttatgagctcaaccctgaaccttccctgacagcagcnaggcctgtgtgcgtacctaattatgaagtgacggcctgtccctgtgaaggtctcaggagagaggcttcccaagctgtgaagtgctcaaaccacagcagaa

SEQ ID NO: 27851 - DNA, 201 bp, Homo sapiens
tacacataaaagtttcttcttgaactaaccttctctaaattgcctgaaggctccctttatttaaggttttatgagagcaagaaaatgaaaaatatgactgygaaaatgaaatgaaaatatgactatgcagatatggaattatgctttcagcaataaggaaaagggagctttgcagattcctaaaataatgtgatgcaaaca

SEQ ID NO: 27852 - DNA, 201 bp, Homo sapiens
cgtcctcaactgatggtttagcgataacttaaaaggtgatgctgcaaatgattctttgctggatttcagaaaataaagaagctattccagcaaaaaaaaaagtttctatttttacctgtattctgtcagggatcacagtatatgtagttttgaagatgaatgttttagagtcagaaagacctggatttatatccaacttcc

SEQ ID NO: 27853 - DNA, 201 bp, Homo sapiens
ttgagatataatgagtgccccaaacaaagtacatgacagtgactggctacactgtgagacttaactgtagtttcatttagtgctgtaaatatcacaaacttcattaaggtggaaaatgggaacagactatgtgttctaattattgctgaaccctgaccattttcccctccatgtccacaaccgagcacgttctctctccag

SEQ ID NO: 27854 - DNA, 201 bp, Homo sapiens
tgctgaaggtggagcccgcctgattggctgagagactggatatgtggtgtgagagaaggaaggtatggaggaagccaaatgagtgatgaatgtgaaatgtktgccacatggtagaatcttagtaaatggtaacttccaacatgtttacatttggggaaactgaagctcgagagatgagtcgatgtgttcaagcccccacac

SEQ ID NO: 27855 - DNA, 201 bp, Homo sapiens
taaattgtagcaaatgcctagagctttcaaaaccattatcagagaggccgggtgcagtggctcacacctgtaatcccagcactttggaaggccaaggtggstggatcacttgaggtcaggagtttgggatgaacctgaccaacatggtgaaaccctgtttctactaaaaataaaaaattagccaggctgtagtggtgcgtg

SEQ ID NO: 27856 - DNA, 201 bp, Homo sapiens
gggactaaaagatgaaagagaagatataagcctgggaaaagatggcaggcatcacaccataccaggccttggggatcttgctttcctcctgcagataatgsgggacttgagaaggattctaattagcagaaatacataatcagaattatgctttacaaagtggtagggagggctgggcacggtggctcatgcttgtaaccc

SEQ ID NO: 27857 - DNA, 201 bp, Homo sapiens
aatgttcacatccaattggaaacattttgtatgtgttcattttgtatttcagttttatatcttttgacaaagttaatttttcttataaatattttcagatraactcaaaagcagaaagagtagcacaatgaatatctacttatatgactctcagagttaatggttatcaagattttgccacatttgctttatctatccctt

SEQ ID NO: 27858 - DNA, 201 bp, Homo sapiens
tgaatgagcatgcaaagttccaaaacttctgagtagaagtttggttgggttcacattggtcatatagactaatttgggtagaatttatatctttacattastgaatgttcacatccaattggaaacattttgtatgtgttcattttgtatttcagttttatatcttttgacaaagttaatttttcttataaatattttcag

SEQ ID NO: 27859 - DNA, 201 bp, Homo sapiens
gccctgcctggctgttttctttcacattgttttttccagataagcttttgaatgagcatgcaaagttccaaaacttctgagtagaagtttggttgggttcmcattggtcatatagactaatttgggtagaatttatatctttacattactgaatgttcacatccaattggaaacattttgtatgtgttcattttgtatttc

SEQ ID NO: 27860 - DNA, 201 bp, Homo sapiens
tgtggagcatggatctaaatgatccatctcagaaacaggccctctgctggtgcctctcgcccaagttaggaaagtcttttgggggctgtccagaatgaatrgtgtgctttgctttcccattcaaaaagatacacgcgctgacataggccgcttcttaaaacgctgtctcctgtaatctcagcactttgggaggctgaggtt

SEQ ID NO: 27861 - DNA, 201 bp, Homo sapiens
  misc_feature (1)...(201): n = A,T,C or G, or insertion/deletion polymorphism (see Tables 1-2)
ttaccttctctgggtcgggaggacagtgggaatgtcagagggtgactgaaatccaccccaaattttcttggcccactcttttcttttttaactacccttcnattcccaccagaggaacagtaaaataaatgaggtcattattcttcactacatgcctcttgtaaattgttagtcagcctgcaagggtggttatttacgagg

SEQ ID NO: 27862 - DNA, 201 bp, Homo sapiens
tcagtaggctcagcatttgtttttacatgtttgttataaatccttaccttctctgggtcgggaggacagtgggaatgtcagagggtgactgaaatccaccscaaattttcttggcccactcttttcttttttaactacccttccattcccaccagaggaacagtaaaataaatgaggtcattattcttcactacatgcctc

SEQ ID NO: 27863 - DNA, 201 bp, Homo sapiens
  misc_feature (1)...(201): n = A,T,C or G, or insertion/deletion polymorphism (see Tables 1-2)
tagtcattgttatttcgaggataccagtcctggcgaactactctactttatactgaaggggctaaaaggaaagaagcaaactcaactgactattgaggaancatttgcttgtgcttcatagattgattccattccagtgttactagataggcaagcaacgtctctggagtggctatatgaaaccattttaggaaggcagtg

SEQ ID NO: 27864 - DNA, 201 bp, Homo sapiens
ttccttgtagagtctcttatatgcttcaaagtgtgctcatagtcagtatctccctagattgtgtgtttggaaggtgtaatccttatctcattcagcctttygtggtgcctggaattgagtcaatgttcagtaaatgtttgctgaactgaactgataatcaccattctgagaggcaaggagacgattattagactcagattt

SEQ ID NO: 27865 - DNA, 201 bp, Homo sapiens
  misc_feature (1)...(201): n = A,T,C or G, or insertion/deletion polymorphism (see Tables 1-2)
attccttcttaagcattctaaaatggcacactcatcagcataagcttactcacacactgtgtgtacttttacgcacccagaagtcagaaatcactgcctancagaagccagtgcaaaagagaagcagacaggaagcagttaacctaatgtgtctgtggtggcagctggctaagcggaagctgttaattattgaataagcac

SEQ ID NO: 27866 - DNA, 201 bp, Homo sapiens
gagtttgagaccagcctgccctacatggcaaaaacttgtctctactaaaaatacaaaaagttagccaggcatggtggtgggtgcctgtaatcccagctacytgggaggctgaggcaggaaaattgcttgaacccaggaggcagaggttgcagtgagctgagactatgccactgcactccagcctgggtggcaagagtgaaa

SEQ ID NO: 27867 - DNA, 201 bp, Homo sapiens
  misc_feature (1)...(201): n = A,T,C or G, or insertion/deletion polymorphism (see Tables 1-2)
ttggcaattgctggagacacttttggttgtgatggctggggtgcggggctgctcctggcatgcagtgggtagacaccagggatgttgcttaacatcgtacntggcacaggacagctctgcaacaaagatgcatccagcccgatatgtcagtagtgttgatgctgagaagccctgatctagatcatgattactgtttttgcc

SEQ ID NO: 27868 - DNA, 201 bp, Homo sapiens
aacaagagagcagaacgaggttttatttgctgctaatgacctgcattctctctcttaggtccgtggcactcaggtagttggttctgacatgactgtgacarttcagtttaccaatcctttaaaagaaaccctgcgaaatgtctgggtacacctggatggtcctggagtaacaagaccaatgaagaagatgttccggtaaac

SEQ ID NO: 27869 - DNA, 201 bp, Homo sapiens
  misc_feature (1)...(201): n = A,T,C or G, or insertion/deletion polymorphism (see Tables 1-2)
tcttgtctttcccgagtccgtttgaggaagtccccgaggcgcacagagcaagcccacgcgagggcacctctggaggggagcgcctgcaggtaagccaccgnccctgcaccctatgagccagggcccgctgcgtccaccttctgcacctcggtttcctggttgaaccagcaagcggcttgctctgggccctgtggcgccggt

SEQ ID NO: 27870 - DNA, 201 bp, Homo sapiens
gtcttgctcttcctctctgtctgtctctcatgcatacatacacactgtcctgtggatgcacgtctaggtgttagtggcagcaaatgtactggagtcccacrgcaccaaagtatgttagcagcagtgaatccacatggatctacagcagcctcaattcttgcctcctcataaggcaggagagactggggcaagttttagagc

SEQ ID NO: 27871 - DNA, 201 bp, Homo sapiens
aagagagcagaacgaggttttatttgctgctaatgacctgcattctctctcttaggtccgtggcactcaggtagttggttctgacatgactgtgacaattsagtttaccaatcctttaaaagaaaccctgcgaaatgtctgggtacacctggatggtcctggagtaacaagaccaatgaagaagatgttccggtaaacctt

SEQ ID NO: 27872 - DNA, 201 bp, Homo sapiens
cgaaatgtctgggtacacctggatggtcctggagtaacaagaccaatgaagaagatgttccggtaaaccttgggttggggagaccgggcaggcagtgcagrgctgtgggaagctttctctgtgtgtgtcttttccaaacatagatctgctccccagtgaaaatgtcttggaagctgcctcctccttgccgaccatttctgt

SEQ ID NO: 27873 - DNA, 201 bp, Homo sapiens
taggctaaattgtgttaggtagacagtttgaaagctgtcactttgaaagagcgagctgccaagtttctagctaccgtatttaaaaaaaaaaaaaaaaaaaaggcggcttagcaatgagctgttccattttgccaggaactaggcttggacaggggaagcaaattcatttcctgtttgtggcaaacggagtctggatgatga

SEQ ID NO: 27874 - DNA, 201 bp, Homo sapiens
aaataaatcaatttaatttaatatgaagaaatcaatatgttcccaatatcttggatgcttttaacagcaaataaataaatatgacctgcttgtattttatyattaaattcatccttagccaatttgctttgtatttatataaggtctttttagcccctttcatacagaatggagtaagtaaccaagactggtgtcctcaga

SEQ ID NO: 27875 - DNA, 201 bp, Homo sapiens
tattgtctctttctatgattcatatcaggaatgaaatttctcagtttggaacagcagaaaaaggcagaagcctccggtgttccttgcaacctttccaattytaacgcatatcaattagtaggagctctcggggtgacaactttgggagaatccactgatttatattaatgaagagtgttactgtagtccaacagagtaaag

SEQ ID NO: 27876 - DNA, 201 bp, Homo sapiens
ggagagatgggacactaacaaggtggaccaccacactgacaagtatgaaaacaacaagctgattgtccgcagagggcagtctttctatgtgcagattgacytcagtcgtccatatgaccccagaagggatctcttcagggtggaatacgtcattggtgagtgccatgtgcaagctccagtcttgacaccatgggttgcatt

SEQ ID NO: 27877 - DNA, 201 bp, Homo sapiens
agcagcctgcggtcccagctacttgggaagctgaggcaggaggattgcttgggcccaggagttcgaggcagccccgccagcctgtctctaagaagaaagaragacaataagcaataactttaaaactcaagaggcagggccgggcccagtggctcacgcctgtaatcccagcacttcgggagaccaaggcaggcagatcat

SEQ ID NO: 27878 - DNA, 201 bp, Homo sapiens
ggcacctttctcaagactttctgtagcacctagatgttgaagcgaaggtcaaaggagaattttttaaagacaagagagagtgggtgttattttatggtgayggagaggaaccaggaaagagagtttgcagtccagagagaggacggtggttcacagccttggctgcacgttgcaatcatctgggaagctttgaaactatgg

SEQ ID NO: 27879 - DNA, 201 bp, Homo sapiens
tgatcttgaaaaggacggtttcactaaagtgatagagacagaagccagggagatggtcatgggctgtgttgtaaacaggaggcgagaaagtagagacggcrggagatggcacctttctcaagactttctgtagcacctagatgttgaagcgaaggtcaaaggagaattttttaaagacaagagagagtgggtgttatttta

SEQ ID NO: 27880 - DNA, 201 bp, Homo sapiens
gaaggtggaggttacaatgagctgagatggcacccctgcactccagcctgggcaacagagcaagactccgtctccaaacaaaacaaaacaaacaaaaaaaataaaaaaaatggtgcctggcaccttgtaggcactgaaaaactctttcaagaatgaacaaaacctggggtcgcctatggctctgcccccctacttaatgcc

SEQ ID NO: 27881 - DNA, 201 bp, Homo sapiens
gggccaatattcaacattcttaaagaaaagaattttcaacccagaatttcatattcagccaaactaagcttcataagtgaaggagaaataaaatactttayagacaagcaaatgctgagagattttgtcaccaccaggcctgccctaaaagagctcctgaaggaagcgctaaacatggaaaggaacaaccggtaccagccg

SEQ ID NO: 27882 - DNA, 201 bp, Homo sapiens
gttttcagttcatggaaaggattggaggaaggtgggacaaaaaccagagaccaatttggaagctgtggtctaggacaaagatgatgataaactaaacatgstggtaccagtggagatgagaaggggttagattggagatctattttgtatttagaacaaaaattgcacagggattcaagatgagaagtaaagaaatgggag

SEQ ID NO: 27883 - DNA, 201 bp, Homo sapiens
aacagcggatctctcggcagaaactctacaagccagaagagagtgggggccaatattcaacattcttaaagaaaagaattttcaacccagaatttcatatycagccaaactaagcttcataagtgaaggagaaataaaatactttacagacaagcaaatgctgagagattttgtcaccaccaggcctgccctaaaagagct

SEQ ID NO: 27884 - DNA, 201 bp, Homo sapiens
  misc_feature (1)...(201): n = A,T,C or G, or insertion/deletion polymorphism (see Tables 1-2)
agtaacttatgtaaccacctccttagaatgttctctctctgacaatatgcctaccaaagactcttttaaagatctttgaaattagtaattagggaggttanaatggagcactgtttgcttgtcttaatgtggaatcctctacatgctttatagaaaacaaatgaagtgaataagttttgctcttgaaggttctcctgctta

SEQ ID NO: 27885 - DNA, 201 bp, Homo sapiens
aaaagcaaggctcaagacctacgtgaagaatgcagaagcctcaggagccgatgcgatcaactggaagaaagggtatcagcgatggaaaatgaaatgaaagmaatgaagcaagatgggaagtttagagaaaaaagaataaaaagaaaccagaaaagcctccaagaaatatgggactatgtgaaaagaccaaatctacgtctc

SEQ ID NO: 27886 - DNA, 201 bp, Homo sapiens
aacctctttttttggagtgaacggtcgtagatacatctgaggacccaggtgctcaatgggcattgtccttggcatttctaaatcaccaaggaactttttcycatttacccatatggattttaatttttgaaaaagttcatctatcaaaacaaatcatgattatgtaataataccttgttaccccattcttgtgtcagattt

SEQ ID NO: 27887 - DNA, 201 bp, Homo sapiens
  misc_feature (1)...(201): n = A,T,C or G, or insertion/deletion polymorphism (see Tables 1-2)
gtctatgcctgttcctgcctcccgactgataggatctggcagcaactatgggcagagaatttcccccaaggagatgcagctgcttctgcaaaggctgccgntactgcagataaaggctcgttattcactgtgacacacctacatgtaccacctccatccatatttgctccagtgggtcaaggcattaccagtggaggatct

SEQ ID NO: 27888 - DNA, 201 bp, Homo sapiens
ggagcaaagagaacaggcttccctgtccccagttctgtctccacttctgcctagctatgtgatgtgcacacatgacgccctcaccaagcctcagtttcccrtctgtaaaaatttcctcacagaggttttgtaaggaccccaagaaataaaacttatttcctgtcactttatttgcatcactatgtgaactgccttggcaac

SEQ ID NO: 27889 - DNA, 201 bp, Homo sapiens
gaccctcatgcaggttctctccacctggtcttccttctcttcactcactcagttgttacctcctttgatccacatttctggctcacacaactcttatccayggcagcatattttctcaatgtcccttttcctcatattcctttggactttccagttttattcttctcttgtctcctttcatctccctagatcccttttgcc

SEQ ID NO: 27890 - DNA, 201 bp, Homo sapiens
gcacatcagaatcacctggagggtcaccacgcttggagcacatcagaatcacctggagggtcaccacgcttggagcacatcagaatcacctggagggtcascacgcttggagcacatcagaatcacctggagggtcaccacgcttggagcacatcagaatcacctggagggtcaccacgcttggagcacatcagaatcacc

SEQ ID NO: 27891 - DNA, 201 bp, Homo sapiens
aaaactctttcaagaatgaacaaaacctggggtcgcctatggctctgcccccctacttaatgccaacatcaaatacctgttgcgtctacttcctgcttccrctggcacccctccacttaccttcccccgagagtcagtcaaagacaccatcatgcctcccttgagcacttcagcaccctctgactggtttccttgctccac

SEQ ID NO: 27892 - DNA, 201 bp, Homo sapiens
acagtggtgtgatctcagctcactgcaacctcttcctcctaggttcaagcgattctggtgcctcagcctccagagtagctgggaccacagttgcacaccaytacgcccagctaattttatgtatttttggtagaggcagagtttcaccatgttgtccaggctggtttcgcactcctaacctcaagttatccacccacctca

SEQ ID NO: 27893 - DNA, 201 bp, Homo sapiens
gtacattaatcttgtatccagaaactttgctgaattcttttatcagtcctaggagctttctggaggagtccttggggttttcaaggtaaacaatcatatcrtcagcaaacagtgacagtttgacttcctctttacctatttggatgtcctttatttctttctcttaacttattgctctggctaggacttccagtactatgt

SEQ ID NO: 27894 - DNA, 201 bp, Homo sapiens
caagtgtttggaaacagtctggtttggtaatagtcactatgtttaaaccctgatgcagatgatgctgtgtatctggacaatgagaaagaaagagaagagtwtgtcctgaatgacatcggggtaattttttatggagaggtcaatgacatcaagaccagaagctggagctatggtcaggtgagccacttaaaatttgttatt

SEQ ID NO: 27895 - DNA, 201 bp, Homo sapiens
  misc_feature (1)...(201): n = A,T,C or G, or insertion/deletion polymorphism (see Tables 1-2)
agctttgttacaagctggctagagggaacttaagatcccagggaaattccatttttccttgagaccccctaagtccaaatcaatacactaagaagaaacgnaaaaaatcctaagagtttaagtaggaagaatttttatcaaggtctgtgtgggaggaaattggggcataagttcctctgtggtcaggcattgagctaggta

SEQ ID NO: 27896 - DNA, 201 bp, Homo sapiens
aaaaaggtcatagttttagctgctgcatatgcctatactagttcctctctaccttgatatattaatattacagttaatagcagaagtattggagccaagcrttctctgggtcagtgccctgggactaatagagctaacatttatttagtatttactatgcatcggtcttggtgtatgcatgatcttatccagttcttttta

SEQ ID NO: 27897 - DNA, 201 bp, Homo sapiens
ccagctgaattgctttccccttagccacaatatctcaatcaacacaagtaacgtactttccttgggacattcacctttcttcagattcagaaccagagagsaaaaaagaaatcaccccttcttccttctgcctttactttctagtagaagttatacttaaaaaaaaaaaacaatttgccaggcatggtggctcacacctgt

SEQ ID NO: 27898 - DNA, 201 bp, Homo sapiens
  misc_feature (1)...(201): n = A,T,C or G, or insertion/deletion polymorphism (see Tables 1-2)
cttcatgcagttcacccagtggccactagtggcctctaagaggccttgtatccgcggttaccaatctgcggatgatgactttggctccaggaacaccagcnccaagttaaactcttgtctccatttttttcagtggccactcttccagttagcaagctgctcttgtaatactgactgagaaatgcagagaggcaagaagag

SEQ ID NO: 27899 - DNA, 201 bp, Homo sapiens
  misc_feature (1)...(201): n = A,T,C or G, or insertion/deletion polymorphism (see Tables 1-2)
atcagtcattatttacttggcagacatatgtgtccacaacccaagtgacattctgggatatccattagaggcactggcataggaatatgaatgtccagtgnctgtagaatgaatgaacgaacagtcaatcacttgtgaattgaatgactcatagctctagtggcattataatttattattaataacaagctacagatttca

SEQ ID NO: 27900 - DNA, 201 bp, Homo sapiens
tgaaaagcaaggctcaagacctacgtgaagaatgcagaagcctcaggagccgatgcgatcaactggaagaaagggtatcagcgatggaaaatgaaatgaawgaaatgaagcaagatgggaagtttagagaaaaaagaataaaaagaaaccagaaaagcctccaagaaatatgggactatgtgaaaagaccaaatctacgtc

SEQ ID NO: 27901 - DNA, 201 bp, Homo sapiens; identical to SEQ ID NO: 6843

SEQ ID NO: 27902 - DNA, 201 bp, Homo sapiens
actctagaaagaagagcgcctctcctcctccaaaggaacgcagttcctcaccagcaaaggaacaaagctggacggagaacgactttgacgagctgagagamgaaggcttcagacgatcaaattactctgagctacgggaggacattcaaaccaaaggcaaagaagttgaaaactttgaaaaaaatttagaagaatgtataa

SEQ ID NO: 27903 - DNA, 201 bp, Homo sapiens
gggaaaaaacagagcagaaaaactggaaactctagaaagaagagcgcctctcctcctccaaaggaacgcagttcctcaccagcaaaggaacaaagctggayggagaacgactttgacgagctgagagaagaaggcttcagacgatcaaattactctgagctacgggaggacattcaaaccaaaggcaaagaagttgaaaac

SEQ ID NO: 27904 - DNA, 201 bp, Homo sapiens
actgcctcctcaagtgggtccctgacccctgacccccgagcagcctaactgggaggcaccccccagcaggggaacactgacaccttacacagcagggtatwccaacagacctgcagctgagggtcctgtctgttagaaggaaaactaacaaacagaaaggacatccacaccaaaaacccatctgtacatcaccatcatcaa

SEQ ID NO: 27905 - DNA, 201 bp, Homo sapiens
gaaggggcagactgcctcctcaagtgggtccctgacccctgacccccgagcagcctaactgggaggcaccccccagcaggggaacactgacaccttacacrgcagggtattccaacagacctgcagctgagggtcctgtctgttagaaggaaaactaacaaacagaaaggacatccacaccaaaaacccatctgtacatca

SEQ ID NO: 27906 - DNA, 201 bp, Homo sapiens
atgcagctggagatctgagaaggggcagactgcctcctcaagtgggtccctgacccctgacccccgagcagcctaactgggaggcaccccccagcaggggmacactgacaccttacacagcagggtattccaacagacctgcagctgagggtcctgtctgttagaaggaaaactaacaaacagaaaggacatccacaccaa

SEQ ID NO: 27907 - DNA, 201 bp, Homo sapiens
cattgcctcactcgggaagcacaaggggtcagggagttccctttcctagtcaaagaaaggggtgacggatggcacctggaaaatcgggtcactcacacccraatactgcgcttttccgacgggcttaaaaaacggcgcaccacgagattatatcccgcacctggctcggagggtcctacgcccacggagtctcgctgattg

SEQ ID NO: 27908 - DNA, 201 bp, Homo sapiens
  misc_feature (1)...(201): n = A,T,C or G, or insertion/deletion polymorphism (see Tables 1-2)
tttctgttaagcagctggttagatctacagactctgtcagattcagctccaagtggcattttttttttggaggaaggggcaaaaatatttcataagtcacnccattgcttcctaggacattcatcctggcagaagatacatatatttaggtttgtcaatagtatctggttcacgttttatcagtctcatccacccgttacg

SEQ ID NO: 27909 - DNA, 201 bp, Homo sapiens
atgagtgacgcagaagactggtgatttctgcatttccatctgaggtaccgggttcatctcactagggagtgccagacagtgggcacaggtcagtgggtgcrcgcaccgtgcgcgagccaaagcagggtgaggcattgcctcactcgggaagcacaaggggtcagggagttccctttcctagtcaaagaaaggggtgacgga

SEQ ID NO: 27910 - DNA, 201 bp, Homo sapiens
cagcaatccaggtaagacaaaatccacatacacacacccaaccatggtcttaccctggcctttgcaatctatgtcctgccatcccacaccatcacctgtggccagggagggagggttgagttgccaaaggaggaaggggagcctggaggctactctaagagaggaatacagcccacctacagggttgatgggaatgcctgg

SEQ ID NO: 27911 - DNA, 201 bp, Homo sapiens
cccacccagcaagtctacccagctctggagtgacactgggcattgtctgcacagaatcctgtgatgtgagccatctctgggtccctctcagccaccggaayagcgcctattccggtggaggtggcagggggtacaatggacactgttagggttcttagctttggtgtttaatgctctatttttgtgctggttggctccctg

SEQ ID NO: 27912 - DNA, 201 bp, Homo sapiens
atatgaagaaatcaatatgttcccaatatcttggatgcttttaacagcaaataaataaatatgacctgcttgtattttatcattaaattcatccttagccwatttgctttgtatttatataaggtctttttagcccctttcatacagaatggagtaagtaaccaagactggtgtcctcagagtaacaatgacccacattcc

SEQ ID NO: 27913 - DNA, 201 bp, Homo sapiens
tgataatgatgccaatttgcaaatggacatcttcctggaagaagatgggaacgtgaattccaaactcaccaaggattcagtgtggtgagtttgattgacartggcattggctgatgtcacattatagtaatgttacacatttaccacaagatagactcaatctgatgtttctgttctattttgaggaccattcaacagcac

SEQ ID NO: 27914 - DNA, 201 bp, Homo sapiens
actgaaggggctaaaaggaaagaagcaaactcaactgactattgaggaaccatttgcttgtgcttcatagattgattccattccagtgttactagataggmaagcaacgtctctggagtggctatatgaaaccattttaggaaggcagtgcgtttggatccttccagaataaaaagctcagactctaaaaatgccattcct

SEQ ID NO: 27915 - DNA, 201 bp, Homo sapiens
gtgtcactcaatccacgagagttgtgtgtttcaagaggaaagcatgaccaatgttattaaatataactaggagatgcagtgagataggaacttcccactggagtcaacagttgggggacactggttgaactcgggtagattccaaattttaatggtctaaaagtcaaggagatgtgaggaaatgggtgtagtcaatttgga

SEQ ID NO: 27916 - DNA, 201 bp, Homo sapiens; identical to SEQ ID NO: 6839

SEQ ID NO: 27917 - DNA, 201 bp, Homo sapiens; identical to SEQ ID NO: 6841

SEQ ID NO: 27918 - DNA, 201 bp, Homo sapiens
cgtggttgtcttttctccagcatgttgttagtgctccacatgtctctggaaccatctctctactctggtggcctctataatggggactcttcacctcttgkgggtgtgcctggtttttgaaaatagccaagtctccaggagtcatgactgggtaatccaggggatcaagggggaaccttcactgggcccagaaacaaagtc

SEQ ID NO: 27919 - DNA, 201 bp, Homo sapiens
gggagtggggccaagtgagaacagcctgctagactggaaccccgccggcttggctccccactcctgcgcgcctccccactcctgcgcatcgcctgcctccrtcccaatttggagctgaactcgagccacttctcctccttagacccgcccagaagcgagggctcctgcccgccgcactcacccagccaggcgtgcacctgg

SEQ ID NO: 27920 - DNA, 201 bp, Homo sapiens
cggggtttcaccaagttcgccaggatggtctcgatctcctgacctcgtgatctgcctgccttggcctcccaaggtgctaggattacaggcgtgagccaccyagcccggccgtcctccatacattttttatctttgagcttgtcatttactgagtcttcacaatgtgccaacagtgtgctctgtgtttgcattagttttatg

SEQ ID NO: 27921 - DNA, 201 bp, Homo sapiens
ctgtcaccaggctgaagtgcagtggcacaatctcagctcactgtaacctccatatcccagattcaagcgattctcctgcctcagcctcccaagtagctggractacaggcacccgccaccacacccagctaatttttgtatttttagtagagacagggtttcatcatgttggcaaggctggtcttgatgtcttgaccttgt

SEQ ID NO: 27922 - DNA, 201 bp, Homo sapiens
ctggtgtgtagtgggtacatagtgaaattaatatctcttgaaccaatcaaaaatgggctgcactcagagaaagatgggagcatgggcaaacagctgacatygaagggcgtctaggcacggaacccgtggtagttgaacctgaaattcatcagtgtcataaacaaagactgctgtaactacctcaccacattattaaatctt

SEQ ID NO: 27923 - DNA, 201 bp, Homo sapiens
aacagacttccctgcattgcattacatgctagcccctgccctatcttttcttctgtcttacaacctagatcacttttttttttttttttttagacagggtytcactctgtcttccaggatggagtgcagtggtgcaatcatggctcactgcagccttgatctcccgggctcaagtgatcctcccactcagcccctcaagta

SEQ ID NO: 27924 - DNA, 201 bp, Homo sapiens
cctacaagaagggttttttcactctgtgtttattaaatgctggtgatgtgtttagctgtggtctgtcctttcctgtagttttacgatgccttggaataccmgcaagaattgttaccaattatttctctgcccatgataatgatgccaatttgcaaatggacatcttcctggaagaagatgggaacgtgaattccaaactca

SEQ ID NO: 27925 - DNA, 201 bp, Homo sapiens
cagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaaa

SEQ ID NO: 27926 - DNA, 201 bp, Homo sapiens
ctcggttcaagccatcaagcacggccatgtctgcttccaatttgatgcaccttttgtttttgcagaggtaagcaggaagctggaggaaagtgctgtttttytccccaacctcttaacacatgaaagagtaagctaaaagttgttgtttctaagttttccaggtacatagcgtatgcttcgtgttgacaaaggtaactaggc

SEQ ID NO: 27927 - DNA, 201 bp, Homo sapiens
ccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaaa

SEQ ID NO: 27928 - DNA, 201 bp, Homo sapiens
cccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaaa

SEQ ID NO: 27929 - DNA, 201 bp, Homo sapiens; identical to SEQ ID NO: 27890

SEQ ID NO: 27930 - DNA, 201 bp, Homo sapiens
acccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaaaa

SEQ ID NO: 27931 - DNA, 201 bp, Homo sapiens
tgttccggtaaaccttgggttggggagaccgggcaggcagtgcagggctgtgggaagctttctctgtgtgtgtcttttccaaacatagatctgctccccartgaaaatgtcttggaagctgcctcctccttgccgaccatttctgtagggcgtggagtaaaactagggttggtttgaccagcactttcatcatttaatcct

SEQ ID NO: 27932 - DNA, 201 bp, Homo sapiens
tttattttgctactatcttatcagatgcagcctatttttttggcatctcctacttggctataaaataatccagtcatttattcaaatagcatacaaaactytggaattattttagctttccttcttaacctcccttatgcatcttgccaaaaataccttcccaaaattatcataaatccagccacttctacaatctctatc

SEQ ID NO: 27933 - DNA, 201 bp, Homo sapiens
gaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacactaa

SEQ ID NO: 27934 - DNA, 201 bp, Homo sapiens
ggaacccagaagtgctcagaaagggctttctgctaactaatgatggcaaacgtggtctgtgtgatggggtggcatctactttctgaaaatttttaattttaatttttgttgttttcgttttgttttgttttataacttgtgttttatttttgccaaatttggtttcattccctgcctgttccatttggaggtactacacta

SEQ ID NO: 27935 - DNA, 201 bp, Homo sapiens
gatgaatggtctccaatgaacagataacgttcaaccagtagagatggatggagagaccccttcagatactaggaagaaaatgttagcaagggctagagggyaggtggacggcagtatgtagagcagtgagaagcgtgccttggctggggtggaggctgggagcagggatgagtaagggtaacctgaaaaagatagcttgag

SEQ ID NO: 27936 - DNA, 201 bp, Homo sapiens
gggaggctgaggcagggggattacctgaggtcaggagttcaagaccagcctgaccaatatagtgaaaccccatctctactaaaacaaaaacaaaaacaaamaaattagccaggcatggtggtgtgagcctgtagtcttagcaacttgagaggctgagacatgagaattgcttgaacccgggaggcagaagttgcagtgagc

SEQ ID NO: 27937 - DNA, 201 bp, Homo sapiens
  misc_feature (1)...(201): n = A,T,C or G, or insertion/deletion polymorphism (see Tables 1-2)
actgagattataaaggtagcaagagcctctgtaaagaaatcatatcccattagccaaaagaaatccagtggtcaaacatagtcctctagaaatagtcagangaagtcattttattattgttattactggaaacagctagaggcaaaaggcatcttcttcgaggccttccaccttgccacttcatccattctatctagagac

SEQ ID NO: 27938 - DNA, 201 bp, Homo sapiens
agtcttggtgccctcatccataatacggttacaatatatacctcacaggcttgttgttgtgaggttcaaactaaatcctttataaaatgtccctgaaacaytgtaggtatgcaacaaatgttggctatctcccccttagtagaaatccgacttcatgtgcactcagaacattctgtgagaaagtaaaattgctctctttaa

SEQ ID NO: 27939 - DNA, 201 bp, Homo sapiens
catacatacacactgtcctgtggatgcacgtctaggtgttagtggcagcaaatgtactggagtcccacagcaccaaagtatgttagcagcagtgaatccaratggatctacagcagcctcaattcttgcctcctcataaggcaggagagactggggcaagttttagagcaggagtgaaagtttattcaaaagctttagaac

SEQ ID NO: 27940 - DNA, 201 bp, Homo sapiens
ccctctgaccaaaggggacgggtggggacttcctggcactgcagggccccttgcctggtactcccagcaactggttgcggtggggagggcagatctagggrtggggatggggaggagaagtgggaatgggaaattgggagtcagaggggcaagtgggagagaagggcgcacctgccgggataacaggccagatgaagtaaa

SEQ ID NO: 27941 - DNA, 201 bp, Homo sapiens
caaagcagctactccattctgtattcccactagcaatacacaaaagttccaacttcatattcttgcaaataacttttattttctgttttttttttttttttaattattattgtagccatcctaatgggtgtgaagtggtatttcatggtgggattaattttcatttctctaatgaccaatgacgttgaacatctttttgtg

SEQ ID NO: 27942 - DNA, 201 bp, Homo sapiens
agacacaatggagtactatacagcccttagaagaaggaaaattctgccattctcaacaagggtagaactggagagcactatgctaactgaaataagccagrcacagaaagatgaatactgtatgatctcacttatatgtggaatctgaaaaagtcaatctcagaaacacagtagaaagttgtttaccagaggctggggctt

SEQ ID NO: 27943 - DNA, 201 bp, Homo sapiens
gatctttgttggtttaaagtctgttttatcagagactaggattgcaacccctgcctttttttgttttccatttgcttggtagatcttcctccatccttttrttttgagcctatgtgtgtctctgcacgtgagatgggtttcctgaatacagcacactgaagggtcttgactctttatccaatttgccagtctgtgtctttt

SEQ ID NO: 27944 - DNA, 201 bp, Homo sapiens
atatgcggtgtttggttttttgttcttgtgatagtttactgagaatgatgatttccaatttcatccatgtccctacaaaggacatgaactcatcattttttatggctgcatagtattccatggtgtatatgtgccacatattcttaatccagtctatcatttgtggacatttgggttggttccaagtctttgctattgtga

SEQ ID NO: 27945 - DNA, 201 bp, Homo sapiens
gagtgttatgttccccttcctgtgtccatatgttctcattgttcaattcccacctatgagtgagaatatgcggtgtttggttttttgttcttgtgatagtwtactgagaatgatgatttccaatttcatccatgtccctacaaaggacatgaactcatcattttttatggctgcatagtattccatggtgtatatgtgcca

SEQ ID NO: 27946 - DNA, 201 bp, Homo sapiens
ccatggcctaggtgagacacttcttatttgacaagggatcctatgtggaatgggggccttggacttcagcaccccacatgttccattttgggatgatcccrgcccaaatcaaagccaccattaaaacccattggtccttctttgccatgaaaatcacatcttttccatggcatttcttttacaacagcaaaagaactgttt

SEQ ID NO: 27947 - DNA, 201 bp, Homo sapiens
ccaaaaactcattgcaattgttaaaaatgacaaaaagatagttatttggcattctccatatctcttccttaaaaacacacagacacacacacacacacacmgacagacacacagacacacacacacagcctttgtagctaagtgcagttcaaagttatctttcccagctccttgattcaggtacctcccatcatcaaataa

SEQ ID NO: 27948 - DNA, 201 bp, Homo sapiens
taagtccctatgaggcactcctacaaataaccccacaggccctaaacagagttaatacaaaatagcgaaggtagatcttgcccttggtaaccctgtcctcwttcaggtccctgctccaaattacttccccttttcctgacaccatttgttcctttggtgccttactcaaatatcccatcaccctgagactgttcttcctgg

SEQ ID NO: 27949 - DNA, 201 bp, Homo sapiens
agtccttgcaatgaaagacactggccagggaagctggttggacacacacacatacttgcacattcacaagtatctttcattaaaaggagatgacctactgsttccctcctgccagtgatgggccacaaaacagacatgacacgtgggccttctcacgtgtcccagatttgttttaaaaatcattttcaattcatctagttt

SEQ ID NO: 27950 - DNA, 201 bp, Homo sapiens
ctaaaataataaataacaaaagatatatattgcttatttatcattgagaagttgtataaatatgcgtatttatttattattgagaattttataaatatatmcacttaatttttatcccagttatggaaggtattatagcaggtggtctcatattcatttttccacatttctcaatgcccctgagcaattagagatcagaac

SEQ ID NO: 27951 - DNA, 201 bp, Homo sapiens
aacgttgacatggactttgaagtggaaaatgctgtgctgggaaaagacttcaagctctccatcaccttccggaacaacagccacaaccgttacaccatcayagcttatctctcagccaacatcaccttctacaccggggtcccgaaggcagaattcaagaaggagacgttcgacgtgacgctggagcccttgtcctgtaag

SEQ ID NO: 27952 - DNA, 201 bp, Homo sapiens
aacaaaactgctgatctggaggtcttatgttataaattcccacatcataccttcaactatatatatgtcctgaaactagcatattttgagaataaaatggmaaatgacatttaaaggacacctatggttaatcctacagtaaatgagataatttattttgaaatgaatgatcaactctacgctccaaattttcacgtaaaa

SEQ ID NO: 27953 - DNA, 201 bp, Homo sapiens
  misc_feature (1)...(201): n = A,T,C or G, or insertion/deletion polymorphism (see Tables 1-2)
agcgagtgaatgactaagaagccaaacaaacgacatggtgaggcaacccaggaattaggaacagtagaaaactgccaccacaccaggagctggaggcacanggaggaggaggtcccatcagaacccagaaggcatcagcaggtgctggagccatggaggagactcagactctcacctcaagacagagagagcacaggagac

SEQ ID NO: 27954 - DNA, 201 bp, Homo sapiens
gaatcaaaagatcacttagaaaaagtaacatgttagaaaacatcatgcttagaattaaatgtctaaagtataccagtatagatgatataatttaaaacaaytgatactatcagctgtcataagaaccaaatacttggttgacctgtgggtggctgactcatgggcaatgaaataaattttgttttatacgtataactttat

SEQ ID NO: 27955 - DNA, 201 bp, Homo sapiens
aaagatcacttagaaaaagtaacatgttagaaaacatcatgcttagaattaaatgtctaaagtataccagtatagatgatataatttaaaacaattgataytatcagctgtcataagaaccaaatacttggttgacctgtgggtggctgactcatgggcaatgaaataaattttgttttatacgtataactttatatatat

SEQ ID NO: 27956 - DNA, 201 bp, Homo sapiens
atataaaaagtttgcttatatataatatatatacacatatcatatataaatatattgtttataatatgtaaacaatatatacataaataatatataaaaastatatattatatatgtaaacaatatatttttaaaacccaaactcatgggtttatagttttttcatagtgaaaacaaacaaatatatagtttgcttatatc

SEQ ID NO: 27957 - DNA, 201 bp, Homo sapiens
ggcatgtgccactatgcccagctagtttttgtatttttagtagagatggggtttcaccatgttggccaggctggtcttgaattcctgacctcaagcaatcyatctgcctcatcctctcaaagggctgggattacatgcctggccaaaaagatcagcattttgattatatttattactttctagaatttaaaatataaatta

SEQ ID NO: 27958 - DNA, 201 bp, Homo sapiens
ttagcagttcttgtagtggtggcttggtaatggtgaattatctcagcatttgtttgtctgaaaaaggctgtatctttctttcatatatgatgcttagtttygctggatacaaaattcttggctgataattgttttgtttgaagaggctgaagatagggttccaatcccttctagattgtagggtttctgctgagaaatttg

SEQ ID NO: 27959 - DNA, 201 bp, Homo sapiens
  misc_feature (1)...(201): n = A,T,C or G, or insertion/deletion polymorphism (see Tables 1-2)
tcccagaaccgttattagagttgtcaatctgatgtctcgtcatccctgaatactttagtgtgtactacctatgagcaaagacattcttctgtgcaaccatnaaaataaggaaattaacactgatatttgatggtagtctaatctttagaacacatttgagtttttctacttgttcagtaatgtaccttatagcaacagaag

SEQ ID NO: 27960 - DNA, 201 bp, Homo sapiens
ttcagttctgtatcttttaaatatagcatttaggccatttacattcaatgttagtgttgaaatgtgaggtaccattacattcatcatgctctttgttgccygtgtactttggtttttttgttttttgtttttgctttttaacttgtatttttgtttcataggtcctgtgtgatttatgctttaaagaagttctgttttgat

SEQ ID NO: 27961 - DNA, 201 bp, Homo sapiens
atgtaatatcagtatattccttccattggtgctggtaaacggagaactgatgaaacccatttctaaggactttggtgtttagctatttttaaaaaaaaaaytttaaagcccctgtgctaagaaagaggaccagaggagttgattgctaagctccttttcaacaggaacatttgtgctcctccagctcattcttgggctggt

SEQ ID NO: 27962 - DNA, 201 bp, Homo sapiens
tgcataggtgatcttatgagattctgatggagctgaaaaattcctgttacatagtgatgtcatagctatcataatagaatagtgagattacttatttttttaaatgtactgtagcctaagtttatagtgtttataaagtctacagtagcatgcagtaatgacctaggccttcgcattcactcaccactcacccagggctac

SEQ ID NO: 27963 - DNA, 201 bp, Homo sapiens
aaagagtgctttcagatgtacttctctagttttttgctattccccaaagtgcatccttacataattagctttaaaattcctttcatcccttatttttttttaaatctatcattaacacgtagatttttatctctaagtttatttttactaaacttgcatctttttaaatacgacgtattctgaatctaaatcagtatttag

SEQ ID NO: 27964 - DNA, 201 bp, Homo sapiens
tctgagaaggggcagactgcctcctcaagtgggtccctgacccctgacccccgagcagcctaactgggaggcaccccccagcaggggaacactgacacctyacacagcagggtattccaacagacctgcagctgagggtcctgtctgttagaaggaaaactaacaaacagaaaggacatccacaccaaaaacccatctgta

SEQ ID NO: 27965 - DNA, 201 bp, Homo sapiens
  misc_feature (1)...(201): n = A,T,C or G, or insertion/deletion polymorphism (see Tables 1-2)
gtggaaaatgggaacagactatgtgttctaattattgctgaaccctgaccattttcccctccatgtccacaaccgagcacgttctctctccagcctcctgnactctctgtggctccatcgcactctcgtcaccaagattcacccctgcccacacccacacccttcatggggaggccggggatgggaaccaggaggtgggct

SEQ ID NO: 27966 - DNA, 201 bp, Homo sapiens
  misc_feature (1)...(201): n = A,T,C or G, or insertion/deletion polymorphism (see Tables 1-2)
tggaaaatgggaacagactatgtgttctaattattgctgaaccctgaccattttcccctccatgtccacaaccgagcacgttctctctccagcctcctgcnctctctgtggctccatcgcactctcgtcaccaagattcacccctgcccacacccacacccttcatggggaggccggggatgggaaccaggaggtgggctt

SEQ ID NO: 27967 - DNA, 201 bp, Homo sapiens
  misc_feature (1)...(201): n = A,T,C or G, or insertion/deletion polymorphism (see Tables 1-2)
attctctttttaaaagtggcatctctcatttttaaaagagaaaatcctagatagtgactcctattatcatcaagtaatatatatcaaggccccaaggctancttgtcacattttactctggcatagaaatctaattccttctctataaagtcaaaaagagagaggtgagttatagatgttttctaatttagtttagggtca

SEQ ID NO: 27968 - DNA, 201 bp, Homo sapiens
  misc_feature (1)...(201): n = A,T,C or G, or insertion/deletion polymorphism (see Tables 1-2)
aaggctaccttgtcacattttactctggcatagaaatctaattccttctctataaagtcaaaaagagagaggtgagttatagatgttttctaatttagttnagggtcaacttataatcctcgtcctcaactgatggtttagcgataacttaaaaggtgatgctgcaaatgattctttgctggatttcagaaaataaagaag

SEQ ID NO: 27969 - DNA, 201 bp, Homo sapiens
cccgggttcataccattttcctgcctcagcctcctgggtagctggggactacaggcgcccgccaccaggcctggctaatttattgtatttttagtagaggyggggtttcaccaagttcgccaggatggtctcgatctcctgacctcgtgatctgcctgccttggcctcccaaggtgctaggattacaggcgtgagccaccg

SEQ ID NO: 27970 - DNA, 201 bp, Homo sapiens
gtaacagttttattaagaaaaattttaattacaaagcaatatctaacccatcctttggtttataaagcagcttaaacctctttttttggagtgaacggtcrtagatacatctgaggacccaggtgctcaatgggcattgtccttggcatttctaaatcaccaaggaactttttcgcatttacccatatggattttaatttt

SEQ ID NO: 27971 - DNA, 201 bp, Homo sapiens
gtacagactcaaagcaattctctaatgtattcaaagtaaacaataccataaggtcaccttattcaccagggattttcatttctgttcattgaagatttttwaaaaattgacagatatattggaagccagtgggaaaatagaatttatctaacagaaagtatcttcatagccacttttgagaaattgcataaatccattcca

SEQ ID NO: 27972 - DNA, 201 bp, Homo sapiens
gttcaacctggcttataaagaaaggtattttcaaagtgatgcaaagaatactgcaaggggtgtgcccaattcaaagaaatagcttctttttttttttttttaagtgttagcctagggtactgctaattagaaaagagtgttatcatttcatcaaaggaagggccactgagcttttacatagaaagattttatcagctgcaa

SEQ ID NO: 27973 - DNA, 201 bp, Homo sapiens
atctcattagttcaacctggcttataaagaaaggtattttcaaagtgatgcaaagaatactgcaaggggtgtgcccaattcaaagaaatagcttctttttktttttttttaagtgttagcctagggtactgctaattagaaaagagtgttatcatttcatcaaaggaagggccactgagcttttacatagaaagattttat

SEQ ID NO: 27974 - DNA, 201 bp, Homo sapiens
gtgagccacttaaaatttgttattgtcaaggacatttttacttcatattttttgtcacatgtatccctacaggatcccatatatcgatattagacaagcayaatttcctgctttttaggatctgagactccaaggcagagagcataggagtagggactcataaagacaactgcgtaatttatcagctgaaaccacatatct

SEQ ID NO: 27975 - DNA, 201 bp, Homo sapiens
aaatgtcatcatttacagactgaatttggtgctgattatgttcaccattactaaaaatattgggaaatgagctatgcttggtgaaacaaagggcattttttaaaaatttggctgattaaatgtagtttagaaacaaaataaacttgcataaacttgcaagtgtttggaaacagtctggtttggtaatagtcactatgttta

SEQ ID NO: 27976 - DNA, 201 bp, Homo sapiens
tttttttggaggaaggggcaaaaatatttcataagtcacgccattgcttcctaggacattcatcctggcagaagatacatatatttaggtttgtcaatagyatctggttcacgttttatcagtctcatccacccgttacgaagttctcttcttaacgaattatttctgcctcaattcgttacttcattagggattgcaaga

SEQ ID NO: 27977 - DNA, 201 bp, Homo sapiens
ttggctattttctctctctctctctctctttttttttttttttttttttgggacagattctagctctgttgcccagcctggagtgcagtagtgctatctcrgcctcctgggctcaagcgattctcctgcctcagcctcccgagtagctaggattacaggcacacaccaccatgcctggcttatatttttatttttagtaga

SEQ ID NO: 27978 - DNA, 201 bp, Homo sapiens
atttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagct

SEQ ID NO: 27979 - DNA, 201 bp, Homo sapiens
  misc_feature (1)...(201): n = A,T,C or G, or insertion/deletion polymorphism (see Tables 1-2)
tgttcttcacagctggctcttcctatagacatgtgggaccccctgctgcaggcctgtcccagctgcttggtggaagcagcttttgctacccttctgggctnttgcgcaggtttcatttatgagctcaaccctgaaccttccctgacagcagcaaggcctgtgtgcgtacctaattatgaagtgacggcctgtccctgtgaa

SEQ ID NO: 27980 - DNA, 201 bp, Homo sapiens
aatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcctgcctcagcctcccgagtagc

SEQ ID NO: 27981 - DNA, 201 bp, Homo sapiens
aaattggggtccaaagtttaatttacctttgggcaagtccttcaatctttcttctttttcaacatattagtttttggctattttctctctctctctctctytttttttttttttttttttttgggacagattctagctctgttgcccagcctggagtgcagtagtgctatctcggcctcctgggctcaagcgattctcctg

SEQ ID NO: 27982 - DNA, 201 bp, Homo sapiens
gtcctaacttttggagcaaactcctcataaagcagcatgttctcccatgcttgaagcttagtctggaatctttgggttagagggaatgactgtttggttcrtggctgtatctcacttaaaacagtgcctagggccaggcacagtggctcacgcctgtaatcccagcacattgggaggccaaggcgggtggatctcttgagg

SEQ ID NO: 27983 - DNA, 201 bp, Homo sapiens
gacagagagagcacaggagacacaccctgacatctcccctcctcctgcttccaatcctctctttggccgaacctacctcgaagtcagagagcagaggagcrtgggaacatggcttcctgtggaacctgacagaagattctaggggtgcaggcaataggtctgagaacagccagtctgtcaataggtggagttgctgagaca

SEQ ID NO: 27984 - DNA, 201 bp, Homo sapiens
acacgtgcatggaggttccctgtatggagccatgttttccatccagattgggccaaggatagctgatgggcagtcatggatgttgatggatgggttttccmagggtagctggattgtggtctcgtaaccatgccgactcctggggctgagaagggctatttagtgaaatgaaatactactctgtcacaacttcctcactca

SEQ ID NO: 27985 - DNA, 201 bp, Homo sapiens
tggacaggagtgacagggtttgagaaatatttaggaggcaaaatctgcaggacttgtgttggggagtctgtgaggggtggaagggaggagggtcaaggtcyacttccaggtggctggcttatgtgactatgatgacagatgctagcacttccaaatgagataaagaatgcctggaattccagagggaaaaaatcgagtgtg

SEQ ID NO: 27986 - DNA, 201 bp, Homo sapiens
accagaagctggagctatggtcaggtgagccacttaaaatttgttattgtcaaggacatttttacttcatattttttgtcacatgtatccctacaggatcycatatatcgatattagacaagcacaatttcctgctttttaggatctgagactccaaggcagagagcataggagtagggactcataaagacaactgcgtaa

SEQ ID NO: 27987 - DNA, 201 bp, Homo sapiens
acatttttacttcatattttttgtcacatgtatccctacaggatcccatatatcgatattagacaagcacaatttcctgctttttaggatctgagactccwaggcagagagcataggagtagggactcataaagacaactgcgtaatttatcagctgaaaccacatatctctgggtattacagtgttacagaaatgagaga

SEQ ID NO: 27988 - DNA, 201 bp, Homo sapiens
tgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaag

SEQ ID NO: 27989 - DNA, 201 bp, Homo sapiens
ttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaaa

SEQ ID NO: 27990 - DNA, 201 bp, Homo sapiens
cttgaacccaggaggcagaggttgcagtgagctgagactatgccactgcactccagcctgggtggcaagagtgaaagtccttctcaaaaaaaaaaaaaaaaaatgagtgccccctcagccagcccctactgtgtgctaagcataaagctttcattatattataaaatctattgtctttttatttcccaaactaaactgcaa

SEQ ID NO: 27991 - DNA, 201 bp, Homo sapiens
  misc_feature (1)...(201): n = A,T,C or G, or insertion/deletion polymorphism (see Tables 1-2)
taaggattgttattaagaagttatttatcattattgttgctacgatttgaaagtagagggggtcgctgtttgtacttacatggcttcctccagagggaatncccgaattctcagacagctcatttaaagcttccaaaatgacaaatattccacaggtatctgctgcgtcctctcctgtcctgattcctgacttcacatttc

SEQ ID NO: 27992 - DNA, 201 bp, Homo sapiens
acatcccaccccaacacacatatacaaaagccaccccatacaggtgtttctcgtctcctctctccgcaaaggacagtgctgttggtctgtcctgagatttyagcctacaggaatttctgaagccatattcaaggtgggggggcaggaatcagccactttcatattttgcttgtttccctggaaaaccacaagctgttataa

SEQ ID NO: 27993 - DNA, 201 bp, Homo sapiens
tcactctgtgtaggaagaatgctttgcatgctttgttccctctctgcattcaagtctctgctctggtcacctcttcaaagaggccttcgctcacccaactscacctaaaatatcaccatctgccctgttgttttcatcctccaaccttagtgtgtactccatttctcccttctagaatatgagctccatgaaggtagaagc

SEQ ID NO: 27994 - DNA, 201 bp, Homo sapiens
ttagcgataacttaaaaggtgatgctgcaaatgattctttgctggatttcagaaaataaagaagctattccagcaaaaaaaaaagtttctatttttacctstattctgtcagggatcacagtatatgtagttttgaagatgaatgttttagagtcagaaagacctggatttatatccaacttccgccagattcctaactct

SEQ ID NO: 27995 - DNA, 201 bp, Homo sapiens
  misc_feature (1)...(201): n = A,T,C or G, or insertion/deletion polymorphism (see Tables 1-2)
tacaataaaactgaacataaattcctacaagattccatggcttcccttccacttcatcccttgtttatttccctccagccatactgagatttttctcttcngaaagcatccacacatcctcttgtgtcagcacttttagacatactgctccttttgctaggaaagctcccctcactatctttcactctgtgtaggaagaat

SEQ ID NO: 27996 - DNA, 201 bp, Homo sapiens
  misc_feature (1)...(201): n = A,T,C or G, or insertion/deletion polymorphism (see Tables 1-2)
tgcaaatgattctttgctggatttcagaaaataaagaagctattccagcaaaaaaaaaagtttctatttttacctgtattctgtcagggatcacagtatangtagttttgaagatgaatgttttagagtcagaaagacctggatttatatccaacttccgccagattcctaactctgtaggctttttatttatcttctaaa

SEQ ID NO: 27997 - DNA, 201 bp, Homo sapiens
attataattactcctttctcacccactgcagaggcgtgtctgacagagggtacaatttgttgctttggcatgggctgcgctccaggggctgagccattttkaagagatgtttgagttgatgaaaagtgtatgaggaatcttttctcaagggtgcctgcagtgggaccccatggggagtgtcatatgagtcgatatgactca

SEQ ID NO: 27998 - DNA, 201 bp, Homo sapiens
  misc_feature (1)...(201): n = A,T,C or G, or insertion/deletion polymorphism (see Tables 1-2)
aatgttaatatttagaaagcaaaacgaacatcaaaattcagacagcaagatcaggaatttgaaacacacaaaagaccagtgttcatctcatcgtacctgcngtggcagtttacagaagcctttggagaccaagcttactggacttggaattttatcccctcgttttcactttgggatttgaagatttccacaaacctccca

SEQ ID NO: 27999 - DNA, 201 bp, Homo sapiens
gaatgcatactggtaaccattgcactctagtactccaggaggaacaaatagttattattaatgtacaccaggcattgtactggggggaattctaaggttcragtctttaagaaacgtatttctagatgccaggtgacagggcacaaacacactgaacatgaaataacaacaatacttgtcaggtgggccatgtagagagca

SEQ ID NO: 28000 - DNA, 201 bp, Homo sapiens
aataaaatcgaggcaaagagtgattaagtgactttctcacaaccatctagctaataaatagcagtgctaagatttgaagccaggcagatacctgaatgcayactggtaaccattgcactctagtactccaggaggaacaaatagttattattaatgtacaccaggcattgtactggggggaattctaaggttcaagtcttt

SEQ ID NO: 28001 - DNA, 201 bp, Homo sapiens
ataaattggggtccaaagtttaatttacctttgggcaagtccttcaatctttcttctttttcaacatattagtttttggctattttctctctctctctctctctttttttttttttttttttttgggacagattctagctctgttgcccagcctggagtgcagtagtgctatctcggcctcctgggctcaagcgattctcc

SEQ ID NO: 28002 - DNA, 201 bp, Homo sapiens
tttatctgatggaaaagtctcattatagaaataaaaaataataaaagcataaaaagagctcaaagatctacaaattagagacactaacaattaacattttsttgtaatgtcatccatttaaagtattttcagtgcttttcatttttaattggcaattaattgaatatattgttcttttcaaataaacacacatgtacattt

SEQ ID NO: 28003 - DNA, 201 bp, Homo sapiens
  misc_feature (1)...(201): n = A,T,C or G, or insertion/deletion polymorphism (see Tables 1-2)
tatgatgaaccgctccccccaacacacacacaagcacatacactgtagcccagcagtcccctgcagttttatgcttgtgtgtgtgttaatgcataacaaangattcagcgctatggcctggtaactggaaagtaggtcaaaagagaggggtgagactgtcgcccaagtgaaaaagatagcagaagataagaaggaaaactg

SEQ ID NO: 28004 - DNA, 201 bp, Homo sapiens
atatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctca

SEQ ID NO: 28005 - DNA, 201 bp, Homo sapiens
tatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcctc

SEQ ID NO: 28006 - DNA, 201 bp, Homo sapiens
cagtgatggaagcagcgagaaccagtccgatctgggcatgtgctgaaggtggagcccgcctgattggctgagagactggatatgtggtgtgagagaaggarggtatggaggaagccaaatgagtgatgaatgtgaaatgtgtgccacatggtagaatcttagtaaatggtaacttccaacatgtttacatttggggaaact

SEQ ID NO: 28007 - DNA, 201 bp, Homo sapiens
  misc_feature (1)...(201): n = A,T,C or G, or insertion/deletion polymorphism (see Tables 1-2)
cacacacaccccggggttcttgattcattcccctaacctttatttagtgcttgcaagtccaggttctgttttatgctggagacacagcaatgcctattctnactgaatttctgatctcatgggggaaccaaacaaacaagtgaatctatagtatagttatatgggtaatagaaaaatacaaagcaggttaaggaaaacggg

SEQ ID NO: 28008 - DNA, 201 bp, Homo sapiens
gtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcct

SEQ ID NO: 28009 - DNA, 201 bp, Homo sapiens
  misc_feature (1)...(201): n = A,T,C or G, or insertion/deletion polymorphism (see Tables 1-2)
ttgcaaatagacaattctggatgtaagcgatgactgtgtcacctaccagctgtgtttcctgagcaaggtacttaagcactctgagctgtctctcctcatcngcaaaggggaaaaacagcacacacaccccggggttcttgattcattcccctaacctttatttagtgcttgcaagtccaggttctgttttatgctggagac

SEQ ID NO: 28010 - DNA, 201 bp, Homo sapiens
tgttccttacccactgctccagtacccgtgttatcctgcctacctggctttgtgaacagcttccctgactccggagaattacatgcccagtgctcaggctyccccgcctgcatttctaatgtcctgccaagctacaagctagttggcaccccctgttcttggattcctgcctgactccctggtttcaagccatcccctcct

SEQ ID NO: 28011 - DNA, 201 bp, Homo sapiens
taggagtcctactcacacttgtgctgctgcaagtgagaaacttgaccgtcaccttcaatttcaatgttggcaacaacaacaaaagcagccacacacaacayctgtgaatgcccagaccttaactgcagtttgggatggagggtgagagcaggaaggatgcactctgtggtcaccacgcttggagcacatcagaatcacctg

SEQ ID NO: 28012 - DNA, 201 bp, Homo sapiens
gaggcagagcttgcagtgagccaagattgcaccactgcactccagcctgggcaacagtgcaagactccatctcaaaacaaaacaaaataaaacaaacaaamaaaaaaacagtaggtaagctacatttggcccgcagactatagttttctaaccattgctctaaaggatgaatggagattacattgatcattaacaactcag

SEQ ID NO: 28013 - DNA, 201 bp, Homo sapiens
  misc_feature (1)...(201): n = A,T,C or G, or insertion/deletion polymorphism (see Tables 1-2)
agctctccatcaccttccggaacaacagccacaaccgttacaccatcacagcttatctctcagccaacatcaccttctacaccggggtcccgaaggcaganttcaagaaggagacgttcgacgtgacgctggagcccttgtcctgtaagctaacaatggtgtggttctttgtgagactcgctgtctggcccctgtcttgct

SEQ ID NO: 28014 - DNA, 201 bp, Homo sapiens
  misc_feature (1)...(201): n = A,T,C or G, or insertion/deletion polymorphism (see Tables 1-2)
ggcatgggtgttgggggcaatggcaattgagtgagatagggaagaacggggcaggagccctcaagggtcagctcagcaaacagcaagtgggacaggcccangtggaaggagagatgaggaagacaggtcttattggggggcaggtattcacaaatcagagagaaaagttacattgcaggaggtggaatggcaagaggcaat

SEQ ID NO: 28015 - DNA, 201 bp, Homo sapiens
caatgccgcagcctaccttcggtatttctcactagaggatggctctcgcagccttctccctatcattaaccctttttcgctcttctccctcccttcccccstcagctcaccaatgactgtaaatatatttatctatacttatggatacccattcacaccttatgcatccaaacactcctgtctccttctcagaccagacac

SEQ ID NO: 28016 - DNA, 201 bp, Homo sapiens
tgggttcaagcaatcctcctgcctcagcctcccgagtagctgggattacaggcacatgccaccacgccaggcaaatttttgtatttttagtagagacgggrtttcactatgttggccaggctgatctcaaactcctgacctcaggtgatccacccacctcggcctgccaaagtgctggaattataggcgtcagccaccgca

SEQ ID NO: 28017 - DNA, 201 bp, Homo sapiens
agcaggaagctggaggaaagtgctgtttttctccccaacctcttaacacatgaaagagtaagctaaaagttgttgtttctaagttttccaggtacatagcrtatgcttcgtgttgacaaaggtaactaggcattattccaacttccaggctattaatgctaaatgcagttcttgtttaacatttttctttccttgatgttt

SEQ ID NO: 28018 - DNA, 201 bp, Homo sapiens
aaatcagcaatgaagttgggaacactggtctttacagagtcaccctcagtgccatgaatcttgcagtatctggacagaattggagatgacaaactcacacygcccttcctctgtgcaatgcaggcatgtatcggtgtggccccgcctcggttcaagccatcaagcacggccatgtctgcttccaatttgatgcaccttttg

SEQ ID NO: 28019 - DNA, 201 bp, Homo sapiens
cttttctccagcatgttgttagtgctccacatgtctctggaaccatctctctactctggtggcctctataatggggactcttcacctcttgtgggtgtgcmtggtttttgaaaatagccaagtctccaggagtcatgactgggtaatccaggggatcaagggggaaccttcactgggcccagaaacaaagtcccccttcat

SEQ ID NO: 28020 - DNA, 201 bp, Homo sapiens
taaatcagcaatgaagttgggaacactggtctttacagagtcaccctcagtgccatgaatcttgcagtatctggacagaattggagatgacaaactcacaycgcccttcctctgtgcaatgcaggcatgtatcggtgtggccccgcctcggttcaagccatcaagcacggccatgtctgcttccaatttgatgcacctttt

SEQ ID NO: 28021 - DNA, 201 bp, Homo sapiens
catggggacattttacaggtgactaatagcagctaatctcttattaactatatagataggtggttaaaatttaaagcattttagaagagtaacataggccytctgacttcctaaatgcatggtgggcatggccaaaatgcacaggcaatgtccaaattctccagttaaacttgacatatgttcataatgtccaaaaacaaa

SEQ ID NO: 28022 - DNA, 201 bp, Homo sapiens
cattgaagggcgtctaggcacggaacccgtggtagttgaacctgaaattcatcagtgtcataaacaaagactgctgtaactacctcaccacattattaaayctttctttattactatatgaacattttctatagtgctgaggggttaatgtgctctcatttgattctgtactgtcatataatttcaggtcttttcaaggac

SEQ ID NO: 28023 - DNA, 201 bp, Homo sapiens
atttagatcttcttcttaaattattccaatggctttttatagcctaagaataaagcatgaatgtttaatttgatatcaaaggatttcacaatcttatcctyacctatatcataggtcagtgttgaagagtgtggatttcagagctctatcactaactagctgtgacctcagcaaggttcttaaccttcctgggtttcagct

SEQ ID NO: 28024 - DNA, 201 bp, Homo sapiens
ggtatatctcacttaccattcttttcacctctctgtcatacctatggtgacccctgattcatgactcttgtcctccatacatttttttttttttttttttttttgagacggagtctcactctgtcgcccaggctggagtgcagtggcatgatctcggctcactgcaagctctgcctcccgggttcataccattttcctgcc

SEQ ID NO: 28025 - DNA, 201 bp, Homo sapiens
  misc_feature (1)...(201): n = A,T,C or G, or insertion/deletion polymorphism (see Tables 1-2)
gcagggtcgcctttttaatgtcttgccagagcccagcatccttggggactgggggatgcaagttttggtagaaccttctgccatggcatgggtgttggggncaatggcaattgagtgagatagggaagaacggggcaggagccctcaagggtcagctcagcaaacagcaagtgggacaggcccaagtggaaggagagatga

SEQ ID NO: 28026 - DNA, 201 bp, Homo sapiens
cccttcatctccaccacaaccactttgcaaaccctgcacaaaacattttcctaaaagcagcacacacacctcgaactgcattagaacttaggtgcaccacygcctgtcaacagatgtccctcaaaaaactgccctccgtgtcagatgagtttgggaaaccttgtgtaaagaaaggcaaagaggtgtccttgctgctgggct

SEQ ID NO: 28027 - DNA, 201 bp, Homo sapiens
gctgtgaagttgcttgtggctggcttcaaggcttcttctcccattcacctcaccttggccagctcagctcctctctgatgtgttcctgatgctcgaatttscctcctgcattttgcctcaatgcatctctggcccgcatccaaagtgatcatcattaatgttctcttctcatggatctattggccagatgatttctgctaa

SEQ ID NO: 28028 - DNA, 201 bp, Homo sapiens
tccaaatgagataaagaatgcctggaattccagagggaaaaaatcgagtgtggaaaatgctaatggaggtagtagcttcattgataactcattggcactgmtgctgtgcagaggtgctgtatgcctcccatttaattgttcaagcagccctctgggcattggactatggccatctccatttttcccatgagataatggttg

SEQ ID NO: 28029 - DNA, 201 bp, Homo sapiens
  misc_feature (1)...(201): n = A,T,C or G, or insertion/deletion polymorphism (see Tables 1-2)
cctgcacccatggcaggctgtgaagttgcttgtggctggcttcaaggcttcttctcccattcacctcaccttggccagctcagctcctctctgatgtgttnctgatgctcgaatttccctcctgcattttgcctcaatgcatctctggcccgcatccaaagtgatcatcattaatgttctcttctcatggatctattggcc

SEQ ID NO: 28030 - DNA, 201 bp, Homo sapiens
aaaggattaagtaatttacccaggtcacacctggaaagtgctgggacctcaatttggacccaagcagcctcttctacttacaatgcttactacctccaccyagggagcctccaccaaggagatggtggaggtatgaatatgcttctgtttgaattgatgagtgtgaattacttgagggactttcaggtaaacctgtccaat

SEQ ID NO: 28031 - DNA, 201 bp, Homo sapiens
ccttacccactgctccagtacccgtgttatcctgcctacctggctttgtgaacagcttccctgactccggagaattacatgcccagtgctcaggcttcccygcctgcatttctaatgtcctgccaagctacaagctagttggcaccccctgttcttggattcctgcctgactccctggtttcaagccatcccctcctcagt

SEQ ID NO: 28032 - DNA, 201 bp, Homo sapiens
atatagtgcctgacacataataagtgtccaataaaagtttcccctattactagtaattctgttattcctgccatactactgctattagtttgggctatgawtagttttctcctggaaaaatacttgctctagcttcccaattccacctcacctcctcaggccctccttccctcagtctagcccctgccttgctgccaaagt

SEQ ID NO: 28033 - DNA, 201 bp, Homo sapiens
atccacatagatggttgtaagcgacgactcatcctgcttcggggctggagtttgaccccaagtggatagtttcttaatcaagggtggcatacacatttcaractggaactttggaagtgaccaagtagaatgttgttttgagaagaacaccaagactgcatctgaatgtggcgggtagaaggattgatggccgccattggc

SEQ ID NO: 28034 - DNA, 201 bp, Homo sapiens
tggaatccatgaagtgctaaggagtgcagaatttattttaaatagtttagacagtctccctgctcttatttacaaaagtaatttgcactacaaagaagaarcttgctgaattgagaacacttgtgcatagtctcagaaagtcagaatttttgttatctgaactagtgaattttcactgtattttttaaatgcttcattttc

SEQ ID NO: 28035 - DNA, 201 bp, Homo sapiens
  misc_feature (1)...(201): n = A,T,C or G, or insertion/deletion polymorphism (see Tables 1-2)
atttgaggatattcttatactctgagctttgagaatttacgtggctctgtctagaagtcagttattttttccctcattcatctgcccagtcctttcaaacngaagactagtatttatcagctctgggatattatattgcagtgtgctttaggaatttctgcttgcaaaatgcttcaggaatttttgcctctttgttctttt

SEQ ID NO: 28036 - DNA, 201 bp, Homo sapiens
ggcccatgttctagaattaagtgctgagcttgtctgtctttctcacggatgccgcattggttactcttcaccacagactttagcagatcaggtaagttcartgtctgtgacttgaaatactaaaaaatcatagtgaattgtaatgcatttttttcagtcagtatgacagtatattgcgagagcgatggttcattttaaaat

SEQ ID NO: 28037 - DNA, 201 bp, Homo sapiens
ccgtcagaaactgatgtgggagggtggtgcacaggaagaagtactatggtacagtgacaaagataactttgtcataattttgcctaaaaagagaaataagwctcgtagtcatgttatataggttaactgtgcgatgaagtaaagggaatgtcatgaactacttgggaaacccagtgtcttgaatcccgaaacttagaactc

SEQ ID NO: 28038 - DNA, 201 bp, Homo sapiens
gctttttggcactagggacccagtttcgtggaagacagtttttccatggacaggggtcgaggaggcagtggggtgggggatagttttgggatgaaactgcwccacctcagatcatcaggcattagattctcataaggagcggacaatctagaacccttgcatgccgaattcctgctcctgtgagaatctgatgcagctgct

SEQ ID NO: 28039 - DNA, 201 bp, Homo sapiens
  misc_feature (1)...(201): n = A,T,C or G, or insertion/deletion polymorphism (see Tables 1-2)
gaaattgcaaagataattatgacatattaaatgatagattttaaataggtagacatttatagaaatgactgtaattactgttgaggatcagctaggtttgngtaggtgaagaagtggttttggagcttcagtgcatttatgtgtgctcagtagggtacttaggatatttgaggagggaaaaggccgtcagaaactgatgtg

SEQ ID NO: 28040 - DNA, 201 bp, Homo sapiens
agctttttggcactagggacccagtttcgtggaagacagtttttccatggacaggggtcgaggaggcagtggggtgggggatagttttgggatgaaactgyaccacctcagatcatcaggcattagattctcataaggagcggacaatctagaacccttgcatgccgaattcctgctcctgtgagaatctgatgcagctgc

SEQ ID NO: 28041 - DNA, 201 bp, Homo sapiens
aactttcccttaaaacttttaaggccttgttcatagttgcctaccttcctgtgtttctgagacatctgatgccattatgattcttacttctttataacagygatctccaagctttttggcactagggacccagtttcgtggaagacagtttttccatggacaggggtcgaggaggcagtggggtgggggatagttttggga

SEQ ID NO: 28042 - DNA, 201 bp, Homo sapiens
gaaaagttacatgataaaaattttgtttgctagcgtgataggttggtgtttccagaaaaactcaccggaaacttttcatgtgaggtttagaagtaaaatasttccaggaaaaagttggcattcggctctgattaactagaatatgagtagtaatgcttgtcttttttatgtttgttttgacaggttttgacacaagggcgc

SEQ ID NO: 28043 - DNA, 201 bp, Homo sapiens
gatattcactccccgccccacccctgagatggagtttcactcttgtcgcccaggctggagtgcaatggtgcgatcttggtttactgcaacctccgcttccygggttcaagcgattctcctgcctcaccctcctaagtagctgggattacaggcatgcgccaccacccctagctaattttgtatttttagtagagatggggt

SEQ ID NO: 28044 - DNA, 201 bp, Homo sapiens
tgactttaaaaaaaaaagtttatttattattttactttaagttctgggatacatgtgcagaacgtgcaggtttacatgtatacgtaggtacacacgtggcwtgttggtttgctgcacctttcaacccatcatctaagttttaagccccacatgcattaggtatttgtcctaatgttctccctccccttaccccacccacct

SEQ ID NO: 28045 - DNA, 201 bp, Homo sapiens
ggatatttttcaaatgattccttcagattttcttgtcagacaggcacttatctgcacacaataatgattctgtctttttcagtattcataactgtcgtttrttttttcattgcattggctaaagtgcagtgctgttcagaagacatgccttgagagccgtaaatgtaagccatatatgtagttttacatttctagtaggca

SEQ ID NO: 28046 - DNA, 201 bp, Homo sapiens
ttaaattacattggctcactactgtaatcccagtactcaggaggcagagatgggaggattgcttgaggccaggagttttgagacagcctgggcaacatagkgataacccgtctctaccaacaaaaaaaaaagatataaaagtaaaaatagaattgaagaattaaaaatcttcatttatgtgaaaatttgaatggagaggtg

SEQ ID NO: 28047 - DNA, 201 bp, Homo sapiens
  misc_feature (1)...(201): n = A,T,C or G, or insertion/deletion polymorphism (see Tables 1-2)
ttatagtgatttccttgaccttgtcttctccaccctagacaaaaggctgcaattgcctgttttcctaatgcagctgatgcacttctcatagtttttgccangttaaagtgatttgtcaggctctaccactgactaggaattttcttttttttcagtactatggtgtcattcttagaatgcaaagtgtcgggtctggagctg

SEQ ID NO: 28048 - DNA, 201 bp, Homo sapiens
aaagtcccatgactatttctggttttaaaattctgtattaacaattcgtgttttgatatggaatagggcaaatatgcattaaatatgctgtttctcaaagktttttcttctagataaatgttagaattaatatatcacataagcatacaaaacaaacacgtaagaaaaatcctagtaggattttcattgggattgcatttg

SEQ ID NO: 28049 - DNA, 201 bp, Homo sapiens
atgaggcagaactgtttctctgcattctatattgagatgtacaattgtttaacaaataattacaaaagaaaatgagtgccatgagagagtgccctaagggrtcagcggatgggtagagaagttcaggctggggctagggccagtggaggtttgggtatcagagaatgcctaatcaatttagatgctaagagataactaggc

SEQ ID NO: 28050 - DNA, 201 bp, Homo sapiens
tgcactccagcctgggcaacagagggagacgctgtctcaaaaaaaaaaaaaaaattaggatttatcgtgtttcaatttttttgaaatacgtataaagcacwttgaaagtgagttgacatggtgaaattctcagataattaccaagggtctactcttgttagttttaaataccttttgtaatatgaccctgataatgattca

SEQ ID NO: 28051 - DNA, 201 bp, Homo sapiens
ctcaaaaaaataaaataaaataaaaaacaaatttagttaaatgctttacttgaaaaccgatctcatgctatctacaacattttcattgctaactccccccrtatatttcctgtgttccagcgatctcaggctacttgtgattactcactgtatgctcacccatgcctccctgttaggcaggagtgaaggaggaataagagc

SEQ ID NO: 28052 - DNA, 201 bp, Homo sapiens
  misc_feature (1)...(201): n = A,T,C or G, or insertion/deletion polymorphism (see Tables 1-2)
ccttgaggtcctttattcagcttactacaactacttagagtcttctgaaatttctcttttcttgtacagttcccttcgcgtttacaaataattgttattantgcctgcagttattgtctgcttgaacaaaaatacatgcatcaactcagtttatagtgatttccttgaccttgtcttctccaccctagacaaaaggctgca

SEQ ID NO: 28053 - DNA, 201 bp, Homo sapiens
ttcttctttttcaagattgtttggctgttctgggtgcttttaatatccatgtgaattttaaaatcagcttacttatttctgtctaaaagccagcttttatwcagctgagatcttttttaagctaaccttagatttaatgaactagttatttaggtccaaaagaaaaggctgggcatggtggcccacgcctgtaatcccagc

SEQ ID NO: 28054 - DNA, 201 bp, Homo sapiens
gtatagtattgttttgtgtattcttaaactttatatagatggtactgcatgtattcttgttcagcatactgtttattttatccccactcaaaatcacttakcagtgtggtttcatgaattgagtttcaactcaattcatcagtgtgggttcatgtagatttaggtcatttatttttactgtgacaagttagtacattttag

SEQ ID NO: 28055 - DNA, 201 bp, Homo sapiens
tttcttattttgtagtcttcaaaaattaaaaaaggaagcaaaggggatacatccatgttgaaaccaacactgatggcagcagttccggtaagaagtgaccyttatttaatattgagtattaaagaagtatcacccgctacaaagcattagtgctagtgaaaaatatattgttgacaaggtagtttatgtaggatttattcc

SEQ ID NO: 28056 - DNA, 201 bp, Homo sapiens
gtgaattgtaatgcatttttttcagtcagtatgacagtatattgcgagagcgatggttcattttaaaatgagctttagccttttaagtgcttcttagactrtaagtacattaaaataatttataataggctttttgatctaagaataccattgaattttaaaaataaggatcactttatatggatcactttttcttatttt

SEQ ID NO: 28057 - DNA, 201 bp, Homo sapiens
cttgtaatggaacttgaatctcttggattaatttaacaccttattttttaaaatgagaattaaattttctatattctaccccttgcttttgctcttctttrtctggaaaagagtctccacctcattttctgacacttgtattgactccttaatttcagctgctattaatttcaaagaactttttcttatttttattccttc

SEQ ID NO: 28058 - DNA, 201 bp, Homo sapiens
caggaaagcgatggattgtttcaggccaggcccactgcttgctgtactttaatgtcattgctgcttatcgccttctctgcagccttgttgacactcctgamaacaagtgtttgtctttggcttctagggcactgtttcctgttcctttacctttcttgttggttcttctggcatctgcccttaatcctttatcctacaatt

SEQ ID NO: 28059 - DNA, 201 bp, Homo sapiens
taaagtcagtgaaatgagtagttttcaacgtaatctgtttattctggcctataattacaaaatggaacagatttcaaaaggacgtaatactccactgtgcracaggtaagtaaagactctctacctccttctttctcctcttgataatttaatcatttagttcacattaatagcccaattaattgagatagttataagaaa

SEQ ID NO: 28060 - DNA, 201 bp, Homo sapiens
agaaaatttttggaaggccaaaaatctcatatcagaatgaccagtatatacttattaatggaagctcaggaattcctgaagaatagcttttctgttggtaratatgtactaactggttgagtaatatatgctaatgtaatttaaaaaattatgtgattgtgaaggcaggaaagcgatggattgtttcaggccaggcccact

SEQ ID NO: 28061 - DNA, 201 bp, Homo sapiens
ctgccaccctctcccaataatttctctgttgccatgtttacccccttaaacacaccctctcactgccaccatgtaattactaaacatggatcttactggcsacaaccatttaatgtctcctagaagctcagttcagggtgcccctgttaacattgttcccctcttcaccttcatcgtcagttgttttcctcctcctccttg

SEQ ID NO: 28062 - DNA, 201 bp, Homo sapiens
acctgtctatttttattatttacttggtatcgaagtatttttgtgaattctccctctggttggatatttttcaaatgattccttcagattttcttgtcagrcaggcacttatctgcacacaataatgattctgtctttttcagtattcataactgtcgtttattttttcattgcattggctaaagtgcagtgctgttcaga

SEQ ID NO: 28063 - DNA, 201 bp, Homo sapiens
tcttgtttcaaagatgtttctgaagaactattattgttttcattttacttattacgtagatgcaagtaagaattatggcaaaaacttgagaaatgtactawtaagtgaataatgtcaataaattaggagtgatcataactttattttgcagaagtaaaattataaaatttattttatgaaattgtggatttttgaatgatt

SEQ ID NO: 28064 - DNA, 201 bp, Homo sapiens
aaaaaaaaaaaaaaaacctcaatgtaggccaaaaaatacgactctacaggcctcacggcctgtgcttcaccaatatgtgacttctgcttttaaggaatagytggggatatctcagccttaggataaataatcatttttggtaatttagaaaaatgaagcagtgtattagctactgttctcaaatatcctttttttcattta

SEQ ID NO: 28065 - DNA, 201 bp, Homo sapiens
tgaatagtttccacagtggattttagtctgggtggccaggagagttgtagtttgatgataccttctttcatgtttatcaacctattttgtttccccaaatkagttctgagagttaagggtgctgatgagttgctcctgaaagtgtattagaagggtattataggggacaggtggtgtgacatgggaatcttttgcacagac

SEQ ID NO: 28066 - DNA, 201 bp, Homo sapiens
  misc_feature (1)...(201): n = A,T,C or G, or insertion/deletion polymorphism (see Tables 1-2)
gaagctagaaaggcagtaggctttgtgaacgaaattatagctgaaaagaatgacaaatagctgacatttattgagcttttattacatgccacgcactgttnggagagctttatgtacagtgtcttcacactgttaacagtcctctggggtgggggttattcccattttacagcgggagaaactgcagattggacgacttag

SEQ ID NO: 28067 - DNA, 201 bp, Homo sapiens
  misc_feature (1)...(201): n = A,T,C or G, or insertion/deletion polymorphism (see Tables 1-2)
gattagagaggtgttttatactgcacatcggtgaggcctaataagaaagtagaatagacgtaaaccattgttttcatcatcctttaagacagggatttcanactcaagaaccaggcagctacctatttaaatgagtcaagtgggccctaatgtaagacaatgtgatgggtaaggattgattctgagggaacaggagcaggc

SEQ ID NO: 28068 - DNA, 201 bp, Homo sapiens
  misc_feature (1)...(201): n = A,T,C or G, or insertion/deletion polymorphism (see Tables 1-2)
atttcaacagattaatgagcaactgaactgccatattttgaagtgggagaacagtttgcctgagtcaggtatccatccctttaggttctcgattggccctnggcccacggtgagtgagctctctttgcttggtgcatcatcgctccacctagttcaagttctggcggcttcctgattttgattctcttgggaaatgaggcc

SEQ ID NO: 28069 - DNA, 201 bp, Homo sapiens
cttcatttgccgatgtaacttttctttaaattattttaaaatgattttgaactaacgcctttctttttcttcctcctagattctcgctgaagtctgttaaytctactttttgagtacttatgaataaccacgtgtcttcaaaaccatctaccatgaagctaaaacataccatcaaccctattcttttatattttatacatt

SEQ ID NO: 28070 - DNA, 201 bp, Homo sapiens; identical to SEQ ID NO: 6861

SEQ ID NO: 28071 - DNA, 201 bp, Homo sapiens
attctccagaattatgccaaagttttgattctgaggttagctcaaatgacacatcagttttctaacatcagttaggaaaacaggtccctctaggtatactktcatcttgtctttaaagaaagttttaaggaaaaatataaacattaattattaatgttttaaaggtagtatttatttgaaatttaaaatattttacattca

SEQ ID NO: 28072 - DNA, 201 bp, Homo sapiens
tgtattttaaaatatttatttatttatttatttatttatttatttatttatttattttgagatggagtctcgctctgtcagcaggctggagtgcaatggcrccatctcggctcactgcaacctccgcctcctaggttcaagcaattctcctgcctcagcctcccaagtagctggggactataggcgtgcaccaccacgccc

SEQ ID NO: 28073 - DNA, 201 bp, Homo sapiens; identical to SEQ ID NO: 6868

SEQ ID NO: 28074 - DNA, 201 bp, Homo sapiens
aaaaaataattctatgcaaacgtaactttctggttcatcataacatttggacgatattctggtttcttctgtaaattattattttgattacattaaaaaawttttttttgttttatcaggttattcttggacagtataattggctttcctatgaagatgtctttgttcgagcctttaattttggaaatggattacagatgt

SEQ ID NO: 28075 - DNA, 201 bp, Homo sapiens
cttttagtaaatttgtaattttgaagggttatattttaaactagtaatttttattttacttctgaagcattaagtaattacaagttttcagaattgtttgraagttaaaaagggagacttttaattatattacagtaaaaagaggtttctttggtctctagacaactcccagaaatatctgggctattctatatgggggaa

SEQ ID NO: 28076 - DNA, 201 bp, Homo sapiens
gtttttttggggtatgggatattttctgcaaatatataggagaagagtagtaaggtgtttgtgaggcagaataatggtggattccaagtactatgatcatygatatcaatttttagaatgtattagatgcatctggagtcaataatttatctggagaagtttttatatcaaactgataggtaatattaaaaaccacttagc

SEQ ID NO: 28077 - DNA, 201 bp, Homo sapiens
catggctgcagtggaggccctgggagccaaggccagcatgggtatgttacacttttctaattccttacctgtgctttctggtgaccacattctccagaatkatgccaaagttttgattctgaggttagctcaaatgacacatcagttttctaacatcagttaggaaaacaggtccctctaggtatactgtcatcttgtctt

SEQ ID NO: 28078 - DNA, 201 bp, Homo sapiens
tttctggcagatagttgtggattctactttaactcttctggttggcaacccactagatgtaaagaccatttcctccttggatgatttcttctgttcttcaraagaaccctgtattattatttgtttaagccactgtttcttgtgcctcagtactttgcttcagcaacgcttataattcctgagtgcttttaagtaggacgg

SEQ ID NO: 28079 - DNA, 201 bp, Homo sapiens
  misc_feature (1)...(201): n = A,T,C or G, or insertion/deletion polymorphism (see Tables 1-2)
ccagttccagggtttccatggctcccttcctcactttattcaggcctttgctaaacgaaactctacagagacggtctccaggcttttccatccaaatagcntctattgtcatcttctcaccttgtcttgcttcagttttcttcataggttaatctgtttgtatatctcaatagaatatatctcccatacgtgcagggactt

SEQ ID NO: 28080 - DNA, 201 bp, Homo sapiens
gatcttttttttcacagataataacatactcctgttcaaaacaacattgctttacatccagaacgtaatccagagttcttcccgtggcctttgaggtcctrtgtgtggtccctgatagccacttgaccattgtttcttgccactcttcctcttgctcactctgttccagccacactccttgctggtctttagatatgctga

SEQ ID NO: 28081 - DNA, 201 bp, Homo sapiens
caaatggttcacatcgtgttttaatgcaggactctgagtgtaaccaagttagtcaccattctgaagcagtgaatagtttttagcaaacacctagatactcwagtccaaagctacctttatttcttagttgaattactgggataatcttgtctccctgataccttttttccccttgtaaagttagttagccacacagcagcc

SEQ ID NO: 28082 - DNA, 201 bp, Homo sapiens
caaccatgacctatttctctttgttcttctgctgtgccacctctatagcttctcagctgttgtccttaggctggtactcttctgatttcaaatggttcacrtcgtgttttaatgcaggactctgagtgtaaccaagttagtcaccattctgaagcagtgaatagtttttagcaaacacctagatactctagtccaaagcta

SEQ ID NO: 28083 - DNA, 201 bp, Homo sapiens
ttgaaaaataatgaacgtgatgaatgttggtgtatttctaggatatagtttctttggtcccacgcctgcggcacatcatcactgttgatggaaagccaccracctggtccgagttccccaagggcatcattgtgcataccatggctgcagtggaggccctgggagccaaggccagcatgggtatgttacacttttctaatt

SEQ ID NO: 28084 - DNA, 201 bp, Homo sapiens
taatagtaacagttttttacaggtatggtaagagtttaataagttaacacttgccgtgtccttagcatgtagtaagcactaataaaggttagttaccctcrttatcattatcatgattattacaactatccagatctcttgaatatttttactctgtggctcccctcagaataattttttcatagtgatcttcagttgcag

SEQ ID NO: 28085 - DNA, 201 bp, Homo sapiens
gcctcccgagtagttgggattacaggcatgcgccaccacgtccggctaattttgtgtttttagtagagacaaggtttctccatgttggtcaggctggtctygaactcccagcctcaggtgatccgcccacctcggcctcccaaagtgctgggattacaggcatgagccacagcgcccaaccagcacagctttttatggcac

SEQ ID NO: 28086 - DNA, 201 bp, Homo sapiens
caactcttgaaggagagtccaaataactgcaactatggaatgaaaaactcagagctcctcttttactggagggccagagggatgttgcttaacctcctctrtatatggcccattaattttgccacttaaacaaatttcatacatcattttcctcaaaacatgaaggagatgccaagcaagttgatgtcagtaattcctaga

SEQ ID NO: 28087 - DNA, 201 bp, Homo sapiens
gggtggccaggagagttgtagtttgatgataccttctttcatgtttatcaacctattttgtttccccaaattagttctgagagttaagggtgctgatgagttgctcctgaaagtgtattagaagggtattataggggacaggtggtgtgacatgggaatcttttgcacagacttgattttgttttctggcatttttctggg

SEQ ID NO: 28088 - DNA, 201 bp, Homo sapiens
  misc_feature (1)...(201): n = A,T,C or G, or insertion/deletion polymorphism (see Tables 1-2)
tagtctgatttatgtaataatattatcttcaatctgataaaatctgcctctgatttcctcctaattagttggtccacatgcaagcatatagtctgcaaggncctgtccatttcagaatcgcctctgtaaaccagatgccttaacatggtgcatgcatggcccccagaggaggtgttcagtaactggttttgagtgaatttg

SEQ ID NO: 28089 - DNA, 201 bp, Homo sapiens
gcggaatgacccgtagtaacctcgccccgccccgggccgccagcgccgcgctccccggcccgaattcgataggcccagccccgcacgcgccaccgctcgckggccaatgggtggcagcctctctgcataggcaacgagtgccggccgggggtgagcgtcccaggcggttccgctcaacagacgctgctgtggctgcgccgg

SEQ ID NO: 28090 - DNA, 201 bp, Homo sapiens
ggagatgatagctgaactaggttttccaagatgaactggagttttcccaggtcaacagggagccaggaaatagaatgttttaccttgattttggatcctctgtgtgtgtgtgtgtgtgtgtgtgtgtgtacacagatgtgtacgcattggagatgttataacgctaccaaagaatattgttagaaaaattaaaaattgctt

SEQ ID NO: 28091 - DNA, 201 bp, Homo sapiens
gataggtacgatgaaggaaaagtattgtgtgaatgaggattatgagcaagattgtgatgtagatggaaatctagtctagggagctgttttttgaattgatrtggtgagattttgctagaggacagtcttgaaatctgagcctgcaattatgtacataatgcaagagtttgggaagttgtcagcaacaataattcttttcat

SEQ ID NO: 28092 - DNA, 201 bp, Homo sapiens
gagatgatagctgaactaggttttccaagatgaactggagttttcccaggtcaacagggagccaggaaatagaatgttttaccttgattttggatcctctgtgtgtgtgtgtgtgtgtgtgtgtgtgtacacagatgtgtacgcattggagatgttataacgctaccaaagaatattgttagaaaaattaaaaattgctta

SEQ ID NO: 28093 - DNA, 201 bp, Homo sapiens
aagttgtcattctgtctgccttcagggtacttaaagcttaaatagtcctctaatactttctcccactcaaaatgaactgtaagggggagtaagactctttkatgtgagatttgggcttgaatattggatttagattttttttaggaaagctaggccaagggtgataggcttttaaaacaacgagcatcataatgactcaaa

SEQ ID NO: 28094 - DNA, 201 bp, Homo sapiens
caaatgctgttctaatttttatctcagccttgcaaaataggtacttttttttttttgagacggagtctcgctctgtccccctggctggagtgcagtggcaygatctcggctcactgtaagctccgcttcccgggttcacgccattctcctgcctcagcctcctgagtagctgggactacaggtgcccaccaccatgcccgg

SEQ ID NO: 28095 - DNA, 201 bp, Homo sapiens
accattctttgtccattatacttaacagtacaaaactgtaatgggcacttttcctcgaaggctctttttagtaatctttactttagttaactttctttgctttttttttttttaaataaaaatatcttaaaatatagaaatatcttgaacatattttacagatatatattattttacttgtaattccatgcatgactgcag

SEQ ID NO: 28096 - DNA, 201 bp, Homo sapiens
ccattatacttaacagtacaaaactgtaatgggcacttttcctcgaaggctctttttagtaatctttactttagttaactttctttgcttttttttttttkaaataaaaatatcttaaaatatagaaatatcttgaacatattttacagatatatattattttacttgtaattccatgcatgactgcagggataattcacg

SEQ ID NO: 28097 - DNA, 201 bp, Homo sapiens
ggagtcttgttgctttgggaccacagatgtgaatgttattattattatttttgcttctctgctttatctgtggcattactgctcttgtggcattccccccsacccccgactcccttgtttttggtgaacataatagtcaccgtaaaaaagatgtataattctagggaaaaacttaagtagggcaaatgctcaacagggaaa

SEQ ID NO: 28098 - DNA, 201 bp, Homo sapiens
taatttcaaatagctttatgaaataattatatttgctgtctttcttagataagtcaagaacataatgtgtttcttttgagctccttcagggagagtaagtttaatttattcttccactagaaagaaagatactgtgctttattcactgctgcacacccagtgcccagcgtataggagacactcacatttgttgaatgaatg

SEQ ID NO: 28099 - DNA, 201 bp, Homo sapiens
taattgcaaatttttataatcttgtaagataatgttatgtaattcaacttgtcagtattattctagtgctattagctatattaattacataaagacattgytgtaaggggactcaaaaattcataggtttgggtagaaaatgagaactagacagtgatttcatcactataaatttagttgttacttagcgtcccctgaggc

SEQ ID NO: 28100 - DNA, 201 bp, Homo sapiens
tggaacctgtgtcagcatcacctgattccagtgttcccagcagtaaatgcattgcactaacgtcgtcttgaaatgaacagtgaaatgatttcaggacaacrttaaaatacatgtatacctgaaatagaacaaagctgcaaagactaaaaatagaaacagaaaagagtacaagctggctcatatactttgtgagccatcaga

SEQ ID NO: 28101 - DNA, 201 bp, Homo sapiens
tactgtcatcttgtctttaaagaaagttttaaggaaaaatataaacattaattattaatgttttaaaggtagtatttatttgaaatttaaaatattttacwttcagttttcatttcttttttatggtgatagttttgggtggtttaaagttagtttataaataatgacatttatcttgtcctatgtgaattacctgtaagt

SEQ ID NO: 28102 - DNA, 201 bp, Homo sapiens
atgcctgtagtcccaactgtttgggaggctgaggagagagaatcgcttgagtccaagagtttgaggctgcagtgagctataatcttgtactgtactctatyctgggtgagatcctgtctttaaaaaaaaaaaaaaaaaggtattattacccacctgccacacaatggctgttcccctctgcccggagtgctctttcttacc

SEQ ID NO: 28103 - DNA, 201 bp, Homo sapiens
agttttttaatatttgttgaacgaatgcttagaaaaataagtcagtcctactgacgacatacggtttttcaaaactacatctgccccttaatctcctttamatgttttcctttcttcccttcctttctcccttcatttgctgctatcatgaatctccttagtattaggcaatatgttagtaacacaatagtgagcaagcat

SEQ ID NO: 28104 - DNA, 201 bp, Homo sapiens
aatttcaaatagctttatgaaataattatatttgctgtctttcttagataagtcaagaacataatgtgtttcttttgagctccttcagggagagtaagtttaatttattcttccactagaaagaaagatactgtgctttattcactgctgcacacccagtgcccagcgtataggagacactcacatttgttgaatgaatga

SEQ ID NO: 28105 - DNA, 201 bp, Homo sapiens
atttcaaatagctttatgaaataattatatttgctgtctttcttagataagtcaagaacataatgtgtttcttttgagctccttcagggagagtaagtttaatttattcttccactagaaagaaagatactgtgctttattcactgctgcacacccagtgcccagcgtataggagacactcacatttgttgaatgaatgaa

SEQ ID NO: 28106 - DNA, 201 bp, Homo sapiens
tttcaaatagctttatgaaataattatatttgctgtctttcttagataagtcaagaacataatgtgtttcttttgagctccttcagggagagtaagtttaatttattcttccactagaaagaaagatactgtgctttattcactgctgcacacccagtgcccagcgtataggagacactcacatttgttgaatgaatgaat

SEQ ID NO: 28107 - DNA, 201 bp, Homo sapiens
acccaagtaatcattcttaaaaaaaacaacaacacacatttaggactgggaacagtgactcacacctgtaatttcgacactttgggaggccaaggcgggtrgatcacctgaggtcaggagttcaagactatcctggtcaacatgggtgaaaccctgtctctacaaaaaataccaaaattagccgggcatggtggcgggcgc

SEQ ID NO: 28108 - DNA, 201 bp, Homo sapiens
  misc_feature (1)...(201): n = A,T,C or G, or insertion/deletion polymorphism (see Tables 1-2)
ttttctttttatttctggaactccttgtaatggaacttgaatctcttggattaatttaacaccttattttttaaaatgagaattaaattttctatattctnccccttgcttttgctcttctttatctggaaaagagtctccacctcattttctgacacttgtattgactccttaatttcagctgctattaatttcaaagaa

SEQ ID NO: 28109 - DNA, 201 bp, Homo sapiens
ggagtatcacaggagcccaggaggccgtgattgtgccactgcactccagtatgagcaacagagtgagaccctgtctcaaaatctcaaaaccaaccaaccawccaaccctcagctcaggcctcacttgcaagaattttttccaaatccccaggttggagagtcttaacacttagcgctaccattgtagtaccaatgtattga

SEQ ID NO: 28110 - DNA, 201 bp, Homo sapiens
ataaaaaaaaaattagccaggcgtggtggtgggtgcctggagtcccagctactcaggaggctgagacaggagaatggcgtgaacccgggaggcggagcttrcagtgagcagagttcacgccactgcactccagcctgggtgacagagcgagactctgtctcccaaaaaaaaaaaaaacaaaaaaaaacctgtctattttta

SEQ ID NO: 28111 - DNA, 201 bp, Homo sapiens
agacaggagaatggcgtgaacccgggaggcggagcttgcagtgagcagagttcacgccactgcactccagcctgggtgacagagcgagactctgtctcccaaaaaaaaaaaaaacaaaaaaaaacctgtctatttttattatttacttggtatcgaagtatttttgtgaattctccctctggttggatatttttcaaatga

SEQ ID NO: 28112 - DNA, 201 bp, Homo sapiens
ctacctgctgtcaggtctgtggcctgggggttgagaattcctgccttacaggaagggtgaccatatatcctgatttgtctggaatacctccagatcactgtttttttttttttttttttttgaagacagattctcgctctgtcgcccaggctggctggagtgcagtggcatgatcttggcttactgcaagctctgcctcct

SEQ ID NO: 28113 - DNA, 201 bp, Homo sapiens
tgaagacagattctcgctctgtcgcccaggctggctggagtgcagtggcatgatcttggcttactgcaagctctgcctcctggcttcaagtgattccgctrcctcagcctcctgagtagctgggattacaggcagatgccaccatgcctggctaatttttggtatttttagtagcaatggggtttcactgtgttagccagg

SEQ ID NO: 28114 - DNA, 201 bp, Homo sapiens
gtttgatcttgataggatacatctttttgaaaaattcacaaaaggttttttccttcttgctgaatcacatccacagttgaagagtacttcttttaaaatgvcttaatattgctagaaatgttaatctaatgctaagtgaatatgtaaggcagctgttattattaactatgttaaactcatttttatacatttaggaaatca

SEQ ID NO: 28115 - DNA, 201 bp, Homo sapiens
caagtgattccgctacctcagcctcctgagtagctgggattacaggcagatgccaccatgcctggctaatttttggtatttttagtagcaatggggtttcrctgtgttagccaggatgggctcgatctcctgaccttgtgatctgcctgccttggctttccaaagtgctgggattacaggcatgagccaccacacctggcc

SEQ ID NO: 28116 - DNA, 201 bp, Homo sapiens
  misc_feature (1)...(201): n = A,T,C or G, or insertion/deletion polymorphism (see Tables 1-2)
gggtttctccttattggtcatgctggtctcgaactcccgacctcaggtgatctgcctgcctcggcctcccaaagtgctgagattacaggcgtgagccaccntgcccagccagccttttgtttttttaggaagatttgaggatattcttatactctgagctttgagaatttacgtggctctgtctagaagtcagttattttt

SEQ ID NO: 28117 - DNA, 201 bp, Homo sapiens
ggtggccatttaccgttttgaagacctccatgtagaggcaagagctcaaaccatgggtatgggtgagattgcctgtggggaggctatagaataagaagagraggaggcctgggatggagctgggcagaggaggttgagcttgtcaaggagacaagagtggccaggaaggtcagaggacagccagaaacagatgttcctgca

SEQ ID NO: 28118 - DNA, 201 bp, Homo sapiens
ccaggctggagtgcagtggcaccatctcagctcactgcaacctctgtctcctgggttcacgcaattctcctgcctcagcctcctgagtagctgggattacrggtgtgcgccaccacgcccagctagttttcgtatttttagtagagtcggggtttcaccatgttggccaggctggtctcgaactcctgacctcaagtgatg

SEQ ID NO: 28119 - DNA, 201 bp, Homo sapiens
atagcctctcttatgcctttgagaatattacatagacatattttaaaatttcccacatttcctacattgtctgtttccactgaggcactttttgtctgctrtttgtctctttctttgatagtgatggtttttcacaaatatctggtgattaagaactttatcttctgtctggattttgaatttttaaatggttttcctgtt

SEQ ID NO: 28120 - DNA, 201 bp, Homo sapiens
attgtatgtatattgcacattttctttatccattcatctgtgtttggacatttgggttgtttctaccttttgggtattgtgaataatgctgtgatgaacayagatgtgcaaatatggctttgagattctgctttgaattattttggatatatacccagaaatgagattgttagatcctatggcaattattaatactatatt

SEQ ID NO: 28121 - DNA, 201 bp, Homo sapiens
tgcaaaacggagacactatacccattacactaattccccttccctctctcccccttccctccacctttttactttatgtttctaaaattttgattacttgwggtacttcatacatgtggaatcatacggtatttattcttttgtgactgtcttatttagtgtatcttcagggtttattcatattgtaccatgtgataggat

SEQ ID NO: 28122 - DNA, 201 bp, Homo sapiens
  misc_feature (1)...(201): n = A,T,C or G, or insertion/deletion polymorphism (see Tables 1-2)
taaagtatacttcacagtaatggacctagcaagcaaaatgcagcacagacaaggaaaacttcctggtgcaatatcgaaagtcaaatagccaaacaaaaacncccaaacgttgcatggtctttttgtgagcaaagaatgtggtactgtatatttttataagataaagttaggacattttgaaaaaccatttcagacggttgt

SEQ ID NO: 28123 - DNA, 201 bp, Homo sapiens
ccaaccaaccaaccctcagctcaggcctcacttgcaagaattttttccaaatccccaggttggagagtcttaacacttagcgctaccattgtagtaccaaygtattgaagtaatacgtttttgcattatgcatgtctccagataggttgtgaacttgcagatggcattgaatatcttcttcacctgcctggtactaatgga

SEQ ID NO: 28124 - DNA, 201 bp, Homo sapiens
  misc_feature (1)...(201): n = A,T,C or G, or insertion/deletion polymorphism (see Tables 1-2)
ggagtgcagtggcatgatctcggcttaacgcaacctctgcctcctgggttcaagtgattctcctgcctcagcctccagagtagctgggactatatgtgcangccaccacacctggctaatttttgtaattttagtggagttggggtttcatcttgttggtcaggctggtcttgaactcctgacctcaggtgatccacccgt

SEQ ID NO: 28125 - DNA, 201 bp, Homo sapiens
tttacatgtatacgtaggtacacacgtggcttgttggtttgctgcacctttcaacccatcatctaagttttaagccccacatgcattaggtatttgtcctaatgttctccctccccttaccccacccacctacaggcccaagtgtatgatgttcccctccctatatccatgtgttctcattcttcaactcccacttatgag

SEQ ID NO: 28126 - DNA, 201 bp, Homo sapiens
aaagtcaaatataaataatcagtagtttcgtagtttctttctataattatagtttctttagtatccaacttaaattcttagttcacttaaaaatgacgtaraatttaaagttgtggaggaaacattattttaagtcattaaagtatacttcacagtaatggacctagcaagcaaaatgcagcacagacaaggaaaacttcc

SEQ ID NO: 28127 - DNA, 201 bp, Homo sapiens
tttttttttgtatgtttggaactgttatatttttcctctggcctttgaattttctttaattttattttttatttcaccctgggggaaagagaggtgggtasatttgtttgtttgtttgtttatttttgagacagagtcttggtctgtggcccaggctgaggtgcagtggcgcaatcttggctcactgcaacctctgcctcc

SEQ ID NO: 28128 - DNA, 201 bp, Homo sapiens
  misc_feature (1)...(201): n = A,T,C or G, or insertion/deletion polymorphism (see Tables 1-2)
acacctggctaatttttatattttttaatagagacggggtttctccatgttggccaggctgaccttgaactcctggcctcaagtgatctgcccacttcagnctcccaaagtgttgggattacaggcgtgagccattgtacctggccgaaaagaggtatatttaaaagtgaatttgttacttcaactaacacaaccttcact

SEQ ID NO: 28129 - DNA, 201 bp, Homo sapiens
gtcccagctactcaggaggctgaggcaggagaatcgcttgaacctgggaggcagagcttgcagtgagccgagatcgcatcactgctctccagccaggcaayggacgggactctctctcaaaaaagaataaaaaaataaataaataaaaagagaaagataatgttacaggacaggggtcctgatctaaacctgaagggaagg

SEQ ID NO: 28130 - DNA, 201 bp, Homo sapiens
  misc_feature (1)...(201): n = A,T,C or G, or insertion/deletion polymorphism (see Tables 1-2)
gatacagaattcgttgttgggaaggactggggaaacagctgtaacatttgccaccctcagaagctgctggtcctgtgtcacaccaccttagcctcttgatngaggaaggtaaagaattactttcactgatttttatctaatttctttgccttttgtttctgctgccttcacattgtcttctacagatagttattttctaaa

SEQ ID NO: 28131 - DNA, 201 bp, Homo sapiens; identical to SEQ ID NO: 6864

SEQ ID NO: 28132 - DNA, 201 bp, Homo sapiens
gacattcatggttcacttgttggttgtgcattttgatggatacgcaaaaagtggggaagttacaccatttgctaagaacttaaataccttttcttcttttytttttttttaatcatcttagcaagtctggaaaagtttgaaattccagtaaaaattcgtttgagtcctgaaccgtggacccctgaaactggtctggtgaca

SEQ ID NO: 28133 - DNA, 201 bp, Homo sapiens
tttctatatttcagttatcattcttatgtcattggatttgttgtgccaaatcaaaaggaactaactgaactagctcgaaagaaaggacttaaagggacttsggaggagctgtgtaacagttgtgaaatggaaaatgaggtacttaaagtgctttccgaagctgctatttcaggtgagtattcggttaaactgatactaaaa

SEQ ID NO: 28134 - DNA, 201 bp, Homo sapiens; identical to SEQ ID NO: 6866

SEQ ID NO: 28135 - DNA, 201 bp, Homo sapiens
  misc_feature (1)...(201): n = A,T,C or G, or insertion/deletion polymorphism (see Tables 1-2)
aaatggatatgccagtgccaagtatggcacatgcattttaaaaaaaatgaggagttatttactacttgtcactgtaataataactgcagtcaacacagttnaccattttgttccttatctgttatcctttctatatttcagttatcattcttatgtcattggatttgttgtgccaaatcaaaaggaactaactgaactagc

SEQ ID NO: 28136 - DNA, 201 bp, Homo sapiens
aatactgataagccacaccccaggggtgaaattcttattgggggccaaagtgtgacaatggggtactacaaaaatgaagcaaaaacaaaagctgatttctytgaagatgaaaatggacaaaggtggctctgtactggggatattggagagtttgaacccgatggatgcttaaagattattggtaagtcatctaatattttt

SEQ ID NO: 28137 - DNA, 201 bp, Homo sapiens
ttgatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttata

SEQ ID NO: 28138 - DNA, 201 bp, Homo sapiens
tgatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttatac

SEQ ID NO: 28139 - DNA, 201 bp, Homo sapiens
gatctatctgtctgtccttttgccagtaccacaccatcttaattacttttcctttatagtaaattttaaaattaagacatataagtcatccaagtttgttcttctttttcaagattgtttggctgttctgggtgcttttaatatccatgtgaattttaaaatcagcttacttatttctgtctaaaagccagcttttataca

SEQ ID NO: 28140 - DNA, 201 bp, Homo sapiens
tgggaggctgaggagagagaatcgcttgagtccaagagtttgaggctgcagtgagctataatcttgtactgtactctatcctgggtgagatcctgtctttaaaaaaaaaaaaaaaaaggtattattacccacctgccacacaatggctgttcccctctgcccggagtgctctttcttacccaaataggcacatggtacgct

SEQ ID NO: 28141 - DNA, 201 bp, Homo sapiens
aaaaaaacctcaatgtaggccaaaaaatacgactctacaggcctcacggcctgtgcttcaccaatatgtgacttctgcttttaaggaatagttggggatayctcagccttaggataaataatcatttttggtaatttagaaaaatgaagcagtgtattagctactgttctcaaatatcctttttttcatttaattcctagt

SEQ ID NO: 28142 - DNA, 201 bp, Homo sapiens
  misc_feature (1)...(201): n = A,T,C or G, or insertion/deletion polymorphism (see Tables 1-2)
agaatgtttgtctttagatatttttgcttgagaataaacggtactgccacttgtttgtgctcttttcttgacatacactgtaaatctgacattcagtgtgncatcctatttgtatatgttctttttcacattgtaaagccaagtggccaacaattaagaatttgaagtcttagaaatcagttataattccttcacaatgtg

SEQ ID NO: 28143 - DNA, 201 bp, Homo sapiens
ctggcctcaagcgatcctcctgcctgagctttcagagttactgggattacaggcatgagccatcatgcctggctctaactcgttttcaatgacagaatatrtattctattttgttcctatatcatattttatttaactcattttcctcttgatggggacttgttaaatagtttattgttttacttatgtttgtattttgag

SEQ ID NO: 28144 - DNA, 201 bp, Homo sapiens
aataacgtgctgtgtgggtgtgtagcctaggagccgtaggctagataatgcagcctagatgtatatatagtaggctataccatcgacattcgtgtaagatrtgctatgatgttcccatgatggcaaaactgccaagtgtgtgatgcatttctcagaacatatccctgtcattaagagatgcgtgactatattggataccct

SEQ ID NO: 28145 - DNA, 201 bp, Homo sapiens
atttttactgccttttctatgtttagatacacttaaatacacaaatacttaactattgtgttacaattacctatggtattcagtacaataacgtgctgtgygggtgtgtagcctaggagccgtaggctagataatgcagcctagatgtatatatagtaggctataccatcgacattcgtgtaagatatgctatgatgttcc

SEQ ID NO: 28146 - DNA, 201 bp, Homo sapiens
tccctctggtgtctgtctgtgatattgtggcctcactggtgctgtagttggccatggtactggagctctacctagtgtctgtgatactgcagcctctggtkcatgttaatctttgttcttgacagctcccaacctggtgccctgttcctgttatttagattcaggaaagacagaagcaagtttcttgcaccccagaagtca

SEQ ID NO: 28147 - DNA, 201 bp, Homo sapiens
ttgtctattgtgacaatttttgtcttaaagtctgttttatttaagtatggccatcccctttaggttcttattttcatggaatatctatttccatccttcastttaggttacgcatgcccttggatctaatgtatgtttcttgtggatggcatatacttgagtcttgttttatattcagttggtcaatctgtatcttttaat

SEQ ID NO: 28148 - DNA, 201 bp, Homo sapiens
tttcaccatgttagtcaggatggtcttgatcttctgaccttgtgatccgcccgcctcgccctcccaaagtactgggattacaggctgggagctactgcgcrgactgcaaaataggttcttttatcattctaatttttacagctgaggaaactgaagcacagagcaatttaagtgacttgcacgattgtgtgctaaatgtgt

SEQ ID NO: 28149 - DNA, 201 bp, Homo sapiens
atactgtgttccttaatgactattgatttacattcccaccaacggtattaagggtttccatttctccacatcctcaccaacatttgtatatttttttctamtatccattctaacagatgtgaagtgatatctcattgtggttttgatttgcatttctctttttattagttatgttgggcatcttatatatacttgttggcc

SEQ ID NO: 28150 - DNA, 201 bp, Homo sapiens
tagtatatggaagagtaaacttatcagtcccccattcaagccttgctacacaaattaaccactcccaccaaactgatgtacatgtatcttgaatgttcttktctctgcaacctttgctttctgggttaccctttctcttatgtcagctgttcttcaaggccttgctcagttttctggccacactagcccatagtgatcagg

SEQ ID NO: 28151 - DNA, 201 bp, Homo sapiens
aaaatgaggtacttaaagtgctttccgaagctgctatttcaggtgagtattcggttaaactgatactaaaaactgagatgggaagagagtacttacatgcwttcaacctgttttaaggtttagggttcattactttctgctcagaaaccatttctaccgttagtatatggaagagtaaacttatcagtcccccattcaagc

SEQ ID NO: 28152 - DNA, 201 bp, Homo sapiens
  misc_feature (1)...(201): n = A,T,C or G, or insertion/deletion polymorphism (see Tables 1-2)
cggcactccaggcaggtcttggggctcctatgtaagctgtgttaagctgcagcctaaacacacagcctccccacctcatgatgatgaagaggcagctgggnacctgtctacgacagttgacatgaattattatgggaaaataaaatctgttatcaggaaaactaatttagaaacagatgttgggggtacagcccaagttag

SEQ ID NO: 28153 - DNA, 201 bp, Homo sapiens
ctctaggaggtccagccattgttcatgcattaaatgaaacagaggtgaccaacatcattactagtaaagaactcttacaaacaaagttgaaggtgaggackctagttactttctaactgtctgatactttagaattttcagtgtcatgagccctattattgatacttagttcttttatgacttttaagtccttaatctttg

SEQ ID NO: 28154 - DNA, 201 bp, Homo sapiens
  misc_feature (1)...(201): n = A,T,C or G, or insertion/deletion polymorphism (see Tables 1-2)
ttatgtaatttcagcatttctgagaatgtttgtctttagatatttttgcttgagaataaacggtactgccacttgtttgtgctcttttcttgacatacacngtaaatctgacattcagtgtgccatcctatttgtatatgttctttttcacattgtaaagccaagtggccaacaattaagaatttgaagtcttagaaatca

SEQ ID NO: 28155 - DNA, 201 bp, Homo sapiens
gtcagttctgctgtacctgaaatgtgggcccattgttgctggcgattccacacttacatctaaaatttcctgattttttaagaatgacaataactaatttaaaaaaaaaaaaaaaacctcaatgtaggccaaaaaatacgactctacaggcctcacggcctgtgcttcaccaatatgtgacttctgcttttaaggaatagt

SEQ ID NO: 28156 - DNA, 201 bp, Homo sapiens
tctttgtaaaaatgttccgagaactcttcctatctgttacttgtgggaatggcctccttctcattgcagccattagctgactcttttccttgtaaggcttcccctgatctttctctctgtccctgttttctgctttacgtctcactgcagtgtcccatggagggaggtgaagaaaataaaaccttccttcctgctgccttg

SEQ ID NO: 28157 - DNA, 201 bp, Homo sapiens
tgtaactttcttttaaaatgtgtacatggcagtattcataacagtttttcatagttgaaattcatcatgaaatgtcagattgaagtttatttagcaacgarctctgccaaagcattggaaaatattatgaatcaaacagtaaaactggcggttgcatgaaatggatatgccagtgccaagtatggcacatgcattttaaaa

SEQ ID NO: 28158 - DNA, 201 bp, Homo sapiens
catttctcagaacatatccctgtcattaagagatgcgtgactatattggataccctattagatacctgtctaaatgtaattttttttttttttaaatgagrtggggtttcgctctgttgcccaggctggagtgcagtagcacgatcatagctcactgcatcttcagatctcctgggctcaagtcatcctcccacctcagcc

SEQ ID NO: 28159 - DNA, 201 bp, Homo sapiens
aagtgacattcatggttcacttgttggttgtgcattttgatggatacgcaaaaagtggggaagttacaccatttgctaagaacttaaataccttttcttcttttttttttttttaatcatcttagcaagtctggaaaagtttgaaattccagtaaaaattcgtttgagtcctgaaccgtggacccctgaaactggtctggt

SEQ ID NO: 28160 - DNA, 201 bp, Homo sapiens; identical to SEQ ID NO: 6862

SEQ ID NO: 28161 - DNA, 201 bp, Homo sapiens; identical to SEQ ID NO: 6863

SEQ ID NO: 28162 - DNA, 201 bp, Homo sapiens; identical to SEQ ID NO: 6865

SEQ ID NO: 28163 - DNA, 201 bp, Homo sapiens
  misc_feature (1)...(201): n = A,T,C or G, or insertion/deletion polymorphism (see Tables 1-2)
gccacttaaacaaatttcatacatcattttcctcaaaacatgaaggagatgccaagcaagttgatgtcagtaattcctagaaactaaaaacattttaactngacaacagaatatgtaaatttcctcacgtttaaatagagtagttgtgtatcttgttttatctgaaaccatcctgatttatacttgttgctgtgacattaa

SEQ ID NO: 28164 - DNA, 201 bp, Homo sapiens
  misc_feature (1)...(201): n = A,T,C or G, or insertion/deletion polymorphism (see Tables 1-2)
atgtccatagacatttcctacctgtatggaccttctttgtaaaaatgttccgagaactcttcctatctgttacttgtgggaatggcctccttctcattgcngccattagctgactcttttccttgtaaggcttcccctgatctttctctctgtccctgttttctgctttacgtctcactgcagtgtcccatggagggaggt

SEQ ID NO: 28165 - DNA, 201 bp, Homo sapiens
tttagatcattttctatttttggttttttgccactgaaacagtactgccatgtctcccaggtgtgtgtgtgtgtgtgtccaagttttatgttcagactatrttactactagttgcagttaactactcatccccaaatctgtaaatatgtcttcctgtgaccctgacactactctgtcgtgattcttagtgatttcaatatc

SEQ ID NO: 28166 - DNA, 201 bp, Homo sapiens
tgttagtcatgtcatgaaatagacgtaaaattgaaggttgattttctttttttttttgagatgaggtctggcttcgtggcccaggccggagtgcagtggcrtgatcttaacttatcgcacttttcatctcctggtctcaagtcatcctcccacttgattccgcctcttgagtagctggtactacaagtgtgtgccaccata

SEQ ID NO: 28167 - DNA, 201 bp, Homo sapiens
caaaaattagctgggcgtgatggagcacgcctgtagtctcagctactcgggaggctgaggcaggagaatcacttgaacccggaggcgaaggttgtagtgarccgagatcgcgccactgcactccagcctgggtgacagagtgagactcggtctcaaaaaaaaaaaaaaaaaaaaaaaaaatggaactcaaatattgttgag

SEQ ID NO: 28168 - DNA, 201 bp, Homo sapiens
gtctaaaagccagcttttatacagctgagatcttttttaagctaaccttagatttaatgaactagttatttaggtccaaaagaaaaggctgggcatggtgrcccacgcctgtaatcccagcactttgggaggccaaggtgggcggatcacaaggtcaagagatcgagaccatcctggccaacatggtgaaaccccatcttt

SEQ ID NO: 28169 - DNA, 201 bp, Homo sapiens
gggtttgtgataaaggaataattttcttaattactatattaagataacattgcaaaaatcaatgttatctttaaagcaaaattaggaatgcctttgttctscagatatcgggatatctggacactcccaagtctggatctgttttttaaacattattaatttgttcccttaactggaaacacccggaggctcggaatgcct

SEQ ID NO: 28170 - DNA, 201 bp, Homo sapiens
attaatgaatctttagatcattttctatttttggttttttgccactgaaacagtactgccatgtctcccaggtgtgtgtgtgtgtgtgtccaagttttatsttcagactatattactactagttgcagttaactactcatccccaaatctgtaaatatgtcttcctgtgaccctgacactactctgtcgtgattcttagtg

SEQ ID NO: 28171 - DNA, 201 bp, Homo sapiens
acctttggatagctgaggccttttaaaactagattggaaacctagaagctgtgaaagaaaaattgacagatttagctgttcaagtttacttttacttttgraagataatgttctaacacggtgaaatcccatctctactaaaaaatacaaaaattagctgggcgtggtggcaggcgactgtcgtcccagctactcaggagg

SEQ ID NO: 28172 - DNA, 201 bp, Homo sapiens
  misc_feature (1)...(201): n = A,T,C or G, or insertion/deletion polymorphism (see Tables 1-2)
taagtgttggggctctctgcctgctctgcaagttgagttttcagattccttttcatgatggtggtggatgtgaggggcataaaatgtctgcttgctctgtnagtagggtgtgaatataataccattgttgacttcttccctccttagacagtgtacatgtcttagattctgagagtgactcctgttttctttgttcagtcc

SEQ ID NO: 28173 - DNA, 201 bp, Homo sapiens
aatttagctttcaccgtcatacgatatagaaaaataaacactgttgaattaaagatctagatgtaaaaattaggtaaacactggaaaaaatacaggagacygatagtttaacctttggatagctgaggccttttaaaactagattggaaacctagaagctgtgaaagaaaaattgacagatttagctgttcaagtttactt

SEQ ID NO: 28174 - DNA, 201 bp, Homo sapiens
  misc_feature (1)...(201): n = A,T,C or G, or insertion/deletion polymorphism (see Tables 1-2)
aagtctctgtagagtgtgtatgactgtcacctaacttttgtggaaaggagactctcaaaagtagtgtattaaaggatacttttttctccccaacaataagntattaactatagaatttattaagagagtatagggtcattaaaaagtttggacatgccttggagagacatgtaggttaatatcctaccttacctgctagct

SEQ ID NO: 28175 - DNA, 201 bp, Homo sapiens; identical to SEQ ID NO: 6859

SEQ ID NO: 28176 - DNA, 201 bp, Homo sapiens
gagtaaatgaacgcagcctttatagtatactttttgagttttggaaataccttattttttataatagagtttattttttagagcagttttaggtgtacagmaaaattgagaggaaggtgcagagatttctcatataccccttcccctacacaggcatagcctccctctttatcaacatccccctacctccccagagtgcta

SEQ ID NO: 28177 - DNA, 201 bp, Homo sapiens
cctgttccttgcctctttcagttctagtggctgctggcattccctattatcagtccaatctttcaggccagcatcttcaaatctctctgctccatcttcaygtcaccatctccttcatgtgtgtccaatctccttctgcctctctatttataaggacatttgtgagggcatttagggaccactgggtaatctagggtcttt

SEQ ID NO: 28178 - DNA, 201 bp, Homo sapiens
ttgaacccaaatggtcaatagctcattggcattatcagtgcaagattaaagcttcacatcacaatgtcatatatcaatatctctggttgaatttcagaacwttttataagaatgagttaaataatcagtgccttgtttatctcatgatttttatattagttttaaatatataatgattatgttttaatttttagctttttg

SEQ ID NO: 28179 - DNA, 201 bp, Homo sapiens
  misc_feature (1)...(201): n = A,T,C or G, or insertion/deletion polymorphism (see Tables 1-2)
tgcaccagcatcattctctgttgcctcagcatgtccagcactctcgggatgtccagcacctaggttgagagaaacggtaatgaagataatgtgttcccctngggagacagaaaggatgggaggacacgagtgtcctggcagaaacctggttgggagatggacagtctcttttccaccttagcgtcttctagaaataagcca

SEQ ID NO: 28180 - DNA, 201 bp, Homo sapiens
acttttttatttgttggctgcttttatgtcttcttttgataagtgtctatgtccttttctcactttttaatggggttatttgtttttcttcttgctttttyttttttttttaagttcctcatagattcttgtattagggttctctagagggacagaactaatgaaatatatatataaaggggagtttattaagtattaact

SEQ ID NO: 28181 - DNA, 201 bp, Homo sapiens
  misc_feature (1)...(201): n = A,T,C or G, or insertion/deletion polymorphism (see Tables 1-2)
tattttattttgtgtgtgtgtaactattgtaaatgagattgtgttcttgatttggctctcagcttgaatatcattggtgtatagaaatgctactgattttngcacattgattttgtgtcctaaaactttactggaatcgtttattagttcaagaagccttttggcagcatctttagggttttctaattatagaatcatatc

SEQ ID NO: 28182 - DNA, 201 bp, Homo sapiens
ttggctctcagcttgaatatcattggtgtatagaaatgctactgatttttgcacattgattttgtgtcctaaaactttactggaatcgtttattagttcargaagccttttggcagcatctttagggttttctaattatagaatcatatcatcaggaaagagataatttgactactacttttccaatttggatgtgtttta

SEQ ID NO: 28183 - DNA, 201 bp, Homo sapiens
  misc_feature (1)...(201): n = A,T,C or G, or insertion/deletion polymorphism (see Tables 1-2)
cagcatctttagggttttctaattatagaatcatatcatcaggaaagagataatttgactactacttttccaatttggatgtgttttatttctttctcttncctaattactctggctaggactccagtagtatgttgaataagagtggtgatagtgggcatccttatgctgttccagttcaaaagaggaatgcttccagct

SEQ ID NO: 28184 - DNA, 201 bp, Homo sapiens
tttccaatttggatgtgttttatttctttctcttacctaattactctggctaggactccagtagtatgttgaataagagtggtgatagtgggcatccttaygctgttccagttcaaaagaggaatgcttccagcttttgctcattcagtatgatgttggctgtggacttgtaatagatggctcttattattttgaggtatg

SEQ ID NO: 28185 - DNA, 201 bp, Homo sapiens
aaaaaccaattttctattttgttccatattttgaaagatttgttttcccttttagatgcagaccaacaacgaagagagaaactcaaaaaggaattagcacratgtgaaaaagagttcaaattaactaaaactgcaatgcgagccaattataaaaataattccaagtcactttttaataccttacaaaaggtaagatagtat

SEQ ID NO: 28186 - DNA, 201 bp, Homo sapiens
tccagcttttgctcattcagtatgatgttggctgtggacttgtaatagatggctcttattattttgaggtatgttcttttgatgcctaatttgttgagggtttttttttttaatcatgaaggattgctagattttattgaagctttttgctacatctgttgagatgatcataaggtttttgtttttaattctgtttatatg

SEQ ID NO: 28187 - DNA, 201 bp, Homo sapiens
ttacccaaaagtcattcaggagcaagttggtttaatttccatgtaaaattatgtggttttgaggagtactcttggtattgatttctacctttttttccacygtggtccaaaaatatgtttggcgtggtttcaatttttttacatttattgaaacttgctttgtcttcgagcatgtggttgatcttagagtatgttccacat

SEQ ID NO: 28188 - DNA, 201 bp, Homo sapiens
caagttggtttaatttccatgtaaaattatgtggttttgaggagtactcttggtattgatttctacctttttttccactgtggtccaaaaatatgtttggygtggtttcaatttttttacatttattgaaacttgctttgtcttcgagcatgtggttgatcttagagtatgttccacatgcagatgagaagaatgtttatt

SEQ ID NO: 28189 - DNA, 201 bp, Homo sapiens
ggttaagcatttgtaaccttcatatctctgtgaataactgctaagagttgctttcttatgcccttaggcttggccagtttgtcatatcttgttggcattctttttttttttttttttttttggtaactacacaaatctcactatattgtttgtattatttaaatagttaatccatttagaatttctataaattaaatgtgt

SEQ ID NO: 28190 - DNA, 201 bp, Homo sapiens
atggaagaacttagaacaggaaaggattagtcttcagctttacagagaaaaagaaaaatctgaaaaacatttttcaacctttgtagtttcagtgttacgtrgctagtttatatttagatgattttctgattttgagacattaacatttttgtttatcatttgtaggtttttagaacgactgttcgagcgacatataaaaca

SEQ ID NO: 28191 - DNA, 201 bp, Homo sapiens
ttccctttctcctgaatggatattaattttatgaaatgcttttttgcatctcttggaatgatgatattatgatataatttttctcttttaatctgtggggttttttttttttatatatatatatatagtctcactctgttgcccaggctggagtgcagtggcatgatcttggctcactacaacctccacttcctgggttga

SEQ ID NO: 28192 - DNA, 201 bp, Homo sapiens
ccaagaagacacagccttttgcagggaacattagtaacatcttgaggccaccacagtccaaggaaatgtgcgcaaaaagagctattaagtcactatgtccytctcttccccagcctcatttccacccaaaaaggccaggtgatcataagcgccatcacctcattgtgttccaggcaggcgatcatgatctccgacaaaatc

SEQ ID NO: 28193 - DNA, 201 bp, Homo sapiens
ttcatctttttttcgtttcagaaaggaaattgattgctctattacttatatttggaattaaatgttaatatcttagtttaaatacttgactagaacttcarataaaatattaacatcttcaggaacatatcagttaattttgtaaacccttgaggctatcatttttttaatgtataatctcaaaatccccaattacatgaa

SEQ ID NO: 28194 - DNA, 201 bp, Homo sapiens
ggaggctgaggcaggagaatcactcgaacccaggaggcagaggttgcagtgagccgagatcatgccactgcactgtagcctgggcaatagagcaagactcygtctcaaaaataaaaaataaaatgagtactttctgtgctcaaaactaccaactaagctaaactatttcatcaaaagaccccactaatcaggaaaactgat

SEQ ID NO: 28195 - DNA, 201 bp, Homo sapiens
ctgcacccactgtcctgcccccactgtccgacaagccccgtgagatgaacccggtacctcagttggaaatgcagaaatcacctgtcttctgcgtcactcgygctgggagctgtagactggagctgttcctatttggctatcttggaaccgcaaacagtatgtttttcttacattttttcctttacctttttgtttgactta

SEQ ID NO: 28196 - DNA, 201 bp, Homo sapiens
aaggaaggagtagagattaaaaagagggcaagaataaggtgttagtagcagaccactagggaagtacacacaatcccctcaggctctggcttctccctcargcctttgctagggagatctcacctgctaaggccatggagagttcattgttaactaccctgtctttgaaatttctgatgtttcaacacatataacttatta

SEQ ID NO: 28197 - DNA, 201 bp, Homo sapiens
caatgcactgaagaccaggaacacacagagggagtgttctcctttgccaataaacccagaaagattacactccttcacacaccacttgtttaacaaacatkagtaggaagacattcctttcaaggccaaagccctgataaagtcttccagatagaaggttttgaaacactattggttacaaagttctgttgtaatgaaagg

SEQ ID NO: 28198 - DNA, 201 bp, Homo sapiens
atctctgtgaataactgctaagagttgctttcttatgcccttaggcttggccagtttgtcatatcttgttggcattctttttttttttttttttttttggkaactacacaaatctcactatattgtttgtattatttaaatagttaatccatttagaatttctataaattaaatgtgttagttaatatctagaggcacatg

SEQ ID NO: 28199 - DNA, 201 bp, Homo sapiens
tttgagggcaggaagcatccagcacaggaggaagatgtaggctgtgagagtaggccagcctcaacccttcacgtttttctgcctgctttatgttcgctcgmagctgattagatggtgcccacccagattaagggtgggtctgccttccccaacccactgactcaaatgttaatcttctttgtcagcaccctcacagatata

SEQ ID NO: 28200 - DNA, 201 bp, Homo sapiens
gagagaaactcaaaaaggaattagcacaatgtgaaaaagagttcaaattaactaaaactgcaatgcgagccaattataaaaataattccaagtcacttttkaataccttacaaaaggtaagatagtatttttattttttaaaagcaaatgtttctaaggtacttctttagtggtacaatctgactttgtttactatagttt

SEQ ID NO: 28201 - DNA, 201 bp, Homo sapiens
atagtttagggtcagcaaatttttcctgtaaagatccagatagttaatattttaaaaggctgttcaggcctctgtcacaactactctgccattggaaggcrgacatagacagtacataaataaatgagtatagccgtgttctgctgaaactttattaactgaagacattgggtcagatttggcctgaaggttatagtttgc

SEQ ID NO: 28202 - DNA, 201 bp, Homo sapiens
agctattaagtcactatgtccctctcttccccagcctcatttccacccaaaaaggccaggtgatcataagcgccatcacctcattgtgttccaggcaggcratcatgatctccgacaaaatcaccacgccagtccttcctaccccagcactgcagtggaccaacaacggagggttggggctttggggatcacttgtgctat

SEQ ID NO: 28203 - DNA, 201 bp, Homo sapiens
tccagcacctaggttgagagaaacggtaatgaagataatgtgttcccctagggagacagaaaggatgggaggacacgagtgtcctggcagaaacctggttrggagatggacagtctcttttccaccttagcgtcttctagaaataagccatgattgcctacttctgattttctgattagttttagctataaatagaatgtc

SEQ ID NO: 28204 - DNA, 201 bp, Homo sapiens
gaggaggtttgtctttccttataacttcattagaaaaattataatgtaaaaataattgtatggtttttttcataccttcaaacaatacattaaaagcaagkgctttttttttcccttgaacttttttgagggtggtggtgggagaagtgaaaggaaaagtattaatcctgtgagattttcagcactgcagtcaaaatttaa

SEQ ID NO: 28205 - DNA, 201 bp, Homo sapiens
tacagctatttagactgtgaagaataatctgttggtggcacttatcatacatgatatagccagtatacagaaggtctgcctatttacaaatggttatagckctctctgaatggccaggtggatcctgccaaatctgggaagtcatttgttactaacatctttcctagatgattggttggctggctggacaaatggaaggat

SEQ ID NO: 28206 - DNA, 201 bp, Homo sapiens
atgtgggtttccacacgctgctctgtccatctgagtgggaactgcaaattagtcctgcctcctatctaccatcttccctccagtataccccctgctgctastatttttaaacaaaccatgccactctcttctttaaaacacctgtgagagtttgcacttgctaacacaataaagtccaggacctttggcattttctatgtt

SEQ ID NO: 28207 - DNA, 201 bp, Homo sapiens; identical to SEQ ID NO: 6915

SEQ ID NO: 28208 - DNA, 201 bp, Homo sapiens
cctttgcatcctcatagcttagctcccacttatgagtgagaacatacaatgtttggttttccattcctgagttacttcacttagaataatggtctccaatwccatctaggttgctgcaaatgccattatttcattcctttttatggctgagtagtattcaattgtgtgtgtgtgtgtgtatatatatacacacatcacatt

SEQ ID NO: 28209 - DNA, 201 bp, Homo sapiens
cattacatgtgtgatgggcctcttgaagatagtagaaggttgggtcttgttttttgtttttttttaaataaaatattattttattttttaaataaaaaaawtaaaaagtggttcttgccactctgtgccttttaactgggtacatttagaccacttacattcaaggttaatattgatatgtgaggtttgatcctgtcatgg

SEQ ID NO: 28210 - DNA, 201 bp, Homo sapiens
ctctttatcttttggaatagtgtccataggattggtaccaattcttctttgaatgtctgatagaattcagctgtgaattcatctggtcctggaatttttgkttttttgttagtaattttttttttttttttttgagatagagtctcgctctgtcacctaggctggagtgcagtggtgcgatctcagctcactgctgcaacc

SEQ ID NO: 28211 - DNA, 201 bp, Homo sapiens
ccaaactgctgggattgcaggcgtgagccactgctcccggccgtgattgttttttacttatgctatttcactggagatttttccattcatatcctatatcttttttttttttttctttgaaaaggagtcttgctctgtcacccaggctggagtgcagtgccacaatctcggctcactgcaacctctgcctccctaggttca

SEQ ID NO: 28212 - DNA, 201 bp, Homo sapiens
aaacagacatgaatacaattcttaccattcttgtaacttaactgaaactgcatgtgctgttgattacttgaggcgttcctctcaccttaatatgtgatgcrttgatgtaaccagtgttgttttctttagttgggaccaactccactctcacatcatcataaggaagaacatcttggaatcgatttctttctgcattttcag

SEQ ID NO: 28213 - DNA, 201 bp, Homo sapiens
  misc_feature (1)...(201): n = A,T,C or G, or insertion/deletion polymorphism (see Tables 1-2)
ctcttttccagtcctccactgccggggctgggcccggccgcgggaaggaccgaaggggatacagcgtgtccctgcggcggctgcaagaggactaagcatgnatggcagccggagaggtaaagggcagctgtcaggggctaccgccgcctcgcccctcgctccaggcggcgctcccagcctcgggtccgggcagctgagtgc

SEQ ID NO: 28214 - DNA, 201 bp, Homo sapiens
tggctgtgggtttgtcataaatagctcttattattttgagatacatcccatcaatacctaatttattgagagtttttagcatgaagggctgttgaattttmtcaaaggccttttctgcatctattgagataatcatgtggtttttgtctttggttctctttatatgctggattacatttattgatttgcatatgttgaacc

SEQ ID NO: 28215 - DNA, 201 bp, Homo sapiens
  misc_feature (1)...(201): n = A,T,C or G, or insertion/deletion polymorphism (see Tables 1-2)
tacttcttttttctatatttagtcatccatatatcttctagactttctatgtgtcctccttgttatagcttttaacagcccacctgatagcaaactagccntcttaccctcttaaaacatctctgtttgggggataaagcatttatattttgcatattaaattacatttaatgctgtaactcagacttcctgttttggaga

SEQ ID NO: 28216 - DNA, 201 bp, Homo sapiens
ctcattggcattatcagtgcaagattaaagcttcacatcacaatgtcatatatcaatatctctggttgaatttcagaacattttataagaatgagttaaakaatcagtgccttgtttatctcatgatttttatattagttttaaatatataatgattatgttttaatttttagctttttgcactgactcctcttctctcag

SEQ ID NO: 28217 - DNA, 201 bp, Homo sapiens
gatttccacatttggtatttgtcatttataaatactgacaatattattaaactattacctttctctttcagctgcagtagactgctcggttccagtaagcrtgagtaccagcataaagtgtaagtaatttttggacattattacctttttaaaaaaaaattaaggtaaatatacataacataaaatttactgtcttaacca

SEQ ID NO: 28218 - DNA, 201 bp, Homo sapiens
  misc_feature (1)...(201): n = A,T,C or G, or insertion/deletion polymorphism (see Tables 1-2)
gtaccgggtatcccgcaggcggggctgcggaacgcacgtcccctgcgccgtgacgtcacaatagcgactcactggacccagcccttagcaacggcctggcnacggtttccctgctgctgcagcccccgtcggctcctcttttccagtcctccactgccggggctgggcccggccgcgggaaggaccgaaggggatacagcg

SEQ ID NO: 28219 - DNA, 201 bp, Homo sapiens
attatcttttgtcatgctcttactgtaatcacgttttagacattcttttgtaaggcaagccttctaaatggtggtatagtacagcaccagactgaaaaacsgttagtcttgtttgtaatctttgtttcctactaactaactaggtaatcttcagcatgtcactgtacgtccctgggcctcagttatttataaaatgggggc

SEQ ID NO: 28220 - DNA, 201 bp, Homo sapiens
aggataaagaacaatatgtaaagtttgctaactttcttttaaagaatatatatatagagctggtataggtatggtggttttaagtatgaggctgccttggytcacatggaagctgcatcctttatcagcagtgtaaccttgaagatgtaactcatatctctgtgcctcagttttcacttcgattaaatgataataataatg

SEQ ID NO: 28221 - DNA, 201 bp, Homo sapiens
gttttcaggtttaagttagaaatttgcttcttggaatataatttttgtatgtagggttttgggatttggtagtcattgaatttctgaaattccgttgattragtattaacaatggtaactaattaagcaagcagctaaacatccttagttagaagattgagagctgtcaaaaaaaaaatagttctgtaaatgtaatgacag

SEQ ID NO: 28222 - DNA, 201 bp, Homo sapiens
gattttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaa

SEQ ID NO: 28223 - DNA, 201 bp, Homo sapiens
atggaaagtttgcaaaaccagattagctattgcatagcttaaggaaactgtgtgtcctgaattttgcttgaacatttatgtatctaagattcattgagcartgagctctactttgtgttatgtaacctaggaccctattatgtatactacttgctttctctgtcataataatatgccaagcatagacatttttaataaatt

SEQ ID NO: 28224 - DNA, 201 bp, Homo sapiens
atttgactcaattaatgtaattagtctcatcttttcttaatcctaggaaaaaatgcgccacctgctgcatgtcctgaaagtagacttaggctgcacatcgraggaaaactcggtaaagcaaaatgatgttgatatgttgaatgtatttgattttgaaaaggctgggaattcagaaccaaatgaattaaaaaatgaaagtga

SEQ ID NO: 28225 - DNA, 201 bp, Homo sapiens
attttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaag

SEQ ID NO: 28226 - DNA, 201 bp, Homo sapiens
cccctcttcagcctgtgcttcgcacgtttccttcagcgtgccgccattcagactgcgccacttacgtcccagtgccacgctgcgtggatcaagtgtcaacrggaaagtatgagttaggcaagcgctttttttttaagctgtaaacgcttcacatgactggccccgtaagaaattgtgggagcttagatgagcctggagctt

SEQ ID NO: 28227 - DNA, 201 bp, Homo sapiens
gtcccctgcgccgtgacgtcacaatagcgactcactggacccagcccttagcaacggcctggcgacggtttccctgctgctgcagcccccgtcggctcctyttttccagtcctccactgccggggctgggcccggccgcgggaaggaccgaaggggatacagcgtgtccctgcggcggctgcaagaggactaagcatggat

SEQ ID NO: 28228 - DNA, 201 bp, Homo sapiens; identical to SEQ ID NO: 6911

SEQ ID NO: 28229 - DNA, 201 bp, Homo sapiens
taaaagtcagagcaacctctgtccttcccagatatggtccaccgtgcctatttaaaggacacttgagcaccaaaagtaatggtaagtgaggtgcttaaaayggcagctttgttagaagattgtctgagtgtttcctttactggcaaattatatgacatgatggaaaaattgtttcatttgacgaatatttgaacttcatat

SEQ ID NO: 28230 - DNA, 201 bp, Homo sapiens; identical to SEQ ID NO: 6913

SEQ ID NO: 28231 - DNA, 201 bp, Homo sapiens; identical to SEQ ID NO: 6914

SEQ ID NO: 28232 - DNA, 201 bp, Homo sapiens
cccatatttcttggaggctttgttcatttccttttactcttttttctctaaacttctcttcttgcttcatttcattcatttgatcttcaatcactgatacsctttcttccagttgatcgaatcggctactgaagcttgtgcattcatcacgtagttctcttgccatgtttttcagctccatcaggtcatttaaggacttct

SEQ ID NO: 28233 - DNA, 201 bp, Homo sapiens
tttgaaaaccctgtttaaaaatttctgaagaataccatttgaaacctttgtttttgatttcaattaagaaatgtatactttatgggaggccgaggcaggcrgatcacgaggtcaggagatcgagaccaacctggctaacagggtgaaaccccgtctctactaaaaaacaaaaaattagctgggtgtggtggtgggcacctg

SEQ ID NO: 28234 - DNA, 201 bp, Homo sapiens
aaggacttcaaatgttttctaaaactctctctacccaagtagacatgcaaactttgatctgaatttcctgacatttccttatttttctgtttttgttttgtttttttttgagacagagtcttgctctgtcacccaagctggagtgcagaggcgagatctcggctcactgcaacctctgcctcctgggttcaagcaattctc

SEQ ID NO: 28235 - DNA, 201 bp, Homo sapiens
agggtcttgaagagaggagtagcagggctacttttacttttaaaagcatccctttggcttcatagttgggaatagtctgaagcagaatgactagttagaaracagtaaataatccagatgagaaataatggtgactgggaccagagtggttgcagtggagagagattgaaataatcagattctggaaacatttcaaatgtg

SEQ ID NO: 28236 - DNA, 201 bp, Homo sapiens
actgtgacaaggccatcttaatcggggccagagatgacactctccccctgtaactcagcctggctctgtctattgggatgtgcctaaatgggatgggtgagggggcactaaacagctaacactggccagggaattaaggagctaaaatgcaagtacctcttgaataccacagcaatctctgtgcacaaatttggactgtac

SEQ ID NO: 28237 - DNA, 201 bp, Homo sapiens
agaacgactgttcgagcgacatataaaacaaaataaacatttggaggaggtttgtctttccttataacttcattagaaaaattataatgtaaaaataattktatggtttttttcataccttcaaacaatacattaaaagcaagtgctttttttttcccttgaacttttttgagggtggtggtgggagaagtgaaaggaaaa

SEQ ID NO: 28238 - DNA, 201 bp, Homo sapiens
  misc_feature (1)...(201): n = A,T,C or G, or insertion/deletion polymorphism (see Tables 1-2)
gcatgtgctgttgattacttgaggcgttcctctcaccttaatatgtgatgcgttgatgtaaccagtgttgttttctttagttgggaccaactccactctcncatcatcataaggaagaacatcttggaatcgatttctttctgcattttcagggagtcgtgctgttgagcactccccatcaactagccgtttcttaagaat

SEQ ID NO: 28239 - DNA, 201 bp, Homo sapiens
cagtagagatggggtctcgccatgttggccaggttggtctcaaactcctgacctcaagtgatctgcccacctcggcctcccaaaaagtgctaggattacargcatgagccactatgctgagcctcttttaatctgttaatgtaatgaattacaaacaattgactttaatgttaaaccaactttgcattcctgttgtaaaca

SEQ ID NO: 28240 - DNA, 201 bp, Homo sapiens
tttttgtatttttagtagagacggggttccaccatgttagccaggatggtctcgatctcctgacctcgtgatctgcctgcctcggcctcccaaagtgctgkgataatcattgtctttttaatggggcatttaatatgtttttatttctggcttcttatttcataccttctatttgactcaatgtggtagacaaaatttgaa

SEQ ID NO: 28241 - DNA, 201 bp, Homo sapiens
attccccttagtaatatgagatagaagtacattggtaatggtagagatagatatttctaattaggtactaatgtttcttacagttttcagaataagtaagraataatttttatgctatatattgccttccttttacagtgaagaagaactgttgtatctgagtttcattgaagatgtaacagatgaaattttgaaacttgg

SEQ ID NO: 28242 - DNA, 201 bp, Homo sapiens
tccaaacgttttgagagaaaaaataaatttttctgcttagtaaatttctcaaccttaaaacaagatgctggcctagggctaggagaggacttcttagttgwagctcctgcttctctggacaactttcctcttccttcttgcaaatgctttgcagagggacttgcacctctgctgctggacctggtcaggagcaagaggaaa

SEQ ID NO: 28243 - DNA, 201 bp, Homo sapiens
gtgggcggatcacaaggtcaggagttcaacaccagcctggccaatatggtgaaacctcatctctactaaaaatacaaaaattagctgggcgtggtggtgcrcgcctgtagtcccagctactcaggagggtgaggcaggagaatcgcttgaaccccgcaaggcggaggttgcagtgagctgagatcgtgccaccacactcca

SEQ ID NO: 28244 - DNA, 201 bp, Homo sapiens; identical to SEQ ID NO: 6910

SEQ ID NO: 28245 - DNA, 201 bp, Homo sapiens
gtttttctagtattacataaacaatttatctggcagtaggttttagttgttttagaaagtaaaaacaatttaagattagtatttttttctttgaatatagrtaagtacagtgatatcagatgagtctgcagatatttaatcaaataaaatcaaataattcaaaattatgtattttataagaatagatgggtctcattcttt

SEQ ID NO: 28246 - DNA, 201 bp, Homo sapiens
ttttgggtgtatatttagaagtggaattgctaaatcatatattctatttttaattttttgagaaactaccatactattttcttttcttttcttttttcttttttttttttttttgagacagggtctcactctattgccctggggctaaagtgcagtggaacgatctcacctcactgtaacctccacctcctgggctcaagc

SEQ ID NO: 28247 - DNA, 201 bp, Homo sapiens
aggggaacatcacactctggggactgttgtggggtggggggaggggggagggatagcattgggagatatacctaatgctagatgacgagttagtgggtgcrgcgcaccagcgtggcacatgtatacatatgtaactaacctgcacaatgtgcacatgtaccctaaaacttaaagtataataataaaatttttaaaaaaaga

SEQ ID NO: 28248 - DNA, 201 bp, Homo sapiens
agtttagtgttttctaagtttctaagttttctaagttaatatttgaatttatgtagagtttgagaacatttctacattaaaaaagtaaatatcagccaggygcagtggctcatgcctgtaatcccagcactttgggaggctgaggcgggcggatcacgaggtcaggagatcgagactatcctggctaacacggtgaaaccc

SEQ ID NO: 28249 - DNA, 201 bp, Homo sapiens
gcataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaata

SEQ ID NO: 28250 - DNA, 201 bp, Homo sapiens
cataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaataa

SEQ ID NO: 28251 - DNA, 201 bp, Homo sapiens
ataggcaacttacagaatgggaggaaatatttgcaaaccatgtatctgataagaggttaatatcccaactgtgtaagtaataagtacaactcaatagcaaaaaaaaaaaaaaaaaaaaaaaaaacccaaaaccttgctataaaaatgcatgaaggacctgagtagacattctcaaaggaagacatacaagtggccaataag

SEQ ID NO: 28252 - DNA, 201 bp, Homo sapiens
ttttgcagggaacattagtaacatcttgaggccaccacagtccaaggaaatgtgcgcaaaaagagctattaagtcactatgtccctctcttccccagcctyatttccacccaaaaaggccaggtgatcataagcgccatcacctcattgtgttccaggcaggcgatcatgatctccgacaaaatcaccacgccagtccttc

SEQ ID NO: 28253 - DNA, 201 bp, Homo sapiens
  misc_feature (1)...(201): n = A,T,C or G, or insertion/deletion polymorphism (see Tables 1-2)
gatgtaggcatttaatactatgaactttcctcttagctctgtctttgctgtattccagaggttcagatattttgatagtttgtgtcactactatcattcanttcaaagaattttttaatttccatcttgatttcattgttgacccagtgatcattcaggagcaggttattgtacttccatttatttggcatggttttgagg

SEQ ID NO: 28254 - DNA, 201 bp, Homo sapiens
tcagaaggggttataattcaacaggtgaatgatgaaacaaatcttgaaacttcaactttggatgaaaatcatccaagtatttcagacagtttaacagatcrggaaacttctgtgaatgtcattgaaggtgatagtgaccctgaaaaggttgagatttcaaatggattatgtggtcttaacacatcaccctcccaatctgtt

SEQ ID NO: 28255 - DNA, 201 bp, Homo sapiens
  misc_feature (1)...(201): n = A,T,C or G, or insertion/deletion polymorphism (see Tables 1-2)
ctgtgggtttgtcataaatagctcttattattttgagatacattctatcaacacctagtttattgagggtttttagcatgaagcgctgttgaattttgtcnaaggccttttctgcatctgttgaggtaatcctgtggtttttgtcattggttctgtttatgtgatgaattatgtttattgatttgcatatgttgaagcagc

SEQ ID NO: 28256 - DNA, 201 bp, Homo sapiens
ggatagtccctcatggcttcccttggctaggggaaggagttcccctaccccttgcgcttcctgggtgaggcaacaccacaccctgcttcagctcaccctcygtgggctgcacatatacagtatttcatcctgtatatgtaccacattttctttatccaattcaccattaatggacacccaggttggttccatatctttgct

SEQ ID NO: 28257 - DNA, 201 bp, Homo sapiens
ccattcactcctcgcactttaaaaacagaagcaaaatctttcctgtcacagtatcgctattatacacctgccaaaagaaaaaaggattttacagatcaacrgatagaagctgaaacccagactgaattaaggtatgacacatcagcaaccaacagtaaatccttcaggaaattaaatgaaaattaatgaattaatattcct

SEQ ID NO: 28258 - DNA, 201 bp, Homo sapiens
ctcattgtgttccaggcaggcgatcatgatctccgacaaaatcaccacgccagtccttcctaccccagcactgcagtggaccaacaacggagggttggggytttggggatcacttgtgctatttgtatggcgtcgaacagactggatctcttcaagatatgctgtggaaaatcaatgaaatagaaaagtactcaaggatca

SEQ ID NO: 28259 - DNA, 201 bp, Homo sapiens
ctaactcttaaagtgattgattactgtggagatgtgtgatgacagattggcacctactaaggaaacctctcttgcctggtacattattaaaaataatccaytggggaaataggactaatttaattacatgcctttatgcagtaagatccacagttgaaaaatagaggcagtagctttaattgcactgtaatgttcacacac

SEQ ID NO: 28260 - DNA, 201 bp, Homo sapiens
cctaagcccttccagtcttcaccctgtaactcttgagtcattcactacttagtcaatgctcccatactactcgtttgcttcactggtgtagcacttactgygtgcttttaagattaagtgaatatgtgggtgtgagctttatttctgaataaatctagaaaagaggcgggagcagtggctcacacctgtgatcccaacact

SEQ ID NO: 28261 - DNA, 201 bp, Homo sapiens
cataggcttgtattatgcacagagtctctggaaggatgcatttaaacagtaacatagtatatttctgggaagggagactaaaggtcagggtagagaaatcrcttctttttcaaactccatatgccattttagctgttgaatttttttaaccacattgcgtgtattacttctcaaaaactgtttttaatgtttaaaaaagct

SEQ ID NO: 28262 - DNA, 201 bp, Homo sapiens
tttgaatatagataagtacagtgatatcagatgagtctgcagatatttaatcaaataaaatcaaataattcaaaattatgtattttataagaatagatggrtctcattctttttgagtttattttttctagccagtaaaccttgttaccacagtgcttatattttgaaggattaacaattatttattttaaattattacag

SEQ ID NO: 28263 - DNA, 201 bp, Homo sapiens
  misc_feature (1)...(201): n = A,T,C or G, or insertion/deletion polymorphism (see Tables 1-2)
tctggagaatattcagttttttcaacctgtttgttggtctgaaccagtgttgcactggtattatttcagtaaaactacaaaaccttaccaaaatcctttcnggacacttaactctaagattaaattacatttcaataaatattaatcactgtaagtaacaaaatatttgtctcattcaatggtccattaatttcaagtgat

SEQ ID NO: 28264 - DNA, 201 bp, Homo sapiens
ttttcaatcttttacatattgtctgtggcagcttttacactaaaaagcagagttgaccagttgtaacagactgtatcaccctgcaaatcctgaagcatttrctacctggccctttgtagaaaaaatttgccaacccttgatatagaaaaagtccattacctcaaagagttccccctagtcctttgccgtcagtcccctcct

SEQ ID NO: 28265 - DNA, 201 bp, Homo sapiens
cgtactgtataatttttatctactggatatctctgttcaatcacttaaaatttgctgtgttatattctgctttcgtaatgtatttttaagcaaaaataaamattttttttattgcatccccaggcatctaattgtgtgacatatgatgccaaagaaaaaatagctcctttacctttagaagggcatgactcaacatgggat

SEQ ID NO: 28266 - DNA, 201 bp, Homo sapiens; identical to SEQ ID NO: 6932

SEQ ID NO: 28267 - DNA, 201 bp, Homo sapiens; identical to SEQ ID NO: 6933

SEQ ID NO: 28268 - DNA, 201 bp, Homo sapiens
cgctcatctactgccgcagcccggactttcgcagcgccttccgccgtcttctgtgccgctgcggccgtcgcctgcctccggagccctgcgccgccgcccgyccggccctcttcccctcgggcgttcctgcggcccggagcagcccagcgcagcccaggctttgccaacggctcgacgggtaggtaaccggggcagagggac

SEQ ID NO: 28269 - DNA, 201 bp, Homo sapiens
cgccgcccgcccggccctcttcccctcgggcgttcctgcggcccggagcagcccagcgcagcccaggctttgccaacggctcgacgggtaggtaaccgggkcagagggaccggcggctcagggtcgggaagcatgcgatgtgtccgtgggtcaactttttgagtgtggagtttattaagagaaggtgggatggctttgctt

SEQ ID NO: 28270 - DNA, 201 bp, Homo sapiens; identical to SEQ ID NO: 6935

SEQ ID NO: 28271 - DNA, 201 bp, Homo sapiens
gaaggcagggctagtgcccccccacccgccccccaagccctcggcctcagttctgggttttctcaaaggtttgacagctgtggaggtgagaatccacttcyggtatgaagtacagttgtgagtgaggagcctgtgagtgcagatgtgtgccctcccgctccctgggctgggttggagtagggatggggtggggcgtgtgtg

SEQ ID NO: 28272 - DNA, 201 bp, Homo sapiens
gtgggtcaactttttgagtgtggagtttattaagagaaggtgggatggctttgcttggagagaaaagggaacgaggagtagcgaaccaaaatgggacccasggtccttttctttccggatccagtcactagggtagaagcaaaggagggcgagcgggccgtcgttcctcacccaaggacccaaggtgcgccaccggaaagc

SEQ ID NO: 28273 - DNA, 201 bp, Homo sapiens
tcccgaggactctcgcctcgcctggtcggctttagggattttttttttttttaaatagagacagggtttcgtctctgtcgcccacgcgggaatgcagtggygcgatctcagctcactgcagtcttgaactcctggctcctgggctcaagcgatcctcccacctcagcctcctgagtatctgggactacaggcgagccccac

SEQ ID NO: 28274 - DNA, 201 bp, Homo sapiens; identical to SEQ ID NO: 6943

SEQ ID NO: 28275 - DNA, 201 bp, Homo sapiens
ggagcatcccattggccatcctccccactctccaattcggctccagaggcccctccagactataggcagctgcccctttaagcgtcgctactcctcccccragagcggtggcaccgagggagttggggtggggggaggctgagcgctctggctgggacagctagagaagatggcccaggctggggaagtcgctctcatgcc

SEQ ID NO: 28276 - DNA, 201 bp, Homo sapiens
ctcaaaggtttgacagctgtggaggtgagaatccacttccggtatgaagtacagttgtgagtgaggagcctgtgagtgcagatgtgtgccctcccgctccmtgggctgggttggagtagggatggggtggggcgtgtgtggctgggtggtgccctggcgtttttgtgtaactaaatatgcgttccagggtctctgatctct

SEQ ID NO: 28277 - DNA, 201 bp, Homo sapiens
ggctggttctttttccttggggataattttaggttctgaattcccctgcaaccttcctaactcccagcccccagctcagcctcccagagggattgttcatwccagtgactataaagtgttctctcgaaatatagagctgttcagagacctgccagggcatagccctggaggcattttccatgataatttttccccctttgt

SEQ ID NO: 28278 - DNA, 201 bp, Homo sapiens
cttcatgggcatagaagtcacttgcttgggagcccaagacaaaccctgctcatgggtgagcagctgggtccctgggagacgaggctggttctttttccttsgggataattttaggttctgaattcccctgcaaccttcctaactcccagcccccagctcagcctcccagagggattgttcataccagtgactataaagtgt

SEQ ID NO: 28279 - DNA, 201 bp, Homo sapiens; identical to SEQ ID NO: 6942

SEQ ID NO: 28280 - DNA, 201 bp, Homo sapiens
gcctgtgaggatttagtaggggagtgatgtgatcacattctaactatgggatggagaatgaattcaaaaacgccatgctcgttgagaggctgccacagggragaacccatagcagcctgagtcaaggtcaatgctgaggtatttgggaagcagaagcaaaagaccttcagggactggtatgcagcaatgatcatgagaata

SEQ ID NO: 28281 - DNA, 201 bp, Homo sapiens
ttaaaccagcagtgactataaagctacaccttaatcaaaatggagatcacaacaccaaagttctgcagacagacccagccaccctgctccatttggttcawcaactggaacaagcattggaagagatgaagacaaatcactgtaggagagttgttcgcaacatcaagtagtaccagttttaaggttttaattcatttgaat

SEQ ID NO: 28282 - DNA, 201 bp, Homo sapiens
gatgggatgggaaaggcagggaagtggcacaacttcactgccacattttcctggttaaggcaaatcactggcccagtccagattaagtggaaggggctacrtaaaggtataaataacatgaggctgggccattgaaaggcagcaacgcagcagagagactaccacaatattatttccaatttgtaaatgagtaaactgtga

SEQ ID NO: 28283 - DNA, 201 bp, Homo sapiens
ggtggttccatatacattttaggattttttttttctgtttatgtgaagaatgtcattggtattttgataaagctttcattaaatctgtagattgctttgcrtagtgtaggcatattaacaatactgattcttccaatccatgaacatggaatatatttccatttatttgtgtccttttcaacttttttcatcaatgtttta

SEQ ID NO: 28284 - DNA, 201 bp, Homo sapiens
gaatttggcttacctcgccatctccccccaccctttcccctcagtggagaggcaaccagagagaaaagaaattgagctgctctgaagggcaaggcctcctyctacttcccgcagctgtttcgccagacttgaccttcttcccttagctagaggcagggggtctccatccctcgcccagatctagttggtgggaaggtgggt

SEQ ID NO: 28285 - DNA, 201 bp, Homo sapiens
agtttccttcccacccgtgtcccagccatacatttcccttccctgtaggcgatatcatcatttatatcttttcaaagatcagctgggcgtggtggctgacrcctgtaatcctaacactttgggaggctgaggcggaagggcatttgaacccaggaactcaagaccaccctgggcaacatagcgagaccctgtctctactta

SEQ ID NO: 28286 - DNA, 201 bp, Homo sapiens
atttgtttttattttatctacttttaaagtaatgaatagttcaatttttagaatcttgaaatggtatttataaagagtttccttcccacccgtgtcccagycatacatttcccttccctgtaggcgatatcatcatttatatcttttcaaagatcagctgggcgtggtggctgacgcctgtaatcctaacactttgggagg

SEQ ID NO: 28287 - DNA, 201 bp, Homo sapiens
atgcctcctcgccagaccaaatatggtcacaagagctaagcagcctctcgtggaaaagctggccttgttggtgtctccccgcgccggggcgcacccgggcsggccttcgggcagaatcgcgggtcagtgcggcgctccgggtgctgcaggcctcggcgcctggctgcaggggagggcgcggtgtccaggaccggcccttcc

SEQ ID NO: 28288 - DNA, 201 bp, Homo sapiens
ccccagtagcactctccccttcctctgaagcctaagttggtccctttcgatgcctcagtttttgtctttgatcctccaaataatttcttgcaaaatgggamcctcactctgaaaagcacctctagtctctcttgagatgccggggttcatgccagccctttttccagttcaagttgtgtcatgcctttcaaacatgtgcaa

SEQ ID NO: 28289 - DNA, 201 bp, Homo sapiens
ttactgcaagctgaagtcccctttctactttaaatgggagagaaaatcttgtgctgacatgagatgctcattaccaccaaggcactcattaccaacaaggrcagtaaaggaatcgcagctttggctgcctctcacactgaatctgagagttgctattattagaatgcaaaaaaaaaaaaattgtggggtgctggtggggga

SEQ ID NO: 28290 - DNA, 201 bp, Homo sapiens
gcccaggagttcgaaagcagcctgagcaacatggtgaaaccccgtctctacaaaaaatacaaaaattagctgggtgtgatagcacacaactatagtcccasctactcgagtggctgaggtgggaggatttcttgaccccaggaggttgggcctgcagtgagccaggatcgccccatggcactccagcctgggtgacagagt

SEQ ID NO: 28291 - DNA, 201 bp, Homo sapiens
gtgaccagaaacctaatcaagctagctaaggaaggatacaggagtatctctcagagcccagagcaagaagtttcactgggcctcagccagagtagactgarccctagggaactggattctacctgttctgggtgatggcatatggtctgtcatttctgcttctctcagcacatcagcctcattttctccagactggttttc

SEQ ID NO: 28292 - DNA, 201 bp, Homo sapiens
ttagtttcatgaaaaatctgtaaatccatttctgataacggagatagaatttggtagatgagggagaaattccaaacttgtgtgtcactggcagctggtayataaagaaattgatactgtaagccttcacagtggcagggtagggcttggcgacttgcctcaggctgtggatcaaagggctccagagtgtgggatctaatg

SEQ ID NO: 28293 - DNA, 201 bp, Homo sapiens
atccatgtaatttatcatgtctgttcagtcttccactgtctgactgtaccataatttgtttaaccattctatcatcatacactaaagatagaaacaaaacygctgtggacatccttaagcatacattctgcatacttgtattggtttggagtcatgtttgtgatttacagggatgcgaaatgagatcatttatttctctaa

SEQ ID NO: 28294 - DNA, 201 bp, Homo sapiens
ctgtttaactcattgcacggggttcctctccaagtcaatgaggattgcgtaaagagtctgaaggcaggatgtgcctcatagtgggatgagaaggagccttrtggctggtcgtcagactaaatttaaaccattatttgttgtgaatatatgattaacgtgggggttaaaaatgaaaaatacagctgcaagagtaggtttctt

SEQ ID NO: 28295 - DNA, 201 bp, Homo sapiens
tgttcctttctggggcaagtaaggaacaaatcttcctagattagttttatgagtacttacagataaaaacatatatgatgtgaataagattcaactgttayatttgatacctagaagcaaaatgatttgtcgaagtaaacccattaaatatgttcattcattcattcattcattcctttaattcagtcacttattctatga

SEQ ID NO: 28296 - DNA, 201 bp, Homo sapiens
agctcatagctcaggcttccttgcagcatgcttttcaaacaaaggattaatggagtcctccttatatgtcggctcctgatctaggtgctttgtgttacatrttgtttgtcaattcactggtttgtgtaccaaagatcacatgccctccttacctctgccataaacacacaaattaactgagaaagtatacacatgcacaca

SEQ ID NO: 28297 - DNA, 201 bp, Homo sapiens
gcttcctgaggccctcaccagaagctgagcagatgttggtgccatgcttgtacagcctgttgaattgtgagccaattaaacctcttttatttataaattcmccagccttaggtattcctttatagcaatataaaaataaactaaaacatctatcatgtgctgtggttcttactggagcaccatcaactcaacttgtagcac

SEQ ID NO: 28298 - DNA, 201 bp, Homo sapiens
ctgaaaatgggtaatttataaaggaaagaggtttaattgactcacagttcaacatggctggggagtcctcaggaaacttacaatcatggcagaagtgaaayaggcacgtcttacatggtggcaggtgagagaagtgaaaaccaagtgaaggaggaagccccttagaaaactatcagatctcgtgagaactcactcactatc

SEQ ID NO: 28299 - DNA, 201 bp, Homo sapiens
caagaaatctttaaagttgtttcttgatttcttcattgattcactggtcattcaggagcattgtttaatttccatgtgtttatatagttttcaaagttccytatgttattgatttctcgttttattccattgtgaacagagaaaatacttaaaatgattgcagtgttttcatagcctaataaatggtctgttcttgagaat

SEQ ID NO: 28300 - DNA, 201 bp, Homo sapiens
ctttttttttttctgtcttctttgctttttttttttttttttttttgagataggttctcactctgtcacccaggttggagtgcagtggcatgatctcagcycactgcaacctccacctcctgggctcaagcaatcttcctgcctcagcctcccaagtagctgggactacaggtgcaaaccaccatgccccactaatttttg

SEQ ID NO: 28301 - DNA, 201 bp, Homo sapiens
tttgtcccatgatataacaaataccatatgttatattacatatgccatttagtttgaagtaaatttacaaactggaatttaaaatgataacgtctactctrctaatgatgttgagtatgtactagaggaagtgagagtgaagaaaaatgatcagttaagtccatgagaagtaatgagaactttaatgaggaggaattgatg

SEQ ID NO: 28302 - DNA, 201 bp, Homo sapiens
aactatggggacagagaagagatgagcacttgccagggttgacagtacagaaagagtagactccaaaggggcagcactgaggaattgtggggcagatggcwcagttccgtgtcttggttgtggtggctatttcacagctctgcatttgtcaaaactcagacatgtataccacaaagagtgaattttactgtatgtaaacaa

SEQ ID NO: 28303 - DNA, 201 bp, Homo sapiens
atataagcacagtgtaggtatcaaaatcaggaaatttaacattgatacaatactcttatctaatagcccagattcgaaatgtcttcagttgtcccggtgaygtcctttgtggctatttttgtttctggcccaggatgtgattgaggatctcacattgcatttagttgtcctgtttccataatctcttctaatttggaacaa

SEQ ID NO: 28304 - DNA, 201 bp, Homo sapiens
ccaagttgattttgtcccatgatataacaaataccatatgttatattacatatgccatttagtttgaagtaaatttacaaactggaatttaaaatgataaygtctactctgctaatgatgttgagtatgtactagaggaagtgagagtgaagaaaaatgatcagttaagtccatgagaagtaatgagaactttaatgagga

SEQ ID NO: 28305 - DNA, 201 bp, Homo sapiens
  misc_feature (1)...(201): n = A,T,C or G, or insertion/deletion polymorphism (see Tables 1-2)
ggcccaagttatgcacgtcagcctctttgggttcacaaggcagtattgtatcatggaaaaagccctagaccttattatgagaacaagatttgactctgctntgccacatggaaactaagaacttattaagtaggtttacttcacccaactctgtttctgtatcttttttttgagacggagtctccctcttgtcacccaggc

SEQ ID NO: 28306 - DNA, 201 bp, Homo sapiens
acaaactggagtcatttatgtcattgtggggcactgcatcagccaaacataaaggtgctctacttggtaacctcttgctatttgagataataaatgtttcstattgtttaagccaatctgagatagggctttctgttatttgtggctgaaggcatggtaattgaaacaacatgcaaagaaacttagccttatcatgtaggg

SEQ ID NO: 28307 - DNA, 201 bp, Homo sapiens
  misc_feature (1)...(201): n = A,T,C or G, or insertion/deletion polymorphism (see Tables 1-2)
tataactatttttaatttcagaatacattgcaaaaatgttttttgtgtaaatgttttaaaacataagatattatcatgaaaaggtaatttcttagaaaaantggaatttatctctactacttttttttgtttagagaaaatttaggaaaagtgaatgtacatcttgaattttagttaagtaattacagttatatagtcaat

SEQ ID NO: 28308 - DNA, 201 bp, Homo sapiens
tcgaatactccaagaatggtagagcagagatagaacaaactggagtcatttatgtcattgtggggcactgcatcagccaaacataaaggtgctctacttgstaacctcttgctatttgagataataaatgtttcctattgtttaagccaatctgagatagggctttctgttatttgtggctgaaggcatggtaattgaaac

SEQ ID NO: 28309 - DNA, 201 bp, Homo sapiens
atgataacatttgtacattttcccgcacttttgtattaatatatttattacgggtctgagtatttaaacatgaacttttttctcaagtcatttaaaatgastacaattcctaacccagaatgaaatgtttcttctaatataactatttttaatttcagaatacattgcaaaaatgttttttgtgtaaatgttttaaaacat

SEQ ID NO: 28310 - DNA, 201 bp, Homo sapiens
aaaatacaaaaattagctgggcgtggtggcacatgcctgtagtcccagctactcgggaggctgaggcacaagacttgcttgaacccggtaggtgaaggttrcagtgagctgagatcacgccactgcactccagcctggctgagagagtgagactccatctcaaaaaaaaaaaaaagcaatcattccgggtacattcaacac

SEQ ID NO: 28311 - DNA, 201 bp, Homo sapiens
ttcgagaccagcatgggcaacatggcgcaaccatatctccactaaaaatacaaaaattagctgggcgtggtggcacatgcctgtagtcccagctactcggraggctgaggcacaagacttgcttgaacccggtaggtgaaggttacagtgagctgagatcacgccactgcactccagcctggctgagagagtgagactcca

SEQ ID NO: 28312 - DNA, 201 bp, Homo sapiens
tcggttgggtgttttaaacctgcacgttttatttctcaagtagaccggaggatccttaaaaggtagccaaagaatagaattatataatattttaaaaagtaaaaaaaaaaataatttttttcatattctgggtcattgtagctttgtttacaaggactttacatgttgaagaattggaggatgtattagttttgggttttt

SEQ ID NO: 28313 - DNA, 201 bp, Homo sapiens
ctataatcccagcattttgggaggctgaggcaggtggatcacttgaggttaggagttccagaccagcctggccaacacagtgaagccccctctttactaawaatacaataattagccaggtatgggggctcacctgtgtcacctgtggtcccagatactcaggaggctgaagcactagtattgcttgaacctgggaggcag

SEQ ID NO: 28314 - DNA, 201 bp, Homo sapiens
gacaggaagatgagagaaggtttggaactgcttcaaggctggttaaatggttgtgaccaaaatgctgatagagatattgacagtaaagtccaggctgatcrggtctcagatggaaatggggaaactgttgggaactgcagtacaggttactcatgttatgccctaacaaagagcttggctttattgtgttcatgccctagg

SEQ ID NO: 28315 - DNA, 201 bp, Homo sapiens
ataagctactgcttccactgtcaccatgtgatgtgcctgctcccactttgccttctgccataaccaaaagttcctgaagccctcaccagaagctgagtagrtgttggtgctacgcttgtatagtcagcagaaccgtgagccagttaaacctctgttctttataaattgcccagtctctggtatacctttatagtaatgcga

SEQ ID NO: 28316 - DNA, 201 bp, Homo sapiens
atagataagctactgcttccactgtcaccatgtgatgtgcctgctcccactttgccttctgccataaccaaaagttcctgaagccctcaccagaagctgartaggtgttggtgctacgcttgtatagtcagcagaaccgtgagccagttaaacctctgttctttataaattgcccagtctctggtatacctttatagtaat

SEQ ID NO: 28317 - DNA, 201 bp, Homo sapiens
  misc_feature (1)...(201): n = A,T,C or G, or insertion/deletion polymorphism (see Tables 1-2)
gattgcagtgttttcatagcctaataaatggtctgttcttgagaatgatccatgtcttgaggagaagaatgttaattctgtagccattggatgaaatgttntgtaaacatctactaggtccatttggtgtatagtgcagattaagtctgatgtttctttgttgatttgctgtctggatgatctgtgcaatgctaaaagcag

SEQ ID NO: 28318 - DNA, 201 bp, Homo sapiens; identical to SEQ ID NO: 6951

SEQ ID NO: 28319 - DNA, 201 bp, Homo sapiens
caggcttgcgtctttcccttcagggcagtgggttcccttctggcccagggtgggtctagatatgctgtctggaagctaggacctggaattgggaactttaggaatctatttagtactttattttactgtggctaagctggtacccacattgcaagaaaatgacctttttattcttccctctcctttcctcaagcagaagtc

SEQ ID NO: 28320 - DNA, 201 bp, Homo sapiens
  misc_feature (1)...(201): n = A,T,C or G, or insertion/deletion polymorphism (see Tables 1-2)
tattcagaatggttgaaaaatggaatattctagtaaagttcatgtttttggataatgagggttatgagtcaaaagattcttgcatttatggttaataaagnattagaaatttaccattgatgagatacattttttcaaactgtggctcagggtgtatgagtgtgcttgagggatggggactggtgggactcaggcttttta

SEQ ID NO: 28321 - DNA, 201 bp, Homo sapiens
aggccaagtcaggcagatcacttgaggtcaggagttcaagaccagcctggccaacatagtgaaatcccatctctaccaaaaatacaaaaattagccaggcrtggtgacaagcaccagtaatcccagctcctcaggaggctgaggcaggagaaccgcttgaacctgggaggcagacgttgcactgaaccgagatcataccac

SEQ ID NO: 28322 - DNA, 201 bp, Homo sapiens
tagctgggcttggtggctgacgcctgtagtcccagctactcaggaggctgaggcccaagaatcacttgaactcgggaggcagaggttgcagtgagccccargatgatgccactgcaccccagcctgggcaacagagtgagactcggtctcaaaaaagaaaaaaaaaaaaagaaaaagaatattattcagccttaaaaagga

SEQ ID NO: 28323 - DNA, 201 bp, Homo sapiens
tttgtgcctgtttgggggatatagaatggtataaccactgtggaaagcagtatggtggtttctcaaaaaattaaaaatagatttaccatatgatccagcartgccatactcagaagaattaaaagcaaagtatcaaagatatttgtatgctcgtgttcatacagcattacttacaatagctaaaacattgaagcaacccaa

SEQ ID NO: 28324 - DNA, 201 bp, Homo sapiens
ctaagtgcaacagcatatttaaaagattatacgctatggctaagtgaggtttattcctggaatgcaaggatgattcaatctatgaaaactgatcaatgtartacaccacattaacagaatgaagggagaaagccacatgatcatcccaagtggtgcagaaaaagcatttgacaaaattcaacatcctttcatggtaaaaat

SEQ ID NO: 28325 - DNA, 201 bp, Homo sapiens
aaaattaatgtggctgatttagtcttggttcacaaggccttcatttagctgcttcaaagctcacacttcaaatgtcaagaaaaatattctcttaatttctsccgtatcaactgctgtaatgcctgaattaattagaatggaactataatttctctccaaatggaattggatcatcccatcctaacaaaacaaatgctcagg

SEQ ID NO: 28326 - DNA, 201 bp, Homo sapiens
  misc_feature (1)...(201): n = A,T,C or G, or insertion/deletion polymorphism (see Tables 1-2)
ttttaaaacttaacatatcttagagagccttccaaattagtacttactgatttgttcattgtttgtcagcaatatgtaatgttccactccgttgagatacngtacttggtttaaccagtcctgtgtgctggatatttagtttattttctggttggtcactattactaaacaatgccacagtgtgcagccttggacataaat

SEQ ID NO: 28327 - DNA, 201 bp, Homo sapiens
ctgtactaccactgtatctttgaattcaataacttgtttttttattttacaggtttatagatagaaggaacttggccttgagtttcagatgagactttggrcttttggacttttgagttaaggctggaacaagttaagactttaggggactattacaaaggcatgattgtattttgaaatgtgagaaggacatgagatttg

SEQ ID NO: 28328 - DNA, 201 bp, Homo sapiens
gtggtggtgcatgcctgtagtcccagctactagggaggctgaggcaggagaatcgcttgaacctgggaggcagaggttgcagtgagccaagatcgcgccaytgcactccagcctggcaacagagcgacactccgtctcaaaaaaaaaaaaaaaaaaaaaaaaaaaaaaaagtaaaaaagaggttataggcaatatgagatt

SEQ ID NO: 28329 - DNA, 201 bp, Homo sapiens
aaccaagctcgaatactccaagaatggtagagcagagatagaacaaactggagtcatttatgtcattgtggggcactgcatcagccaaacataaaggtgcyctacttggtaacctcttgctatttgagataataaatgtttcctattgtttaagccaatctgagatagggctttctgttatttgtggctgaaggcatggta

SEQ ID NO: 28330 - DNA, 201 bp, Homo sapiens
aggccaaggtgggcagatcatttgaggccaggagttcgagaccagcatgggcaacatggcgcaaccatatctccactaaaaatacaaaaattagctgggcrtggtggcacatgcctgtagtcccagctactcgggaggctgaggcacaagacttgcttgaacccggtaggtgaaggttacagtgagctgagatcacgccac

SEQ ID NO: 28331 - DNA, 201 bp, Homo sapiens
tttctccctaacaactacaggatcacatggacctaatttgttttattgtcacaagagtcccttttcttgacaggatatgcctaattaaaaccagggtgttaaaaaaaaaaaaaaagctaagttttgcaggcaagttgacatactgtgtgactcaagggtttcaggagggacaaggagggatggtggtgtgttattgaagca

SEQ ID NO: 28332 - DNA, 201 bp, Homo sapiens
gatttcttcactctattatttatatatatatagagagagatggtgtcttgctgtatgtattgcccaggctggagtgcagtggctattcataggtattcatwggtatgaccatagccttgaactcctggcctcaagggatcctccagcctcagcctccttatagccttggacttcagctactggccaccatccctagctggt

SEQ ID NO: 28333 - DNA, 201 bp, Homo sapiens
gctattattcaggccgggtgcagtggctcacgcctgtaatcccagcactttgggaggccaaggtgggcagatcatttgaggccaggagttcgagaccagcwtgggcaacatggcgcaaccatatctccactaaaaatacaaaaattagctgggcgtggtggcacatgcctgtagtcccagctactcgggaggctgaggcac

SEQ ID NO: 28334 - DNA, 201 bp, Homo sapiens
gtacttacagataaaaacatatatgatgtgaataagattcaactgttatatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagt

SEQ ID NO: 28335 - DNA, 201 bp, Homo sapiens
ctctggctacaggatgaagaaatgatcagagtcagggcaggattcaccaggagagcaactcagtagtgagttccagttagttctagaggctatgatgcagytatcttacagataagcacgcggggcaagttgctaggggaacccaggctctaaaattgcagttgaagtaggtaagctctaaaattgcagtaggtaaaaggt

SEQ ID NO: 28336 - DNA, 201 bp, Homo sapiens; identical to SEQ ID NO: 6953

SEQ ID NO: 28337 - DNA, 201 bp, Homo sapiens
tacttacagataaaaacatatatgatgtgaataagattcaactgttatatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagtt

SEQ ID NO: 28338 - DNA, 201 bp, Homo sapiens; identical to SEQ ID NO: 6947

SEQ ID NO: 28339 - DNA, 201 bp, Homo sapiens
acttacagataaaaacatatatgatgtgaataagattcaactgttatatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagttg

SEQ ID NO: 28340 - DNA, 201 bp, Homo sapiens
cttacagataaaaacatatatgatgtgaataagattcaactgttatatttgatacctagaagcaaaatgatttgtcgaagtaaacccattaaatatgttcattcattcattcattcattcctttaattcagtcacttattctatgagtagttttttaatgtctgctgtgtgtaaggccttctgcatttagtccatagttgg

SEQ ID NO: 28341 - DNA, 201 bp, Homo sapiens
ctattgcatttttcccccttttgtgcctctctctagttcagagcacctttaggctaagcactcatgggagtattatggtggcgccttttccaactcacagttaaggcagagacaagattttcagtcctgcactatagctgtggaattattttcagaggctgtaatgagcaggtataggttcaaatgtggaatgcagcatca

SEQ ID NO: 28342 - DNA, 201 bp, Homo sapiens
ataggttcaaatgtggaatgcagcatcattttttaagcaggaaatgggttcattttggggggaggatagctttctcattttttttctgattagaaaaatartgcttattgtacaaaaagaacaaagaaatgtaaagatatgaataaagcctacttcccccttgttcatatgtgttctatttaccaaaacgggattatgttc

SEQ ID NO: 28343 - DNA, 201 bp, Homo sapiens
  misc_feature (1)...(201): n = A,T,C or G, or insertion/deletion polymorphism (see Tables 1-2)
gggactggtatgcagcaatgatcatgagaatagattctgtaaccaccaggaatctttgctctgttgtttcctgatagcagaaccattggacattgaattgnttgtgatattgtacagggcattgttataacctttttaaatatcacttttctaatttgcaagatgggagtaaaaatggggtcaaaatggggatactattag

SEQ ID NO: 28344 - DNA, 201 bp, Homo sapiens
ctcacagacgtcaatgggttgaaggagatgttggctcttgcactgattctttcagaagcccaggaggtggtggggaggggggaggagaagaggggacaggwttgtacttgtcgtgtcactgccctctcagttggagcttcctttacctttccaggctcctacagcgtggagaggcagcctagtataatgcaaggcacagag

SEQ ID NO: 28345 - DNA, 201 bp, Homo sapiens
agcaggtagttggtaattgttgaagctgtgtgatgagtgcacagggattcattatatcattctctttacttttgtttaggtttgaaatttttcactataaraagtttttgaaaataaggagccccagagagaattcctagaagatggcagaggaggaaaaagaggaacctatcttcccacctagataataattttaccagt

SEQ ID NO: 28346 - DNA, 201 bp, Homo sapiens
cccccacctgggccttccaaagcactgggattacaggcatgagctactgtgcccagccaaagagtaaagcctttgcagagatgttgttttgtttttaactrtagaatatctcaaacttatacaaaaatacatagaataatataatgaactctcaggtacacgtcacttagtttcaatgataatcaactagtgtcaaatatt

SEQ ID NO: 28347 - DNA, 201 bp, Homo sapiens
  misc_feature (1)...(201): n = A,T,C or G, or insertion/deletion polymorphism (see Tables 1-2)
aatgactgatattcaagccggtcgaagaacaagaaaatcaaacagtccagattcagcagaaccctgatccacccacgtgctttcaattacaactaaaaatngctggaacaattaaaaaagagtttgttggtacaaataactgtcaagtccagaggtagtattggttcaggcaaacatgatccagtggcctagagatggccc

SEQ ID NO: 28348 - DNA, 201 bp, Homo sapiens
gtctaacaggtacttcatactcaaaattcatcctctcttacaaacttactcttcttccagtgttttctattcatgaaatggcatcaccatccaaacactcrctcaaaccagagacatgtgtcactcttggcttctctctggcttcttaaccacagctggtcaattaccaagtcctatcaaatctaccttcctaaatacatc

SEQ ID NO: 28349 - DNA, 201 bp, Homo sapiens
  misc_feature (1)...(201): n = A,T,C or G, or insertion/deletion polymorphism (see Tables 1-2)
tcttcctgatatcttatgttagaaagtaagcattttcaagtctatttcatctcaatatctcttgacccacatccctgttcagttaccatacaccctctctngtctccatttcagtaactccttgaaaaaatttacctgccttcccaaacccatcttgataacatttccaggaacttccgtgttgctaaatctaatgcatac

SEQ ID NO: 28350 - DNA, 201 bp, Homo sapiens
ctctcctggaactctgaaaccctcagacttaaagagaatggttgacacaaattcattttagtggcctggccagatgtttgatggcctgatacatagcctcktgaatctgctcctgttcctgtcctttatggaccaggtcttaggtctgtcccttaattctgcagagtacctaatgcatttccaaaaaaatcattctctgct

SEQ ID NO: 28351 - DNA, 201 bp, Homo sapiens
ttcttatttagttcatttggtgaggtcctgtttttctggatggtcttgatgcttgtgaatattcatcaatgtctgggtactgaggagttaggtatttattmtaatcttcacaatgtgggcttgtttgcactcacatttctcgagaatgttttccaagtactcaaaggaaattgagtgttgtgatctaagtctttggtcact

SEQ ID NO: 28352 - DNA, 201 bp, Homo sapiens
ccgtaggaactgctattctttttctttataaacagcatgggatcaggtgattgattccatttgtcccctgatttgagccacacgaagataggagccaaaastgtagtttatcttcaggaactctttttgtttgtttgtttgtttgttctttgagactgagtttctctcttgttgcccaggctggagtgcaatggtgcgatc

SEQ ID NO: 28353 - DNA, 201 bp, Homo sapiens
tttcaaatagcctgtcttgaagctcactaatactttcttctgtttaagccattctgctgtagagagactctgatgcattcttcagtttctcaattgaattyttcagctccagaatttctccttgatttttaaaatttatttcaatttctgttaaacttatctaataggattttgaattccttttctgtgttaccttgaagt

SEQ ID NO: 28354 - DNA, 201 bp, Homo sapiens
atcccagcactttgggagactgaggtgggaggatcacttgagctcaggagttcgagaccagcctgggcaacataaggagacacccacctctacaaaaaaawttttttaaaaaaaatgagccaggtgtggtcgcaggtgcctgtggtcccaggtactcagtaggccaaggtgggaagattgcttcagcccaggatgtcgggg

SEQ ID NO: 28355 - DNA, 201 bp, Homo sapiens
agctggctgacctcgcacagccatcctgacagagggctcctggagggggacacacctggctgtgagcagcactggcctggggaaggttctgaggccccccyctttttttttttgtcatgcaaagaatagctatttagcgagctaggagagtgtcgtattggagcagatcatgaagcataaatgtaggctatttcatagcct

SEQ ID NO: 28356 - DNA, 201 bp, Homo sapiens
aggattctttctgcaggttggcagatttgttgaacactgagtctaagtaaaatgaaataagctctgaaggggaaaattgcaaaaatatggttttttttttkttttttttttttttttttttttttttgcactttaattcaaatagccatctccagtttggtctagcttaaaactaaaattttagtttttgtatttgccaaa

SEQ ID NO: 28357 - DNA, 201 bp, Homo sapiens
actttgggtaaaaaattaaaatgaaaagaaccaaagtgagatagcagaggaccctgtgagctgttgagcctgtgtgaacagagactagtggccctcatgghatgtggctgaatgagtggttggtaacgatctcctgctttctactatctgtttccttttcttcctcagtttttttcttaatctgcttccttgagaaaacaa

SEQ ID NO: 28358 - DNA, 201 bp, Homo sapiens
cagcctcccaagtagctgggactacaggtgcaaaccaccatgccccactaatttttgtggttttggagagatggggtttcaccatgttgccgaggctagtyttgaactcctgagctcaagtgatccacccacctcagcctctcaaagagctaggattataggcatgagccaccactccaagcatgcccatgtattttcaaa

SEQ ID NO: 28359 - DNA, 201 bp, Homo sapiens
ctggagtgcagtggcgcgatctcggctcactgcaacctccaccttccgggttcaagcaattctcccgcctcagcttcccaagtagctgggactacaggcgygtgccaccacacccagctaatttttgtaattttagtagagacggggtttcactatgttggcaaggctggtctggaactcctgaccttgtgatctgcccac

SEQ ID NO: 28360 - DNA, 201 bp, Homo sapiens
ttaaatgtcatgagccacacacacccacaatgactacagagtattctgttgttacacctgaaaaattcaacgcaatatttgctcagtatcctaaaaggcayaattgcaactttaccaaatgaagtgggaaatcgtagtcacaggtcagacattgagaaacaggcttctcaatgcctgtttatctaaaagaacaattccttg

SEQ ID NO: 28361 - DNA, 201 bp, Homo sapiens
gctacttgggaggctgaggcaggagaatcgcttgaacccaggaggcagaggttgcagtgagctgagattgtgccactgcactccagcctgggcaacagagygagacgccgtctcaaaaaaataaaaacaaaaaaaataaataaattaataaaataaaataaaaattcaagatgtacattattatggaagagaattcatggt

SEQ ID NO: 28362 - DNA, 201 bp, Homo sapiens
taagaggaagcagcaactagaatgtggtaccctttggatattcccctatgaaactctagaggtaagggttaaaatgcatcctctagagaagatgagttatgggtgaggcgttgccagtttttttctcagttctcatcttgattatgtttctatttgaaatttaaaaagcctatgatgatcatcttgctataaatggaactg

SEQ ID NO: 28363 - DNA, 201 bp, Homo sapiens
  misc_feature (1)...(201): n = A,T,C or G, or insertion/deletion polymorphism (see Tables 1-2)
atggactccaacagagtgctctgcaaaactgcctgggcatcaatcaggcacttttgtaccatactccattcattcagttttcattccgtcagtcaggagtntgttgccgtgtgccctctgtgggtcaggctcagtgctgtacttcaaaaacgaatacaagagaattcctaaaagaacccacagtgctctccctgtttcagt

SEQ ID NO: 28364 - DNA, 201 bp, Homo sapiens
gtattacccagtgtatgcctttgaatgttgcatatttacctattttgaagagactgcattcaagttttaaaaacaatgtcagcctctacctgttctactctttttttttttggagacgaagtttcactcttgctgcccaggctggagagcaatggcgtggtcttggctcaccgcaacctcctgcctcctgggttcaaacga

SEQ ID NO: 28365 - DNA, 201 bp, Homo sapiens
gattctcctgccgcagactcccgagtagctgggattaaaggcatgcaccactatgcccagctaattttgtatttttaatagagatggggtttctccatgtyggtcaggctggtctcaaactcccgacctcaggtgatttgcccgcctcagcctcccaaagtgctgggattactgcctgagccaccgtgccggctttacctg

SEQ ID NO: 28366 - DNA, 201 bp, Homo sapiens
gctagtattttgttaaggatttttgcatcaatgttcatcagagatattggcctatagtgttcttttttctttttgttcctttttccttttctttctctctytttttttttaatgtgtctttgtctggtgttggtatcagggtaatactgacttcatagaatgagtttggaagaattcactcctcctctattttttggaata

SEQ ID NO: 28367 - DNA, 201 bp, Homo sapiens
  misc_feature (1)...(201): n = A,T,C or G, or insertion/deletion polymorphism (see Tables 1-2)
gctggaacaaaagcctgggatctatggtgtggcgatctcagagtagtggtactcattccatagcagctgggttttcaagaaaaagcattctaagagacagnaagtagaagttgccaatttcttggggcctagctctggaaacggtcgtggagtcgcttttgccacactctcttggtcaaagtagtcacagagaaccccccg

SEQ ID NO: 28368 - DNA, 201 bp, Homo sapiens
aagatgatctcccttctttctccttgttccctcttgctcaaaatataaggatataaaatagagttctgatacacctttttctgctatctctaagaagtcartgttggccaggcatggtggccaacctcctgtaatctcagcactttgggaggctgaggcgggtggatcacctgaggtcaggagttcgggaccagcctgatc

SEQ ID NO: 28369 - DNA, 201 bp, Homo sapiens
ccactcggccctcctgttcatcctatgtgaggagcaggaaagagtgcagcaggaccatttcttgaggatggagcctgcacctggctagttgggttgtatamaataggctattatttctctcatatttgtggctgaggtgagattgcatgttcttagtttatatttccaagtacccactgtatgcctagcactgttaaggta

SEQ ID NO: 28370 - DNA, 201 bp, Homo sapiens
ctgagtttctcttaatttagacgtttatgtattgggttatttaacctctgagtctcattttccttatctgtaaaatggtgataatgatagtacctatctgrtaacgttgttttgagtatttaggtagtccatgtcttggtacctgatgtatagtaagctgccagcacttgtattgttatagctattattgttagccagttg

SEQ ID NO: 28371 - DNA, 201 bp, Homo sapiens
gtggcgtgatctcggctcactgcaagctctgcctcccaggttcacgccattctcctgcctcagcctcccgaggagctgggactacaggcgcctgccaccaygcccggctaattttttgtatttttagtagagacggggtttcaccgtgttggccaggatggtctcgatctcctgacctcgtgatccacccacctcggcctc

SEQ ID NO: 28372 - DNA, 201 bp, Homo sapiens
ggcaccactccagggctccaggctcctcgggcttccggagtcgagacgtggtggagttggctcgggctgaacttctttcggggggctgcctgtcctggaawcgtgcgacctttcctttgccatcctgcggttcagcaagccccgagtgcagttattccctccacccctcgccctatcttctcctcctccaggcaacttctt

SEQ ID NO: 28373 - DNA, 201 bp, Homo sapiens
cgccattctcctgcctcagcctcccgaggagctgggactacaggcgcctgccaccacgcccggctaattttttgtatttttagtagagacggggtttcacygtgttggccaggatggtctcgatctcctgacctcgtgatccacccacctcggcctcccaaagtgctgggattacaggcatgagccaccgcgcccggcctt

SEQ ID NO: 28374 - DNA, 201 bp, Homo sapiens
ctgccttttcttttctttttttttaagctggagtttcgctcttgttgctcaggctggagtgcaatggcgtgatctcgggtgactgcaacctccacgtcccrggttcaagccattctccctcctcagcctcccgagtagctgggattataggcacctgccaacaagcccagataattttttgtatttttagtagagacgggg

SEQ ID NO: 28375 - DNA, 201 bp, Homo sapiens
ctacttcaggttcaccaaagaaatggcaactctagaaaaaaaaagcaattcttattgaagttttgctttctcttcatttttttaaggaaattaaaatttgrtttgttgagtttttttaagtagaaaaaaattttaatttttgactaagcgtggtggctgacgcgtgtaatcccagcacttcgggaagccaaggcgggcaga

SEQ ID NO: 28376 - DNA, 201 bp, Homo sapiens
tggctcccccttgtcccttcacgggggctgccttgtagagaaatcattattcccaaagcaaattcagccctgcttttaccctcaaccttttctttctttctttttttttttttaatttgggggttgggggacaggagaatgcagtttgtcaaacaaaaatgctgactaagcctggcctcgggtcgccgaggcaacagggac

SEQ ID NO: 28377 - DNA, 201 bp, Homo sapiens
  misc_feature (1)...(201): n = A,T,C or G, or insertion/deletion polymorphism (see Tables 1-2)
gtttccatggaagcttacttcatccagtgcctgtctttgtctttgcttcagctgctttagtttcatccattttgactgctgctgtttggtctaagtcagangtttgcctttcatttttacccacgcaagggtagtggatgtcatgtggcagtccaaatcctactgggtctgggctttaattttatacctaaatttagttta

SEQ ID NO: 28378 - DNA, 201 bp, Homo sapiens
aactttcctcttactactgcttttgctgtatcccataggttttggtatgttgtgtttttatttttatttgtttcaagaaattttttcttttaaaaaaaaawttttaaattttaaattttttctcaatcaatgccatgccagaatttcaagaaatctttaaagttgtttcttgatttcttcattgattcactggtcattcag

SEQ ID NO: 28379 - DNA, 201 bp, Homo sapiens
taagtatttgattatttgcaatctagatgaacagaagtgagccaaagaccctttccagctagatttatttcagtataagttaacaatacagtttttttttwaatcaatcaggtctctcatggtttgtaacagtgcaaccaactctagtaactgaaaatttttatagccgatgacttcactaggacttgtctagacagcagc

SEQ ID NO: 28380 - DNA, 201 bp, Homo sapiens
gcttgaacctgggaggcggaggttgcagtgagccgagattgcaccattgcactccagcctcggcaacaagagtgaaactccatctcaaaaaaaaaaaaaagaaagaaaagaaaagagatgatgttcagggtgaaatgtgaataagatctatagtttagtaaataatattctacagtgtcagatttctgattttggtaattg

SEQ ID NO: 28381 - DNA, 201 bp, Homo sapiens
ttgtttcttttcttttgctgcttttaggatcctttctttatccttgacctctgggagtttgattattaaatgtcttgatatggtcttatttgggttattctttttttttttctgtcttctttgctttttttttttttttttttttgagataggttctcactctgtcacccaggttggagtgcagtggcatgatctcagctc

SEQ ID NO: 28382 - DNA, 201 bp, Homo sapiens
taggatcctttctttatccttgacctctgggagtttgattattaaatgtcttgatatggtcttatttgggttattctttttttttttctgtcttctttgctttttttttttttttttttttgagataggttctcactctgtcacccaggttggagtgcagtggcatgatctcagctcactgcaacctccacctcctgggct

SEQ ID NO: 28383 - DNA, 201 bp, Homo sapiens
atgaaaaccagaagtgattattaaagttggcctttggtgacctgggcaaaagcagggacagtggtgtgatctgggtgcaagttcagctgctgaggctaagygaagaattctgccaaatggagaaactagtgatcaggttgtatatgcccagaagctggctagattgttctttataaaataaagtaagctctagtaccccta

SEQ ID NO: 28384 - DNA, 201 bp, Homo sapiens
ggagtttcgctcttgttgctcaggctggagtgcaatggcgtgatctcgggtgactgcaacctccacgtcccgggttcaagccattctccctcctcagcctyccgagtagctgggattataggcacctgccaacaagcccagataattttttgtatttttagtagagacggggttttactgtgttggccaggctggtctcga

SEQ ID NO: 28385 - DNA, 201 bp, Homo sapiens
gaaaatggcatcttgtctcttgtacaactacaagttcatgattactatctcatattgttttctgacatttgaattcttggtcttgatacctgctttttccytctgaaagcttgttggattttctcctatttctaagggtctgacatttcacaatggtctattttcatccattgtctaggtattttgggggcgctatcaatc

SEQ ID NO: 28386 - DNA, 201 bp, Homo sapiens; identical to SEQ ID NO: 6952

SEQ ID NO: 28387 - DNA, 201 bp, Homo sapiens
atgtctcctctccttcctagaatggttccttatgctggctgcctctgttctggaggttgaatttggactgagaatagtgcttcattatataagcctttttycaaatctgtctgctttcagcataatattcccagtctttatcgtgcctagtgtcctagctctggcttagagaccctctgttatatcttctgcagcagtcac

SEQ ID NO: 28388 - DNA, 201 bp, Homo sapiens
attgaacagctgggttcaaggccttatactaggttcccaccagctgtttcaaagggatggagaggagccacccagagtgctttgcagcagctgtgaccccraaccaagggaagctttatttcgaaagcacactaagaatagatacaggctcctgattttaaaatacagcggacgattaaaagctttctgggtataaacagt

SEQ ID NO: 28389 - DNA, 201 bp, Homo sapiens
agcctaccctgggaaatggcttgcttcttggtttcccctgtgctgatttagaatttagccttcttagtttgttacgtgatatgcaaagtatcctatttttyagctcttaaaattttgttgctgtcattattttctcccccttttaatttgttaaaatccttttatttttaatttaatagaggtttgggggtaaacacattt

SEQ ID NO: 28390 - DNA, 201 bp, Homo sapiens
gcaattaaaaaaaaaaaaagaaagaaaactaagacgagggcatgtacaatcaattaaatagaagtaattacattatgagggcttcatgagtagtgtacggkgcattaacattgtggagacaaaagccaccagacagcacattgtatgtgcaagtcttttgaatctgaggttggttttcatggtcttctcgattctacgttg

SEQ ID NO: 28391 - DNA, 201 bp, Homo sapiens
aatggtttcattcaatggctccccctgcttccctagaattgggatttcatccaaaacactaaaggttaagttatcaatagaactcaaagagcattttgttwccatttgtataagtcgtttaatgttttttaagtccacgcatgtgttaacaaaggaggcagtcaattacaggggagcttagcaaggcattcttagagttct

SEQ ID NO: 28392 - DNA, 201 bp, Homo sapiens; identical to SEQ ID NO: 6955

SEQ ID NO: 28393 - DNA, 201 bp, Homo sapiens
attttttttgcttttatcaatttaatacattcacttactattattatctgccttcaaaaacatctgactttagggatgacagttttcactatcctggggarttaaccttaaaactaataagtgtctctatggtgcagccaaagttacaaagccagactgaagtctgcagataccaatgatggttggtctttgtttaaccac

SEQ ID NO: 28394 - DNA, 201 bp, Homo sapiens
aagtgtctctatggtgcagccaaagttacaaagccagactgaagtctgcagataccaatgatggttggtctttgtttaaccactaatcactaagagacctsactcccaggggtcttaaatgttagggtggaagatggtggatcagtctacggtacttacttcctgacagcaagtcagaaagttgatctttttttcatttaa

SEQ ID NO: 28395 - DNA, 201 bp, Homo sapiens
gataccaatgatggttggtctttgtttaaccactaatcactaagagacctcactcccaggggtcttaaatgttagggtggaagatggtggatcagtctacrgtacttacttcctgacagcaagtcagaaagttgatctttttttcatttaaatttaatttttattttactgtagtaagaacatttaacatgagagctaccc

SEQ ID NO: 28396 - DNA, 201 bp, Homo sapiens
ttaagtatgcaataccatattgtcaactataggcacaatgttgtacagcagctttctagaacttattcatctcacataactgaaactttagcaactccctrttttctcttcccctccttctgcttctataaatttgactattttaggtttttcctgtaagtggaatcatgcaatatttgtccttctgtggctggcttattt

SEQ ID NO: 28397 - DNA, 201 bp, Homo sapiens
tcctaaaaatacaaaattagctgggcgtggtggcgcatgcctgtaatgccagctactccagaggctgaggcaggagaattgcttgaacctgggaggcagasgttgcagtgagccaagatcgccccattgctccagcctgagtaacaagagggaaactccgtctaaaaaaaaaaaaaagagtctcaaggttatctagttgac

SEQ ID NO: 28398 - DNA, 201 bp, Homo sapiens
accaccatgcctggctaatttttgtatgtttagtagagatggggtttcaccatattggccaggctggtctcgaactccggacctcgtgatccgcctgcctyggcctcccaaagttctgagattacaggcatgagccaccatgcctgggcctacaatttttatgtgtgtgtgtgtgagagagaaagagataaagaaagacag

SEQ ID NO: 28399 - DNA, 201 bp, Homo sapiens
ggctcactgctgccttggcttcctcagctcaagcaatccttccacctcagcctccccagtagctgggaccacaggcctgcgcctaccatgcccagctaatttttttttttttttttttttttttgtagagacgaggtcttactatgttgcctaggccggtcttctactatgttgcctaggcttaagcaatattctcacctc

SEQ ID NO: 28400 - DNA, 201 bp, Homo sapiens
gctcactgctgccttggcttcctcagctcaagcaatccttccacctcagcctccccagtagctgggaccacaggcctgcgcctaccatgcccagctaatttttttttttttttttttttttttgtagagacgaggtcttactatgttgcctaggccggtcttctactatgttgcctaggcttaagcaatattctcacctca

SEQ ID NO: 28401 - DNA, 201 bp, Homo sapiens
ctcactgctgccttggcttcctcagctcaagcaatccttccacctcagcctccccagtagctgggaccacaggcctgcgcctaccatgcccagctaatttttttttttttttttttttttttgtagagacgaggtcttactatgttgcctaggccggtcttctactatgttgcctaggcttaagcaatattctcacctcag

SEQ ID NO: 28402 - DNA, 201 bp, Homo sapiens
aggcgggaggatcgcttgagcccaggagtccaaggctggaatgagctgtgatggtatcactgtactccagtttgggtgaccaagtgagaccctatttcttaaaaaaaaaaaaaaaaaggaaaaaacttcttccattaccatccatcctcttatatatctttttatagaaagattttttatataaacatttataaaaataaa

SEQ ID NO: 28403 - DNA, 201 bp, Homo sapiens
ctgaggaaactttgattacaaatctaaagtgagccttcattatttcagtatggaagctcatattttttttccttccttcattcctttatctcttcattcaktcaatcaatatttatttagtagaaaataacagacaggtaaatgggatgtgactgccttcagataacttgtatttttgcagaaaaggaaaaataattaact

SEQ ID NO: 28404 - DNA, 201 bp, Homo sapiens
ttccagggccttgcctttgtgccatctaaaagatctttagccagttcagctaatttacaactagaaatcatttgaacttggctgggcgcggtggctcacgmctgtaatcccagcactttgggaggctgaggcaggcagatcacctgaggtcaggagttcgaaaccagcctgaccaacatggagaaaccctgtctctattaa

SEQ ID NO: 28405 - DNA, 201 bp, Homo sapiens
gttttgctttctcttcatttttttaaggaaattaaaatttgatttgttgagtttttttaagtagaaaaaaattttaatttttgactaagcgtggtggctgrcgcgtgtaatcccagcacttcgggaagccaaggcgggcagatcacttgaggtcaggagttcgagaccagcctggccgacatggtgaaaccctgtctctac

SEQ ID NO: 28406 - DNA, 201 bp, Homo sapiens
aaaaaaaaagaaaaacaggctcaggtgccacctgtaagaggaaggagaactggaccctgccatgggagttaggcagagagggttcaggatcaggcctgaamcttctgatatgctgagaagccagtcctgaggttgcaggaggttatttgcttggaggctcgcccctgggagctaaccatcatgatcctgtgggaaagttaa

SEQ ID NO: 28407 - DNA, 201 bp, Homo sapiens
ggttttatgtaaccaacaggggataaaagcatgccatatggcaaattgagaacagaacaattaagagattatgttcggccaggcatggtggctcatgcctrtaatcccagcactttgggaggccgaggtgggcagatcacctgaggttgggagttcgagaccagcctgaccaacatggagaaaccctgtctcttctaaaaa

SEQ ID NO: 28408 - DNA, 201 bp, Homo sapiens
tgaggcaggagaatcgcttgaacccgggaggtggaggttgtggtgagctgatattgtgccactgcactccagcctaggtgacagagtaagactccgtctcaaaaaaaaaaaaaaaaactttatttgtggccgggcatggtggctcaagcctataatcctagcactttgggaggccaaggtgggcggatcacttgagaccag

SEQ ID NO: 28409 - DNA, 201 bp, Homo sapiens
tcccctcatcactatgtggtggggagcactttgcttacctggggacctcacccaggactattctgtgagaaagaaataggctttgattgtgttgagcagtkacatgctggacctatttgttattacaaatcagcttcataataacacaggaaataaaaaaattacaaacatttttaatgcagagaagtataatataaaaaa

SEQ ID NO: 28410 - DNA, 201 bp, Homo sapiens
tgtgagaaagaaataggctttgattgtgttgagcagttacatgctggacctatttgttattacaaatcagcttcataataacacaggaaataaaaaaattrcaaacatttttaatgcagagaagtataatataaaaaatgaataataagacctttaagcataataatatagtacattaagataaatatgtagaagtagaat

SEQ ID NO: 28411 - DNA, 201 bp, Homo sapiens
tttcctattgtccttttctttgtcttttagctttattttcctagtttctcaactttatcatataaactgtctaagttttaaaattccattattatatttcaaatttctaagagttattttttgttctttttatttcatcctattcttataacatctttttacttctctgaagatattattagcttttttaaaagcttttat

SEQ ID NO: 28412 - DNA, 201 bp, Homo sapiens
gctcttgggcagtgagtaaaaaaagagaattgacttcttttttttatctgtttctgtctactcatcaggccctggacaagtcacttcacctcttgcctcaytttcttttcttttcttttctttttttttttttttgagacggagtctcgctctgtcgcccaggctggagtgcggtggcatgatctcggctcactgcaagct

SEQ ID NO: 28413 - DNA, 201 bp, Homo sapiens
agtgagtaaaaaaagagaattgacttcttttttttatctgtttctgtctactcatcaggccctggacaagtcacttcacctcttgcctcattttcttttcttttcttttctttttttttttttttgagacggagtctcgctctgtcgcccaggctggagtgcggtggcatgatctcggctcactgcaagctccgcctcccg

SEQ ID NO: 28414 - DNA, 201 bp, Homo sapiens
agtaaaaaaagagaattgacttcttttttttatctgtttctgtctactcatcaggccctggacaagtcacttcacctcttgcctcattttcttttcttttyttttctttttttttttttttgagacggagtctcgctctgtcgcccaggctggagtgcggtggcatgatctcggctcactgcaagctccgcctcccgggtt

SEQ ID NO: 28415 - DNA, 201 bp, Homo sapiens
aaaaagagaattgacttcttttttttatctgtttctgtctactcatcaggccctggacaagtcacttcacctcttgcctcattttcttttcttttcttttytttttttttttttttgagacggagtctcgctctgtcgcccaggctggagtgcggtggcatgatctcggctcactgcaagctccgcctcccgggttcacgc

SEQ ID NO: 28416 - DNA, 201 bp, Homo sapiens
aaaagagaattgacttcttttttttatctgtttctgtctactcatcaggccctggacaagtcacttcacctcttgcctcattttcttttcttttcttttctttttttttttttttgagacggagtctcgctctgtcgcccaggctggagtgcggtggcatgatctcggctcactgcaagctccgcctcccgggttcacgcc

SEQ ID NO: 28417 - DNA, 201 bp, Homo sapiens
ggagtctcgctctgtcgcccaggctggagtgcggtggcatgatctcggctcactgcaagctccgcctcccgggttcacgccattctcctgcctcatcctcycgagtagctgggactacaggggtccgccaccaggttggacatcagcacctgtagaggggatagcactggatatggaaaacttagagtagatagtgaagga

SEQ ID NO: 28418 - DNA, 201 bp, Homo sapiens
atctgactcttatcttggcatctgcttcctggtggatctgaactgacccataagccacgcttactagtgattttccaggtaatcatctatttttattcatttttttttcttgattggtagtttgaacatgatattaaacacatttactgtataaatatagatatcattgttggccaatttgctgtaattgaactctccaga

SEQ ID NO: 28419 - DNA, 201 bp, Homo sapiens
aacacttctagaagcaatttaaaaagttttagcttaatatctatttattcccctgggacacattatagaccagattttctcttaaagattgtgtccatttktacataccccaaccattgactattaaattaatattgactattaaaaagagagtagccagcaaagttcctggtattcactgggcacgttaaaatttgctgt

SEQ ID NO: 28420 - DNA, 201 bp, Homo sapiens
ctgacaaatcttccaataaaataaattattttaactttctttagcccaacatttcccagtcttattagaccagggaacacttctagaagcaatttaaaaarttttagcttaatatctatttattcccctgggacacattatagaccagattttctcttaaagattgtgtccatttgtacataccccaaccattgactatta

SEQ ID NO: 28421 - DNA, 201 bp, Homo sapiens
tcaagaaaaggagaaatggtcatgcctgggcatttttgggtgctttgtttgaaatatgcatccacttggctgggtgtggtgcctcatgcctataatcccarcattttgggaggctgaggcaggtggatcacttgaggttaggagttccagaccagcctggccaacacagtgaagccccctctttactaaaaatacaataat

SEQ ID NO: 28422 - DNA, 201 bp, Homo sapiens
attctagcaggcgttccgggtttcctaggtttgtcgcagcctgttcctgagatctgggctgaggcatttaatcttccaatattcttcatctctaaaataastgaattagtctaaatcattggttttaaagtctgtcccaaagtcccatgctagaatctcagggggatgtgagcagaagctaaccttagtgttcagtttcca

SEQ ID NO: 28423 - DNA, 201 bp, Homo sapiens
  misc_feature (1)...(201): n = A,T,C or G, or insertion/deletion polymorphism (see Tables 1-2)
tggttttaaagtctgtcccaaagtcccatgctagaatctcagggggatgtgagcagaagctaaccttagtgttcagtttccaaaagctgggccctgttcantgtgttttaaacatttgtttaaagtttcagcatgacacttgagaaatgcctgaagggaaagcagagtgaaagcaagaccaagatgatttagagaagacag

SEQ ID NO: 28424 - DNA, 201 bp, Homo sapiens
ggtggctgaaaaacatgatcaaagaccctgatcattcctgtctctctgttcactcatcttcatcttcaggccagctgccctcttggttacaaaatggctgrcagagatctaggcatcaccctagatactccaatgttcagatgaagcagacagtagtttctcttgtatgtgtaatatgaataaagaaatatttccctaaag

SEQ ID NO: 28425 - DNA, 201 bp, Homo sapiens
atgccactgcactccagcttggtgacagagcgagactctgtcaaaaagaaaaaagaaaaaaaaaaaacaaaacccaaaacaacaacaacaacaacaacaamaaaaaactgtcaaatcaggaaacgttgggaagtatgtatcatgtagtcattggcaggatgggctacataatttgcgggacctagtgaaaaataaaaatac

SEQ ID NO: 28426 - DNA, 201 bp, Homo sapiens
aacatggagaaaccctgtctctattaaaaatacaaaattagccgggcatggtggcgcttgcctgtaattccagctactcaggaggccgaggcaggagaatygcttgaatccgggaggcagaggttgcagtgagccgagatcatgccattgcactccagactgggcaacaagagcaaaactctgcctcaaaaaaataaaaaa

SEQ ID NO: 28427 - DNA, 201 bp, Homo sapiens
  misc_feature (1)...(201): n = A,T,C or G, or insertion/deletion polymorphism (see Tables 1-2)
tgactgtagcgtaagaccccaccattgtcacctatgttgagatcttcctggttgtttagagaactaagcattttatgctgacttaaaagagtctggaaatnatggtctttttatctttccattcatagctccatcctatattcaatttagcaagtacagttccaaaattgtgggtggtctttacttcccaagtaagtggga

SEQ ID NO: 28428 - DNA, 201 bp, Homo sapiens
ttttagcccataaataattactcacttcagagagctagatagttgaccacaaactcaccaagagattcttgagcccttattttgcaagtctttccaccccragcttggacatagacaaaaataaatttgttggaggagggttgggtcagggtcagcagggagagctttccttctgaaaagtgcccttgaaattggaacttg

SEQ ID NO: 28429 - DNA, 201 bp, Homo sapiens
gaagtattttcattcaaaaaaaggctagaatttttaaagttctaaatatagaactcgtattataaaatttaagtgaagtaaaacatctcactactttccakttatattcgaacaaattttatgttatataaaaatggtttataaacctctccttgtttaaaaaaaattgttttcttagccttggtgaccattatgatgaat

SEQ ID NO: 28430 - DNA, 201 bp, Homo sapiens
ctggcagtggtgaaatagaaaagactgactaaaggtaaaaacttggactctgtacaaaggcctttggtgattttgggtaaaaaaggccaagtctctcccaygccaatggcttgtgttggaggctgtaaagttactcatttagcaaagctgaccagaaagtcaaagggaggattcattagcaaggttgaaatttaccactag

SEQ ID NO: 28431 - DNA, 201 bp, Homo sapiens
taagattatgtggtcacaaaggaggttcccttgtaagatgtggggttcttgtatatgtgggggtatattgtatatgtgtattgttcttgtatatgtggggrttcttgtatatgtgtataaccttgtatatgtggggttcttatttcttgttccacaaaaacaaaacccctggcagtggtgaaatagaaaagactgactaaa

SEQ ID NO: 28432 - DNA, 201 bp, Homo sapiens
ggttgaaatttaccactagattatgcttgtctttccagccaaacagaatgagacttcatggcagtctttttgtggggtgttcaaacactaatgaaaaaaawtttgaaaccaaggtgactttttggtgagtggagtgtctgagggagcttatgtggagaaatcaatgtaactattgcctcagtgttgtcagagaatttatta

SEQ ID NO: 28433 - DNA, 201 bp, Homo sapiens
gttgaaatttaccactagattatgcttgtctttccagccaaacagaatgagacttcatggcagtctttttgtggggtgttcaaacactaatgaaaaaaaawttgaaaccaaggtgactttttggtgagtggagtgtctgagggagcttatgtggagaaatcaatgtaactattgcctcagtgttgtcagagaatttattaa

SEQ ID NO: 28434 - DNA, 201 bp, Homo sapiens
tggtttggagggctctcttctccttggctccaaaccacaaattaacttttttgaccaggcatgaaaagtgtcctaacttgtgtctggacaatgctgagacagagagataatagtagagcccatatatacttgactcttgtcaccaagaaaaataagacaaggaagagcagtggcttgaacagctagtgtaaccagatctgt

SEQ ID NO: 28435 - DNA, 201 bp, Homo sapiens
ggtttggagggctctcttctccttggctccaaaccacaaattaacttttttgaccaggcatgaaaagtgtcctaacttgtgtctggacaatgctgagacagagagataatagtagagcccatatatacttgactcttgtcaccaagaaaaataagacaaggaagagcagtggcttgaacagctagtgtaaccagatctgtg

SEQ ID NO: 28436 - DNA, 201 bp, Homo sapiens
ctgaggcaggagaatggcttgaacccgggaggcggagtttgcagtgagccaagatgacgccactgcactccagcctggtgacagagcaagactctgtctcaaaaaaaaaaaaaaaaagaaagaaaggaaatttctaatttcccgttattatagatcatggtgcaatgagcaactctgcaatatgccctgatcattaacttc

SEQ ID NO: 28437 - DNA, 201 bp, Homo sapiens
ccgggcgcggtggttcactcctataatcccagcactttgagaagccaaggtgggtggatcacacctgagatcaggagttcgagaccagcctgaccaacatrgagaaaccccatctctactaaaatacaaaatcagccaggcatgatggcgcatgcctgtaatcccagctactcgggaggctgaggcaggagaatcgtttga

SEQ ID NO: 28438 - DNA, 201 bp, Homo sapiens
acaaactgcacagtacactaatgggtgctgaaagaggaatgggcaaaatcatctaaaggtcactatgctctcaacaaggaattgtggccttcttaggagcrgtttcataagaaaatttttttttaagatggagtctcgctctgttgcacaggctggagtgcaatggcatgatctcggctcactgcagcctccgcctcctgg

SEQ ID NO: 28439 - DNA, 201 bp, Homo sapiens
gttcctgtgggaacaccgtaggagacattaagtggtgtctaatactggaaagtgctctgtagatatacatttggagcttgtcagtgtatgaaaggtagtcmaagtcatgggaatggatgagtttgaccaagacactggataatgggaagacaatagagccaacaacagaattttgggatcactactttaatattacgtgcc

SEQ ID NO: 28440 - DNA, 201 bp, Homo sapiens
agaggcaggagaatcgtttgaacccgggaggcggaggttgcagtgagctgagatggagctattgcactcaagcctgggggacaagagggagacgtcactcaaaaaaaaaaaaaaaaaaattaaggcacaatacgtgaacttgaagaacatacagttctcttttatttaacaaacacttacgtaaccagcccggtgctgtgc

SEQ ID NO: 28441 - DNA, 201 bp, Homo sapiens
gtacaacgtgaatgtacttagtactactgaactgtacacttcaaaatggttaagataataaatgttatattaggtatattttaccacaattaaaaaaccarcaagcaaacaaaaccaaccaaccaacaaaacaaacaaaaaccaacaagaaaaaaaatgttgtcagtcatatttagaccatagtgagtctgcgttattgag

SEQ ID NO: 28442 - DNA, 201 bp, Homo sapiens
tggcaggtaggaggaaatatacagaatgaactgtgaaatttctcttgtctaaaatcattcacaaaaaatgggagatgatgactcagtagaactacaacgtrcagccactgggttagtgcccatgtagtcctaacattgtttggctgttaagagcttcatgtgatacctccaagtctagaaggactcaaccagagtatcagg

SEQ ID NO: 28443 - DNA, 201 bp, Homo sapiens
  misc_feature (1)...(201): n = A,T,C or G, or insertion/deletion polymorphism (see Tables 1-2)
ctgtagcgtaagaccccaccattgtcacctatgttgagatcttcctggttgtttagagaactaagcattttatgctgacttaaaagagtctggaaattatngtctttttatctttccattcatagctccatcctatattcaatttagcaagtacagttccaaaattgtgggtggtctttacttcccaagtaagtgggatac

SEQ ID NO: 28444 - DNA, 201 bp, Homo sapiens
atgaagactcagttttttgttgttttttttgagacacaatcttgctctgttgccctgcctggagtgcagtggcgccatctcggcttactgcaaccactgcmtcccaggcccaagtgattctcctgcctcaacctcctaagcagctgggattacaggcgcccgccaccatgcccggctaattttttgtatttttagtagaga

SEQ ID NO: 28445 - DNA, 201 bp, Homo sapiens
tccctcccactggactctagtactggggaccttgtttgtcttctttaaacgatagaagtgcaagttcaagtgaaatgacatttctagaagaatggaaattycttatttaagtgaagcccttttgagttcagatgggtatgtgataacagaaagagaagagcactcttgttcccagactagctacccactgctgcccaggct

SEQ ID NO: 28446 - DNA, 201 bp, Homo sapiens
aggactttcttcaatagagtcactgtgaggacagcagtgagctgacatcttcaccagccacacctgtaaaattgcttgcactgttcacactgaaggccgtrgtttcttgtctaccaagggttgagcccagctgggtgctagagctgagccattgctgcccatcgcgggacgcccctaagggtcagctgttgccttggaagc

SEQ ID NO: 28447 - DNA, 201 bp, Homo sapiens
agaggtctacctttgtctgttttcagaagggcaagtttaccttcagagtttccctggattacttttaatgtttcctttccttttccctcccactggactcyagtactggggaccttgtttgtcttctttaaacgatagaagtgcaagttcaagtgaaatgacatttctagaagaatggaaatttcttatttaagtgaagcc

SEQ ID NO: 28448 - DNA, 201 bp, Homo sapiens
gtgcggtggcatgatctcggctcactgcaagctccgcctcccgggttcacgccattctcctgcctcatcctcccgagtagctgggactacaggggtccgcyaccaggttggacatcagcacctgtagaggggatagcactggatatggaaaacttagagtagatagtgaaggaggaagaggataaatagcagttatggcct

SEQ ID NO: 28449 - DNA, 201 bp, Homo sapiens
aatcatctatttttattcatttttttttcttgattggtagtttgaacatgatattaaacacatttactgtataaatatagatatcattgttggccaatttrctgtaattgaactctccagaggggtttcaggatggttttgctttttctagaaattgtagcagggaagcagaggtctacctttgtctgttttcagaagggc

SEQ ID NO: 28450 - DNA, 201 bp, Homo sapiens
aagggcttctgggaccacagtcctctaacttagccaccccaccaagtttctaaccatacacctttgctgaaatcagtcattcagaccaagtcagcaacccrgaggtagggctgagaagcagctgaagctttcctgaggcaaaaatggcagatgaatagcaggggcaaaatccactgggttaggcatgtacagaacactcct

SEQ ID NO: 28451 - DNA, 201 bp, Homo sapiens
tgcaagctccgcctaccgggttcacgccattctcctgcctcagcctcccgagtagctgggactacaggcacccgccaccaagcccggctacttttttgtattttttttagtagagacggggtttcaacatgttagccaggatggtctctatctcctgacctcgtgatctgcccgcctcggcctcccaaagtgctggaatta

SEQ ID NO: 28452 - DNA, 201 bp, Homo sapiens
cgagtagctgggactacaggcacccgccaccaagcccggctacttttttgtattttttttagtagagacggggtttcaacatgttagccaggatggtctckatctcctgacctcgtgatctgcccgcctcggcctcccaaagtgctggaattacaggtgtgagccaccacgcctggccccagccctacatgatttctaaac

SEQ ID NO: 28453 - DNA, 201 bp, Homo sapiens
aatatgaaataggagctaggcttgcctaatatctgaggaaaactagacgaaaaagaccctgaaacaaaagcaaaacaaaaaaattcctttatacattgtgttttgaatgattggagtagctcagaactgcctgtgaacaagggcaaaagtggaagttagccttggatttagagaaagttgctgtgatctctctgcccatcc

SEQ ID NO: 28454 - DNA, 201 bp, Homo sapiens
ttgggcagaggatacccaactccatctgagaagtgtctagtttttattgtttggaatctagattgtcactacaaattgagctgtttttgtgtgtgggataggggaggaagaggaaatggagaagggggagatgagcaggaaaggtaattgacatttgttgattacctgctgtatgccagacaaggcagagagtgagagtca

SEQ ID NO: 28455 - DNA, 201 bp, Homo sapiens
actaatcttatcactttggggggccgaggtgggaggattgcttgaggccaagagtttgagacaagcctgggcaacatagcgagattctgtctctacagaatttttttttttttttttttttgagatagcgtttcactcttgtcgcctaggctggagtgcaatggcgccatctcagctcacggcagcctcctgctcccaggt

SEQ ID NO: 28456 - DNA, 201 bp, Homo sapiens
tctgccacttcatttattttatttgcaggaggagttgaaaccaattttaagggagattttcattttccccctaaacatgaatcattcaagtaaaaccaacttaactatagaaatgtagcaaagtaaggggaaagcagcacaacaacccaagaggcaaaggctggggggaaggggtgggtgcagtctgcgtataacatatgc

SEQ ID NO: 28457 - DNA, 201 bp, Homo sapiens
ctgccacttcatttattttatttgcaggaggagttgaaaccaattttaagggagattttcattttccccctaaacatgaatcattcaagtaaaaccaacttaactatagaaatgtagcaaagtaaggggaaagcagcacaacaacccaagaggcaaaggctggggggaaggggtgggtgcagtctgcgtataacatatgca

SEQ ID NO: 28458 - DNA, 201 bp, Homo sapiens
gcttcctcttctcctcctactcttcctcttcgtcctccttcctcttcttcttctccttctctttctccttctccttctccttctcctccttcttcttcttmttctccttctatatattgtaccttaacttcgtttttacccaccactttaaagtattttgttctatgacagcagctagagatcttaatacgttactccatt

SEQ ID NO: 28459 - DNA, 201 bp, Homo sapiens
actccacgtgatacatggctgcacagaaaaggggaacacaggtgatcggaaaggccttaaactcctccttgacatacaaaaccgattttcacaaagatccwggcagtttggtcccaaactaaggtgaacacttcaaagtttattcacatgctttactttctcttttaagaatcatcgtttcccaaattaaattagatttaa

SEQ ID NO: 28460 - DNA, 201 bp, Homo sapiens
gcttggtcatcaatgtcagagagcagtcatagagagtactcatgagctttgtaatcagacgtactggtttgaatcatggatctgccacataatgagcttasataacttcaggaagcacgtttcctcgttggtaaagtgggaactaccttgcctgtttccttagagtcagagctatgctagaaactacgtggccttggggca

SEQ ID NO: 28461 - DNA, 201 bp, Homo sapiens
gctaggttgtttatttaaaaaaaaaatattcatttgtgatggcttttctgcagatattaaaatactgaatatctttctcctagtttgcacttgcaaagcayttcttagcctaggttttcaaaggggcacctgggcacctatcatagttgaggctgcaactgtgtgtgataacccatcagaaaggagaaaacccaagcaaat

SEQ ID NO: 28462 - DNA, 201 bp, Homo sapiens
gtttgtttttaaaaagctggcttttgttataaaaataatacatactcttaccaaaaagtccaaacagaactgaaagttataaagtgaaaagtaggggctgrgcagtggctcatacctgtaatcccagcattttaggaggccaaggcaggtggatcacttgaggtcaggagtttaagagcagcctggggccaggcgtggtgg

SEQ ID NO: 28463 - DNA, 201 bp, Homo sapiens
agaggatttgcactttctccttttcttcagaatgtgtatctgcctaagcagtgggataacttttttcccagactggatcgatattccttagctggtcctgytgcagcaggagtccggtgactggagagaggaagctcttgggcagtgagtaaaaaaagagaattgacttcttttttttatctgtttctgtctactcatcag

SEQ ID NO: 28464 - DNA, 201 bp, Homo sapiens
cctcatttacataaccagccacaaactgagttgaaaggactcctgcaagaggatttgcactttctccttttcttcagaatgtgtatctgcctaagcagtgkgataacttttttcccagactggatcgatattccttagctggtcctgttgcagcaggagtccggtgactggagagaggaagctcttgggcagtgagtaaaa

SEQ ID NO: 28465 - DNA, 201 bp, Homo sapiens
tttttccagtggtagtcaattctcaacttatttcttcttttaactgatttttaatttttattttttttaaaaaacagagacagggtctcactatattgccyagactggcctcaaactcctgggctcaagtaatcatcctacctcagcctcccaaagtgctgggattacaggcgtgagccactgtacctggcctatttcttc

SEQ ID NO: 28466 - DNA, 201 bp, Homo sapiens
taggcttaagcaatattctcacctcagccttccaaagtgcgctgggattataaacatgagccatcatatccagccaaattctttattttcaccttccattkcaaaacagcctatcttctccttacctgtcttgactcttaccttggtacctccaaaatcttgagacctctggggaataggggagggggaaacaaagggacc

SEQ ID NO: 28467 - DNA, 201 bp, Homo sapiens
cacccaggctcaagtgcagtggcatgatcatggctcactgctgccttggcttcctcagctcaagcaatccttccacctcagcctccccagtagctgggacyacaggcctgcgcctaccatgcccagctaatttttttttttttttttttttttttgtagagacgaggtcttactatgttgcctaggccggtcttctactat

SEQ ID NO: 28468 - DNA, 201 bp, Homo sapiens
cttttgcaggcattttccccaatacatctctgctcatctgactcttatcttggcatctgcttcctggtggatctgaactgacccataagccacgcttactrgtgattttccaggtaatcatctatttttattcatttttttttcttgattggtagtttgaacatgatattaaacacatttactgtataaatatagatatca

SEQ ID NO: 28469 - DNA, 201 bp, Homo sapiens
tttcaccatattggccaggctggtctcgaactccggacctcgtgatccgcctgcctcggcctcccaaagttctgagattacaggcatgagccaccatgccygggcctacaatttttatgtgtgtgtgtgtgagagagaaagagataaagaaagacagacagagagagagagagagacagagacagagagagagagacagtg

SEQ ID NO: 28470 - DNA, 201 bp, Homo sapiens
agccctccttcctaccctcctccttcactattgacagacgtgcattgcaatctgaatactctcctagcttactcaccttctttctcctctttaacttttgyaggcattttccccaatacatctctgctcatctgactcttatcttggcatctgcttcctggtggatctgaactgacccataagccacgcttactagtgatt

SEQ ID NO: 28471 - DNA, 201 bp, Homo sapiens
cgcttgaacccaggaggcagaggttgcagtgagctgagattgtgccactgcactccagcctgggcaacagagcgagacgccgtctcaaaaaaataaaaacaaaaaaaataaataaattaataaaataaaataaaaattcaagatgtacattattatggaagagaattcatggttttatttttttcagaattggcatagaca

SEQ ID NO: 28472 - DNA, 201 bp, Homo sapiens
gaggcagaggttgcagtgagctgagattgtgccactgcactccagcctgggcaacagagcgagacgccgtctcaaaaaaataaaaacaaaaaaaataaatwaattaataaaataaaataaaaattcaagatgtacattattatggaagagaattcatggttttatttttttcagaattggcatagacaatcctgaatttct

SEQ ID NO: 28473 - DNA, 201 bp, Homo sapiens
aaaaataaataaattaataaaataaaataaaaattcaagatgtacattattatggaagagaattcatggttttatttttttcagaattggcatagacaatyctgaatttctaacggtttatgtgtgaaaatgtttttttaaagtcaaatattttaacttaattatatttttaaatgaatactgagtgcatggaaaaatata

SEQ ID NO: 28474 - DNA, 201 bp, Homo sapiens
ctgaatccaaggctattattgccataaatttcgatggggatagtaaggaaagaataatgataaactcagacccactttagtgggttactgaatcgagcacattattattattattattttgagacaaggtctcactctgtcacccagactggagcgcagtggtgtgatgtgagcttactgcagcctctgcctctcgggctc

SEQ ID NO: 28475 - DNA, 201 bp, Homo sapiens
acttgaacctgggaggcggaggttgtagtgtgccaagatcacgccactgcattctagcctgggcgacagagcgagactcaatctcaaaaaaaaaaaaaaaggggggggggggaggcggggataatgataatgttttataagtgttttgtaggtatcaatttatctaatttcacaataatcctataagtagtataattaaac

SEQ ID NO: 28476 - DNA, 201 bp, Homo sapiens
tgaatccaaggctattattgccataaatttcgatggggatagtaaggaaagaataatgataaactcagacccactttagtgggttactgaatcgagcacattattattattattattttgagacaaggtctcactctgtcacccagactggagcgcagtggtgtgatgtgagcttactgcagcctctgcctctcgggctca

SEQ ID NO: 28477 - DNA, 201 bp, Homo sapiens
cttgaacctgggaggcggaggttgtagtgtgccaagatcacgccactgcattctagcctgggcgacagagcgagactcaatctcaaaaaaaaaaaaaaaggggggggggggaggcggggataatgataatgttttataagtgttttgtaggtatcaatttatctaatttcacaataatcctataagtagtataattaaact

SEQ ID NO: 28478 - DNA, 201 bp, Homo sapiens
gaatccaaggctattattgccataaatttcgatggggatagtaaggaaagaataatgataaactcagacccactttagtgggttactgaatcgagcacattattattattattattttgagacaaggtctcactctgtcacccagactggagcgcagtggtgtgatgtgagcttactgcagcctctgcctctcgggctcaa

SEQ ID NO: 28479 - DNA, 201 bp, Homo sapiens
tacctgggaggctgaggcaggagaatcacttgaacctgggaggcagaggttgtggtgagccgagatcgtgccattgaactccagcctgggcaacaggagcraaactctgtctcaaaaaaaaaaaaaaaaaaaagaaaagaaaagaaaaccagcaaaccaaaagaaaggacactgattttcagagttaccacattattagat

SEQ ID NO: 28480 - DNA, 201 bp, Homo sapiens
gctataaaaacatcctctgtcatgtggagtagataagatactctatgttgttttaaagaagtcttttacaaagaagatgagtgtgtgtgtgtggggggggrgcggtggaggaggggtgcagaagaacatatgagatccagctccccagaggatcttccttaaggcacttggaactaagtttgaaggcactgcccacaaatt

SEQ ID NO: 28481 - DNA, 201 bp, Homo sapiens
gaggcaggagaatcacttgaacctgggaggcagaggttgtggtgagccgagatcgtgccattgaactccagcctgggcaacaggagcaaaactctgtctcaaaaaaaaaaaaaaaaaaaagaaaagaaaagaaaaccagcaaaccaaaagaaaggacactgattttcagagttaccacattattagattcaaatatccaat

SEQ ID NO: 28482 - DNA, 201 bp, Homo sapiens
gccttgaattcctggggtcaatctatcttcccacctcagcctcctgagtagctgggatcacaggcatatgaaccaccatgcccagctaatttaaaaaaaattttttttttttgtacagatggggtcttggttcactgcccaagctggtctcaaactcctgacttcaagcgatcctcccaccttggcctcccaaagtgttgg

SEQ ID NO: 28483 - DNA, 201 bp, Homo sapiens
tggggccaggcgtggtggctcacacctgtaatcccagcactttgggaggccgaggcgggcagatcacgaggtcaggagatcaagaccatcctggctaacayggtgaaaccccatctctactaaaaatacaaaaaattagccaggcgtggtggcgggcacctgtagtcccagtgactcgggaggccgaggcaggagaatggc

SEQ ID NO: 28484 - DNA, 201 bp, Homo sapiens; identical to SEQ ID NO: 6945

SEQ ID NO: 28485 - DNA, 201 bp, Homo sapiens
attccaggctgggccacagagcaagactctgtctcaaaaaaataagtaaaaaaagaagtgaacagtaaaagtactgcccacctccctgccaccaccacccygcaaccccaagacacacactaggtttactcctcagaagtaactactgttcccagttacttgtgttatcttccaaggatttattatgcatatatgtatata

SEQ ID NO: 28486 - DNA, 201 bp, Homo sapiens
catatatgtatatatgacttgactgataaaaacagcattagtttgtttttgcattgtgggaagtctctgttactggttgagcctcacataacctcaggacygggtagagtacagacatggattaaattctggagaactggatgcaatgcctgatgggatgtctcagggtgaaaagccttatcggggtaaccatgatctaga

SEQ ID NO: 28487 - DNA, 201 bp, Homo sapiens
catcactaataatagctcagatcctttcctcaatgggtaagttaatatttgggggccacttatttttattctctttattatgtgatctagactataatagratctttgtttacattgggaagaggtggggagcttgagggttgagggtgagaataaagggaggaagtgggaggagctggcagaaaaaagaaaagcagggga

SEQ ID NO: 28488 - DNA, 201 bp, Homo sapiens
gatccgcttgcctcagcctcccaaagcgctgggactacaggcgtgagacccggcacccagcagtttccagatttctaataaggcagtgaatttctcaagargcacattctggggtttttccaacaatatttgtgtatttgcccattgcaaagtgtgtttctagcttatggagaatcacagatgtgtctgaaggatggaaat

SEQ ID NO: 28489 - DNA, 201 bp, Homo sapiens
tacaaaattagctgggcgtggtggcgcatgcctgtaatgccagctactccagaggctgaggcaggagaattgcttgaacctgggaggcagacgttgcagtragccaagatcgccccattgctccagcctgagtaacaagagggaaactccgtctaaaaaaaaaaaaaagagtctcaaggttatctagttgactgaggaggg

SEQ ID NO: 28490 - DNA, 201 bp, Homo sapiens
tgggcggatgacctgaggtaaggagttcaagatcagcctgaccaacatggtgacaccccgtctctcctaaaaatacaaaattagctgggcgtggtggcgcrtgcctgtaatgccagctactccagaggctgaggcaggagaattgcttgaacctgggaggcagacgttgcagtgagccaagatcgccccattgctccagcc

SEQ ID NO: 28491 - DNA, 201 bp, Homo sapiens
ctcttctaagattcccctgaggaggaaaggcccacagcaaccttggatgaactgcgccctgaaaaatggagaagtcagcctgtgtgatgcagtctgtacgsactgtgataaaaaccatgtgggtaaatgcttaggactttcttcaatagagtcactgtgaggacagcagtgagctgacatcttcaccagccacacctgtaa

SEQ ID NO: 28492 - DNA, 201 bp, Homo sapiens
tcccgggttcacgccattctcctgcctcatcctcccgagtagctgggactacaggggtccgccaccaggttggacatcagcacctgtagaggggatagcaytggatatggaaaacttagagtagatagtgaaggaggaagaggataaatagcagttatggcctcaagaccaactacagcggtaggggctgtggtttgtctc

SEQ ID NO: 28493 - DNA, 201 bp, Homo sapiens
ggatttagattcaattggatatttcaaagcaaattgcaatagtttattttaaaatatctatattaataacatcatgaaaattacaacctttgcaattattyaaacatacgatgtaatattttagatgtcaactgaaaattttgtgaaggagtacatggttttaaaacattctgttaggggatatgccagcagaaacttttg

SEQ ID NO: 28494 - DNA, 201 bp, Homo sapiens
ggaggatgtattagttttgggttttttaggttggtttttagagaagtattaggaagttcccaaggggattgaccttgtagtttcaagaaaaggagaaatgrtcatgcctgggcatttttgggtgctttgtttgaaatatgcatccacttggctgggtgtggtgcctcatgcctataatcccagcattttgggaggctgagg

SEQ ID NO: 28495 - DNA, 201 bp, Homo sapiens
agccaaagaatagaattatataatattttaaaaagtaaaaaaaaaaataatttttttcatattctgggtcattgtagctttgtttacaaggactttacatrttgaagaattggaggatgtattagttttgggttttttaggttggtttttagagaagtattaggaagttcccaaggggattgaccttgtagtttcaagaaa

SEQ ID NO: 28496 - DNA, 201 bp, Homo sapiens
gtgttgaactaacattaggtttctttaaatctgctattaaaacgaagagtggccatttgtaactttaggagcataagagctgggttcatgatgtaagtgarcagagacacccttaaagttatttcccaaggccctgggaatgcgattttcttagtttatttgttacaagggagtgttttgtacattggtagaggaaaatac

SEQ ID NO: 28497 - DNA, 201 bp, Homo sapiens
gtataccacaaagagtgaattttactgtatgtaaacaaaaagaataataaaagaaaacgaattgctacacacaaaaagacaaaacgtatgtttatggtacrgaatgtataaaatactaaacaacaaagaaggaaattataatcacctatactcttacctagaaagagtggctgtaaatatgctgatgatttctttctagtc

SEQ ID NO: 28498 - DNA, 201 bp, Homo sapiens
atgaaaacaggcatatggctttacctgaagagagtatttcttttcatgtgtgttattcatttaaatataacggtttggggccatctttctggaagattttracctcgaggaccaggacctggaagacgagtaagtggcaaagccttggctcccccttgtcccttcacgggggctgccttgtagagaaatcattattcccaa

SEQ ID NO: 28499 - DNA, 201 bp, Homo sapiens
tgttttgttccagaaattatacacttatccactgtgctgcctcttacgggcagtacctgatacatacaagacatctgtaaatgttatttaatctgaagctyttgttggaatggctgggacaacagcaaatcttttgaattattcactattacatcttatatgctatttgggaactgggagtttttcagttatcctgtgtta

SEQ ID NO: 28500 - DNA, 201 bp, Homo sapiens
tccttgcccatccagttccaacccagattctcactgcccatctaattccaaccctgattctcacctttcttcgggagtgaggactttcctagagtagggcrggcctcaagttttcatcttttaatcatcaagtcagccttgtgacttctgaattagtatcattaggttccagtcacttcctcttgttcgatagcttatttc

SEQ ID NO: 28501 - DNA, 201 bp, Homo sapiens
atatgacttgactgataaaaacagcattagtttgtttttgcattgtgggaagtctctgttactggttgagcctcacataacctcaggaccgggtagagtayagacatggattaaattctggagaactggatgcaatgcctgatgggatgtctcagggtgaaaagccttatcggggtaaccatgatctagagactgggattt

SEQ ID NO: 28502 - DNA, 201 bp, Homo sapiens
ccatgccagaatttcaagaaatctttaaagttgtttcttgatttcttcattgattcactggtcattcaggagcattgtttaatttccatgtgtttatatasttttcaaagttccttatgttattgatttctcgttttattccattgtgaacagagaaaatacttaaaatgattgcagtgttttcatagcctaataaatggt

SEQ ID NO: 28503 - DNA, 201 bp, Homo sapiens
aggcagcgagtaaagcaggaggaaaggaagatttgcagattgctggctgtataatgtcagggctggtggcgcctctaattgtagcaagccgtactgggagscttggaagaagtggagaaattatttaacatattgagtttgaagtgactttaagatgcccaagggaggaaaatggggtgtagtggaatgtgtataattatt

SEQ ID NO: 28504 - DNA, 201 bp, Homo sapiens
tttgtattgttttttaaatttcatttttgtttatttctgctctgatctttattatttattctactaattttgggtttggtttgctcttgcctttctggttytttaagatgcatcattaagttgtttatttgaagtttttcctctttcttgatgtaggcatttattgctataaactttcctcttactactgcttttgctgta

SEQ ID NO: 28505 - DNA, 201 bp, Homo sapiens
aggagcttagggaaaaaacatctgactgttaaaaaagagctcatttgtagacttttaaaatggatgtggtgggcatcaaatcgcttggatttagattcaaytggatatttcaaagcaaattgcaatagtttattttaaaatatctatattaataacatcatgaaaattacaacctttgcaattattcaaacatacgatgta

SEQ ID NO: 28506 - DNA, 201 bp, Homo sapiens
ccaggcctggtcccatgaaatatcttctgtgcttttctttgctttttctccttctaccagctacacgaattgagaatgaggctctaggaaagcggttggcraactttggtaaaaagccagacagtaactattttgggctttgcggccacataaagcctctgatgcacattctactggttgtttttttgtttgtttgtttgt

SEQ ID NO: 28507 - DNA, 201 bp, Homo sapiens
cttccaggcctggtcccatgaaatatcttctgtgcttttctttgctttttctccttctaccagctacacgaattgagaatgaggctctaggaaagcggttrgcgaactttggtaaaaagccagacagtaactattttgggctttgcggccacataaagcctctgatgcacattctactggttgtttttttgtttgtttgtt

SEQ ID NO: 28508 - DNA, 201 bp, Homo sapiens
tctgcaacctcctgaaggcacctttcctgagcattcacagctttcctgtggtgttcaggtgtcctgtggtattcagatattcctttagagtaacaatgacyagggcatggtggtgcccacctgcagccactaccacccccaccccatctctaaataaaaagtttttaaaaattagagtaacagtgaagcagattgaatgtt

SEQ ID NO: 28509 - DNA, 201 bp, Homo sapiens
aaagcgtcaactttctttaaaaataataggaccctctcaggctacaaatataaggagaagggaaggagacccaccctggagagttttggaggtgaaccccrctgtgatttcatggacaacatggatatctctgtttggtttaatacaaactttgaccagcttgatttgggggcctcctgtagccatagcacacactcttca

SEQ ID NO: 28510 - DNA, 201 bp, Homo sapiens
atttaatacattcacttactattattatctgccttcaaaaacatctgactttagggatgacagttttcactatcctggggaattaaccttaaaactaatargtgtctctatggtgcagccaaagttacaaagccagactgaagtctgcagataccaatgatggttggtctttgtttaaccactaatcactaagagacctca

SEQ ID NO: 28511 - DNA, 201 bp, Homo sapiens
aagctggggaatataggcttttgtagaggagtatgcttctcttctagaccagagaggtttgttcattctggagcactcaaagcaaccaactccaacttcamcaaagtagaaaaaccagcctcttaacaaagaaattctttgcagtccttggttcccatggccaattttaaagtcaaaagacctcaatacattttttttgct

SEQ ID NO: 28512 - DNA, 201 bp, Homo sapiens
catgccaatgagctgtatcacttcagagttaaccaaagaaagaaatgtaatgggggatggagaatgtaattagagtggagtacaaggggggggtggggaabctttgtaactaaattattagcattatcatgaagaaactgtcttttgaattgtttttaagctaaagaaatcataaagcagtgtttttatgtgactatgtaa

SEQ ID NO: 28513 - DNA, 201 bp, Homo sapiens
ctgttaaaaaatttccaaattaaaaaattggtgataggacgtagagtaaacccctagtcaagaatttgaaaatgggcatgaacttatatttttaaacatgrtggtgtcgtctagtacttatacttggaagaatcttctggttttatgtaaccaacaggggataaaagcatgccatatggcaaattgagaacagaacaatta

SEQ ID NO: 28514 - DNA, 201 bp, Homo sapiens
taatgtctgctgtgtgtaaggccttctgcatttagtccatagttggggctactgagaagttgaaagctgctttaaagtctcctttcattttaacaccattaaaaaaaaaaaaaactcatggaaaggaaaaatctaaatgtatcctgtaaagaaaataccatttcctctggtaattatgatggtctatatcctgtttaactc

SEQ ID NO: 28515 - DNA, 201 bp, Homo sapiens
tctgcattttacaattttttttttcaccgtgagtgtggattttctttcaccatgaacatggattatttgattgttgaaaaataacaaaagcccagctgggygtagtggctcacaccactaataccagcactttgaaaggtggaggcaggcaggtcgcttgagtccaagatttcgagaccagcctgggcaacagtgagacct

SEQ ID NO: 28516 - DNA, 201 bp, Homo sapiens
gcccccggcctttttttttttttttttaatcacatttattctaaaaccttagacctttagacccaagttttcacgcaaggcaatggatgagttccccttgrcaataccttcaagtcttgcattaagaaatctgaataacaattttagcagaggaagcatttaaaaatgaggagacagactgaaaagaaaacaagacaaata

SEQ ID NO: 28517 - DNA, 201 bp, Homo sapiens
  misc_feature (1)...(201): n = A,T,C or G, or insertion/deletion polymorphism (see Tables 1-2)
tgtcagcatatcccaactgagccgaaaagtttatgccacattaggaattaaatggtagagaaaaatagcattttaaaaatattaccccacagtggtttacntgtaaagttccttcaaaattttccttctgaaattttcctgtttttttttaaagactaaatatatctttcttgctgagctataagctataaaacaatttta

SEQ ID NO: 28518 - DNA, 201 bp, Homo sapiens
agtggaaatcatgtatgtcacttccaggcctggtcccatgaaatatcttctgtgcttttctttgctttttctccttctaccagctacacgaattgagaatraggctctaggaaagcggttggcgaactttggtaaaaagccagacagtaactattttgggctttgcggccacataaagcctctgatgcacattctactggt

SEQ ID NO: 28519 - DNA, 201 bp, Homo sapiens
tcccacaatttgttccaccctccttcgggtacgtaggtagcctacttttccccatcatccttgctgtaacatgtagtcatgtaattgttctggcaacaacwtgtgagtggaaatcatgtatgtcacttccaggcctggtcccatgaaatatcttctgtgcttttctttgctttttctccttctaccagctacacgaattga

SEQ ID NO: 28520 - DNA, 201 bp, Homo sapiens
ataaagtgggagtgatatgctcacggcagagttgtgaggagtcatgagatcacagagaccagctcaaagtgctcttctccagtaagaagactgatgtcatrcatacaatggacttgataatgtcagagtgccacgttaacctggttaagtgagaatcagctcattgagtgtgggaatgtgagtgccaagttaacctggtta

SEQ ID NO: 28521 - DNA, 201 bp, Homo sapiens
tggcctggggaaggttctgaggcccccccctttttttttttgtcatgcaaagaatagctatttagcgagctaggagagtgtcgtattggagcagatcatgwagcataaatgtaggctatttcatagcctttgcttcagaacaggggactatttaacttttagaaaagcatttcatagcattaggtttcagagttgactggg

SEQ ID NO: 28522 - DNA, 201 bp, Homo sapiens
tgaggcaggaaaatggcttgaacccaggagatggaggttgcagtgagccaagatcatgccactgcactccatcctgggtgacagagcaagactccatctcaaaaaaaaaaaaaaatttagatatttgttgagaaactaatatgtgctaactgtgcaggctctggtgatggtggttgtgtgtgtgtgcacatttgtgtgtgt

SEQ ID NO: 28523 - DNA, 201 bp, Homo sapiens
tgttgatgtctgagatgtgatgcctggaaatagggctactatgttgtgaccatgaatggatctagcctgaaaaccaagctcgaatactccaagaatggtasagcagagatagaacaaactggagtcatttatgtcattgtggggcactgcatcagccaaacataaaggtgctctacttggtaacctcttgctatttgagat

SEQ ID NO: 28524 - DNA, 201 bp, Homo sapiens
ccaaccctggctctgggaattttctccatactggttcagcaagtcagggcaggttctgccccaagggcttctgggaccacagtcctctaacttagccaccmcaccaagtttctaaccatacacctttgctgaaatcagtcattcagaccaagtcagcaacccggaggtagggctgagaagcagctgaagctttcctgaggc

SEQ ID NO: 28525 - DNA, 201 bp, Homo sapiens
tttctttctttctttttttttttttaatttgggggttgggggacaggagaatgcagtttgtcaaacaaaaatgctgactaagcctggcctcgggtcgccgrggcaacagggacgagaaaagagggaggcctcggaattcttttggcaggtctgtgggatttctgccaggcttgacagccaccaggcgcggcgggccagctg

SEQ ID NO: 28526 - DNA, 201 bp, Homo sapiens
aggtgtgtgtgtgtaacccagtgtagtcaatgagacatagagaaaagttgcctaggaggtctttgggaaagatttcttcactctattatttatatatatakagagagagatggtgtcttgctgtatgtattgcccaggctggagtgcagtggctattcataggtattcattggtatgaccatagccttgaactcctggcct

SEQ ID NO: 28527 - DNA, 201 bp, Homo sapiens
agtgaaacatggcaacaaaagagtaaatgcaaaaatgagtggcagcaccaattattttttatttaggtatttgcatatttgctatatgctggacactgtgytaaacacttgggatatggtaaattctgaaaacacaagtatcacgtttgatttgtcaaggaactggtcaactcttatcctcatgttgaaccttattcaata

SEQ ID NO: 28528 - DNA, 201 bp, Homo sapiens
tcattaccaccaaggcactcattaccaacaagggcagtaaaggaatcgcagctttggctgcctctcacactgaatctgagagttgctattattagaatgcaaaaaaaaaaaaattgtggggtgctggtgggggaactatgtgagacttgtggttagctagacctgtgttttaagaatatttttgtctctgagtcaattgtt

SEQ ID NO: 28529 - DNA, 201 bp, Homo sapiens
gtagtcccagctcctcagaggctgaggcgggaggatcgcttgagcccaggagtccaaggctggaatgagctgtgatggtatcactgtactccagtttgggwgaccaagtgagaccctatttcttaaaaaaaaaaaaaaaaaggaaaaaacttcttccattaccatccatcctcttatatatctttttatagaaagattttt

SEQ ID NO: 28530 - DNA, 201 bp, Homo sapiens
gtctctgagtcaattgttacttaactactcgactatatgaaatcaagtatatcagccaggtgcagtggctcatgcctgtaatcccagcactttgggaggcygaggcaggcagatcacctgaggtcaggagttcaagaccagcctggccaacatggtgaaaccccgtctctactaaaaatacaaaaaaattagcctggcgta

SEQ ID NO: 28531 - DNA, 201 bp, Homo sapiens
agcctggccaacatggtgaaaccccgtctctactaaaaatacaaaaaaattagcctggcgtagtggcgcatgcctgtagtgccagctactcaggagactgwggcaaaagaatcacttgaacctgggaagtgaaggttgcagtgagcagagatcgttctccagtctgggtgacaagagtgaaactccatcttaaacacacac

SEQ ID NO: 28532 - DNA, 201 bp, Homo sapiens
  misc_feature (1)...(201): n = A,T,C or G, or insertion/deletion polymorphism (see Tables 1-2)
actcagtcacttacatgtccaggtacggtgttctatagtgcaccaagtagaaatgtccagtcatgagctggggtacaggcctgaggctaggaagacaaagnagtagccctttactgcaggattgattagacgagagagggcactggttaggacaaaggaatcaggcagaggaccattaccataattctagtttaggagaac

SEQ ID NO: 28533 - DNA, 201 bp, Homo sapiens
gctgggaccacaggcatataccaccacgcccgactcatattttgatttttttttttttagagataagatctccctatgttgcccaggctggccttgaactyctatgctcaagcaatcctcctgcctcagcctcccaaagtgctaggattacaggcgtgagccactgtgtctggactatacattttttaatagcattattga

SEQ ID NO: 28534 - DNA, 201 bp, Homo sapiens
agatgttgttctccttacctcaagcttggtaccagcgcctcagtgtctgctgaccccaccagcatgcccggatgtatctgttggctgcaagacattgtagmcccaggcttgtagccagcctgggcaggcagcttgttggctcaaggagtccttcgtactgttcttcagtccttcgaatgtcttattctcagacgctcttct

SEQ ID NO: 28535 - DNA, 201 bp, Homo sapiens
  misc_feature (1)...(201): n = A,T,C or G, or insertion/deletion polymorphism (see Tables 1-2)
tctcaaagtgttgtgattacaggtgtgagtcactaatctggcctggttccttttttaataatactactgacaaacactgcctcgtagaaactcctgtcagngtgaagagttggaaggggaggggaacagtgctatttttcttcttcaagaagtttcagggggctcctcataggattgccttcaggagtgtccatactccct

SEQ ID NO: 28536 - DNA, 201 bp, Homo sapiens
gccacttcagatgctgggcttcctatgctagatgttcctgctcttgccgcattcaggagccacagcccacttgttcagaacgggaggggagagtgggggaygagcatttaggaatgcatcattccagctcctgtattattcctagagctggtagctgaaattctgaccacggaagtgtccttgaacatcttccagcaaatg

SEQ ID NO: 28537 - DNA, 201 bp, Homo sapiens
agtagcaccaccatgcctgtctaattttgtatttttagtagagacagggtttctccatgttcgccaggctagtctctaactcccgacctcaggtgatccayccgcctcggcctcccaaagtgctgggattacaggccactgtgcccggcctgattattctatttttacagataagatttttatctttgcctttactatgtt

SEQ ID NO: 28538 - DNA, 201 bp, Homo sapiens
ttggctcccccttgtcccttcacgggggctgccttgtagagaaatcattattcccaaagcaaattcagccctgcttttaccctcaaccttttctttctttytttttttttttttaatttgggggttgggggacaggagaatgcagtttgtcaaacaaaaatgctgactaagcctggcctcgggtcgccgaggcaacaggga

SEQ ID NO: 28539 - DNA, 201 bp, Homo sapiens
gctggatgtggtagcatgcgcctgtagtcccagctcctcagaggctgaggcgggaggatcgcttgagcccaggagtccaaggctggaatgagctgtgatgrtatcactgtactccagtttgggtgaccaagtgagaccctatttcttaaaaaaaaaaaaaaaaaggaaaaaacttcttccattaccatccatcctcttata

SEQ ID NO: 28540 - DNA, 201 bp, Homo sapiens
ttaaaaattcacctgatttttttacataatgtacacatcattgaataaattaattaaaacctacttctatgaaattatgtcattgaatatttttccagtgrtagtcaattctcaacttatttcttcttttaactgatttttaatttttattttttttaaaaaacagagacagggtctcactatattgcccagactggcctc

SEQ ID NO: 28541 - DNA, 201 bp, Homo sapiens
aggctgaggcaggaaaatcgcttgaacctgagaggcagaggttgcagtgagctgagatcgcaccattgcactccagcctgggcgacaagaatgaaactccrtctcaaacaaacaaacaaacaaacaaacaaacaaacagtggtgaaagtgggcatccttgttgtattcccaatcttagaggaaaggctttcagttttttcc

SEQ ID NO: 28542 - DNA, 201 bp, Homo sapiens
agagaatccagatggagagagaaaggattcgaatgcgccaagaggagctcatgaggcaggtatggctttccatggtgtctggtggaggctccctggccttrgtgccaaagctgatgggtaggtagctgcttaccttcagggtaattcttctagagaagaagagacaatagggctcaaagccctactccaagcctcttgatt

SEQ ID NO: 28543 - DNA, 201 bp, Homo sapiens
aaaaaaaaaaagatagtgccttccatcatcattatcatcaaaattatcttccttatcatcatgccagtgatgcatttattaagaacaccaaagtgaaacayggcaacaaaagagtaaatgcaaaaatgagtggcagcaccaattattttttatttaggtatttgcatatttgctatatgctggacactgtgctaaacactt

SEQ ID NO: 28544 - DNA, 201 bp, Homo sapiens
taggagttttatggggaagttttctatagtctttttaaatactgggtagtggcatgatctcagagcaccagccagtgttcacagaagaccaaaatgagtgyatactacatatgcattttgattcaaggataacatttagaaaatccagaactgtagtttttttgttgtatgttttgttttcatttttaagaaggaagctcc

SEQ ID NO: 28545 - DNA, 201 bp, Homo sapiens
ctgtaatcccagctactcgggaggctgaggcaggagaatcgtttgaacccgggaggtggaggttgcggtgagccgagatggcgccattgcactacagcctsggcaacaggagcgaaactccgtctcaaaaaaaaaaaaaaaagatagtgccttccatcatcattatcatcaaaattatcttccttatcatcatgccagtga

SEQ ID NO: 28546 - DNA, 201 bp, Homo sapiens
aggtatcagaattatgtagcacagattgcagctgggattctgttccatccaaattccaatcagttatcaaaagcattgtttaataggagtttcctcaaagwtcaacagtgccacagaacaatggcccatacataacacagtttctctggtccctgccggactgagaattctgtctccaggaggtttgaggtatgtgtagag

SEQ ID NO: 28547 - DNA, 201 bp, Homo sapiens
acatcagacaaaagatagtgccttctggccgggcgcggtggttcactcctataatcccagcactttgagaagccaaggtgggtggatcacacctgagatcrggagttcgagaccagcctgaccaacatagagaaaccccatctctactaaaatacaaaatcagccaggcatgatggcgcatgcctgtaatcccagctactc

SEQ ID NO: 28548 - DNA, 201 bp, Homo sapiens
caaaaattccttttttctctagcccaaatgcattactaaagcaacagataacatcagacaaaagatagtgccttctggccgggcgcggtggttcactcctrtaatcccagcactttgagaagccaaggtgggtggatcacacctgagatcaggagttcgagaccagcctgaccaacatagagaaaccccatctctactaaa

SEQ ID NO: 28549 - DNA, 201 bp, Homo sapiens
caaaatgatagcaaaaatactaaaggataaataacttacataaggtactgaagttaagattaaatatcaaaaattccttttttctctagcccaaatgcatyactaaagcaacagataacatcagacaaaagatagtgccttctggccgggcgcggtggttcactcctataatcccagcactttgagaagccaaggtgggtg

SEQ ID NO: 28550 - DNA, 201 bp, Homo sapiens
ctacacaagatagaattcatggattaaaaattcacctgatttttttacataatgtacacatcattgaataaattaattaaaacctacttctatgaaattaygtcattgaatatttttccagtggtagtcaattctcaacttatttcttcttttaactgatttttaatttttattttttttaaaaaacagagacagggtctc

SEQ ID NO: 28551 - DNA, 201 bp, Homo sapiens
atgttttctgaggttactacattctctactacacaagatagaattcatggattaaaaattcacctgatttttttacataatgtacacatcattgaataaaktaattaaaacctacttctatgaaattatgtcattgaatatttttccagtggtagtcaattctcaacttatttcttcttttaactgatttttaatttttat

SEQ ID NO: 28552 - DNA, 201 bp, Homo sapiens
gttagatatacttaaccattctcttcttaaatatttaggaaatttctgagccgggcgcagtaactcatgcctgtaatcccagcactttgggaggctgaggygggcagatcatgaggtcaggagatcgagaacatcctggccaaaatggtgaaacccccatctctaccaaaaatacaaaaattaactgggcatgatggtggg

SEQ ID NO: 28553 - DNA, 201 bp, Homo sapiens
tgtgaaactgaaagtgtaaactaaaactattgtttttattattatttactttatacttagggaaatgattttcatctctttacttcagtatttccccatcttttttttttgggggggatggagtctcactctgctgcctaggctggagtgcagtggcatgatcccaactcactgcaacctccacctcccgggttcaagcga

SEQ ID NO: 28554 - DNA, 201 bp, Homo sapiens
tcaccatgttggccaggctggtctcgaactcttgacctgtggtgatccacccgcctcggcctcccaaagtgctgggattagaggcgtgagccaccgccccyggcctttttttttttttttttaatcacatttattctaaaaccttagacctttagacccaagttttcacgcaaggcaatggatgagttccccttggcaata

SEQ ID NO: 28555 - DNA, 201 bp, Homo sapiens
ggctggcttattttacttagcataatgtccttaagtttcatctatgttgtcacatattcaggatttccttctgttttaaagctgaataatattctattgtktatatacaccacattttcttatccattcatctattgatgaacatttaaattgtttccacatcttggctattatgaatagtgctgcaatgaacataggagt

SEQ ID NO: 28556 - DNA, 201 bp, Homo sapiens
atgttggccaggctggtctcgaactcttgacctgtggtgatccacccgcctcggcctcccaaagtgctgggattagaggcgtgagccaccgcccccggcctttttttttttttttttaatcacatttattctaaaaccttagacctttagacccaagttttcacgcaaggcaatggatgagttccccttggcaataccttc

SEQ ID NO: 28557 - DNA, 201 bp, Homo sapiens
ttcatttaaatttaatttttattttactgtagtaagaacatttaacatgagagctaccctcttaacagatttttaagtatgcaataccatattgtcaactrtaggcacaatgttgtacagcagctttctagaacttattcatctcacataactgaaactttagcaactccctattttctcttcccctccttctgcttctat

SEQ ID NO: 28558 - DNA, 201 bp, Homo sapiens
tgtaggttaggtacatggacttgggtgtctgactgccagaatttgaatcctggctctgtagttactagtttggtgacccttaagttatttgtctgtgcttygatttcatcatatgtacaatggggattattaatatatgaggaacttacgagtttatatatgcaaagtgcttagaactatgattgccacatagtaagctaa

SEQ ID NO: 28559 - DNA, 201 bp, Homo sapiens
caatgtattcattaccttcagtgaggatagtgccctctggtggaaatgtttaagttacctctcccaggagaaacttcttatcactagacaccttatttttyataagagctttagatgccgggcgcggtggctcacacctgtaatcccagcactttgggagaccgaggtgggaggatcacgaggtcaggagatcgagaccat

SEQ ID NO: 28560 - DNA, 201 bp, Homo sapiens
atctttggctcacttgtttagttgccttccagcatctggtaggaatttggagagatgggggaagtggtggttctggtgaaatttaaagattatctgtacamttctgtttgttctctctgtcctacccctatgtcctgggtagtcaacaactgcctgaatatcccttgctcagtggacagtttgtaattacactggctctcc

SEQ ID NO: 28561 - DNA, 201 bp, Homo sapiens
cctccccggttcaagtgtttctcttgcctcagcctcccgagtagcaccaccatgcctgtctaattttgtatttttagtagagacagggtttctccatgttsgccaggctagtctctaactcccgacctcaggtgatccacccgcctcggcctcccaaagtgctgggattacaggccactgtgcccggcctgattattctat

SEQ ID NO: 28562 - DNA, 201 bp, Homo sapiens
atggagtttcactcttgttgcccaggctggagtgcaataatggcgctctctcagctcactgcaacctccgcctccccggttcaagtgtttctcttgcctcwgcctcccgagtagcaccaccatgcctgtctaattttgtatttttagtagagacagggtttctccatgttcgccaggctagtctctaactcccgacctcag

SEQ ID NO: 28563 - DNA, 201 bp, Homo sapiens
tccaccagtccgttagttctcatgaaggcaggagctatttttccaagtttaagcccagtgcatgacacgcagcaggaattgcaataacaatttcagtgagygtatggacaaaaaagaacatttttatcccaccctcacctccatcctggagaaatctttgccattgaattcttcctcaaagaaatctattcttctctagaa

SEQ ID NO: 28564 - DNA, 201 bp, Homo sapiens
  misc_feature (1)...(201): n = A,T,C or G, or insertion/deletion polymorphism (see Tables 1-2)
gcctcccaaagtgctgggattacaggcataagccaccgtgcccagctgataaacattctcaaagatttttaagatgcatcctgagtgcttcattagaattngttcttagcaatggaattactgaatccaaggctattattgccataaatttcgatggggatagtaaggaaagaataatgataaactcagacccactttagt

SEQ ID NO: 28565 - DNA, 201 bp, Homo sapiens
gtggcaaaagaagaggcagtttggaggctgcttccaggtcccgtcctaaccactctgctgatggaggggagccctgatgtctgacactgtatgaaactctyatttattaaataaatggtgggcagaaaaaagacaaaacacttatgtttgaagacaaaatctttgcccatagaaataagcaacatgctgctaatagtttta

SEQ ID NO: 28566 - DNA, 201 bp, Homo sapiens
ttgacctcaagtgatccacccacctcggcctcccaaagtgctgggattacaggcataagccaccgtgcccagctgataaacattctcaaagatttttaagwtgcatcctgagtgcttcattagaatttgttcttagcaatggaattactgaatccaaggctattattgccataaatttcgatggggatagtaaggaaagaa

SEQ ID NO: 28567 - DNA, 201 bp, Homo sapiens
tcccagctacttgggaggctgaggcaggaaaatcgcttgaacctgagaggcagaggttgcagtgagctgagatcgcaccattgcactccagcctgggcgayaagaatgaaactccgtctcaaacaaacaaacaaacaaacaaacaaacaaacagtggtgaaagtgggcatccttgttgtattcccaatcttagaggaaagg

SEQ ID NO: 28568 - DNA, 201 bp, Homo sapiens
atggtaaaaacccatctctactaaaaaatacaaaaattagctgtgtgcagtggccggcacctgtaatcccagctacttgggaggctgaggcaggaaaatcrcttgaacctgagaggcagaggttgcagtgagctgagatcgcaccattgcactccagcctgggcgacaagaatgaaactccgtctcaaacaaacaaacaaa

SEQ ID NO: 28569 - DNA, 201 bp, Homo sapiens
  misc_feature (1)...(201): n = A,T,C or G, or insertion/deletion polymorphism (see Tables 1-2)
ctgggatgtaaggacctttcacaacagatctcaagcttgacagtcaactctcttggtgtcccaggtccttcccaagaaaacctgcaatttcctattctggntgtctggtcctcaggggcagctatccagtggcgtttcttctgaaagacctccaaccggtctgttggggtagctctttgtcctgtcttcctaggctgtcta

SEQ ID NO: 28570 - DNA, 201 bp, Homo sapiens
agacaaggaagagcagtggcttgaacagctagtgtaaccagatctgtgacttatttgggtaaagggaggagttgagtgaaattgtcaaacaataaatgttytaatcaggtggcaaactcttccaagctcagcttgaaagatcacttctgcccttgaacacaatggatattaaaaaaatatgtaccgtatttgttgaatgga

SEQ ID NO: 28571 - DNA, 201 bp, Homo sapiens
tagttttaaatttaaatggaatgttttctgaggttactacattctctactacacaagatagaattcatggattaaaaattcacctgatttttttacataaygtacacatcattgaataaattaattaaaacctacttctatgaaattatgtcattgaatatttttccagtggtagtcaattctcaacttatttcttctttt

SEQ ID NO: 28572 - DNA, 201 bp, Homo sapiens
ggccttcatttagctgcttcaaagctcacacttcaaatgtcaagaaaaatattctcttaatttctgccgtatcaactgctgtaatgcctgaattaattagratggaactataatttctctccaaatggaattggatcatcccatcctaacaaaacaaatgctcagggcggctccatgctggaggtttctggacaccttccc

SEQ ID NO: 28573 - DNA, 201 bp, Homo sapiens
  misc_feature (1)...(201): n = A,T,C or G, or insertion/deletion polymorphism (see Tables 1-2)
ctccttggctccaaaccacaaattaacttttttgaccaggcatgaaaagtgtcctaacttgtgtctggacaatgctgagacagagagataatagtagagcncatatatacttgactcttgtcaccaagaaaaataagacaaggaagagcagtggcttgaacagctagtgtaaccagatctgtgacttatttgggtaaaggg

SEQ ID NO: 28574 - DNA, 201 bp, Homo sapiens; identical to SEQ ID NO: 6946

SEQ ID NO: 28575 - DNA, 201 bp, Homo sapiens
  misc_feature (1)...(201): n = A,T,C or G, or insertion/deletion polymorphism (see Tables 1-2)
aaatagttctagtaaggtgtatctgcccattctcacagggttactatgagattcgtgtgtgactgtacatgtgaagttgttttgtagtctgtaaaatattntataaatatgatttattattattgccatagttgaaatactaacagcttttaatgatcataactagattgagatgtcttcaatcatatggtcaaattagga

SEQ ID NO: 28576 - DNA, 201 bp, Homo sapiens
cacaagcgctccaataatcagggtttgattgaattttcagtacctccaacacatttaagtttttatttatttaatgagagggaggagacaactaagcttckatatacattttaggagcctctgtacatcgtatggccattagatgacaaaacatttgtgaaatgatactgtaagtcagtggaggaaaaatgcctttaaaaa

SEQ ID NO: 28577 - DNA, 201 bp, Homo sapiens
ctgtcatcagcccagcaaatcacctttcatcacaggtacacagatgacaaatacagagtacggaaggagtcagctgaaggtgctgcttgcctgggctgtcttttttttttttttgttacatctgccacttcatttattttatttgcaggaggagttgaaaccaattttaagggagattttcattttccccctaaacatgaa

SEQ ID NO: 28578 - DNA, 201 bp, Homo sapiens
tctcctgaatttgagacacatgtacctaccacatgtctacacttaatgtctaacaggtacttcatactcaaaattcatcctctcttacaaacttactcttyttccagtgttttctattcatgaaatggcatcaccatccaaacactcactcaaaccagagacatgtgtcactcttggcttctctctggcttcttaaccaca

SEQ ID NO: 28579 - DNA, 201 bp, Homo sapiens
aacctaggaggggccattagctggaaaaaatgtctctgagcagcagatgcagtgccagatactgatgctgattcagggctgagcgatgcatccataccaascacataccaaattttcacatgcctttccgagtgtcattcaccttttgtagaatgcagtgtgaatgatccctctaaaattgggggtaacataaaaatagtt

SEQ ID NO: 28580 - DNA, 201 bp, Homo sapiens
aggtaatcatctatttttattcatttttttttcttgattggtagtttgaacatgatattaaacacatttactgtataaatatagatatcattgttggccaytttgctgtaattgaactctccagaggggtttcaggatggttttgctttttctagaaattgtagcagggaagcagaggtctacctttgtctgttttcagaa

SEQ ID NO: 28581 - DNA, 201 bp, Homo sapiens
caaaacaaaattctcaaaacctaggaggggccattagctggaaaaaatgtctctgagcagcagatgcagtgccagatactgatgctgattcagggctgagygatgcatccataccaagcacataccaaattttcacatgcctttccgagtgtcattcaccttttgtagaatgcagtgtgaatgatccctctaaaattgggg

SEQ ID NO: 28582 - DNA, 201 bp, Homo sapiens
aagtgcgctgggattataaacatgagccatcatatccagccaaattctttattttcaccttccattgcaaaacagcctatcttctccttacctgtcttgamtcttaccttggtacctccaaaatcttgagacctctggggaataggggagggggaaacaaagggaccatttgaagtattggctcctcccatccctggcctc

SEQ ID NO: 28583 - DNA, 201 bp, Homo sapiens
gactttcttcaatgcaaacataaaaatagttggaaactcctctatattcttttttgtagcttgtttttaatataccatgagcatcttcccatttcagtaatttttttttttttttgagacagaatctcgttctgtcgcccaggctggagtgcagtggcaagacctcggctcactgcaacctctgcctcccaggttcaagcc

SEQ ID NO: 28584 - DNA, 201 bp, Homo sapiens
cttggacagtaaattgtgtggtcaccttatctatgaggaggttattgtcatcaccttattgaatagctgaggaaagggaagtgttaagtaactttcccacrttcacacaagtagaaggagagaccagcagagatttaccatgatgtcagaatacagttctgaatttcttggggcaaagaaatgttgcctgtctctctagga

SEQ ID NO: 28585 - DNA, 201 bp, Homo sapiens
caaagttacaaagccagactgaagtctgcagataccaatgatggttggtctttgtttaaccactaatcactaagagacctcactcccaggggtcttaaatrttagggtggaagatggtggatcagtctacggtacttacttcctgacagcaagtcagaaagttgatctttttttcatttaaatttaatttttattttactg

SEQ ID NO: 28586 - DNA, 201 bp, Homo sapiens
aacactaataacagggttaagattgcaatcatttgaaatttaggcttatttacagtctattcgatattgtatgttgaatgatgcagtccaagctggggaawataggcttttgtagaggagtatgcttctcttctagaccagagaggtttgttcattctggagcactcaaagcaaccaactccaacttcaccaaagtagaaa

SEQ ID NO: 28587 - DNA, 201 bp, Homo sapiens
attacaggcatgagcccctgtacccagcctaaatatcctaagtgaggcagggcaactgcaagaagttattctgtggttacacctctggaatctagaaaggsctttaagtgtaaacccattatgaaaactaacaatctcactaatagggatacattaatatcattcctcaatatttactagccatgtgaccttggacaaact

SEQ ID NO: 28588 - DNA, 201 bp, Homo sapiens
attacacttgtgtgaattaagagagggcagggcataaataaagtattggccaagcagctgcttggtggcctcaggacggagtaggtgttcaacaacctgtkcgctgtgtgccaaggttgggcaacaccttgtttttgatactattcttagatgcacctttatgctgtgtgtatttcatcaccccatgtgcctacacattca

SEQ ID NO: 28589 - DNA, 201 bp, Homo sapiens
agaggtacttcctcaagtaagtcagcctggagccgaagaaggcaccaagtcacagtgcccaacgcgcgcgtgtgttcgtgtgtgtgtgtgtgtgtgtgagwgagagagagagagagagagagagagagaaagagagagatggtgcgtgtccttccacggttatttcacagatatggagagctggaagcagggagtgagtct

SEQ ID NO: 28590 - DNA, 201 bp, Homo sapiens
  misc_feature (1)...(201): n = A,T,C or G, or insertion/deletion polymorphism (see Tables 1-2)
cctgcgacaccatctgtgcaaaaccctttacctcccaccccaggccttcaagtagaagttgtaattatactataacaagctctagaagtgaaatactcatntcaggttttttggcatcaatcatgactgtgctttttctcttgttcttaatctaagagtgtaagaaatgcccaactgattttattcattcatcagatcgtt

SEQ ID NO: 28591 - DNA, 201 bp, Homo sapiens
agtgcaattttttttaaagaaatgggtgaagaagataaactaatgaagagccttgaggaggtcgtcaatggctcttgctcccacagtgccactcaaactayagtaacaggagccatccataatctccaccccagctcgtctctcttggacattgcatgctgtcatgcttctcccttggctgtcacacccccttcccattgg

SEQ ID NO: 28592 - DNA, 201 bp, Homo sapiens
tgattgagttttaaaccagtctgccttggttttatgaccccaggctgtctttaaattctcatctcattggtgtggttctctttaactgctcagctaggttktggcaaaagaagaggcagtttggaggctgcttccaggtcccgtcctaaccactctgctgatggaggggagccctgatgtctgacactgtatgaaactctc

SEQ ID NO: 28593 - DNA, 201 bp, Homo sapiens
gatttacattgcctttttgataagatccaaacttctaatatgacctataaagtctttcataatctggctcctgcctttatctccagcctcatttcttcttyttttttttttttttttttgagatggaatcttgctttgtcccccaggctggagtgcaatggcacgatcacgatctcggctcactgcaacctctgcctcttg

SEQ ID NO: 28594 - DNA, 201 bp, Homo sapiens
tttttttcttttttgttttttaagagctagggtctttttatgttgcccaagctggtctccaactctggggctcaagcagtcctcccgcctcagcctcccaragtgctaagattacaggtgtgagccaccacacctggctagcattatctgtggaacatttcttctggaagagcttgtattctactggaagagaaaaaagga

SEQ ID NO: 28595 - DNA, 201 bp, Homo sapiens
tggactgtatattcaaaagtttttcagtggtaatttttaccacactccacatttgccaaaactgattttggggagcagagcaaggtggcacgcatgtgtayacccagcctcgggaggctgaggcaggaggatcacttaagcccaactgttggagtccagcctgggcagcatctctttcaaacaaaagaaaactgagtttgg

SEQ ID NO: 28596 - DNA, 201 bp, Homo sapiens
atataagtatcctaaatgaataggtggaaaatacaatataagtacttttgtgagcctgagggactcttctgtaagatcaaagacaaatattttagtttgaytgagaaaggagtgaaactttttaaataaacaacagtatttattttaatagggagtctgaggtctttccagtaggagttgggaaataactttttttcctct

SEQ ID NO: 28597 - DNA, 201 bp, Homo sapiens
tttcctgctacagaactcttcttggtgtcctgtcctgtcagggctgatctcctgcctggttcctaaacctctagaatctgacagtgtgaccctgctcatcsagcctcacttcccttgcaacccatttgctgccacccacagctcctggcagtgcttgtaccccttccctggagcaccctcactcacctcttccctgaccct

SEQ ID NO: 28598 - DNA, 201 bp, Homo sapiens
  misc_feature (1)...(201): n = A,T,C or G, or insertion/deletion polymorphism (see Tables 1-2)
ttcttatgcccattttacattggaggagaccaaggcttggagatgttacttacagtagtctcttagtcagttaatggcagaaacagatctcaaatccactntaccactctgcctcatttgggtgatattttcgactgaagatgccaagaaatacacgtaaagaaacattgtaggctgggtttgaaatgtgaaccataagct

SEQ ID NO: 28599 - DNA, 201 bp, Homo sapiens
tgctaggattacaggtgtgagccactgtgtctggcctatctggtcagttttctaagcagaaaagttctttttagcttgtttgttttttaacaagcctacayctaacatcataaagagcaggaaagtcctaaatccagcttctttactggctgttgtgtgatacaactgaggatcctcttcccaagttcttgcagaggaact

SEQ ID NO: 28600 - DNA, 201 bp, Homo sapiens
aaggaggtctcagcatgtggcttcatcgtctttctttcactatatgtcttttcctggtttacagagagacgcaagtatggccgagacttcctgctacgttkccgcttctgcagcatcgcttgtcagcgaccagtaggactggtccttatggaaggagtgacagatactaagccaggtaatgggaactaatcccagtttctt

SEQ ID NO: 28601 - DNA, 201 bp, Homo sapiens
atcctcaattggaactatcgcttcgtgaacctcatgcaggaattccagcactgggaccctgatgtgagtgaagagggggaattgccatcttgcattgttgstggacctgggctgttgcccagtgctcttagaagatgagttcaacccatagttgttcaaatgattggagtcctatctagggctggagcttgcctgcctggt

SEQ ID NO: 28602 - DNA, 201 bp, Homo sapiens; identical to SEQ ID NO: 6971

SEQ ID NO: 28603 - DNA, 201 bp, Homo sapiens
acctggatacagacaaaaaccagactcttgggtggggggcaaagttatgttcaaagccatctaatattcacgccctcccccatgacattcctgggtggctyactgccttgcaggggccccatcctttctaccttttctctcacataacccatgctcagactagtgggctagcagagtttggtttctctggggaagtagaac

SEQ ID NO: 28604 - DNA, 201 bp, Homo sapiens
  misc_feature (1)...(201): n = A,T,C or G, or insertion/deletion polymorphism (see Tables 1-2)
gttgttggcagatgctgagaagaatctccctagatgtgcacttcccagcacctttatgcaggaagggaggcttgagggattcaaggagcaggaaaatccantgcacatctctaatctcttcagcttaagtctgggcctgttcttgctgttggtgactctgggaagtttcagtgtgacccagcagcttcccacctggcctca

SEQ ID NO: 28605 - DNA, 201 bp, Homo sapiens
agggggaaagcactgctcacagatcagggttaacaaggcctgaggggcttcagcaggctgaggaagtctggaaccccagaagtttcatcatgactgcaggsgctgggaggtttcctgttccctggcttcaggctcacctcaggtcaggctcttcccagagccaatggggctaatgccgctgggctgggggagggctcgggc

SEQ ID NO: 28606 - DNA, 201 bp, Homo sapiens
tagggctttctggaggtagggatagagaggtctcagggcctctagtctctgtctcagtcacaattacctcagttttatttgtgttgtatattgagagtccyttaaaatttgaagaatggcgtcaatagatttgaaatccactatgctgccacatgccataggggagatggggacacaccatagtttctagtcccacagact

SEQ ID NO: 28607 - DNA, 201 bp, Homo sapiens
tgcaattactctaaaaatgtctttaacctcaggtgactgttaagcacactcatctgagtgattctccggagattcatggatttatcaaaaatgagagtgtktcagcttccatatatggagcatctattagatgctaggtgctggggatgtagtggtgagcaggccaagattgtctctggccttgtggagctaaccatgtca

SEQ ID NO: 28608 - DNA, 201 bp, Homo sapiens
gtgatgagaaggttgctacggtttcctgagctacactcatctcccaggagaacatgccccatttctcctttgctcctgatggactgctgtggactgagacyggaagagcagggtcctggaatacatcctgggtgctaacttgagcctctggaggccaggcccactgtgtgaagagggggaaagcactgctcacagatcagg

SEQ ID NO: 28609 - DNA, 201 bp, Homo sapiens
ttttaattttttgtagagatgaagtttcgttatgttgcccaggctggtctctaactcctggcctcaagtgatcctgctgcctctgtctctgcctcccaaastgctgggagccaccacgcctggcctcttgtccccattttacagtcaagagtaacttcatctgactaggggcattgttcaaggtcagttttattaattttg

SEQ ID NO: 28610 - DNA, 201 bp, Homo sapiens
  misc_feature (1)...(201): n = A,T,C or G, or insertion/deletion polymorphism (see Tables 1-2)
ccaagtcctttcaggctcagggttggaaaaagtttgtatatctgtgtgcacattgtcatttggacggggctcagagaggtgacctgccagctgacctgacntggcctctcctcatcttctgccaggcctcaacagctggtcccctcaccttgctggcagacactaagggttacaggcagcctgcttctgggccattctgct

SEQ ID NO: 28611 - DNA, 201 bp, Homo sapiens
ttgttcgctgtatctctggtgttaacacattgcttggtatacagtaggcactcagtgaattcaggaatgtcttgtgtgtccatacttctgaggaatgtggraaactccacagaagtaattgtttccagagaactaaacatattcttttaactatgttgctgtttttcctggagctcttctaatgccttagtgatacagtat

SEQ ID NO: 28612 - DNA, 201 bp, Homo sapiens; identical to SEQ ID NO: 6969

SEQ ID NO: 28613 - DNA, 201 bp, Homo sapiens
ggggcctggggtgctggcatccgcctcagacccggatctggtacccgttaaggtctggcatggctttgggctcggaagtcttcttgtcacccgagggcctrtgggaggaagagagcagagcgggaggagagtgagtggtctgttagggagatggagttggggagccagcagcggctgcctggtggcttccccgccacattc

SEQ ID NO: 28614 - DNA, 201 bp, Homo sapiens
gtgattctcctgcctcagcctcccaagtagctgggattacaggtgtgtgccaccatgctcggctgatttttgtatgtttagtagagacggggtttcgccaygttggccaggctggtctcgaactcctgaactcaggtgatccacctacctcagcctcccaaagtgctaggattacaggcgtgagccactgcgcctggccta

SEQ ID NO: 28615 - DNA, 201 bp, Homo sapiens
gtcagtaaccggtagtgattattaagattcttaattgtacatggtattattatcccattttatttatttatttatttatttatttatttatttatttattttttgagacagagtctcgctctgttgcccaggctggagtgcaatggcacgatctcggctcactgcaacctctgcctcctgggttcatgtgattctcctgcc

SEQ ID NO: 28616 - DNA, 201 bp, Homo sapiens
agtcagtaaccggtagtgattattaagattcttaattgtacatggtattattatcccattttatttatttatttatttatttatttatttatttatttattttttgagacagagtctcgctctgttgcccaggctggagtgcaatggcacgatctcggctcactgcaacctctgcctcctgggttcatgtgattctcctgc

SEQ ID NO: 28617 - DNA, 201 bp, Homo sapiens
tgcttgaacctgggaagcggaggttgtggtgagccgagatcatgccattgcactccagcctggacaacaagagtgaaactccatctcaaaaaaaaaaaaaraaaagaaaagaaaagaaagaaaactcagctaggaattagaaacatcatttgtcctcttggcctgttcagctggtgactgtaggtaagttacttaacctct

SEQ ID NO: 28618 - DNA, 201 bp, Homo sapiens; identical to SEQ ID NO: 6972

SEQ ID NO: 28619 - DNA, 201 bp, Homo sapiens; identical to SEQ ID NO: 6964

SEQ ID NO: 28620 - DNA, 201 bp, Homo sapiens; identical to SEQ ID NO: 6965

SEQ ID NO: 28621 - DNA, 201 bp, Homo sapiens; identical to SEQ ID NO: 6966
  misc_feature (1)...(201): n = A,T,C or G, or insertion/deletion polymorphism (see Tables 1-2)

SEQ ID NO: 28622 - DNA, 201 bp, Homo sapiens
caggcacgtgtattactggttcacaccggtaatcccagcactctgggaggccgaggtgggtagatcacttgaggttaggagtgagaccagcctggccacaygatgaaaccccgtctctactaaaaatacaaaaaattagccgggtgtggtgacggtgtctgtaatcccagctgcttgggaggctgaggcaggagaatcgct

SEQ ID NO: 28623 - DNA, 201 bp, Homo sapiens; identical to SEQ ID NO: 6968

SEQ ID NO: 28624 - DNA, 201 bp, Homo sapiens
tagagcaacaggcagagctgggactgagcaagtagacgcagttagggcctgggaactttttgcccagaggtccttccctgggctcgctctcatatcacccytcctctgcccacacagcactgcccatgggggcctcaagggcctgaaggctctcctgagccacgagctcatgctcttggggcagatgtggcctgtgccaag

SEQ ID NO: 28625 - DNA, 201 bp, Homo sapiens
  misc_feature (1)...(201): n = A,T,C or G, or insertion/deletion polymorphism (see Tables 1-2)
cggcctcccaaagtgctaggattacaggtgtgagccactgtgtctggcctatctggtcagttttctaagcagaaaagttctttttagcttgtttgtttttnaacaagcctacagctaacatcataaagagcaggaaagtcctaaatccagcttctttactggctgttgtgtgatacaactgaggatcctcttcccaagttc

SEQ ID NO: 28626 - DNA, 201 bp, Homo sapiens
gtctcaaactcctgacctcaggagatctgcccacctcatcctcccaaagtgctgggattacaggtgtgagccagtgcactcagaagacttcggacttcttmatattgacatccaactctagaagacagtggattaaggtttctaggaaaggatatatagttcaagaatattatactcaactaacaacatttcttcaagaaa

SEQ ID NO: 28627 - DNA, 201 bp, Homo sapiens
tggaaggtagataggtacaaaattaatgtgcagaacttagtagtgttcctatatagaaatacatgtttattaaaagatataatgaaaaaaatacactgtgtaagagcaacaaaaagaaaaaatatagaaataaatctaacaggaagaatataaggcatataaaagggcattcctttcttttttttttttgagatggagtct

SEQ ID NO: 28628 - DNA, 201 bp, Homo sapiens
gtgaagagggggaaagcactgctcacagatcagggttaacaaggcctgaggggcttcagcaggctgaggaagtctggaaccccagaagtttcatcatgacygcaggcgctgggaggtttcctgttccctggcttcaggctcacctcaggtcaggctcttcccagagccaatggggctaatgccgctgggctgggggagggc

SEQ ID NO: 28629 - DNA, 201 bp, Homo sapiens
gagaagacatgtgtctcagtaaaaaatgatacaggagccaggcaccctggctcacacctatagtcccagcatcttgggagaccaaggcagaaggattgctygagcccaggagtttgagaccagcctgggcaacaaagtgagacaccgtctctacaaaaaaatcaaaaaattagccaggcatggtgatgcatgcctgtggtc

SEQ ID NO: 28630 - DNA, 201 bp, Homo sapiens
ctggaaggtagataggtacaaaattaatgtgcagaacttagtagtgttcctatatagaaatacatgtttattaaaagatataatgaaaaaaatacactgtgtaagagcaacaaaaagaaaaaatatagaaataaatctaacaggaagaatataaggcatataaaagggcattcctttcttttttttttttgagatggagtc

SEQ ID NO: 28631 - DNA, 201 bp, Homo sapiens
  misc_feature (1)...(201): n = A,T,C or G, or insertion/deletion polymorphism (see Tables 1-2)
aagtataattcttagagattagcttctggtaatacgtatatttagaaggaaggttagttgagttcagtggccattgcatggatgtgcagtgtgataagagngccggaccaggaatcaagacacctgggttgtaactagctttgagagcttgggtaagccatttaacctttttaagcttaagttgctaatgactagcatgtg

SEQ ID NO: 28632 - DNA, 201 bp, Homo sapiens
aagtcagtaaccggtagtgattattaagattcttaattgtacatggtattattatcccattttatttatttatttatttatttatttatttatttatttattttttgagacagagtctcgctctgttgcccaggctggagtgcaatggcacgatctcggctcactgcaacctctgcctcctgggttcatgtgattctcctg

SEQ ID NO: 28633 - DNA, 201 bp, Homo sapiens
aaagtcagtaaccggtagtgattattaagattcttaattgtacatggtattattatcccattttatttatttatttatttatttatttatttatttatttattttttgagacagagtctcgctctgttgcccaggctggagtgcaatggcacgatctcggctcactgcaacctctgcctcctgggttcatgtgattctcct

SEQ ID NO: 28634 - DNA, 201 bp, Homo sapiens
caaagtcagtaaccggtagtgattattaagattcttaattgtacatggtattattatcccattttatttatttatttatttatttatttatttatttattwattttttgagacagagtctcgctctgttgcccaggctggagtgcaatggcacgatctcggctcactgcaacctctgcctcctgggttcatgtgattctcc

SEQ ID NO: 28635 - DNA, 201 bp, Homo sapiens
ggtgtttttttgggtggattaaataaaataatgcgtgtaaagtgttttccagtatctggctcaaagtcagtaaccggtagtgattattaagattcttaatygtacatggtattattatcccattttatttatttatttatttatttatttatttatttatttattttttgagacagagtctcgctctgttgcccaggctgg

SEQ ID NO: 28636 - DNA, 201 bp, Homo sapiens
agatgaaatttgaggacccgtggctgaaacgagaagaggaagtgaaaaaagagacggctcatcccaatgaagaagggatgatgaggtgtgagactgccacrggcccctcgaatgctgagaccagagcagagcaggagcaggacggaaagcccagtccgggagacaggctcagcagcagcagcggagaggtgtcggcctccc

SEQ ID NO: 28637 - DNA, 201 bp, Homo sapiens
tcagttttcccgtgacccagcaaggatgatgttgctaattcactgtgcatttcatcataatttatcctgagaaagttcagtgctgccatgtgcatgtatawcgcagagtatacaagggtgctccatcgtaaaacacccagctgtcttcatccatgctgtcgcccatcttttcttaacaggtgaaagtcatgcttcgcatct

SEQ ID NO: 28638 - DNA, 201 bp, Homo sapiens
gcttcttggctatgcccaaatacttttaagtaggtgttatttcataataaagcattaatggtgtttgttacatgtggatgaatatcttcactgtgtctggragctctgcctcagaacgtaggatcttgttccctatccctgctgtttataatctgttttattaccttctcccactgtgtcatggaccggatggtttttcta

SEQ ID NO: 28639 - DNA, 201 bp, Homo sapiens
atctcaaatgatgctgcttgcacctcagggttctacagtgtttcataaaaagagatcgatgagcaaataaatagattaacttcatgtactcttaatagttmaagacctctgccaaccagcggtctcaggataagcaagacatgacctcataataggaggtgtgctggttggatcacaaaggctggtccttcagccagagtg

SEQ ID NO: 28640 - DNA, 201 bp, Homo sapiens
aggtgaaggtggatgctcttattcccgatacggagaagttccagaatgactagcgtgcttcttggctatgcccaaatacttttaagtaggtgttatttcayaataaagcattaatggtgtttgttacatgtggatgaatatcttcactgtgtctgggagctctgcctcagaacgtaggatcttgttccctatccctgctgt

SEQ ID NO: 28641 - DNA, 201 bp, Homo sapiens
tacccagtgtttaccaaaaatcaggcagaagagcgtggtggaagttggaagaccttagtgtaacccgcgtctataaaaactgggcgtccaggccgggcacsgtggctcacgcctgtattcccagcacgttgggagtccaaggcaggaggatcacttgagtccaggagttcaagaccagcccggacaacatagaaaaaccct

SEQ ID NO: 28642 - DNA, 201 bp, Homo sapiens
ctggacgttactgatctaggtgaaaggccagaagcagtgggatattgaaattctcagaagtggagagactgtggcaaggaggtacagaagacactaaatcrggtgccatgttagcaagctcaagttttcatattgatcatgcagtgagctgcagagaagaaaagcagctttgcctgggtcctgttgttctccaagccaaat

SEQ ID NO: 28643 - DNA, 201 bp, Homo sapiens
cgtcccgtctgtatcccttgggctagtttcttctagactgaggtttctaagtccaaacaagatgaactgtgcacagtgcctcaattagggaacagcagctkgagtgctttggaaatacaaaagtgtagtttgtaggttcaccttgaaggcaagatcagacagctctacgtaagccagagctctgaaacaaagcttcaggct

SEQ ID NO: 28644 - DNA, 201 bp, Homo sapiens
agatgcttagtgaaggaaggaatggatttctcacctggttgcttatcttctagactcatttggggagtggccaggagtccgggagagctgccggccattgytccgtcccgtctgtatcccttgggctagtttcttctagactgaggtttctaagtccaaacaagatgaactgtgcacagtgcctcaattagggaacagcag

SEQ ID NO: 28645 - DNA, 201 bp, Homo sapiens
tttagtctccattctgggagccatgtgcttcactaatacccagggtctcttctgctgtgaaagaaagaggatagatactgggagagaactagccgtcctcrtcacaacgtgtgaagtgtgtgaaatagtaccaggcacgtaaccagtgcatgtgagtgctactgctgctgttataagcaaataaacagtgttttctggaac

SEQ ID NO: 28646 - DNA, 201 bp, Homo sapiens
cccgggaagcggagcttgcagtgagccgagattgcgccactgcagtccgcagtccggcctgggcgacagagcgagactccgtctcaaaaaaaaaaaaaaaacatcaaacaatactcactgagcccttcccacgtgccgggctatttgccgagaacttctcatgcattatctcatttaatcctcatcacaacttctctcagg

SEQ ID NO: 28647 - DNA, 201 bp, Homo sapiens
tcaggaatgactgaattttggtaaatgctttttctgcatctactgaaacaatcatatagttttcctttcagtttgttaatatggtaaattatattgattargttttttttgttaatcaaccttgcattcctgaaataaacctcacttgctcatggtataaaaccctttgtatttgttgctagatacaatatttttttgagt

SEQ ID NO: 28648 - DNA, 201 bp, Homo sapiens
tcccacttcttccactggagacactgcgggggagaaacatgtaaatatcgttaataacaatgcatcgcgtccttgaaaattgctgctaagagagtagattktaagtgttctcaccataaaaaagtatgtaagataatacatatgttaattagctcagtctagctattccacaatgtgtacatattttaaaacaatgtgttg

SEQ ID NO: 28649 - DNA, 201 bp, Homo sapiens
agctactcgggaggctgaggcaggagaatggcgtgaacccgggaagcggagcttgcagtgagccgagattgcgccactgcagtccgcagtccggcctgggygacagagcgagactccgtctcaaaaaaaaaaaaaaaacatcaaacaatactcactgagcccttcccacgtgccgggctatttgccgagaacttctcatgc

SEQ ID NO: 28650 - DNA, 201 bp, Homo sapiens
tctttccaatctggatatcgttcatttattgtacttgccttattgtactggccaggacttccagtataatgttaaatggaaacggtgagagtggacatgcytgtcttgctcccaatcttagagggaaggcatttagtcttttaccattaagtatgatgttagctttagtttttagtagataccttttattaaattgaggat

SEQ ID NO: 28651 - DNA, 201 bp, Homo sapiens
ataataatcttttaaagagatttaaagtaataaaaattacatatttacccatgtggttatcatttccaaagctcttcattcctttgtctatattccttgtrtttttgcttatggtgaattcttttaggatttttaagtcaaaaaatatctttatttcccttttgttttggaatgatacttttgctgggtgtatatttctaa

SEQ ID NO: 28652 - DNA, 201 bp, Homo sapiens
gtgaaatgtcccttcaaatcttctgtccttttaaaaattgttttgaaagtttttaatatattctggatgcaaatcctttataagatatagtatttgcaagyattttctctcagtctgtggcttctctcttcattctcaacagcatcttttgaaaaacaaatacttgtttttttatgaagtccaatttatatgttcttttat

SEQ ID NO: 28653 - DNA, 201 bp, Homo sapiens
aaatacaaaaaattagccgggcgcggtggcgggcgcctgtagtcccagctactcgggaggctgaggcaggagaatggcgtgaacccgggaagcggagcttrcagtgagccgagattgcgccactgcagtccgcagtccggcctgggcgacagagcgagactccgtctcaaaaaaaaaaaaaaaacatcaaacaatactcac

SEQ ID NO: 28654 - DNA, 201 bp, Homo sapiens
gattgtagaggcacagtcatagctcactgcagcctcaaatttgtagtgttcctgccacctcagcctcctgagtagctaggattataggcacatgacatcakacccagctaatttctttttgtatcatttttctgtagagatggggtctcactatgttgaccaggctggtcttgaactcctggccttaagtgatccttctgc

SEQ ID NO: 28655 - DNA, 201 bp, Homo sapiens
agtttcatagtttcaggtttaaatttaagtccattttgagttgattttcataatgtgataaaaaatgaagctctagtttcattcttctgcatatgaatatycagttttcccagcaccatttattaaagagattgtcttttccccaatgtatgttattggtgcctttgtcaaaaatgagttggctgtaagtgcatagattta

SEQ ID NO: 28656 - DNA, 201 bp, Homo sapiens
ggaataattttttccatcccttcattttcattctatgtgcatctttacaaatgaaatgcatttgttggagacagcatacagttgggtctttttttttttttaaataaatccattcatcttgtctatattttttacttaaggaatttaaactgtttacattcaaggatgtcattgataggtaaggacttacttctgtgattt

SEQ ID NO: 28657 - DNA, 201 bp, Homo sapiens
cagagcaaggctctgtctcagaaaataaaaataaaaagacttccagctgggatctatggacaggctccccctgatttcccctaagcctcctcgtggctcaraagacctggacaacagtactcctggggagagagctctttgcgggcttctgctgtccccaggcaaaagcgcctcccttcccccacctcggtgcctctcttc

SEQ ID NO: 28658 - DNA, 201 bp, Homo sapiens
ataatgacttccagcttcatccatgttgcttaaaatgacaggatttcattatttttatggctgaataatattccattgtgtgtgtgtgtgtgtgtgtgtgtatctatctcacattttctttattaatttacccattgatggacacttagactgattctatattttggctattgtgaatagtgctacaataaacatggtagt

SEQ ID NO: 28659 - DNA, 201 bp, Homo sapiens
gaatgagatcctgcagatgaaggtatttggtatactgaagagctctgagaatgatgaaaatgatgtgcaagtctcttccaggactttttgtgtgcctttcrtagtgtaatacagaccccggcacatgggtgttcacacttagggtatgaccagcctcacagctaagttgcttagcatatggtaccagcgaacccaagtttg

SEQ ID NO: 28660 - DNA, 201 bp, Homo sapiens
gtttattgatttgcatacatcgaaccatcattgcatccctaggataaatcccacttgattatggtgtattatgttattggtgtgttgttagatttggttcrctagtattttttagatgatttttgcatctatgttcatcagggatattggtatctcattttggtattaggataatggtggcctggttgcgtgaattaggaa

SEQ ID NO: 28661 - DNA, 201 bp, Homo sapiens
cataatgacttccagcttcatccatgttgcttaaaatgacaggatttcattatttttatggctgaataatattccattgtgtgtgtgtgtgtgtgtgtgtgtatctatctcacattttctttattaatttacccattgatggacacttagactgattctatattttggctattgtgaatagtgctacaataaacatggtag

SEQ ID NO: 28662 - DNA, 201 bp, Homo sapiens
catgcacgatactggcaagctaggattcaaacacagtggggctccagcaccttccctttcagtccccacattagcctctggctgaggtgtggggaaaagcwcacagatcagactggggggacctgagttccagccccagctcctcgcgggctgcctgtgtgacctgagagccccgaggctccatctgtgaaatgcagaggg

SEQ ID NO: 28663 - DNA, 201 bp, Homo sapiens
cagtgtggtgattcttcaaggatctagaaccagaaataccatttgacccagcaatcccattactgggtatatacccaaaggaatataaatcattctactayaaagacacatgcacacatatatttattgcagcactatttacaatagcagagacatggaaccaacccaaatgtccatcaatgatagactgcatgaagaaaa

SEQ ID NO: 28664 - DNA, 201 bp, Homo sapiens
tataagtaataatccctgcggacctggcagccagaactcaattaggggaaagtttattaattagtcaccctgcagggaagccattagaagagatctctgcygcaagaactaaatagactctgtgtgcgcctctgaatctcatatgcacacatgcattttatacattttacacacaaatgcatcttacatttataattttac

SEQ ID NO: 28665 - DNA, 201 bp, Homo sapiens
atgaaaggagcccacgtcccatgcacgatactggcaagctaggattcaaacacagtggggctccagcaccttccctttcagtccccacattagcctctggmtgaggtgtggggaaaagctcacagatcagactggggggacctgagttccagccccagctcctcgcgggctgcctgtgtgacctgagagccccgaggctcc

SEQ ID NO: 28666 - DNA, 201 bp, Homo sapiens
ggtgattattaaaaagtcaagaaacaatagatggtggcaaggctgtggagaaatagaaacgctttcacattgttggtgggaatgtaaattagttcaacttytgtggaagacagtgtggtgattcttcaaggatctagaaccagaaataccatttgacccagcaatcccattactgggtatatacccaaaggaatataaatc

SEQ ID NO: 28667 - DNA, 201 bp, Homo sapiens
gatgaaaggagcccacgtcccatgcacgatactggcaagctaggattcaaacacagtggggctccagcaccttccctttcagtccccacattagcctctgkctgaggtgtggggaaaagctcacagatcagactggggggacctgagttccagccccagctcctcgcgggctgcctgtgtgacctgagagccccgaggctc

SEQ ID NO: 28668 - DNA, 201 bp, Homo sapiens
ttaagttaaagagctcctgcacagcaaaagaaactagcatcagagtgaacagacaacctacaaaacgggagaaagtttttgcaatctatccatctgacaarggtctaatatccagaatctacaaggaacctaaatttacaagaaaaaaaacaaacatcaaaaagtgggcaaaggatatggagagacacttctcaaaagaag

SEQ ID NO: 28669 - DNA, 201 bp, Homo sapiens
gttttccaatgctagcttcttcagtttccgctgagttcttttctcctggagtgtgagatcacaatggcatgccttacaaaagagtgctcttgcctgctccrtcctggctgctcccaggccgaccctggctcctcaccagcaccctgccgtaaacgctcagctgccccttcccctagcagcagcgtcggcactacatttagg

SEQ ID NO: 28670 - DNA, 201 bp, Homo sapiens
attcgttagtggagctctgttccagctgtagctaataaagttattttctcgctgaaatcggtgatggtaaaattggtctgttttccaatgctagcttcttyagtttccgctgagttcttttctcctggagtgtgagatcacaatggcatgccttacaaaagagtgctcttgcctgctccgtcctggctgctcccaggccga

SEQ ID NO: 28671 - DNA, 201 bp, Homo sapiens
ctgtgttctgtgccacaaccaaagattcagatatcaattttgtccacttgtagctcatttgagatctgttaagcaacaacagtgaatgctgggtggattcrttagtggagctctgttccagctgtagctaataaagttattttctcgctgaaatcggtgatggtaaaattggtctgttttccaatgctagcttcttcagtt

SEQ ID NO: 28672 - DNA, 201 bp, Homo sapiens
ggattacaggaaaaacaaccaaaaatagaacaattacagtagcaccgagtgctagagacaaatttcctgccaaatctcttttccagttccctcagtctgcstctgtgttctgtgccacaaccaaagattcagatatcaattttgtccacttgtagctcatttgagatctgttaagcaacaacagtgaatgctgggtggatt

SEQ ID NO: 28673 - DNA, 201 bp, Homo sapiens
gtttaattttttatttttatcaaaagtaggagtggtgcacacgacctcactggtcctttacagacttatcgtgactccggccctgggcttcatttggccgscgttgctagtcttgctgaagctccggagcaactactaaactgtggggatttagattttacttgttcagttcgcagactgccagtcccctgggtacccaaa

SEQ ID NO: 28674 - DNA, 201 bp, Homo sapiens
atacaaacatgtagtgaaagaaagacgtggcggtttaattttttatttttatcaaaagtaggagtggtgcacacgacctcactggtcctttacagacttawcgtgactccggccctgggcttcatttggccgccgttgctagtcttgctgaagctccggagcaactactaaactgtggggatttagattttacttgttcag

SEQ ID NO: 28675 - DNA, 201 bp, Homo sapiens
gtcccaagctctcttccctcatcatctcagatagctttgtggttgtcactgtgttgttttatatatgaatattttttatggatttttatatatggattgcygtgtgacttatgtttccctgccctaagcacaccgatgaaagtacattaatactcaaaatgactttgaaaagaccaaaagaaacaaaaaaagtcctaaatt

SEQ ID NO: 28676 - DNA, 201 bp, Homo sapiens
acagtcccaagctctcttccctcatcatctcagatagctttgtggttgtcactgtgttgttttatatatgaatattttttatggatttttatatatggatygccgtgtgacttatgtttccctgccctaagcacaccgatgaaagtacattaatactcaaaatgactttgaaaagaccaaaagaaacaaaaaaagtcctaa

SEQ ID NO: 28677 - DNA, 201 bp, Homo sapiens
attgcagtataaggtacattcaccaaaacatcactttgatgtgtctttagatgagttttggccaatctatacagtcatgtagccaccaccattatcaaaayagagcataaggctaaagttccctcttgccgtttgtcccttcccctgacctctagcccctggcaaccacggatctgattgttgtcctggttttgcgtttat

SEQ ID NO: 28678 - DNA, 201 bp, Homo sapiens
ccagattgttcttcatggattagaacatgagccacataaatttttttattatgacctcttgatgaattatctcatttctcattatagaacgttttttttttgactctaacaacatttttcatcttcagtcttttttggcatttttaaattgtgtgtcatagttgtacatatttttggagtacacatgatattttgatgcat

SEQ ID NO: 28679 - DNA, 201 bp, Homo sapiens
caggaagactttgagtagaactgttattatttcttccttaaatggtgggtagaattcaccagtgcctccatctggtcctagagttttacctgtggaaaggytgtgaactacagattctatttctttaatgaatctagggccatttttattatctattacttcttgaaagagctttggaatttttcatctttcaagacattt

SEQ ID NO: 28680 - DNA, 201 bp, Homo sapiens
caatcagacaagaggaagaaataaagcatattcaaataggaagagaggaagtcaacttgtctctgtttgcagttgacctgattctatgtttagaaaactayatcattggagcccaaaaacttcttgaactgataagcaacttcagcaaattctcaggatacaaaatcaatgcaaaaatcacaagcattcctatacaccaac

SEQ ID NO: 28681 - DNA, 201 bp, Homo sapiens
ttcctgctgcctgttctgcctgctcctttagtttttttgtttgtttgagatgaagtctcactcactctgttgcccaggctggagtacagtggcgtgatctyggctcactgcaacctccgcctcccgggttcaagcgattctcctgcctcagcctcctgagtagctgggaatacaggtgcccaccaccatgtctggctaatt

SEQ ID NO: 28682 - DNA, 201 bp, Homo sapiens
gttctggccagggcaatcagacaagaggaagaaataaagcatattcaaataggaagagaggaagtcaacttgtctctgtttgcagttgacctgattctatrtttagaaaactacatcattggagcccaaaaacttcttgaactgataagcaacttcagcaaattctcaggatacaaaatcaatgcaaaaatcacaagcatt

SEQ ID NO: 28683 - DNA, 201 bp, Homo sapiens
tttagtttttttgtttgtttgagatgaagtctcactcactctgttgcccaggctggagtacagtggcgtgatctcggctcactgcaacctccgcctcccgrgttcaagcgattctcctgcctcagcctcctgagtagctgggaatacaggtgcccaccaccatgtctggctaatttttgtacgttaagtagagacggagtt

SEQ ID NO: 28684 - DNA, 201 bp, Homo sapiens
aagcattccctttgaaaaccagcacaagacaaggatgccctctctcagcactcctattcaacatagtgttagaagttctggccagggcaatcagacaagargaagaaataaagcatattcaaataggaagagaggaagtcaacttgtctctgtttgcagttgacctgattctatgtttagaaaactacatcattggagccc

SEQ ID NO: 28685 - DNA, 201 bp, Homo sapiens
tcacttgaggtcaggagttcgagaccagcctgccaacatggcaaaaccctgtctctactaaaattacaaaaatagatgggcatggtggcgggtgcctgtartcccagctaatcgggaggctgaggcaggagaatcacttgaacctgggaggcagagattgcagttagccaagatgaagtcagcttcatccctggttcaaca

SEQ ID NO: 28686 - DNA, 201 bp, Homo sapiens
taaccttccaactttgttcttattttttaaagttgttttggctattcagtgtatttggcatttccatacaaattttagagtcgctttctaaatggattacrtagaaaaaatttctatcaaagaagtctaccaggattctgattgggattgcattgaagctatagcaacttggagatgattgacctcttcacagtattgagt

SEQ ID NO: 28687 - DNA, 201 bp, Homo sapiens
tcctgataccaaaacctggcagagacacaacaagaaaaaggaaacttggccgggcacggtggctcacagtggctcatgcccataaccccagcacttagggragccaagcaggtggatcacttgaggtcaggagttcgagaccagcctgccaacatggcaaaaccctgtctctactaaaattacaaaaatagatgggcatgg

SEQ ID NO: 28688 - DNA, 201 bp, Homo sapiens
gttctgaaattgaggcagtaattaatagcctaccaaccaaaaaaagtccaggaccagatggattcacagccgcattctaccagaggtacaacgaggagctrgtaccattccttctgaaactattccaaacaatagaaaaagagggaatcctccctaactcattttatgaggccagcatcatcctgataccaaaacctggca

SEQ ID NO: 28689 - DNA, 201 bp, Homo sapiens
accaataacgagttctgaaattgaggcagtaattaatagcctaccaaccaaaaaaagtccaggaccagatggattcacagccgcattctaccagaggtacracgaggagctggtaccattccttctgaaactattccaaacaatagaaaaagagggaatcctccctaactcattttatgaggccagcatcatcctgatacc

SEQ ID NO: 28690 - DNA, 201 bp, Homo sapiens
agcagaactgaaggagttggagatgcgaaaaacccttcaaaatatcaatgaatccaggagccagttttttgaaaaaaaaaattaaggaaatagaccacttsactagactaataaagaagaaaaggagaagaatcaaacagacacaatagaaaatgataaaggggatatcacccctgatcccacagaaatacaaactaccat

SEQ ID NO: 28691 - DNA, 201 bp, Homo sapiens
cccaggaggacactgcatcaataggatagttccacgactgcagcaggaggtgctgtacatgcctctctgcgggtcttagcacaaatgggataggtctttgmctgtcttcagtctcttttgtctaatattggtagatccactccagctcttatggttactgtttgccttatccacacttacacgtttaaatgattgtttatt

SEQ ID NO: 28692 - DNA, 201 bp, Homo sapiens
aacaaaattaagggagaaatcaatgagaacaaaaagacgatgtaccggaagctctgggacaccgctaaagcagtgttagagggaaatttatagcactaaaygcccacatcagagagctggaaagatctcagatcgacaccttaacatcacaattaaaagaactagagaagcaagagcaaacaaatccaaaagctagcagaa

SEQ ID NO: 28693 - DNA, 201 bp, Homo sapiens
ccacacgtgcagtcagcaagccgagtcaccaggcacagagccctttctcctgatcccctcctcttgtttctattcccaggcctcattatgtataatgtcayagacacacacgcccaggaacatcccatcacagccaggacagaagcgccaagggaggtgctttgcacagattccatcttggagttagaagcacttgctcgg

SEQ ID NO: 28694 - DNA, 201 bp, Homo sapiens
tttgatgtgggtcaatcctacgtctgtgcacatcttaacaactatcgtaggtgtagggtgcctttggtttactagaggtttcatcagtccacctgattctyactactgacgtaaatgtcagaggtggtcctgcctcttctcagtctccatcccaaggctctttacagctttctgtggcctgattttcttgctgtggatgct

SEQ ID NO: 28695 - DNA, 201 bp, Homo sapiens
tcggtgcttgccaactacaaatagccccatgctggaaaatgatgctaattagtatgccattaaaaagggtggggggaccaccacccacaacaaaatggccrtgtgcaggcctgaagccctgccctgagggccacagggaagcatggccgctaatgcagcctaattcactttgtttggcagagagagcaagctcgccatgtt

SEQ ID NO: 28696 - DNA, 201 bp, Homo sapiens
gggtgcctttggtttactagaggtttcatcagtccacctgattctcactactgacgtaaatgtcagaggtggtcctgcctcttctcagtctccatcccaargctctttacagctttctgtggcctgattttcttgctgtggatgctgaagggcactcttcagtggtttctcccagggccgttgcggattgcagctgtttca

SEQ ID NO: 28697 - DNA, 201 bp, Homo sapiens; identical to SEQ ID NO: 6982

SEQ ID NO: 28698 - DNA, 201 bp, Homo sapiens
agaggtttcatcagtccacctgattctcactactgacgtaaatgtcagaggtggtcctgcctcttctcagtctccatcccaaggctctttacagctttctrtggcctgattttcttgctgtggatgctgaagggcactcttcagtggtttctcccagggccgttgcggattgcagctgtttcatacccagatgacctgggg

SEQ ID NO: 28699 - DNA, 201 bp, Homo sapiens
cagagtgagactccaactaaaataaattaataaatacatgaataaataaaaaataaaattcctttctgtagccactgtgagccaaaagcacgggcttaaaytgcagagtgctgtgtgtgcactcacaaatcccaggttcccagagtggagagccctgcaccccagccgcggccaagggtcagaagtagcaactggtgatta

SEQ ID NO: 28700 - DNA, 201 bp, Homo sapiens
ttctcagcctcctgcctcccatcccactttatgtccaaagaaggcttagtccattgggcagccttctgcctgctctgcagacacgcctctggcaaattccrtcaagacgctactgcttctgtctcagggttagcactgggctctccttgcctaagtcctggggggtttgaaagatcctgtgtgccctacagcagccctgtc

SEQ ID NO: 28701 - DNA, 201 bp, Homo sapiens
gtaatagatcaccttaaataggatgttataatggtgatgaagaccaatcacagctgcctggaaacagtagatcatgggtcaataatgggcccacacctggrttttgttactgagtcaacctacgctacttgttcatgttgtacctatttatcttgagctggtattagtatatccatttctaaaaatccttgcttgagaagg

SEQ ID NO: 28702 - DNA, 201 bp, Homo sapiens
atataaaatactcattttctggcgttcctggccagagatgtctacacagagcaaaatggatgaaaggacccacggtgagcagggaggactggtttggtccygtagcccagagtctcctatcttatataccaggtctgttcttgagctttcagagtgcaagtagagaaacagaatttagcatccactttctccgtggagatc

SEQ ID NO: 28703 - DNA, 201 bp, Homo sapiens
atttatgataggatggcatatcgctacatataaaatactcattttctggcgttcctggccagagatgtctacacagagcaaaatggatgaaaggacccacrgtgagcagggaggactggtttggtcctgtagcccagagtctcctatcttatataccaggtctgttcttgagctttcagagtgcaagtagagaaacagaat

SEQ ID NO: 28704 - DNA, 201 bp, Homo sapiens
gtgataaatataggggtacaggtatccctttgatatactgatttctgttcctttggacaaacacccagtagtgggattgctagatcatatggtagttctckttttagtttttttttgagaagcatctatactgttttctatactggctgtactaatttacattcccaccaacagtgtgtaagagttccctttactatgcat

SEQ ID NO: 28705 - DNA, 201 bp, Homo sapiens
cctactgtgctatcaaacactacggcttcctccttttatttaactgtgtatttgtaactgttaacccacctgttttatccccctcccccggcaccccacaycccgccccttcccacacacacacattcttcccagcctctggtatctaccattctcctctctacctgcatgagatcaactttttaagctcccacatatgag

SEQ ID NO: 28706 - DNA, 201 bp, Homo sapiens; identical to SEQ ID NO: 6997

SEQ ID NO: 28707 - DNA, 201 bp, Homo sapiens
tcgggctcttctgcagacgcgtggatgcctagatccctcccacgcaccccgagtgccacctgcaatggtccagacacacgcgggtcccacacgctctgctsgctttttgtaccaacacctttcaatcttgccccaaattacttggcctccacaacagctttgggaagtttccatctctgcctttgccattttccttctgtg

SEQ ID NO: 28708 - DNA, 201 bp, Homo sapiens
tgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttttttc

SEQ ID NO: 28709 - DNA, 201 bp, Homo sapiens
gtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcaccttttttt

SEQ ID NO: 28710 - DNA, 201 bp, Homo sapiens
tgtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttttt

SEQ ID NO: 28711 - DNA, 201 bp, Homo sapiens
gctgtgacccaagcttgcagggtacaaaatagcataaaacagaagtgacacattatatcttccccttaaaggggttttactgggaatagttgaagagaaacaaaatataacatccttaatgtaaaaagttctttgccatagacgtgccagtagctggagagctggaattgcaatgctttctttaagtatttctcacctttt

SEQ ID NO: 28712 - DNA, 201 bp, Homo sapiens
ccaggtgtggtggcgagcacctgtagtcccagctactccgaaggctgaggcaggagaatggcgtgaacccgggaggcggagcttgcagtgagccgagatcrcaccactgcactccatccagcctgagtgacagagcgagactccgtcttaaaaaaaaaaaaaaagcaataaacagaatctcatgcttctatacaataaaaa

SEQ ID NO: 28713 - DNA, 201 bp, Homo sapiens
tgctgtttccgttaggagacagaaacccaatcactaacttggagtatgagtcagaggcaggacagagaaatgtctgtctagtcggtgagctaattaatacrtgatcctgaggatggaggagccagggctgccgttccttctccactagggaaaaaaaaaaaagatgtttctctgtcaggcagctccctagctacctccagt

SEQ ID NO: 28714 - DNA, 201 bp, Homo sapiens
caggtgtggtggcgagcacctgtagtcccagctactccgaaggctgaggcaggagaatggcgtgaacccgggaggcggagcttgcagtgagccgagatcgyaccactgcactccatccagcctgagtgacagagcgagactccgtcttaaaaaaaaaaaaaaagcaataaacagaatctcatgcttctatacaataaaaat

SEQ ID NO: 28715 - DNA, 201 bp, Homo sapiens
gctaattagtatgccattaaaaagggtggggggaccaccacccacaacaaaatggccgtgtgcaggcctgaagccctgccctgagggccacagggaagcayggccgctaatgcagcctaattcactttgtttggcagagagagcaagctcgccatgttgctgcgggagtctctggggaacatgaactgccgtaccaccatg

SEQ ID NO: 28716 - DNA, 201 bp, Homo sapiens
agagaattagtcaagagcacttccacaatctccagggagagaagagggtttaggagacaaaagagccaacagcatggaagagctttgtggaactctgggcratgcatcccctacatggaagagctttgttgaactccaggcgatgcttcccctatacggaagagctttgtggaactcggcagtgcatcccctacacggaag

SEQ ID NO: 28717 - DNA, 201 bp, Homo sapiens
aggtgtggtggcgagcacctgtagtcccagctactccgaaggctgaggcaggagaatggcgtgaacccgggaggcggagcttgcagtgagccgagatcgcrccactgcactccatccagcctgagtgacagagcgagactccgtcttaaaaaaaaaaaaaaagcaataaacagaatctcatgcttctatacaataaaaata

SEQ ID NO: 28718 - DNA, 201 bp, Homo sapiens
aaacaggctctaagaacagagttaatgaactgagagaaaatagtttctggttatgctactagaaactgtggtttttatcctcataaatcattgctttaggraaaaaaagtcctttctaaacttttcctgtcctgtttccttttcattttttgaatgaatgaacagtagggtattctctgtctttgagttattttcttccta

SEQ ID NO: 28719 - DNA, 201 bp, Homo sapiens
acagtccttgcttgcaaatgcaaacagagaaaaagatactacccgagtgagcaggtgtttccgttggggtctgacaggagaaagacaccacacttagatcrggactatttagaaaagtatggatggagtgtagaaaatgaaaagggctaattagatagaccagggctagtcatagcagagtgccaggatggcctaggtccg

SEQ ID NO: 28720 - DNA, 201 bp, Homo sapiens
tcttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcga

SEQ ID NO: 28721 - DNA, 201 bp, Homo sapiens
cttataaaacaacccattcattttttcctatgaaagaaagaacttatcaggcattaattacataaaatatacttctaatcaaaatgtctttaccttttcttttttttttttttgagatggagtgttgctctgtcacccaggctggagtgcagcagcacgatctcggctcactgcaacctctacctcccaggttcaagcgat

SEQ ID NO: 28722 - DNA, 201 bp, Homo sapiens
gagcctccggactcgcctcctccctccagagggcaagggggttctgctgatgcagtccaggcaggcccactccctggacaccaggagagtggaaaagggtrgagactgagtctggagggcacggaggaaaattggctcagcatggattagaacagtctttcgcttcctggagcttaaaagccctccttacttacccttagc

SEQ ID NO: 28723 - DNA, 201 bp, Homo sapiens
agatctggataataggagcagaacagtttcaaaggacttgttacaatgtatcaagtcaataacttataattttagaaaatccctgaatacaaatttgcacrattttgagttgttttacaacttaccaggccgttaatctaagttttaaaagtctcttaatatacttaatcatagcctgtgcttttttttttaagtgctgaa

SEQ ID NO: 28724 - DNA, 201 bp, Homo sapiens
agtaaactaaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggc

SEQ ID NO: 28725 - DNA, 201 bp, Homo sapiens
gtaaactaaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggcc

SEQ ID NO: 28726 - DNA, 201 bp, Homo sapiens
catgccaccactcccggctaatttttgtattttttatggagatggggttttaccacgttggccaggctagtctcaaactcctggcctcaagtgatccaccygccttggcctcccaaagtgttgggattccgggtgtgagccaccgcacacagcctccctggattcttaatacagccctgagaggtaggcagtggggcagtg

SEQ ID NO: 28727 - DNA, 201 bp, Homo sapiens
gggttttaccacgttggccaggctagtctcaaactcctggcctcaagtgatccacctgccttggcctcccaaagtgttgggattccgggtgtgagccaccrcacacagcctccctggattcttaatacagccctgagaggtaggcagtggggcagtgcggggaggcaggggcttgttagatgctgcccatagatgagaaca

SEQ ID NO: 28728 - DNA, 201 bp, Homo sapiens
cttggcctcccaaagtgttgggattccgggtgtgagccaccgcacacagcctccctggattcttaatacagccctgagaggtaggcagtggggcagtgcgrggaggcaggggcttgttagatgctgcccatagatgagaacactgagattcagagagggcaaaataattcctagaggtgacaccgcttttcagagtggatg

SEQ ID NO: 28729 - DNA, 201 bp, Homo sapiens
aaagtgttgggattccgggtgtgagccaccgcacacagcctccctggattcttaatacagccctgagaggtaggcagtggggcagtgcggggaggcagggkcttgttagatgctgcccatagatgagaacactgagattcagagagggcaaaataattcctagaggtgacaccgcttttcagagtggatggggtgacacca

SEQ ID NO: 28730 - DNA, 201 bp, Homo sapiens; identical to SEQ ID NO: 6996

SEQ ID NO: 28731 - DNA, 201 bp, Homo sapiens
acagatgatattttgctttaaaaataactatttccatagcacgctgctgtgacccaagcttgcagggtacaaaatagcataaaacagaagtgacacattayatcttccccttaaaggggttttactgggaatagttgaagagaaacaaaatataacatccttaatgtaaaaagttctttgccatagacgtgccagtagctg

SEQ ID NO: 28732 - DNA, 201 bp, Homo sapiens
catcaaatggactgttagagtcagaattggtctctgtctttgccctttaatctgtggtgcatgtggaatatctgagcttctcctgtctatataattaggctgcaaaacagatgatattttgctttaaaaataactatttccatagcacgctgctgtgacccaagcttgcagggtacaaaatagcataaaacagaagtgaca

SEQ ID NO: 28733 - DNA, 201 bp, Homo sapiens
ggtataattataggtattttatattatcatcctcagcacagtctaaactgtgccttttgttcttgtgttctgttttactacatgtacattatccattttaktccattacatcaaatggactgttagagtcagaattggtctctgtctttgccctttaatctgtggtgcatgtggaatatctgagcttctcctgtctatata

SEQ ID NO: 28734 - DNA, 201 bp, Homo sapiens
cccttcccctgttttcttcttcttttctgtgataagatgatcatggatttgttttgtttttcttttgagacggagtctcactctgtcacccagcctggagwgcagtggcgctatctgggctcactgcaacctccgcctcctgggttcaagcgatcctcctgcctcagcctcccgaatagctgggattacaggcatgcacca

SEQ ID NO: 28735 - DNA, 201 bp, Homo sapiens
caggtgcgcaccaccatgcctggctaatagtttatatttttttgtagagatggggtttcaccattttgcccaggctgctctcaaactcctgagctcaggcratccacctgccttggcctcccaaagtgctgggattacaggtgtgagccatggtacccgtccaaaaaatcctcattttttatcacatcttttcaaagcatt

SEQ ID NO: 28736 - DNA, 201 bp, Homo sapiens; identical to SEQ ID NO: 6998

SEQ ID NO: 28737 - DNA, 201 bp, Homo sapiens
cactttacaaccaactgggtatagactttttctagattcttacagtattttccactctataattcctcattcacacaaaattcaacatcgttaaaaaaaawttttttttttgagacagggtctcactctgtcacccaggctgaagtgcagtggcgctatcttggctcactgcaacctctgcctcccaggctcaagtgatcc

SEQ ID NO: 28738 - DNA, 201 bp, Homo sapiens
cactttgggaggctgaggccggaggatcacttgaggtcaggagttcaagaccagcgtggccaacgtagtgaaacctcgtctctactaaaaatacaaaaatyagccaggcatggtggcgggcgcctgtagtcccagctactcgggaggctgaggcaggagaatcacttgaacctgggaggcggagcttgcagtgagctgaga

SEQ ID NO: 28739 - DNA, 201 bp, Homo sapiens
atggttgcatacactaagtggtaaactaagaccttcagattgtaagagatctgatttgcttttggtgggaaaaatcagctttgcattgtttgacagaatcrtagccatttaaagaaaagacacaaaggcacaaaatatcgaggcaggggcaggagaccgagggaggccacagcacaaggtacagaaatgagacgtaatgag

SEQ ID NO: 28740 - DNA, 201 bp, Homo sapiens
caggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgtg

SEQ ID NO: 28741 - DNA, 201 bp, Homo sapiens
tcaggagtcagaggttacagggttgcagtgagccgagatggcgccactgcactccagcctgggcaatagagggaaactgtttcaaaaaaaaaaaaaaaaaaagaatctctgggctgggcgtggtggctcacactgtaatcccagcactttgggaggctgaggccggaggatcacttgaggtcaggagttcaagaccagcgt

SEQ ID NO: 28742 - DNA, 201 bp, Homo sapiens
acctcaggtgatccacccacctcggccagcctggccaacatggtgaaaccccctctttactaaaattacaaaaattagtcaggtgtggtggcaggtgcctrtaatcccagctacttgggaggctgaggcaggagaattgcttgaactcaggagtcagaggttacagggttgcagtgagccgagatggcgccactgcactcc

SEQ ID NO: 28743 - DNA, 201 bp, Homo sapiens
taaactaaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggcca

SEQ ID NO: 28744 - DNA, 201 bp, Homo sapiens
tggagcatcccattgtcttcattcctggtccactaattttcatctgagttaagagttttgggtttgaattcaagggaaatgaaaagttcttaaaggggccrggcacggtggctcacacctgtaatcccagcactttggaaggtggaggcaggcagatcacctgcggtctggagttcaggaccagcctggccagcatggcaa

SEQ ID NO: 28745 - DNA, 201 bp, Homo sapiens
aaactaaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccac

SEQ ID NO: 28746 - DNA, 201 bp, Homo sapiens
aactaaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccacc

SEQ ID NO: 28747 - DNA, 201 bp, Homo sapiens
ctaaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccct

SEQ ID NO: 28748 - DNA, 201 bp, Homo sapiens
taaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctc

SEQ ID NO: 28749 - DNA, 201 bp, Homo sapiens
aaagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcc

SEQ ID NO: 28750 - DNA, 201 bp, Homo sapiens
aagtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcct

SEQ ID NO: 28751 - DNA, 201 bp, Homo sapiens
ggcctggaactcctggcctcaagcaatcctcccatcttggcccccacaaagtgctgaggttacaggcatgagccactgagcccaaccagcattctttattrtagccatttagttagtaataccagaaaatgccttctgttgttgtcaaatactatttctctcatctttttgttccttctcttcccttttccccccttccct

SEQ ID NO: 28752 - DNA, 201 bp, Homo sapiens
agtttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctg

SEQ ID NO: 28753 - DNA, 201 bp, Homo sapiens
tttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgat

SEQ ID NO: 28754 - DNA, 201 bp, Homo sapiens
tccagtcctggagctttccttggtggtgggcagggcagacagttttcagctgagggctttcccaggcccagcagcaaagtaagacccaaggaggcagggcrgtggcctgggctgtctacagggcctgccccagcatcactggacatggaagcaggtggaaaaaacagtgtggaccaggactcctgtccaggagaggactca

SEQ ID NO: 28755 - DNA, 201 bp, Homo sapiens
ttgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatc

SEQ ID NO: 28756 - DNA, 201 bp, Homo sapiens
cagtgagcaatgatcgtgccactgcactctagcctgggccacagagtgtctctattttttgaaaacttacattgaacagagcagtgcctcctctgaggggragcatccagtcctggagctttccttggtggtgggcagggcagacagttttcagctgagggctttcccaggcccagcagcaaagtaagacccaaggaggca

SEQ ID NO: 28757 - DNA, 201 bp, Homo sapiens
gagttagaggctgcagtgagcaatgatcgtgccactgcactctagcctgggccacagagtgtctctattttttgaaaacttacattgaacagagcagtgcytcctctgaggggaagcatccagtcctggagctttccttggtggtgggcagggcagacagttttcagctgagggctttcccaggcccagcagcaaagtaag

SEQ ID NO: 28758 - DNA, 201 bp, Homo sapiens
tttagctcagaatttatcaaaagcatgacacttaatgatacagaattaaaaccagctatcccagaccattgaaggagaccggggtcggggagggagaggcrgtgcaaacggtgttgcttttgtctttctgacctgcttctctcgtgatgtgttctgcaactggtaagaacattggatgaattataagattttaatcagtag

SEQ ID NO: 28759 - DNA, 201 bp, Homo sapiens
ggacagcccgctgaccacgctcttctcagtggagagccgggtgggaactgtgccaggggatgccgccccaactctgcacagcaggtctcctctcgcccccrgcctctgcacgggtgactcagtgtggtccacacacagccaacattctcccaggtggctcaagaatcaaatacagcttattttatgtatagctcaaggtga

SEQ ID NO: 28760 - DNA, 201 bp, Homo sapiens
tttcctcccaccaaagtcagggttacagaaggaagagaaggaggcagggagggagggaaaaggaaaggaaaggaaccacaatggcaccttgcctctgccaygctcctctccgatcgcctcctcaacaaagacgtcagattcccctctttgtaatgtcttctttgaatttcagcagtgtgggggatgttatgcttttgcctt

SEQ ID NO: 28761 - DNA, 201 bp, Homo sapiens
caaagtgctgggattaccatacctagcctaatctgctttcttttgacaatgcaaatgttttctttacatgtcatggaatggcttaaatcaactaatgctgyatttagggctgtgtggtggatatgactctggagatccattctttgggtggcagatgtgggaaaagaggcttaggaaagaaccttgcttctaatggagcca

SEQ ID NO: 28762 - DNA, 201 bp, Homo sapiens
gccatcgctctcttaatctgtattatgatcttgtctttatatatgagttttgtttttcaaattagtggatggccttaggtaccattttgttattctgcttstttgtgtcttctgaagacagtcacagcatcatagaatactacagattggaggggtctatgggatcatcagaaccagtgcttttcaaaaaaattttaactg

SEQ ID NO: 28763 - DNA, 201 bp, Homo sapiens
atgccttatagacatagcctgaaggtaactttatacaatatcttcaataattttgtgcatgaaacaaagtttttactgcattttgactgcaacccctcacraggtcaggtgtggaattttccccttgtggcatcatattggccttcaaaaagtttgagattcttggagtattttggatttcagattttttgggttagggat

SEQ ID NO: 28764 - DNA, 201 bp, Homo sapiens
aaagaaagggcaaataccacgaatggtttccaaaacctcggttaggtccttcctaatgtttcagtggatgagaacaaagaaggggaaggagtccaggggtsgtgcgatcggcagacctgggggacatctcttccctcccgaggggaaaggatcccggccagaatgcacacggcctccccgcctgggactcacttgacttca

SEQ ID NO: 28765 - DNA, 201 bp, Homo sapiens
cccatgcattcctctgtctccctcccagagttctctgatgacaggaagggctgcgtttctcttaggtgttgagctgaataaccaataacaagttatacgaygaaaacctatgttgttcattgtaggtggacacccattcatgtaggaaagccttcaagtccaaatagatggaaagagaagtagcagagttgttcccacttg

SEQ ID NO: 28766 - DNA, 201 bp, Homo sapiens
caatctatacagtcatgtagccaccaccattatcaaaatagagcataaggctaaagttccctcttgccgtttgtcccttcccctgacctctagcccctggmaaccacggatctgattgttgtcctggttttgcgtttatccaggatatcgtgggaatggactcgtgtggcccagatgtggccttttgtgtctggcttcttt

SEQ ID NO: 28767 - DNA, 201 bp, Homo sapiens
attctctgccttctgtgaagtagtgtttactctatgcccaaaagagttgagcaccagatcagctgaatgtctccagtggggatcttggaccaggggcaaaktggtctgttgatttcactgggttcctaaggcaggttgtgggtaacggggctgctgggctggccgggcagtggcttccgtggttcctccatgtcccgctct

SEQ ID NO: 28768 - DNA, 201 bp, Homo sapiens
tgaaggctaagaaaaagaagaaaagaccaatattccctttaattcttgttgaaaaatcttttaaattctttggtttatttttccatagcgagacaaaattktgaacacaaaagaatctctctttgaagtctgaggattttgatggcctcaggttctaaatattggctcttacagttcaaaattatttgtatagttagagta

SEQ ID NO: 28769 - DNA, 201 bp, Homo sapiens
ccactgctcctgttccaggcattttctagacattcaaatatgctttcacccccattcgtttttagaacttcattgatgaaattccactaaggggtgaaaartctggttaaatgaaggctaagaaaaagaagaaaagaccaatattccctttaattcttgttgaaaaatcttttaaattctttggtttatttttccatagcg

SEQ ID NO: 28770 - DNA, 201 bp, Homo sapiens
tgcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatct

SEQ ID NO: 28771 - DNA, 201 bp, Homo sapiens
gcatttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctg

SEQ ID NO: 28772 - DNA, 201 bp, Homo sapiens
tttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctc

SEQ ID NO: 28773 - DNA, 201 bp, Homo sapiens
ttcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctca

SEQ ID NO: 28774 - DNA, 201 bp, Homo sapiens
tcacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcag

SEQ ID NO: 28775 - DNA, 201 bp, Homo sapiens
caattctcctgcctcaacctcctaaatagctaggattacaggtgtgcgccaccatgcccagctaatttttgtattttcaatagagatggggtttcaccatrttagccaggctggtcttgaactcctgacctcgtgatctgcctgcctcggcctcccagagtgctgggattacaggtgtgagccatcgcacctggcccactt

SEQ ID NO: 28776 - DNA, 201 bp, Homo sapiens
cacacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcagg

SEQ ID NO: 28777 - DNA, 201 bp, Homo sapiens
acacttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggc

SEQ ID NO: 28778 - DNA, 201 bp, Homo sapiens
acttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggctt

SEQ ID NO: 28779 - DNA, 201 bp, Homo sapiens
ttttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttct

SEQ ID NO: 28780 - DNA, 201 bp, Homo sapiens
tttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctg

SEQ ID NO: 28781 - DNA, 201 bp, Homo sapiens
ctgtggcctgattttcttgctgtggatgctgaagggcactcttcagtggtttctcccagggccgttgcggattgcagctgtttcatacccagatgacctgrggggcatcttcagtgtgtgcagatcagactcagcactgatactcgtcctccagccgtactttgtctccgcggtggtgctcagacttaaagcacttctcag

SEQ ID NO: 28782 - DNA, 201 bp, Homo sapiens
ttaagggaatcctcctgcctcagcctcccaaagtgatagaattacaagtgtaagccaccacacttgtccatcattgccttttaatctttgcatcctgccayctccccagcacagccagcataggagccggcacttagtacatgtttgtttggggaatgaatgtgaggtcactagtcaatgattctgaaatgagtctattga

SEQ ID NO: 28783 - DNA, 201 bp, Homo sapiens
ggacagctgacggtatagcagccagggaaggctgcacctgtgtttccattttagcgctttgatgtgctgcatgcggttgccctgcaattagttcatatgcrtgaatcacaatggcatatgtaaaacgtgtgctcatacagacccctctccaaagacctcacgcatcctttgcttctggagagaattcccctgaatgtatgt

SEQ ID NO: 28784 - DNA, 201 bp, Homo sapiens
cacagacacacacgcccaggaacatcccatcacagccaggacagaagcgccaagggaggtgctttgcacagattccatcttggagttagaagcacttgctyggtgcttgccaactacaaatagccccatgctggaaaatgatgctaattagtatgccattaaaaagggtggggggaccaccacccacaacaaaatggccgt

SEQ ID NO: 28785 - DNA, 201 bp, Homo sapiens
caggctgctctcaaacttctggcctcaagcaagttgccctcccgggcctcccaaagtgctgggattacaggcatgagccactgcgccgagcctctgatgcrttcttgccggtcatttgtacagtgttgcttgcatgtgagttcttcttcaggtcgagattaagggtatgacattagtactaaccattattcaacctctgaa

SEQ ID NO: 28786 - DNA, 201 bp, Homo sapiens
ggtattaaaaacccaccgatctttaatccaggttcgtggcagggggactcctttttgttgcaagattgtctgtgtgtggaaaccctggagaaaggccacaygtgcagtcagcaagccgagtcaccaggcacagagccctttctcctgatcccctcctcttgtttctattcccaggcctcattatgtataatgtcacagaca

SEQ ID NO: 28787 - DNA, 201 bp, Homo sapiens
tgatttttaaaattcctttctgggctgggcgtggtggctcacacttgtaatcccagcactttgggaggccaaggcaggcggatcagaagatcaggagttcragaccagcctggccaacatggtgaaaccccatctctactaaaatacaaaaattatccaggcatggtggtgtgtgcctctaatcccagctactcaggaggc

SEQ ID NO: 28788 - DNA, 201 bp, Homo sapiens
taattacactcggctaaatttttttgtatttattagagattggctttcaccatgttgaccaggctggtcttgaactcctgagctcaggtgatccacccacrtcggcctcccaaggtgctgggattacaggcgtgagccacggtgcccagcctgaagtgaaatcttataagaccctcagtattggtccagggagggtagact

SEQ ID NO: 28789 - DNA, 201 bp, Homo sapiens
aaaattcctttctgtagccactgtgagccaaaagcacgggcttaaactgcagagtgctgtgtgtgcactcacaaatcccaggttcccagagtggagagccytgcaccccagccgcggccaagggtcagaagtagcaactggtgattaatcaagtggctcctgtcttaggacagtcagcgtttattgtctctgcaggccaga

SEQ ID NO: 28790 - DNA, 201 bp, Homo sapiens
tcccactatgctggtatgttctctctctggacagccgtctttctaacaacgggtgctgttctgaaaagctgggagcccaagaaatgttgtaaaaaccaagygtggccttcagctgttggaccctgaggaacagcacctgcattagggccttgctcacgtttcttactagacaggttgccagctctcatttttgccctttgt

SEQ ID NO: 28791 - DNA, 201 bp, Homo sapiens
cagtatctacacagtgtctgtgatgcaatcagtaggactcgacccactgctcctgttccaggcattttctagacattcaaatatgctttcacccccattcrtttttagaacttcattgatgaaattccactaaggggtgaaaagtctggttaaatgaaggctaagaaaaagaagaaaagaccaatattccctttaattctt

SEQ ID NO: 28792 - DNA, 201 bp, Homo sapiens
tgtttactttaaagtggactggaactttatggcctgcagctgtggggccatcggcttgcccagtctaaatatttgtaccttgactctaattgacaatgagyagggaccacaattacagcatttgggggagaaatggaattcactttctttatgcccctttcaaaaaaaaaaagtaacaatctttcttttgtttaacaacaa

SEQ ID NO: 28793 - DNA, 201 bp, Homo sapiens
ggaaaaatccagtcaacagtttaatatgaaaatagagacctgtagaccaaatggagggcaggaagcagatatttgccacacaaacatttattgagcgcttratgtattataggtgctgtgtaaagttttggagattcagaaatgaatcaaagagaggagtgaacatacaaattatcccaactataataccggtgataagcc

SEQ ID NO: 28794 - DNA, 201 bp, Homo sapiens
aagtgatcctctcgcctcagcttcccaagtagctggggccacaggcatgccccaccacacccagataatttttaaaaatttttcatagaggcagggtctcygtatgttgcccagactggcctggaactcctggcctcaagcaatcctcccatcttggcccccacaaagtgctgaggttacaggcatgagccactgagccca

SEQ ID NO: 28795 - DNA, 201 bp, Homo sapiens
atccagtcctggagctttccttggtggtgggcagggcagacagttttcagctgagggctttcccaggcccagcagcaaagtaagacccaaggaggcagggmagtggcctgggctgtctacagggcctgccccagcatcactggacatggaagcaggtggaaaaaacagtgtggaccaggactcctgtccaggagaggactc

SEQ ID NO: 28796 - DNA, 201 bp, Homo sapiens
aaatacgaaaggtaaaaaagggaaataaatcttcctttcaggacccaagctacttatcagggctaaacaaaaaataccaagtaagaatgtaatgatgaggkgtggggagggggcaaaaaataaaattaaaaagaatgtaacaagcaacgagacgctcctgactttgaacctgtgtgcagggctccgggtagattagaaggc

SEQ ID NO: 28797 - DNA, 201 bp, Homo sapiens
ctgtttaataaactctatgtatacgtgtgtcagcagagggtgagtggagagtttaaagaccttatccgggaccccagaatggcagatgagggaagggaatkaggttcatgagcacactgtgcccccattccagcctgctcctgcctgctctacagacgcattcgctgaaacgtaccacggattagcagaagggtggtttgc

SEQ ID NO: 28798 - DNA, 201 bp, Homo sapiens
cccaggaggcggaggttgcagtgagttgagatcgcaccattgcactccagcctgggcaacgagactgaaactccgtctcaaaaaaaaaaaaaaaaaaaaaaatgaggaaggtgtgaattgaaaatgaggaaagagatcaggagagaaagcagatatatatcacaaacctcttgcttacgtgagaactacggtgtttctcaa

SEQ ID NO: 28799 - DNA, 201 bp, Homo sapiens
aaggtaaaaaagggaaataaatcttcctttcaggacccaagctacttatcagggctaaacaaaaaataccaagtaagaatgtaatgatgaggggtggggagggggcaaaaaataaaattaaaaagaatgtaacaagcaacgagacgctcctgactttgaacctgtgtgcagggctccgggtagattagaaggcatcctaac

SEQ ID NO: 28800 - DNA, 201 bp, Homo sapiens; identical to SEQ ID NO: 6983

SEQ ID NO: 28801 - DNA, 201 bp, Homo sapiens
tcaagcatggactatgaatgcgttttagatttattccacaaaaagggtccattttaattgctagtctttgtttacatttcacactcggctgcagagctcartatgctcaatactggagtttcgctcatttcagaatgccttactttcattcacatttccaatgttataataaattacatgtctgtataaatttgcagtttt

SEQ ID NO: 28802 - DNA, 201 bp, Homo sapiens
tggagccacttcccacgccgcactgatgggagaaactgcaggactccaccaggctttctctggctccaggacccccacgaaggcctcctgatttatctggrgcagctcctgcataagaagggtgaccgtttcccacagtggagaaccagacactgggcacagcccacttgataagacagcttccatctcccgcccctcctg

SEQ ID NO: 28803 - DNA, 201 bp, Homo sapiens
aagaagacaaagtactttatgaataagttctatggtttctctccttattacattttttgtgtggcatatcacccaatgggctcagtaatttaaacctgacrtttggtctaacaaatggcctacaaataatttcattaacacagttaaaacttttcagaagcaaatctccacaagttgtaagaattccaaagcaaaccctaa

SEQ ID NO: 28804 - DNA, 201 bp, Homo sapiens
tatattacaccgtgggcacacagcacatgttacaggctccattcattaagaagttgagcatgcggtttccccaaagagttttacccaagaagacaaagtaytttatgaataagttctatggtttctctccttattacattttttgtgtggcatatcacccaatgggctcagtaatttaaacctgacgtttggtctaacaaa

SEQ ID NO: 28805 - DNA, 201 bp, Homo sapiens
gctgcatctgagtagaggaggtggcgatgttctcacgggctcctatattacaccgtgggcacacagcacatgttacaggctccattcattaagaagttgarcatgcggtttccccaaagagttttacccaagaagacaaagtactttatgaataagttctatggtttctctccttattacattttttgtgtggcatatcac

SEQ ID NO: 28806 - DNA, 201 bp, Homo sapiens
gaattgctgccttacaaatcaccctaaaattcagtgcttaatacagtaagcatttatcattgctcatcggtcagctgagcagctcttctggtcctagctcmgctcatttttatgtctgtgatcagctgtgggttgggcaggcagctctgtggatcttggctggatatcagccaggcgaaataagatcatcctatatcacac

SEQ ID NO: 28807 - DNA, 201 bp, Homo sapiens
ttttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctgg

SEQ ID NO: 28808 - DNA, 201 bp, Homo sapiens
tttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctggg

SEQ ID NO: 28809 - DNA, 201 bp, Homo sapiens
ttaaaaacattaaagatatctctctcactgatttgcaatccaaaatgtaatcaaagccctgagttcacccatgagactgtgtcgaggagcggggcatcggtctggggtcacagaacatcataagagaaggtgtggcttccatctgcccagtggccacgtggcagctgaggccaccctcctgatctgctcaggcttctgggg

SEQ ID NO: 28810 - DNA, 201 bp, Homo sapiens
gctactcaggaggctgaggcaggagaatcgcttgaacctgggaggcagaggttgcagtgagcagagatcgcgccactgtactccagccttgacgacagagygagactccatctcaataaaaaagaaaaagaaaaagaaaaacgagaagttgccaagaccctgcctcttcctgcacagagcatctggttcttccatttcagc

SEQ ID NO: 28811 - DNA, 201 bp, Homo sapiens
tggaatgatgacactggtttccattctgttgcgatgatccttcccatccgtataaggcctgacaatttccatgcccttgcacctatgtcatcttcctggattttttttttttttttgagacagtctcactctgtcgcccaggctggagtgcagtggggcgatcttggctccctgcaacctctgcctgctgggttcaagcga

SEQ ID NO: 28812 - DNA, 201 bp, Homo sapiens
ttatagcgctgtcaggaatgctctagctattggtgggccctcagagcacagtgaattcgagggctctgatgtattctgttgttttttttgggtttttttgttttttttattttgagacagagtctcactctgttgcccaggctggagtgcagtggcaccatctcagctcactgcaacctccacctcccgggttcaagcaat

SEQ ID NO: 28813 - DNA, 201 bp, Homo sapiens
ctgtcaggaatgctctagctattggtgggccctcagagcacagtgaattcgagggctctgatgtattctgttgttttttttgggtttttttgttttttttwttttgagacagagtctcactctgttgcccaggctggagtgcagtggcaccatctcagctcactgcaacctccacctcccgggttcaagcaattctcctgc

SEQ ID NO: 28814 - DNA, 201 bp, Homo sapiens
cccggatccctttgtgcatgatttctgtcattcaaccagtgttcataaagcccttgtaacatggaggataaatatttgaataagatactggctttaccccrcagaagcttagagctttgaaaggaggtaagacatataggtaaataatacacataggaagttattttaaaaatataatgagagttattagagttcagaaga

SEQ ID NO: 28815 - DNA, 201 bp, Homo sapiens
agatggaggttgcagaaagccgagattgcaccactgcactccagcctgggtgacagagtgagactccaactaaaataaattaataaatacatgaataaataaaaaataaaattcctttctgtagccactgtgagccaaaagcacgggcttaaactgcagagtgctgtgtgtgcactcacaaatcccaggttcccagagtgg

SEQ ID NO: 28816 - DNA, 201 bp, Homo sapiens
ttccttcactgatgagaaagtgatcagatcagaactgatgttgtataaactgctctgtaattcctgcctgattggcttttcttgagaggtgcctgtccatwagcttttgccttccttttgtcaggctctctaaacactttaagtaacagaatcaattaagccttcctcacgattttagaaaactaagtggtagctcaggag

SEQ ID NO: 28817 - DNA, 201 bp, Homo sapiens
agcctgggtgacagagtgagaccctgtctcaaacaaaacaaacaaacaaacaccttgattgatgatccaatatagttcttttgttgttctttgggccttctttttttttttttttaatgatcacttatctttcccttgagggaaacctacgttgtaaatagagaattttttttttttttttttttttttttgagacggagt

SEQ ID NO: 28818 - DNA, 201 bp, Homo sapiens
aaaccaagcgtggccttcagctgttggaccctgaggaacagcacctgcattagggccttgctcacgtttcttactagacaggttgccagctctcatttttrccctttgtctgagctaattggccttagtgttacatcggcccacatttttctccctgtaaactccattcctccctcatttcatctacactgcagagaactc

SEQ ID NO: 28819 - DNA, 201 bp, Homo sapiens
tccattcctccctcatttcatctacactgcagagaactctcaagctcctggtgagttttgctgcaaagcctgtggcacgctgaaagaatgcaccccttccraacctcatcttcccacttcttccactggagacactgcgggggagaaacatgtaaatatcgttaataacaatgcatcgcgtccttgaaaattgctgctaag

SEQ ID NO: 28820 - DNA, 201 bp, Homo sapiens
ttcaagactggcctagccaacgtggcaaaaccccgtctctactaaaaatacaaaaatgttagccaggcatggtggcgggcgtctgtagtcccagctactcrggaggctgaggcaggagaatcgcttgaacccagaaggaagaagttgcagtgagccaagatcctccactgcattccagcctgggcgacagagtaagtgaga

SEQ ID NO: 28821 - DNA, 201 bp, Homo sapiens
aagtcaagacctgggtgtttgagtcccagctctgtgcataaccatttgagtgatcttaagaaaatgatcaccccctcttccatgctacagccctagatggkttactccttactccaccactctcctcaccttgactcgtgccggtccctcagcacgacgggtcctcctcctggctggctcctttcttctctccttctatga

SEQ ID NO: 28822 - DNA, 201 bp, Homo sapiens
aagttttggagattcagaaatgaatcaaagagaggagtgaacatacaaattatcccaactataataccggtgataagccacaaggtagctctgctagcacrgaacatatggaagagatgaataattctgcttcggagggaaggagtcatattagagttgggtctagaagaatgagcaggaggtggctgggaagggagggcg

SEQ ID NO: 28823 - DNA, 201 bp, Homo sapiens
ggtaccagttactttattaaggtaaattcccaaaactcacaatagtgggaaaaaatactgataagccttctaaaacaccaaagaagtgtagaacaacatcytggatgcttttagtcacgagtcagaacgccgcggtggttacagagcaatagcatttcagagctgggagagaccttagagatcatgtattttgtggatttt

SEQ ID NO: 28824 - DNA, 201 bp, Homo sapiens
aggtgccagatgatcagccagcctggggtgctcatgtaccccaataccgccctgtccagggcacctcaaaatgaagcacatcagaaaccgtcctcctgcayctacagtactggccttgtctgtggttcctacaagggttgatgtggatgcatcttcaggtggctccgacctctccccctctatccctaatgacctccctgg

SEQ ID NO: 28825 - DNA, 201 bp, Homo sapiens
tgaggcaagagaattgctttaactcaggaggcagaggctgcagtgagtcgaggtggtaccactgcactccagcctgggtgacagagtagaaccccatctcaaaaaaaaaaagaaaagaaaaaattaagtatagtcatgtgtcactgaatgatggggatgtgttctgagaaatgaatcattaggtgattttgttgttgtttg

SEQ ID NO: 28826 - DNA, 201 bp, Homo sapiens
gtgtcactgaatgatggggatgtgttctgagaaatgaatcattaggtgattttgttgttgtttgaacatcatggagtgtacttccacaaatctagatggtrtagcctcctacacacctaggctagagggtaggactgttgctgtactgaatagtgtagccatttgtaacacaatggtaagtatttgtgtccctaaacatat

SEQ ID NO: 28827 - DNA, 201 bp, Homo sapiens
gaagataacagaaagggacaaggacaatgcgtcaaggtgctggtgacagatctagtaggaccctactcctgcctgggcattgtacgaagggaaaaaaaaaagtgtttcagggagctgattagaattaggccatctcctaggccctgtataagcacactggggttgagggcaagcctgtagccctagtaaggaaccagagtg

SEQ ID NO: 28828 - DNA, 201 bp, Homo sapiens
gatggaccagttccttcaggagtcaatctgagctccaccgaatggtccagtgcttttgaattactggtgtcagaccttgggcaggatcagtgtgcacagayttcaataaaatctgtccttggggagaaggaagtgtgagccagtcagtggatcacacacagaagcaggaagataacagaaagggacaaggacaatgcgtca

SEQ ID NO: 28829 - DNA, 201 bp, Homo sapiens
ttatattaataggaagacaaagaacatgatgtgccagctccatattgaagtaatgggcatatcaaaatattctacctggtaattataaataaatcagtttycccgtgacccagcaaggatgatgttgctaattcactgtgcatttcatcataatttatcctgagaaagttcagtgctgccatgtgcatgtataacgcagag

SEQ ID NO: 28830 - DNA, 201 bp, Homo sapiens
tttaaggttaatattgttatgtgtgaatttgatcctgtcattatgatgctagctggttatttttcccattagtcgatgcagttttttcatagcatgaatgrtctttacaatttggtatctttgtgcagtgggctggtaccagttgatcctttccatgtttagtgcttccttcaggagctcttgtaaggcaggcctggtggt

SEQ ID NO: 28831 - DNA, 201 bp, Homo sapiens
gtgtgttttgtttgggcaaagaaatttaagccaatttacttttgttctgtaactcataactgaactgtgctcagagtctctggggtcctttcaggcatggstctgtggttctgtaatggtaactatgggttgatggagcaatggctttgtaaaatatgtttaaaagctccctctgaattgagggatcacagcctccttagt

SEQ ID NO: 28832 - DNA, 201 bp, Homo sapiens
ggttttaaaattttgttgcttttcaaaaaaacaaactttttattttgttggggttttttgtattgttattttagtctcaatttcatttatttctgctccawctttactcatttttttcctactaattttaggtttggtttgtttttccttttctagttcattgaggtgcaacattaggttgtttatatttggagtctatat

SEQ ID NO: 28833 - DNA, 201 bp, Homo sapiens
gctctaaaaagtgaggttttggccgggcacagtggctcatgcctgtaatcccaacactttgggaggctgaggcaagtggatcatttgagatcaggagttcragaccagtctggccaacatcgtgaaaccctgtctctactaaaaatacaaaaaattagccgtgcgtggtagcgggcgcctgtagtcccagctacttgggag

SEQ ID NO: 28834 - DNA, 201 bp, Homo sapiens
tctgggctctaaaaagtgaggttttggccgggcacagtggctcatgcctgtaatcccaacactttgggaggctgaggcaagtggatcatttgagatcaggmgttcaagaccagtctggccaacatcgtgaaaccctgtctctactaaaaatacaaaaaattagccgtgcgtggtagcgggcgcctgtagtcccagctactt

SEQ ID NO: 28835 - DNA, 201 bp, Homo sapiens
aggtgtctcacgctaaggagacagacatttgctttattcccgtggtcgatgttacttagtttcgttagttggggcctgcactttgttggaaactaaatgcsattgtgtatgtgtctacacaagatcaaatctgggctctaaaaagtgaggttttggccgggcacagtggctcatgcctgtaatcccaacactttgggaggc

SEQ ID NO: 28836 - DNA, 201 bp, Homo sapiens
tttgtgtccctaaacatatctaaacacagaaaaggtacagtaaaaataagattatcttatgggaccaccagtatatatgtggttcgtccttgactgaaacrttatacggtgcatgactgtatttggtttagcccatgtttttattttgaagaaatgcagaacaagtttaaaattgaattgttgaattgttgtcattagttg

SEQ ID NO: 28837 - DNA, 201 bp, Homo sapiens
tgcacttaaagccattgaatccaccagatgagtgtggacctcatttttttaggtttgggtagatctggccaatgagagcaagtaaccatcctatgtgaagytcatttcagttctaaactgatccttgaattcagatattgtcatattgatgcattaggagaattgtcttgggtgtgagatgagtgaggctatggagagaaa

SEQ ID NO: 28838 - DNA, 201 bp, Homo sapiens
tggcccactttttgtttttttataggtgttcaggaaatattaatttcatcctgctagagagactttttccttgaaataaggcacagataattatatgaagytaatggatgtttaaagatgtatgctgggataaatagctttaggaaatatattgtactatccttggtaagaataagacaagtagtttttaagttatggtag

SEQ ID NO: 28839 - DNA, 201 bp, Homo sapiens
agctaaagatgcttttatgtttcacctgctgctttggtacctgtattacataggtttaacccctattcagatacaatacggtacaatacaggacacatagrcctagattcagccttggctctactacttattatttattatattctttcaaaggatcattgattagtgtactaaatgctttacatgtactgtcattaaatt

SEQ ID NO: 28840 - DNA, 201 bp, Homo sapiens
actaggtgttaggtactgtgctgagcggtaggcttaggtttgaaataatggacaaggcagagcacctgtccttaaggtacttataacttagtgctttattscagtcagtcttagaaagctcaccaatttgggccaatatgaaggacaatctgatttaaggaaaaatcaggattgtaggcttaaaatgattctgtctcactt

SEQ ID NO: 28841 - DNA, 201 bp, Homo sapiens
aaaggatcattgattagtgtactaaatgctttacatgtactgtcattaaattctcataaaaagtctaaaaaagtaggtattatttttgcttcatcttcctrtgtggaaactgaggcttgataataatatttataatagtgatgatgatgatgatagcattgtcatgtgccaactgtgttccaggcactgtgcttgggcctt

SEQ ID NO: 28842 - DNA, 201 bp, Homo sapiens
acctcaggtgagctgcctgcctcggcctcccaaagtgctgggattacaggtgtgagccaccgtgcctggccaagattatcatgttttaagtgttacaggayacttgaatgatggacgatgtcattggaacagcctatgttattaatgatgccggcagcctcccctcccacctttccctgccttcacactctgtgccccctt

SEQ ID NO: 28843 - DNA, 201 bp, Homo sapiens
tagctcgttaacttcactctgttatagtaagggactgctacagaggacactgagcaggaggagagaaggaatgattaggcctcagaaagaacgaggggttktttaagagaaaacgaagtaagcctagcagatctgatcgtacaatcattttccccttattgttcctttttccactccagagctgcccagaagttaaatctg

SEQ ID NO: 28844 - DNA, 201 bp, Homo sapiens
atagctagcctgatagctttgtaaattaaattgttagctcttctgggaaattaactcatgtgacgttaaactccatagttaagcttacgtagagttggggktggtggttgttttccctttcttcctttatttcttattttgagccttccttcaaccgatacctccagagaaaggcgacttggggaaaatgttctgactctt

SEQ ID NO: 28845 - DNA, 201 bp, Homo sapiens
aacacattccatacaagtaagtgactcttctactcaaagaatgtggtggggtaagcatggtgtgggacgctttgttcagtgccatctgtggagaggtgtgycacagagggacagcctggaccccattataagttcagtgccagagaccagccttagctaacagttgtgtaatgcatgatctcccaaattcaaaacttttgg

SEQ ID NO: 28846 - DNA, 201 bp, Homo sapiens; identical to SEQ ID NO: 6985

SEQ ID NO: 28847 - DNA, 201 bp, Homo sapiens; identical to SEQ ID NO: 6987

SEQ ID NO: 28848 - DNA, 201 bp, Homo sapiens
ctgcgactccgagaggctctgagccagaaccacctggcaaaaattgctcccagattcccaacccacagggatatgtgagatcaatgtttgttgttttagcygctgggtttggggtttatttgttacacagcagccatttggaagctagagttgaggcacacagaagctaaacagtttgccaacagtcagctagcttgatca

SEQ ID NO: 28849 - DNA, 201 bp, Homo sapiens
gccggcacaggggacaaggccactgtaagaagtttgtaatctaattggagagaaagggtgaaaagcgtggaatagagaacagtgaactgagtgcattcccrgatgctgagtggggtagtgaaggcccaagtggagagagcatttagacaaagcaggatcctgcaaggcaaaggctgcagagaaatgtcgggattgagcttg

SEQ ID NO: 28850 - DNA, 201 bp, Homo sapiens
ttcttttgtttaacaacaaaccggaatatttactgctctgcacaaatagctagagccattacggggctgttgatgactctataaactgtgcttctggcacyggtttacagccggattagcagtgctgcaggaaaaactaataaccactttctaattagaaccgtgatataattgctagaactatggaagccaagagaagct

SEQ ID NO: 28851 - DNA, 201 bp, Homo sapiens
tgttaattggagtcttgggtggcacatgacagtaagttatgatgggcaaggagaagaggacccgggtcagagctggtggccctggaggtcttggggtaggwgaaatgaaaggatggtaaggagagaaaaagacagacagaggcaaaagttcccaagaacaactgaagctacttgagaattttgcctggaatcatctctgct

SEQ ID NO: 28852 - DNA, 201 bp, Homo sapiens
gtactccagaataattaatatataaagcccacagacttgttaattggagtcttgggtggcacatgacagtaagttatgatgggcaaggagaagaggacccrggtcagagctggtggccctggaggtcttggggtaggagaaatgaaaggatggtaaggagagaaaaagacagacagaggcaaaagttcccaagaacaactg

SEQ ID NO: 28853 - DNA, 201 bp, Homo sapiens
attcattagtgcagaagtcctcaaccttctcttgggtcctgaagcccagcttttgcagatggcgtcttagtcattagtaaggccgctccatcggagtcccygtcatacaaaatattaaaggaagctgtgaagatcggttgcagtgtctgctatcctgctgtcgtctggccagaggtgagccgagactgtggggcagcgggg

SEQ ID NO: 28854 - DNA, 201 bp, Homo sapiens
gggtacctaccctcatgacctggtggcttcagaagcccctcctgtgaggttggtggcctgcaagaccctggcagcctctctcagggatgtgggataacgcrcagattgtcccattgaaagtggaatggcgagacccttcctccacctccaccccaaacatatttgtggacagtcatgtttgcacacctgccacagggcctg

SEQ ID NO: 28855 - DNA, 201 bp, Homo sapiens
cttgctgaagctccggagcaactactaaactgtggggatttagattttacttgttcagttcgcagactgccagtcccctgggtacccaaacacggtcatgsctgggtttctgggcctcagaaggcctctgtctctctggagtctccccttgcaccctctaccctctcttcttttcacctttcccagtttctcccgtgtcct

SEQ ID NO: 28856 - DNA, 201 bp, Homo sapiens
caaatccaaacatcattctggatgaactgtggagcagttcaccgttcacagttcacaaaaggaccctctgtagaagcagaggatctttccctggggaaatyatcctaagtcttctgattttaataactgatatagttcaagtatttgtccccgcccaaatctcatgttcactgttaatccccagtgctggaggtggggcct

SEQ ID NO: 28857 - DNA, 201 bp, Homo sapiens
ggtttggattctatcgcgggcagtttatgcttctacgatagtaataaaagcaatgagagaaaaaagctacagaaccaaataaatatagatccaggagttgyacaacttttaaaagaaaaattctttagcctattgatccttcctaaggtaaacatttattttatttcagtttagaactcaagaatttttttcaagtacaac

SEQ ID NO: 28858 - DNA, 201 bp, Homo sapiens
aaccccttcaggaaactattcttaattccatcatcatttatagttgcctatctgcccaataaaccagaatttagccttaaagccatcgctctcttaatctrtattatgatcttgtctttatatatgagttttgtttttcaaattagtggatggccttaggtaccattttgttattctgcttgtttgtgtcttctgaagaca

SEQ ID NO: 28859 - DNA, 201 bp, Homo sapiens
gttcgagaccagcctggccaagatggtgaaaaccctgcctctactaaaaatacaaaaattagccaggcatggtggcaggcacctgtaatcccagctactcrggaggctgaggcaaaaggatcacttgaacccgggaggcggagttgcagtaagccaagatcgccaccactgcactccaggctgggcgacagagcgagactc

SEQ ID NO: 28860 - DNA, 201 bp, Homo sapiens
tggccaagatggtgaaaaccctgcctctactaaaaatacaaaaattagccaggcatggtggcaggcacctgtaatcccagctactcgggaggctgaggcaraaggatcacttgaacccgggaggcggagttgcagtaagccaagatcgccaccactgcactccaggctgggcgacagagcgagactccatctcaaaaaaaa

SEQ ID NO: 28861 - DNA, 201 bp, Homo sapiens
ggccaagatggtgaaaaccctgcctctactaaaaatacaaaaattagccaggcatggtggcaggcacctgtaatcccagctactcgggaggctgaggcaaraggatcacttgaacccgggaggcggagttgcagtaagccaagatcgccaccactgcactccaggctgggcgacagagcgagactccatctcaaaaaaaaa

SEQ ID NO: 28862 - DNA, 201 bp, Homo sapiens
cctttgaatccagagcactacacggtgcccaactgtcataggtgctcagtaaatactaggtgtattagccagagttctccagagaaacagaaccagcaggrtgtgtgtgtgtgtgtgtgtgtgtgtgtgtgtgtggagtgggggtgggggattgactgattttcaggactggactcctgtgactgtggaggttggcgggca

SEQ ID NO: 28863 - DNA, 201 bp, Homo sapiens
tcatgatgtaccatatgtagtgaccacagataaggggccttacaatgaggagttatgcttgttagtaaactaaagtttgcatttcacacttttttaaaaamattaaagatatctctctcactgatttgcaatccaaaatgtaatcaaagccctgagttcacccatgagactgtgtcgaggagcggggcatcggtctggggt

SEQ ID NO: 28864 - DNA, 201 bp, Homo sapiens
caagaaatacagtggagtttaatatagaacataaataattggcgctatatataaatcggcaggtttgaggtagacaagtttgatggaattcccaaaagcargttgattgattatttaaacctgacctggagtctcctagagtggaggaggggagcaggaatctccaacgcttgagatggccctgaaggtgagagtgttgtc

SEQ ID NO: 28865 - DNA, 201 bp, Homo sapiens
cctccaaagatgtttgccttcgatgcagtttttccacaagacgcttctcaggtgggtatcagccccctctcaggctcaggcaacgttgatgaaagggcaaygtttactcattcacaagggcccttgagctgggagggtgtcttctggagcattctgatggaccagttccttcaggagtcaatctgagctccaccgaatggt

SEQ ID NO: 28866 - DNA, 201 bp, Homo sapiens
agaaaggtcactgttttatcatctttcagaatcgtgtaacccacgtggttctgccaccatcctgtcttctgtgcattccttgactttgaaagtacgcatcytttcttttgaccaagtagataattaccgtctatcgaaatgaaccctcatgcatttattcaatgagagtttgtgtgcctaacacacagcatggctgcctga

SEQ ID NO: 28867 - DNA, 201 bp, Homo sapiens
tgtaacccacgtggttctgccaccatcctgtcttctgtgcattccttgactttgaaagtacgcatcttttcttttgaccaagtagataattaccgtctatygaaatgaaccctcatgcatttattcaatgagagtttgtgtgcctaacacacagcatggctgcctgatacagatacttggtttaagagaattctacaggct

SEQ ID NO: 28868 - DNA, 201 bp, Homo sapiens
ttttgaccaagtagataattaccgtctatcgaaatgaaccctcatgcatttattcaatgagagtttgtgtgcctaacacacagcatggctgcctgatacaratacttggtttaagagaattctacaggctctgcacgaaagtgaagtcatgatgtaaggaggcaaaggactctgccctcaaacagtccaatgggcctgaga

SEQ ID NO: 28869 - DNA, 201 bp, Homo sapiens
ggttttcgttcagagattgtcaaggccaactttgatataaatttcactttacattttacaccacacgtgactcataacatttaactctgtcatccatagarctcggtgctgttctgatcagcaaggtagattctggcccaaaagaactggtggaggaatttaaggaactggttctaagcctaattgaggtcaccaaacata

SEQ ID NO: 28870 - DNA, 201 bp, Homo sapiens
atgatactctgttctttagggcaatgaccacagttgctgtttctttttatcctcacttttctttcttttcactccctaccgatgagatcaatgaaaatttgggggcatttctagatttggcagcctcccatttataagcatacatttttttagttttgtgccctgacatgcccatttttctgagggtcaaatgtgtctgtc

SEQ ID NO: 28871 - DNA, 201 bp, Homo sapiens
actgtactggagctcctcctccatttgtgagattcttcttatgtctttgacatgttttgattgtaagatgtgttgcatatgcagatgtagaaacacacctrctcagtctatagaatgacaaaaaatctgtgtgcccaccacccaggttaggaaatagaacattccactagctcaggtgcccttgtgtgatcgtctgccttc

SEQ ID NO: 28872 - DNA, 201 bp, Homo sapiens
caggagcaggagtttgggaatgggcagaagcatattccccagggggagctgagagggctcagcactcagaacacccatgtttcccaacacttaacctcagmagcagcatctgcagactcgtgtggggacttctgtctggactcagggatgttaagagtagaaggcccaatgtcagcttctcacgtgggctgtcagcaccgc

SEQ ID NO: 28873 - DNA, 201 bp, Homo sapiens
gatcgccaccactgcactccaggctgggcgacagagcgagactccatctcaaaaaaaaaaaaaaaagtgtgaagccattttcattcattattaatatgatyacctttaattctgctgatgagggtgtgtggatatcattttctgttgtcttcattatcaaatggagaactagaaggggtaagcagcacattttggtttaat

SEQ ID NO: 28874 - DNA, 201 bp, Homo sapiens
agaaagttttcctttgtgcctcaaacagaataggaaatgctgttcttgcctactgaattgttcgtatcaaatagaaaatatttgaatccctttctaatgcytcattgaaccaaaatgtattattatggagggggagaataattccgatacattctttttttttttgagacagaatcttgctctgtcgcccaggctggaatg

SEQ ID NO: 28875 - DNA, 201 bp, Homo sapiens
gatgagctgagggacagtcatttttgtcccgtcatcatgcatttgatttgctccttgttttatgtaaatatataattttagacagcgtcttccttcgtcasccaggctggagtgcagtggccctgacacggttcactgcagcctcaacttcctgagctcaggggatcctcccacctcagcctctcaggtagctgggaccac

SEQ ID NO: 28876 - DNA, 201 bp, Homo sapiens
ccgtgtgacttatgtttccctgccctaagcacaccgatgaaagtacattaatactcaaaatgactttgaaaagaccaaaagaaacaaaaaaagtcctaaaytccgtgggaggaaaaaccatgatcctttagccctactccagaatagtaagaactgagagccaaagccaaggcggggacagcaccctgggagctgatgggc

SEQ ID NO: 28877 - DNA, 201 bp, Homo sapiens
aagtacattaatactcaaaatgactttgaaaagaccaaaagaaacaaaaaaagtcctaaattccgtgggaggaaaaaccatgatcctttagccctactccrgaatagtaagaactgagagccaaagccaaggcggggacagcaccctgggagctgatgggctggttagtcccatcccagattatatggaggcacccgggtg

SEQ ID NO: 28878 - DNA, 201 bp, Homo sapiens
cctcccgcaggagccaccaacaggactgtgatgaggacgaccaccgcaactcacacgtgttcttcacactgcacatctaccagtaccggatggagaagagygggaaagggggaagtaagtcggccactccaccctcctgcctccttagcggctctggccccagccagaaatcccttgggcaaccatgacctttgtgtgtgt

SEQ ID NO: 28879 - DNA, 201 bp, Homo sapiens
cccccaacagcacaggcgtccgctgggtggatggccccttgcggagcagcccgaggggccttggggaaccctttgagattaaagtctatgaaatcgatgaygtggagcgcctgcagcggcgacgagggggtgccagcaaggtgaggcagcctccttcccaccccctgcctacgtggtggcagctccccaccaagcctgagc

SEQ ID NO: 28880 - DNA, 201 bp, Homo sapiens
tttctggttttgatccccttgcttgtcttataggttttaccacctaagtatgtgtccccccaaaacatactgtttagttttgtctgctgttgaacgttacrtaaatgaaatcatactctattctatgcccttccgtaccttcttttgatcagtatttcatttttgagatccatcttgatgcgcacagctacaggttcttaa

SEQ ID NO: 28881 - DNA, 201 bp, Homo sapiens
ttccctggttctcccaggaaaatcctacaccatgatcggaaaggatgattccatgcagaacctgggcatcattccctgtgccatctcttggctcttcaagstcataaacgaacgcaaggaaaagaccggcgcccgtttctcagtccgggtttccgccgtggaagtgtgggggaaggaggagaacctgcgggacctgctgtc

SEQ ID NO: 28882 - DNA, 201 bp, Homo sapiens
cagcctgcttggtgcccagcactgggctggtgcaggttactgttggatattattggttgattcattgatgggctggttgcttggttggcggcacagtcctraaagtttactcatgtttattttctgtgtatttctcatatcttttcctgctggtgctaagtgctttaagtgttgagtctagtctgctactttgtcattcta

SEQ ID NO: 28883 - DNA, 201 bp, Homo sapiens
ccatccagattgcatcgagagtcttgaggatgaagaaaaagaagacgaaggtaaggagctcgcggggtgggggggtggtggatgagggagcctttggagcygtgccctggaacagagtcagaaaaagccaaatcaacgttgccaatcccccagcatcaggagatgtgacttggagctgacaacacgtggctcagggtccac

SEQ ID NO: 28884 - DNA, 201 bp, Homo sapiens
ttagagtacaaggcataaagcagttaaaagtcacattatcaagtacattcaaggaaagaggtaagcagttccagcaagtaggccgggcgcggtggctcacrcctgtaatcccagcactttgagagcccaaggagggcggatcatttgaggtgaggagtttaagaccagactgaccaacatggcaaaacccaatatctacta

SEQ ID NO: 28885 - DNA, 201 bp, Homo sapiens
acgcccttgctctgggctaagtgctctcgtaaatgctgtcctctaggagcctctggttaggtaaggctattggaggaaaacagtgtaaaattaaaatgccrgggcaggtgctagaaatggatttcatgtggaatgtcaagagcagaagacctttgtgatgagctgctgtagatccaggctccatgatggatgtggcagtgg

SEQ ID NO: 28886 - DNA, 201 bp, Homo sapiens
aatcccagcactttgagagcccaaggagggcggatcatttgaggtgaggagtttaagaccagactgaccaacatggcaaaacccaatatctactaaaaatmcaagaaaaaaaaaaaaaagccaggcgtggtggaacatgcctgtaatctcagctactcaggagcctgaggcaggcgaatcgcttgaaccccgggaggtgga

SEQ ID NO: 28887 - DNA, 201 bp, Homo sapiens
gtgccttgcgtctaccagtccatttcattatttccgtggctttcacaggtttttgtttttttccccaagacttttattgtttggtttggcggttacagtgsagtaaagaggaagaacaatgatggaaaaacaaacgtgtgaagtgactgcttggcgagcaggcagcaggctctgcatacgcccttgctctgggctaagtgc

SEQ ID NO: 28888 - DNA, 201 bp, Homo sapiens
cagcactttgagagcccaaggagggcggatcatttgaggtgaggagtttaagaccagactgaccaacatggcaaaacccaatatctactaaaaatacaagaaaaaaaaaaaaaagccaggcgtggtggaacatgcctgtaatctcagctactcaggagcctgaggcaggcgaatcgcttgaaccccgggaggtggaggttg

SEQ ID NO: 28889 - DNA, 201 bp, Homo sapiens; identical to SEQ ID NO: 6994

SEQ ID NO: 28890 - DNA, 201 bp, Homo sapiens
tttcagtgtcccacagtgctttcatggactcaaatttagtgccttgcgtctaccagtccatttcattatttccgtggctttcacaggtttttgtttttttycccaagacttttattgtttggtttggcggttacagtgcagtaaagaggaagaacaatgatggaaaaacaaacgtgtgaagtgactgcttggcgagcaggc

SEQ ID NO: 28891 - DNA, 201 bp, Homo sapiens
tttctcaggcagaggccaagccaggatggtggcagggtggcaagtagttgagaaaaccatcatgatcgtggccactcagtggcaggggcagctgctgaggkgggggcctttttcccccttctctgttttgtaccttttttatctttaaatagcgtttcttaaccagagttccacggcacagggtgccaaacattggtgagc

SEQ ID NO: 28892 - DNA, 201 bp, Homo sapiens
cccagctcggcccctgcttgataattgcctttgggaaaaaggtaatagccaccttgaaacaccattcagttggacctttccaaaagccacgggtttttctycaccaaagtccttcatttgagcctataatctgtgaatggaaagaagcgatgatgcctctaaaagccttttggttggagtcagagtcaccctttgagcact

SEQ ID NO: 28893 - DNA, 201 bp, Homo sapiens
taaaggaactgtgcaggtattaaaaacccaccgatctttaatccaggttcgtggcagggggactcctttttgttgcaagattgtctgtgtgtggaaacccyggagaaaggccacacgtgcagtcagcaagccgagtcaccaggcacagagccctttctcctgatcccctcctcttgtttctattcccaggcctcattatgt

SEQ ID NO: 28894 - DNA, 201 bp, Homo sapiens
gaaaccaggaggcggagcttgcagtgagccaagatcacgccactgcactccagcctgggcaacagagcgagactccttctcaaaaaaaaaaaaaaaaaaargaaaaaaaagaaaatttattgtagaatttaggacactatggccaataaccaatgatgaaagtctggttacacctatctagtcaagcctatcctcacctat

SEQ ID NO: 28895 - DNA, 201 bp, Homo sapiens
aagggcaggggagggaaaccgttggagttggagatgaagggaagagtactagcactcactggtttccataaaatgagaatcatgtctgttaatgtcagaayttcatagatcatgatatagataaaattccaaattgcaccttagcaggaggtcattgattacatatcttacttatagcttttacactgtttctgcagggcg

SEQ ID NO: 28896 - DNA, 201 bp, Homo sapiens
gtgatgagacatggacatggggacgaattcctctcatctggaatcgcagacacagcatggagatatgagcacgcggcatgggaaataggcttcctcagcccttcaggatcagggaacgtgccagagatgcaatgacatttggcagcagttgagagtatgagtgctgttgatgaaataaacagaggcctttaaaagcaaggc

SEQ ID NO: 28897 - DNA, 201 bp, Homo sapiens
gaattgatggcgggaagatagatgcatgtaaacatgaaattatttttaatttaaagtaacttccttttagttagagttgggttttttataaatgagtaggraaacattaaaaattgtttttatggcccagcgtggtggctcacacctatattcctggcactttgggaggctgaggcgggaggattgcttgagaccagcctg

SEQ ID NO: 28898 - DNA, 201 bp, Homo sapiens
cacgtgtaaaatggtctgctctctgctgacagtggcctgagtctcccatagtgtctgctgagctggatagtccctctccagggagctttgcaggggacggrtgatgagacatggacatggggacgaattcctctcatctggaatcgcagacacagcatggagatatgagcacgcggcatgggaaataggcttcctcagccc

SEQ ID NO: 28899 - DNA, 201 bp, Homo sapiens
gggcatggtgttgcatggttgtagtcccagctacttgggaggctgaggtggaagggtggcttgagtccaggaggcagaggctgcagtgagttgagattgcrctactgcaccagcctgggcaacagagtgagaccctgtctcaaaaaaaaaaaaataaatgaaagtttgtattaatcgttcaagcttcgtgttaattaagca

SEQ ID NO: 28900 - DNA, 201 bp, Homo sapiens
ggtcacgtgtaaaatggtctgctctctgctgacagtggcctgagtctcccatagtgtctgctgagctggatagtccctctccagggagctttgcaggggaygggtgatgagacatggacatggggacgaattcctctcatctggaatcgcagacacagcatggagatatgagcacgcggcatgggaaataggcttcctcag

SEQ ID NO: 28901 - DNA, 201 bp, Homo sapiens
gctgaggtggaagggtggcttgagtccaggaggcagaggctgcagtgagttgagattgcgctactgcaccagcctgggcaacagagtgagaccctgtctcaaaaaaaaaaaaataaatgaaagtttgtattaatcgttcaagcttcgtgttaattaagcatatttttaacatgctggccctaccaactggctacctgccct

SEQ ID NO: 28902 - DNA, 201 bp, Homo sapiens
aggccagaagcaggtcacgtgtaaaatggtctgctctctgctgacagtggcctgagtctcccatagtgtctgctgagctggatagtccctctccagggagytttgcaggggacgggtgatgagacatggacatggggacgaattcctctcatctggaatcgcagacacagcatggagatatgagcacgcggcatgggaaat

SEQ ID NO: 28903 - DNA, 201 bp, Homo sapiens
cgcatggcctgttttaaacattttaagaaaatattttatcatatttgcacaagaagattttcagtgaaggacaatgttttgaaaatccaatcagtaagatrctcgctgggaggtatttttatagaaatccatggaaagctaatcataggaaatcggaaaaacagagagcagggtttgtagcttggcctttcccctaccttg

SEQ ID NO: 28904 - DNA, 201 bp, Homo sapiens
ctgatttactcaaactcagctgatttaaatgttaatctcatctaaaaaaatacctccacagaaatatgaccaaatatctgaataccggggcccagccaaaytgacacattaccatcgcactaggggaatgaatggaatgatgacactggtttccattctgttgcgatgatccttcccatccgtataaggcctgacaatttc

SEQ ID NO: 28905 - DNA, 201 bp, Homo sapiens
tcagctgatttaaatgttaatctcatctaaaaaaatacctccacagaaatatgaccaaatatctgaataccggggcccagccaaattgacacattaccatygcactaggggaatgaatggaatgatgacactggtttccattctgttgcgatgatccttcccatccgtataaggcctgacaatttccatgcccttgcacct

SEQ ID NO: 28906 - DNA, 201 bp, Homo sapiens
ttgactgggtgcctgtgaaatgaggacttgggggggttcattttgtggaccactgatttcacaatcatttagcagtttccagggggagaaaagtggcctgsgtattcaacagagcttagagaagagactgtgtagggatttgcccagggagtgcagtagggagaggtgcatcaccaagaatatcggagacttctccttagc

SEQ ID NO: 28907 - DNA, 201 bp, Homo sapiens
atgcttatgttttcagcctttcctcccaccaaagtcagggttacagaaggaagagaaggaggcagggagggagggaaaaggaaaggaaaggaaccacaatrgcaccttgcctctgccacgctcctctccgatcgcctcctcaacaaagacgtcagattcccctctttgtaatgtcttctttgaatttcagcagtgtggggg

SEQ ID NO: 28908 - DNA, 201 bp, Homo sapiens
aaggaaccacaatggcaccttgcctctgccacgctcctctccgatcgcctcctcaacaaagacgtcagattcccctctttgtaatgtcttctttgaatttyagcagtgtgggggatgttatgcttttgccttactccgccttatattttggctgtttgtgagctagtccaagccctattggactataggttccttgagaaa

SEQ ID NO: 28909 - DNA, 201 bp, Homo sapiens
cacacaactacatggaaattgaacaacctgctcctgaatgagtcctgggtaaataacaaaattaagggagaaatcaatgagaacaaaaagacgatgtaccrgaagctctgggacaccgctaaagcagtgttagagggaaatttatagcactaaacgcccacatcagagagctggaaagatctcagatcgacaccttaacat

SEQ ID NO: 28910 - DNA, 201 bp, Homo sapiens
gccacattaccaaatttatcagttctcagagtttttggtggaatctttaggttgttctaattattatatgccatctgcagagaggaacaatttgactttckcttttccagtttggatgccttttatttctttctcttgcctaattgctctagctaggacttccagtactatgttgaataacagtggtggaagtgggcatcc

SEQ ID NO: 28911 - DNA, 201 bp, Homo sapiens
tagcatcttagtcaatgagaagacagagctgacctggtgcattcctcaacttctcttcttttggtttcatagtctcctggtccctttacctcagtttcccscctgctccttcccacaggcctgctgctcccgtctcctggcgttcttcctcctgccccttctgcctcttctgggacctcaccaattgggaccccctcagtg

SEQ ID NO: 28912 - DNA, 201 bp, Homo sapiens
tggcttcctcgtcgagtgcggctgtccgtgggtttctgctagacagataacgttctgaaggagttaaactttcacagctcctcctcctcctcctcctcctytatatcccttacctcgccacgttcatcactggtcattttgctggaagggaagccctggtatattcttacattgctctggaagtgagccttagcccagcgt

SEQ ID NO: 28913 - DNA, 201 bp, Homo sapiens; identical to SEQ ID NO: 6993

SEQ ID NO: 28914 - DNA, 201 bp, Homo sapiens
cagtcactgagacactttgggtctcagcagctgtgctgagctcgcctcctcctctctctggtagagcctgaggcaatctgtgatccaagctgcaggccacragcaaacaccgcaggcagcatccacttccagaaggctgtgttccacaaaagcgatgaggacacccatcctcaggggctataatgggaactcttttcctcc

SEQ ID NO: 28915 - DNA, 201 bp, Homo sapiens
gtaattgaaatgggccagatgcagtggctcacacctgtaatcccagcactttgggaggccgaggcgggcggatcgcctgaggtcaggagtttgagactagmctggccaacatgggtgaaaccccgtctctactaaaaatacaaaaaattagctgggtgtggtggcgcgtgcctgtagtcccagctactccggaggctgagg

SEQ ID NO: 28916 - DNA, 201 bp, Homo sapiens
acactttgggtctcagcagctgtgctgagctcgcctcctcctctctctggtagagcctgaggcaatctgtgatccaagctgcaggccacgagcaaacaccrcaggcagcatccacttccagaaggctgtgttccacaaaagcgatgaggacacccatcctcaggggctataatgggaactcttttcctcctaaggccctag

SEQ ID NO: 28917 - DNA, 201 bp, Homo sapiens
tttcaccgtgttagccaggatgttcttgatctcctgacctcatgatccacccacctcggcctcccaaagtgctgggattacaggcatgagccaccgcgccyggccggtctttggtatgttttcttggggacttacacagggtcacgtggagatacagggggatgcgccttcggcccatctgtatgtggggccactctggaa

SEQ ID NO: 28918 - DNA, 201 bp, Homo sapiens
gggtctcagcagctgtgctgagctcgcctcctcctctctctggtagagcctgaggcaatctgtgatccaagctgcaggccacgagcaaacaccgcaggcarcatccacttccagaaggctgtgttccacaaaagcgatgaggacacccatcctcaggggctataatgggaactcttttcctcctaaggccctagtgaggag

SEQ ID NO: 28919 - DNA, 201 bp, Homo sapiens
aggtaaggagctcgcggggtgggggggtggtggatgagggagcctttggagccgtgccctggaacagagtcagaaaaagccaaatcaacgttgccaatccmccagcatcaggagatgtgacttggagctgacaacacgtggctcagggtccactttggggcagggaaaccttggggctgatacaaagtcatgtcacctccc

SEQ ID NO: 28920 - DNA, 201 bp, Homo sapiens
ctcctgagtagctgggaatacaggtgcccgccaccacgcccagctaattttttgtatttttggtagagatggggtttcaccgtgttagccaggatgttctygatctcctgacctcatgatccacccacctcggcctcccaaagtgctgggattacaggcatgagccaccgcgcccggccggtctttggtatgttttcttgg

SEQ ID NO: 28921 - DNA, 201 bp, Homo sapiens
aggtgagcagtgggggagcatgaccacctgagggctgttggctgtctgatcagtggtggcactggattctcataggaacctcatgctattgtgaactgtgygtgcgagggatctagcctgtgcgctccttatgagaatctaatgcctgatgatctgaggtggagcagtctcatccccaaaccattccctactcccattggg

SEQ ID NO: 28922 - DNA, 201 bp, Homo sapiens
tcaccacgttacatccttttatccggtctttggtaagttttcttttcttttttttttttttttgagacagacaggtctcgctctgtcgcccaggctgaagygcagtggcgcgatcacggctcactgcaagctccaccccccgggttcacgccattctcctgcctcagcctcctgagtagctgggaatacaggtgcccgcca

SEQ ID NO: 28923 - DNA, 201 bp, Homo sapiens
caaaccattccctactcccattgggtccatggagaaattgtcttccacgaaacctgtccctggtgccaaaaaggtaaaagggtttgggactgcggagccayggcattgaattcccatctcacacaggagaggaaaggctcttcctcaggacttggatgtatattacttagacgtaccatgaaattaagtagatatttgcca

SEQ ID NO: 28924 - DNA, 201 bp, Homo sapiens
tcatgagccattcaggttttaacttgatgagtttcagaattctgctattcaaatggcatttaggtagaaacgtatcctcctgtaatttgacatttattttytccaaaatctcattcagttcaacctgcaagaattatttgaattcacttatttgtagtgtgaatgtcagtaggctttagaaggtcagtggtgcgtggtgga

SEQ ID NO: 28925 - DNA, 201 bp, Homo sapiens
tgtctttggtctgtcttcctgggtaatgtcacatggagacccaggggatctgccgtcagctgtgtgcagtgggttaacaagacgacggggaacttcagagygcaggcagtcctcatcttttgcagattctgtatttgcacattcacctactcactgaaatgcatttgtaaccccaaaatcaatacagcggtttcacagtca

SEQ ID NO: 28926 - DNA, 201 bp, Homo sapiens
aggcactgaagctataaccctattttctgagccagataaaatagcaaacatatatttgctctaccgggttattttgacaaatttatcaagcatcttcaaartatacagtactagtctaagcattagggctaatgcagagagcttttgcaccagtaggacagaggaaaaaatgtgcacaaattagagtacaaggcataaagc

SEQ ID NO: 28927 - DNA, 201 bp, Homo sapiens
agttctccagatttgtttaagatagcatgaaacggagaggttcatgtaagaatctgtgtgtgtgtgtgtgtgtgtgtgtgtgtgtgtgtgtgtgtgtgtgkgagagagagacatatgcatatttaacctcctttaaatgtacattaatgctgtattttctccccctgatttacagggagaatatcaatttagaactatttg

SEQ ID NO: 28928 - DNA, 201 bp, Homo sapiens
atacacagggcaggcagttcgctatcacgatgttctctctcaattctgtctttggtctgtcttcctgggtaatgtcacatggagacccaggggatctgccrtcagctgtgtgcagtgggttaacaagacgacggggaacttcagagtgcaggcagtcctcatcttttgcagattctgtatttgcacattcacctactcact

SEQ ID NO: 28929 - DNA, 201 bp, Homo sapiens
ttctccagatttgtttaagatagcatgaaacggagaggttcatgtaagaatctgtgtgtgtgtgtgtgtgtgtgtgtgtgtgtgtgtgtgtgtgtgtgtgwgagagagacatatgcatatttaacctcctttaaatgtacattaatgctgtattttctccccctgatttacagggagaatatcaatttagaactatttgca

SEQ ID NO: 28930 - DNA, 201 bp, Homo sapiens
tcggtgagtgtctcacagttcctttctccctcagccccatgatgccgtccagaacaaggtgctgaactgattaatgagcaggacataaagacaactgctgyccagagcaacagctgtcccaatccatccgtggaataaacaaacagggcagagcgaggtcccgaccagtggggacttgggtgcaggaaatgccagtctctt

SEQ ID NO: 28931 - DNA, 201 bp, Homo sapiens
tctcaagctcctggtgagttttgctgcaaagcctgtggcacgctgaaagaatgcaccccttccgaacctcatcttcccacttcttccactggagacactgygggggagaaacatgtaaatatcgttaataacaatgcatcgcgtccttgaaaattgctgctaagagagtagattgtaagtgttctcaccataaaaaagtat

SEQ ID NO: 28932 - DNA, 201 bp, Homo sapiens
ggggagtcgcagtaaacattttaccatgtgattgagtcatgggtggggagtcgcggaaatacacagggcaggcagttcgctatcacgatgttctctctcawttctgtctttggtctgtcttcctgggtaatgtcacatggagacccaggggatctgccgtcagctgtgtgcagtgggttaacaagacgacggggaacttca

SEQ ID NO: 28933 - DNA, 201 bp, Homo sapiens
acatatgcatatttaacctcctttaaatgtacattaatgctgtattttctccccctgatttacagggagaatatcaatttagaactatttgcacaaactcyagataccagtttagagcgttccctatttagaaataaaataaccaaagtctcaggttgccaggcaactgcagcaatgataattcttagtattgctgcttta

SEQ ID NO: 28934 - DNA, 201 bp, Homo sapiens
caatccatccgtggaataaacaaacagggcagagcgaggtcccgaccagtggggacttgggtgcaggaaatgccagtctcttcttgcttgaatcagggtgycagggggccttcctggccaccactcaggctgttcctttagctttctggatcccattccctgcaggtctacccttgggagtgaaatagtgaccgtcccttt

SEQ ID NO: 28935 - DNA, 201 bp, Homo sapiens
acggtgcccagcataaatttattttcaaaggcaagtgtggtcagtgtaggcagggagtgaaacatgtatgcgtaaacacaactacttgaaagagcggtgcrgtccttcctcaggcccccgtcagctctgctccatccccagtcccttcctgtgcctgcccaacctgtcctccatagccagggccccccaacccaaacccct

SEQ ID NO: 28936 - DNA, 201 bp, Homo sapiens
atatgcatatttaacctcctttaaatgtacattaatgctgtattttctccccctgatttacagggagaatatcaatttagaactatttgcacaaactccakataccagtttagagcgttccctatttagaaataaaataaccaaagtctcaggttgccaggcaactgcagcaatgataattcttagtattgctgctttaga

SEQ ID NO: 28937 - DNA, 201 bp, Homo sapiens
cacggtgcccagcataaatttattttcaaaggcaagtgtggtcagtgtaggcagggagtgaaacatgtatgcgtaaacacaactacttgaaagagcggtgyggtccttcctcaggcccccgtcagctctgctccatccccagtcccttcctgtgcctgcccaacctgtcctccatagccagggccccccaacccaaacccc

SEQ ID NO: 28938 - DNA, 201 bp, Homo sapiens
ggtttggggctgtgggagcacctcttccttctgttggtcctaggagctcagcgcttggtgggatgttccagaccaggagaggctgggactaaaattccagrgtgatctatgggtgcagaagcttcagacgcctgttcaagagatgggtatcaggtgaggtgagtccatatttaggtctccagctaggatttaaacctataa

SEQ ID NO: 28939 - DNA, 201 bp, Homo sapiens
gctaaacagtgattagaacagtcctgtttcatggttgcctttgagagccatatgacccttcagtggcttcggcagtcgctggctgcccctgttgggacacrtctctgctgggacacacccctgctggagaacctggacttgtgggcaggcagagccttcctgcagacctggcccttcccatgggggctgtgctcgagaagg

SEQ ID NO: 28940 - DNA, 201 bp, Homo sapiens
tgagagccatatgacccttcagtggcttcggcagtcgctggctgcccctgttgggacacgtctctgctgggacacacccctgctggagaacctggacttgygggcaggcagagccttcctgcagacctggcccttcccatgggggctgtgctcgagaaggctgcatgcctctccaggtcccaggggaagcagcaaggggcc

SEQ ID NO: 28941 - DNA, 201 bp, Homo sapiens
ctctgaattcatccttcttcttcaagctttaatttggatgttatcccttcaccccgcttccccaaggaagttccctcctgcccctgaggcctcttgccatrctgggctctaagtgggcatttatttctctgtgcagagtttgtccttctttgaaccaggtccctcctggacaaggaaggtgctagatacatgtttgtctag

SEQ ID NO: 28942 - DNA, 201 bp, Homo sapiens
cctcccgggttcaagcgattctcctgcctcagccttccaagtagctgggagacaggcgcacgcccccacacctgcctaattttttgtatattttattagaggcagggtttcaccatgttggtcaggctggtcttgaattcctgagctcatgatccacccaccttggccttccaaagtgctgggactacaggcgtgagccac

SEQ ID NO: 28943 - DNA, 201 bp, Homo sapiens
ctttgaatttcagcagtgtgggggatgttatgcttttgccttactccgccttatattttggctgtttgtgagctagtccaagccctattggactataggtkccttgagaaagagtgccacagtgccagggctgtgtctgctgcatgctgtttgtgagcttgtccaagccctattagactataggttccttgagacagagtg

SEQ ID NO: 28944 - DNA, 201 bp, Homo sapiens
ttcctcaacttctcttcttttggtttcatagtctcctggtccctttacctcagtttcccgcctgctccttcccacaggcctgctgctcccgtctcctggcrttcttcctcctgccccttctgcctcttctgggacctcaccaattgggaccccctcagtggtcttttcatgcttatgttttcagcctttcctcccaccaaa

SEQ ID NO: 28945 - DNA, 201 bp, Homo sapiens
taaagaaatgcattgatttttgtccattgacctcatatcctgcaaccttcctaaactcacctattagttctagtaccttttttgtggattgcatccattakatttttctataggtgactatatcaccaatgaagatcatttgactttctttccaatctggatatcgttcatttattgtacttgccttattgtactggccag

SEQ ID NO: 28946 - DNA, 201 bp, Homo sapiens
cgtctggggatcggccggggtcacaaacactgggttcaagctttggttgttctgccgctagtttgacacatgaactctacacctcgtccttttcattcttmagaggaccacattctggcccctctcagagcttcactgaattgggaacagaatatcaggccccagctctgtcatcatctcttggcagcaaagccacggctc

SEQ ID NO: 28947 - DNA, 201 bp, Homo sapiens
cagcttgggcctgcaggaccctggttggtcagccctgtgcctgagtgataacatgctctttcatgcctttaaaaatgattattaaagtgtgttcattatcytgttctttttgtcctttttcttgtttaataagtgttcactgattttaaaaagacatttttctaaaaatctggggtttttttgtgttttttttgtgtgtgt

SEQ ID NO: 28948 - DNA, 201 bp, Homo sapiens
cctgcaccccgcaaaacaactccatcccccactctctctcagaggtggcagcggccataattcagacacatacaacccagccagcgtaaccaccccctacycaccccctgaaaatagaagaagaaaggatttagagtctgggcagattgcttttaaaacatttccaaccttcgatctaatttgtcattattatttgtagag

SEQ ID NO: 28949 - DNA, 201 bp, Homo sapiens
tgttctgccgctagtttgacacatgaactctacacctcgtccttttcattcttaagaggaccacattctggcccctctcagagcttcactgaattgggaamagaatatcaggccccagctctgtcatcatctcttggcagcaaagccacggctcatgtttttgtctgtccactgcagcagccgctgtggcgtaatggcaca

SEQ ID NO: 28950 - DNA, 201 bp, Homo sapiens
ttgaacccaggaggcggaggttgccgtgagctgagatcacactactgcactccagcccgggtgacagggcaagacttcgtctcaaaaaagaaaaaaaaaaagcaagacaaaaactctctcccttttctagaaaagagcatgcctgtgcgtatggctggctgtgtgcctacagttcatgtgcctgtttccgtttttgctgct

SEQ ID NO: 28951 - DNA, 201 bp, Homo sapiens
cttatgcaggtgacccagagcattgctgaacctggccaggtggtaaggcagtggctcccaaacttagctacacattagactcacctggagggcttttaaamgcatcccagagtgcgtgctgccctccagcccaattaaattagaaaggctgggagtgggaaccagacgtcaatatttcttgaaagattccagggtgattcc

SEQ ID NO: 28952 - DNA, 201 bp, Homo sapiens
agcttcactgaattgggaacagaatatcaggccccagctctgtcatcatctcttggcagcaaagccacggctcatgtttttgtctgtccactgcagcagcygctgtggcgtaatggcacatgatggtctcggggctgggtagaaattggaaggcgtcttcctttcccttttggcctttcaagtgtatcttcctttatgtct

SEQ ID NO: 28953 - DNA, 201 bp, Homo sapiens
ggcacggtggctcacgcctgtaatcccagcactttgggaggccaaggagggaggatcacgaggtcaggagattgagaccatcgtggccaacatggtgaaaycccgtctctactaaaaaatacaaaaaattgctgggcgtggtggtgcatgcctgtagttccagctactcaggaggctgaggcaggggaatcgcttgaaccc

SEQ ID NO: 28954 - DNA, 201 bp, Homo sapiens
cttcactgaattgggaacagaatatcaggccccagctctgtcatcatctcttggcagcaaagccacggctcatgtttttgtctgtccactgcagcagccgytgtggcgtaatggcacatgatggtctcggggctgggtagaaattggaaggcgtcttcctttcccttttggcctttcaagtgtatcttcctttatgtctaa

SEQ ID NO: 28955 - DNA, 201 bp, Homo sapiens
aaaaagcaagacaggcctggcacggtggctcacgcctgtaatcccagcactttgggaggccaaggagggaggatcacgaggtcaggagattgagaccatcstggccaacatggtgaaatcccgtctctactaaaaaatacaaaaaattgctgggcgtggtggtgcatgcctgtagttccagctactcaggaggctgaggca

SEQ ID NO: 28956 - DNA, 201 bp, Homo sapiens
gaatatcaggccccagctctgtcatcatctcttggcagcaaagccacggctcatgtttttgtctgtccactgcagcagccgctgtggcgtaatggcacatratggtctcggggctgggtagaaattggaaggcgtcttcctttcccttttggcctttcaagtgtatcttcctttatgtctaatgtctggggttactattaa

SEQ ID NO: 28957 - DNA, 201 bp, Homo sapiens
tagacgcattgcaaagaaaagaatggagtgtggcctttcccccagctcggagctcagtgggtttttaaagaactgtgtgtatctctttggccagaccagcractgggatcttcagcctctctgcagaaaatgagccgcaggctcgggatttcgttaagatgcaggagcattccttctggaccaatgactcactcattcagc

SEQ ID NO: 28958 - DNA, 201 bp, Homo sapiens
aagttcctaattcgtggacttgctggaccacagggaggaggagaaaatgatttctagtacttatttcctggcatttcagctacatggaaggtagttagcayggtgcataaatgagcccccggtgagagtatttcccatcgtgagcaccacagccgggcgttgttctcactgtgcctcacaagctctgctaaatgccttatg

SEQ ID NO: 28959 - DNA, 201 bp, Homo sapiens
ggtcagtggtgaggaggatatttgaacagtcagcgtgtatttcaaagccgtggttctgtccccctctggtgttgcttccttctcctcttcactctgcagcygcctcttggtggtcagagggtgaatgcagggccctggggtttggggcctagggctgggagatcagagctcttggagctggcttgatacctggcaatcctc

SEQ ID NO: 28960 - DNA, 201 bp, Homo sapiens
acttatttcctggcatttcagctacatggaaggtagttagcacggtgcataaatgagcccccggtgagagtatttcccatcgtgagcaccacagccgggcrttgttctcactgtgcctcacaagctctgctaaatgccttatggatatttcattctgacaacctgtgacataggtactgtaatcatactagtatcacagat

SEQ ID NO: 28961 - DNA, 201 bp, Homo sapiens
aaggcattagcatccttgaagggaatgttgccaagacaaggccacttctgcagagcagataccttccccagaggggaggcgtccaaagtcttgcctcaaaygtaggaatgttcaggaagcagtcatggacagcgagatcatcaagtcccttaggaataagtaaactcaaataaaataaaaataaagtgattttcccttttg

SEQ ID NO: 28962 - DNA, 201 bp, Homo sapiens
aagcaagaactcctggcaacaagtccgagggactttcttgatcacaagtggtatctcctaagcactttaattatagcagattaagcaggaagtggagtgcyggactaaaggaataatgatacaaaggaggtgaagcagaaaaacttaatttccttcctttaagggaaaaaaaagtccatttatttagacgcattgcaaaga

SEQ ID NO: 28963 - DNA, 201 bp, Homo sapiens
acggtgcataaatgagcccccggtgagagtatttcccatcgtgagcaccacagccgggcgttgttctcactgtgcctcacaagctctgctaaatgccttayggatatttcattctgacaacctgtgacataggtactgtaatcatactagtatcacagatggggaaactgagacacagaaaggttgagtatcttgtccaag

SEQ ID NO: 28964 - DNA, 201 bp, Homo sapiens
cagccaccaacattccagagccatcatggtgccagccccaaatgaccaggatggtgtcgggaagaacgcgtctctcccacgcattatcctgcctcagaggmatctcaaatgatgctgcttgcacctcagggttctacagtgtttcataaaaagagatcgatgagcaaataaatagattaacttcatgtactcttaatagtt

SEQ ID NO: 28965 - DNA, 201 bp, Homo sapiens
ctggcaacaagtccgagggactttcttgatcacaagtggtatctcctaagcactttaattatagcagattaagcaggaagtggagtgccggactaaaggartaatgatacaaaggaggtgaagcagaaaaacttaatttccttcctttaagggaaaaaaaagtccatttatttagacgcattgcaaagaaaagaatggagt

SEQ ID NO: 28966 - DNA, 201 bp, Homo sapiens
gagtatcttgtccaagttcacacagctaataggcaacagggcctcactgcctcccagtttatcaccccccaccgagtacagtttctggaatattgtgctcrgtcaacatttgttgcaataacaagtggggtacaacagaggatcaaacataccagcaaagcttgcatatgtgtagttgattataagtaaaagcacagtctg

SEQ ID NO: 28967 - DNA, 201 bp, Homo sapiens
gttgctagttctgtcagacttttccccttgtttttctgaatgacaaggattagtagtggataataatgagtggattcatggatttgagcaggacatgaaasaatttccatagacagagatgaaagggcatttctgacttgaaacctgggatgagcaccgatgcaggagaggcacgaaagctcacagcgtgttcagggcgta

SEQ ID NO: 28968 - DNA, 201 bp, Homo sapiens
gggcagggctgatggtagccaattcatacattcaggtcggtctcctggtctcacctgtttctgtgattgctaagccaggctgatggctagatacccatggyaatgaagaatgtaaaatacgaaaggtaaaaaagggaaataaatcttcctttcaggacccaagctacttatcagggctaaacaaaaaataccaagtaagaa

SEQ ID NO: 28969 - DNA, 201 bp, Homo sapiens
gaaaaggcaggtgatttctaaggacacaagtcccttggggttgctagttctgtcagacttttccccttgtttttctgaatgacaaggattagtagtggatrataatgagtggattcatggatttgagcaggacatgaaagaatttccatagacagagatgaaagggcatttctgacttgaaacctgggatgagcaccgatg

SEQ ID NO: 28970 - DNA, 201 bp, Homo sapiens
tgtcacctgtcctagttatcatttttttttgtattgtagtgaaataaatgtctcatttaaaaaaaaaagaattgaaagcaggaaatgaaacagatacttgwataccaatgctcatagtagcattaagcataatagccaagaggtaggaacaacccaattgttcatccacaaatgaggagagaaaatgtggtatgtaaatat

SEQ ID NO: 28971 - DNA, 201 bp, Homo sapiens
tggctgcccctgttgggacacgtctctgctgggacacacccctgctggagaacctggacttgtgggcaggcagagccttcctgcagacctggcccttcccrtgggggctgtgctcgagaaggctgcatgcctctccaggtcccaggggaagcagcaaggggcctccggggcccctgccagctcttaacacacaccagatgg

SEQ ID NO: 28972 - DNA, 201 bp, Homo sapiens
gctgatgagggtgtgtggatatcattttctgttgtcttcattatcaaatggagaactagaaggggtaagcagcacattttggtttaattagatcagatttrtgataggatggcatatcgctacatataaaatactcattttctggcgttcctggccagagatgtctacacagagcaaaatggatgaaaggacccacggtga

SEQ ID NO: 28973 - DNA, 201 bp, Homo sapiens
caggagaattgattgaacccagcaggcagaggctgcagtgacctgagatcacaccactgcactccagcctgggcgacagagtgagactccctctcaaaaamagtgaggtttaatatgaagcaaaaggagctcggagcccagagttcactccatagagaaaattaacacagcagtgagtgccccttgttgtctcctggagga

SEQ ID NO: 28974 - DNA, 201 bp, Homo sapiens
ccggaacaacattataaagcagcagcccccagcctgtaggcaccagggactggtttcacggaagacagttttcccacggaccaagggtggtggtgggggaygatgattttaggaagattccagtgcattccatttatcattagattctctcaaggagcgtgcaacctagacccccacatgcacagctcacaatagggtttg

SEQ ID NO: 28975 - DNA, 201 bp, Homo sapiens
gacaactgcatgtttggagggttcccaaaacgaccctcaggctcgtaattctctagagggactcacagaattcacggaaaatactcatggctacaatttawtatgttggaaaggagacagattaaaatcagccaaaggaagagacacatggggcagaatctaggacggtttcaaaagggacgcttccattgtcgtcaggac

SEQ ID NO: 28976 - DNA, 201 bp, Homo sapiens
agaggcttgggaaaacacatgttggacacagactaatgataatgtggaacaattattacaatgaacacaataattgtatttgttttatgaacatgatagcytgaagaaacccataccaagaaatattttacgtgttgtcatcattaagaagtcagcaaaccttaaagacaaacacaatctattcatccatccatccatcca

SEQ ID NO: 28977 - DNA, 201 bp, Homo sapiens
cattataaagcagcagcccccagcctgtaggcaccagggactggtttcacggaagacagttttcccacggaccaagggtggtggtgggggacgatgatttyaggaagattccagtgcattccatttatcattagattctctcaaggagcgtgcaacctagacccccacatgcacagctcacaatagggtttgtgcttccat

SEQ ID NO: 28978 - DNA, 201 bp, Homo sapiens
gtggtgtgcacctgttatcccaactacttaggaggctgagacaagagaattgcttgagcccaggaattcaaggctgcagtgagctatggatcgcaccactrcactccagcctgggcaacagagcaagaccctgtctcaaaaaaacaacaaaaaaattgaaattcagaaagactaactctctgggcttatccccctcctcag

SEQ ID NO: 28979 - DNA, 201 bp, Homo sapiens
aggacctggagtgctactccagcacggcccccgtctccgaggtcagcatcacacagttcttgcccctcccgaagatgagcctggatgagaaggcccaggaygcagggagcagacgctcttccatcagctcctggctgagcgagatgagcgcgggcagtgagggtgagcagtcgtgccacagtttcatagcccagacgtgtt

SEQ ID NO: 28980 - DNA, 201 bp, Homo sapiens
caggctggtctcgaactcctgacctcaagtgatccgcccgtctcagcctcccaaagtgctgggattacaggcgtgagccaccacacccagtcagtctttgycatttttaagaatctcctatcaaaaggcacgtactccagaataattaatatataaagcccacagacttgttaattggagtcttgggtggcacatgacagt

SEQ ID NO: 28981 - DNA, 201 bp, Homo sapiens
gtgaaattattaacacaagttaggtgacacacctgtcacctgtcctagttatcatttttttttgtattgtagtgaaataaatgtctcatttaaaaaaaaaagaattgaaagcaggaaatgaaacagatacttgtataccaatgctcatagtagcattaagcataatagccaagaggtaggaacaacccaattgttcatcca

SEQ ID NO: 28982 - DNA, 201 bp, Homo sapiens
aagtttagagtgtagtatgtgatgatttgatatatattgtgaaattattaacacaagttaggtgacacacctgtcacctgtcctagttatcatttttttttgtattgtagtgaaataaatgtctcatttaaaaaaaaaagaattgaaagcaggaaatgaaacagatacttgtataccaatgctcatagtagcattaagcat

SEQ ID NO: 28983 - DNA, 201 bp, Homo sapiens
catcccagagtgcgtgctgccctccagcccaattaaattagaaaggctgggagtgggaaccagacgtcaatatttcttgaaagattccagggtgattccarcgggcagcaaagtttgggaggaactacgacggtgcgggaaggcgagttaaaagagcttctgcatgctttctggttagcttcggattttcatcttagattt

SEQ ID NO: 28984 - DNA, 201 bp, Homo sapiens
aggcatgagccactgtgcctggccaggatcatgtttctttaaaccacacatgatacccagaaggcatcataatagagttggcttcatcatcttccttatcmtaggttatgcttgatttcaaaagaaatttgttcctcgacaatacacagaaaatgcacttaacaatagcccctgaagttttccccagccaatgactggtta

SEQ ID NO: 28985 - DNA, 201 bp, Homo sapiens
ctgatataggcatttaatgctatacgtttgttttaagtacatcttcagggttattcacaaatttggatgggttgcattttcatttctattcacttaaaaasactttaaaattttcattttgaatttttccttgaccataggctgtttggggccaagttgtggagtttcagaatatttggaggtttttcagatattgttcta

SEQ ID NO: 28986 - DNA, 201 bp, Homo sapiens
gcatcaacaaaggctttttcactgaaatccaaactcaaggtgtatacatgtcacctcccagcacagcaaatggcacagactcgagggaatgttttccttcyggaacaacattataaagcagcagcccccagcctgtaggcaccagggactggtttcacggaagacagttttcccacggaccaagggtggtggtgggggacg

SEQ ID NO: 28987 - DNA, 201 bp, Homo sapiens
tactctcgtgtgtggcttctttcacttagcataatgattttgagatgtaatcatttcattgcctgtatcaatagttcatatatttatatttctgcataatrgtccactgcccagatataccacagttggccgatccattcatctcttgatggacatttctgttgtttccagtttggggatattacaaataaaagtactaaa

SEQ ID NO: 28988 - DNA, 201 bp, Homo sapiens
aaggcagcatcgtctactttggttttctttctttctttttttgaaacactctgcccaggctggagtgcagtggcacgatctcggctcactgcagccttaasctcctgggctcaagctatcctcctgactcagcctcccaagtagctgggacaacaggcgtgtgccaccatgcccggctacttttttaaatatttttaatag

SEQ ID NO: 28989 - DNA, 201 bp, Homo sapiens
taggatgtgatgggaggctgaaagcatctctctgctgtgacgtaggagggaccgtgagccttatgctaggcactccttccagcccaaggcagcatcgtctrctttggttttctttctttctttttttgaaacactctgcccaggctggagtgcagtggcacgatctcggctcactgcagccttaagctcctgggctcaagc

SEQ ID NO: 28990 - DNA, 201 bp, Homo sapiens
cacaagtggtatctcctaagcactttaattatagcagattaagcaggaagtggagtgccggactaaaggaataatgatacaaaggaggtgaagcagaaaarcttaatttccttcctttaagggaaaaaaaagtccatttatttagacgcattgcaaagaaaagaatggagtgtggcctttcccccagctcggagctcagtg

SEQ ID NO: 28991 - DNA, 201 bp, Homo sapiens
ggctgcttcctcggcaagcagagatgacgcttgtggccctttttgaaacaccttttttacatgccagaggtatttaacttgtccgtaccaaatggtacggwcaagttaaaagggttatccgcccttttaactcaaatatcccgttgggatcaaacatttttgctctggagacctttgtacctgtgcagcatcagtataagg

SEQ ID NO: 28992 - DNA, 201 bp, Homo sapiens
cagccccttctttcccgcttctccttgtcagccctcgcctggctgagctcatattttacattcagcacctctggttacccagaaattgcatgcaaaattgkgaaatagaaaagcagtgggctgtgggctccatcagctctgcctggcgttgcatcatccttgacttgcaatgctcagagcctgggctaggagatttgctta

SEQ ID NO: 28993 - DNA, 201 bp, Homo sapiens
caaaggctaacacataggcggctgcttcctcggcaagcagagatgacgcttgtggccctttttgaaacaccttttttacatgccagaggtatttaacttgwccgtaccaaatggtacggacaagttaaaagggttatccgcccttttaactcaaatatcccgttgggatcaaacatttttgctctggagacctttgtacct

SEQ ID NO: 28994 - DNA, 201 bp, Homo sapiens
tcagaccttgggcaggatcagtgtgcacagatttcaataaaatctgtccttggggagaaggaagtgtgagccagtcagtggatcacacacagaagcaggamgataacagaaagggacaaggacaatgcgtcaaggtgctggtgacagatctagtaggaccctactcctgcctgggcattgtacgaagggaaaaaaaaaagt

SEQ ID NO: 28995 - DNA, 201 bp, Homo sapiens
tgaataaagaaatgaaaaatccaggacaaaataaaccagacaggatgcagggtgataggcatacactgagacttctaggcaagtgagcaactggtcagccraattaaagcccttggaggggttcctgtaccctaggttcttaatacatgcttgttgaatgaacaatcggaggtagcttatttgtttgaataaggctttctg

SEQ ID NO: 28996 - DNA, 201 bp, Homo sapiens
tctcaaactcctgacctccagtgatccacccgcggtcagcctcccaaagtcctggcattagaggcatgagccactgctcctggctggaacattatgtccttttttttttttttttttttttgagacggagtctctctctgtcgcccaggctggagtgcagtggtgcaatctcagctcactgcacctctgcctcctgggttt

SEQ ID NO: 28997 - DNA, 201 bp, Homo sapiens
gtctcaaactcctgacctccagtgatccacccgcggtcagcctcccaaagtcctggcattagaggcatgagccactgctcctggctggaacattatgtccttttttttttttttttttttttgagacggagtctctctctgtcgcccaggctggagtgcagtggtgcaatctcagctcactgcacctctgcctcctgggtt

SEQ ID NO: 28998 - DNA, 201 bp, Homo sapiens
acaatcattttccccttattgttcctttttccactccagagctgcccagaagttaaatctgtcttctaaaaagaagaaacatcggccttccacttcttccsctgccgaaccaccgctctttgcaaccagcttcagtgggattctgcagacctcccctcccccagccccaccctgcctgctgagggctgtcaacaaggtgaa

SEQ ID NO: 28999 - DNA, 201 bp, Homo sapiens
tatgacccttcagtggcttcggcagtcgctggctgcccctgttgggacacgtctctgctgggacacacccctgctggagaacctggacttgtgggcaggcrgagccttcctgcagacctggcccttcccatgggggctgtgctcgagaaggctgcatgcctctccaggtcccaggggaagcagcaaggggcctccggggcc

SEQ ID NO: 29000 - DNA, 201 bp, Homo sapiens
gaaaaccccccaacagcacaggcgtccgctgggtggatggccccttgcggagcagcccgaggggccttggggaaccctttgagattaaagtctatgaaatygatgatgtggagcgcctgcagcggcgacgagggggtgccagcaaggtgaggcagcctccttcccaccccctgcctacgtggtggcagctccccaccaagc

SEQ ID NO: 29001 - DNA, 201 bp, Homo sapiens
gccatgtgcttcaatgcaaagctgaagattctggaacaccgccagcagaggatcgccgaggtccgcgcgaagtacgagtggctgatgaaggagctggaggygaccaaacagtatctgatgctggatcccaacaagtggctcagtgaatgtaaggccggggtgccttcccacccttgtgactagtgggttcacctgctcaac

SEQ ID NO: 29002 - DNA, 201 bp, Homo sapiens
ctccggggcccctgccagctcttaacacacaccagatggacagcccgctgaccacgctcttctcagtggagagccgggtgggaactgtgccaggggatgcygccccaactctgcacagcaggtctcctctcgcccccggcctctgcacgggtgactcagtgtggtccacacacagccaacattctcccaggtggctcaaga

SEQ ID NO: 29003 - DNA, 201 bp, Homo sapiens
cgaggtccgcgcgaagtacgagtggctgatgaaggagctggaggcgaccaaacagtatctgatgctggatcccaacaagtggctcagtgaatgtaaggccrgggtgccttcccacccttgtgactagtgggttcacctgctcaaccgggctggcgtgtagcccagggtgacagtgacacaggctgtgtcctcgtcctcagt

SEQ ID NO: 29004 - DNA, 201 bp, Homo sapiens
ttctcaccctgtttgctctgcgtctccatcaggctcttcctctcttgcagttgacttggagcaggtttgggagctggattccctggagtacctggaggcaytggagtgtgtgacggagcgcctggagagccgtgtcaacttctgcaaggcccatctcatgatgatcacctgcttcgacatcacctccaggcgccggtagat

SEQ ID NO: 29005 - DNA, 201 bp, Homo sapiens
ggctcttcctctcttgcagttgacttggagcaggtttgggagctggattccctggagtacctggaggcactggagtgtgtgacggagcgcctggagagccrtgtcaacttctgcaaggcccatctcatgatgatcacctgcttcgacatcacctccaggcgccggtagatgagccagacccttgtcctagtggtcccccgc

SEQ ID NO: 29006 - DNA, 201 bp, Homo sapiens
agcaggatcacttgagctcaggagttcagcctgggcaacagagtgagactctatctccacaaaaaatgttttttaaaaattagccaggtgtggtggtgcaygcctgtagtcctggtgggtggccaagtcaggaggatcgcttgagcgtaggaggttgaggctgcagtgagctatgatcatatccctgcccttcagcctggg

SEQ ID NO: 29007 - DNA, 201 bp, Homo sapiens
ttttggtagagctggggtttcaccatgttgcccaggctggtctcaaactcctgacctccagtgatccacccgcggtcagcctcccaaagtcctggcattasaggcatgagccactgctcctggctggaacattatgtccttttttttttttttttttttttgagacggagtctctctctgtcgcccaggctggagtgcagt

SEQ ID NO: 29008 - DNA, 201 bp, Homo sapiens
acctatatatttacatatatgtttatgtgcattaacacatcaaaccatctgtttttgataactgtggcttctgtttctcttgatagaatatcacagtttgkttaaaaataagtgtgaatttattcatacaaccaccaattacaagtttatttcagtgaaatacatttctcaattcagtgagaatattgtgtgttaaagttt

SEQ ID NO: 29009 - DNA, 201 bp, Homo sapiens
tcacacacagaagcaggaagataacagaaagggacaaggacaatgcgtcaaggtgctggtgacagatctagtaggaccctactcctgcctgggcattgtaygaagggaaaaaaaaaagtgtttcagggagctgattagaattaggccatctcctaggccctgtataagcacactggggttgagggcaagcctgtagcccta

SEQ ID NO: 29010 - DNA, 201 bp, Homo sapiens
gcttgaacccgggaggtggaggttgcagtgagccgagatcacgccattgcactccagccttggcaacaagagtgaaactccatctcaaaaaaaaaaaaaaatccacaacatttaactgtacttggtaagaaggttttcctaggaacccagcctatcatattgctcctttgcttttatttttttcctgttacacacctctcc

SEQ ID NO: 29011 - DNA, 201 bp, Homo sapiens
cagagtgcaaggcagggaaaccgaggctgacatgcatcctgtggcctggctcagtggagtgaaggggaagaagagaggctcagggacaggtgttgtattcrctgaattgctgccttacaaatcaccctaaaattcagtgcttaatacagtaagcatttatcattgctcatcggtcagctgagcagctcttctggtcctagc

SEQ ID NO: 29012 - DNA, 201 bp, Homo sapiens
ggcagatcacctgaggtcgggagttcgagaccagcctgaccaacatggagaaaccctgtctcgagtaaaaatacaaaattagccgggcatggtggcgggcrcctgtaatcccagcagctgaggcaggagaatcgcttgaacccgggaggtggaggttgcagtgagccgagatcacgccattgcactccagccttggcaaca

SEQ ID NO: 29013 - DNA, 201 bp, Homo sapiens
tttaggaggccgaggcaggcagatcacctgaggtcgggagttcgagaccagcctgaccaacatggagaaaccctgtctcgagtaaaaatacaaaattagcygggcatggtggcgggcgcctgtaatcccagcagctgaggcaggagaatcgcttgaacccgggaggtggaggttgcagtgagccgagatcacgccattgca

SEQ ID NO: 29014 - DNA, 201 bp, Homo sapiens
tcttatagtttgtttggttttctagttgcttaaggttggagggtaaatccagtttctatttttcaaagatggccagaagcagaaatttcgtcatttgtgattttttttttgtttatttctttaaacagtttaattgtctctaacatgttaatcaactttttgttgtttatttgtgatctaggtttgaacatctcattcttg

SEQ ID NO: 29015 - DNA, 201 bp, Homo sapiens
aaatacatgacactgtttcactcagaagcccctcagacccagcatctcgccaacctttgggcttaagaagtggtgaaaagatggggagagagtgactgaaygcatttttctgtctaggcaatttagtattacaggagatgctctcaaatccttgaccggagtgaaggcagagttcttgtcagttatgtaagaaaaacagct

SEQ ID NO: 29016 - DNA, 201 bp, Homo sapiens
tcatctctgtcttttttttttttctctcttattctctttcccctcttctatctctccaattctttctttgcatctctctccattcttcccttctgctattktgtcctacaaattttagctgccctgatctccccaaagtctggacttttccttgttcagaaggatgtggctgcctggctctgcttgggtcccctgtcgtgt

SEQ ID NO: 29017 - DNA, 201 bp, Homo sapiens
tacatatatatacaatatatatataaacccaatgatacatatacacacacacccaatatgcatatacacccaatgatatatacacacacacacacacacacccaatatatatataacccagtgatatacacacacacacgcatgccctgggtataaacagatctcctcactctgtctgcttgaacacagacttccaatccc

SEQ ID NO: 29018 - DNA, 201 bp, Homo sapiens
ttttatttgtgagaattctgcaagctctgggataaagatagtttactccagacagcatttgtgtttacttctaccaggtgccagttgaggatagtctaaaytacattctcagcttgaaatatttttgaccacccagatatggagaactaagcgtgcaaacctgcatgtaattcagaccagggttcgcaattctcaggacag

SEQ ID NO: 29019 - DNA, 201 bp, Homo sapiens
atacatatatatacaatatatatataaacccaatgatacatatacacacacacccaatatgcatatacacccaatgatatatacacacacacacacacacacccaatatatatataacccagtgatatacacacacacacgcatgccctgggtataaacagatctcctcactctgtctgcttgaacacagacttccaatcc

SEQ ID NO: 29020 - DNA, 201 bp, Homo sapiens
aggctggtctcaaactcctggcctccagtgatccactccctgcctcagcctcccaaagtgctggaattacaggtgtgagccactgcgcctggcccattttwattattttgtgatccgtgggttatttagaaatgtatttactaatcgccacagttaagttacttggaatttgttccttttgagccttttaagccttgcaaa

SEQ ID NO: 29021 - DNA, 201 bp, Homo sapiens
agaggatgacatgaaatcatgtacgcgagcgtgatttgctactaggcagctctgtagggctgtatgtattgatatcacatgcgtctatatgaacgccccgytgcagctgcctttgctatacagtgaatacactgtgggtctattattcgcctcttcagatccagcccaggagttggtgcagactcatttttcactttcctt

SEQ ID NO: 29022 - DNA, 201 bp, Homo sapiens
tcactgcaacctccacctcctgggctcaagtgattctcctgcctcagcctccctaaaatactgtttttaaaaaaggtactcggtagctgttattcactcastcaacaagtagaaacagtggggatagctctctgttgttcaggaggtgatgccggggaaaatctcatgcctttcagcccaccaaggtgcagtttatttaca

SEQ ID NO: 29023 - DNA, 201 bp, Homo sapiens
ctcatctttttgttccttctcttcccttttccccccttccctgtgcctttcttctatatccttggcatctattttggagactccgtggaatgatgcctggrcactgaacctgcttttcttccttccctggttctcccaggaaaatcctacaccatgatcggaaaggatgattccatgcagaacctgggcatcattccctgt

SEQ ID NO: 29024 - DNA, 201 bp, Homo sapiens
aggtgggtatcagccccctctcaggctcaggcaacgttgatgaaagggcaacgtttactcattcacaagggcccttgagctgggagggtgtcttctggagmattctgatggaccagttccttcaggagtcaatctgagctccaccgaatggtccagtgcttttgaattactggtgtcagaccttgggcaggatcagtgtgc

SEQ ID NO: 29025 - DNA, 201 bp, Homo sapiens
cttttcagcagagtcaagggcagaaattctgcccgacttctgtgtctggtacctatttgtacaatgcagaggtcccatgcaaattgttttcctttgaaatraccttaatgatttcttcaggtttcaactacagtaaataatttgttaaataaaaatattagaatgaaaggggggaaaagaaattacttcctctagcaaatg

SEQ ID NO: 29026 - DNA, 201 bp, Homo sapiens
aggaaggaaggaaggaaggaaggaaggaaataaataagcaataagcatgaagtggcagttattctccaagtgaacagtgtggagtaactgccattttactrgtactcaagtacttggtgtaactgctacatccaggcaactgctgagacttgagcaaggacctttacagcctttggaagtcccatccgtcagacacaccag

SEQ ID NO: 29027 - DNA, 201 bp, Homo sapiens
agattttaagtagacttgaatttgaaggctaaggtcatccagatctctttgcggatgtggagctggaatgaagccctcctggctttgcctcctctgccgtygtcgcagccggcaggtcccagctctcctctttcaattgctgtgtgaccctacggaagatattcagtttttctgggcctgaacttctttatctgcaaaaca

SEQ ID NO: 29028 - DNA, 201 bp, Homo sapiens
gtcctcttcagcgagagctacacgagctgtgaatttaccacgtgcccgtcaagggggtcattgtgttcctcactctgtcaataaaccacacagtaaagatytggataataggagcagaacagtttcaaaggacttgttacaatgtatcaagtcaataacttataattttagaaaatccctgaatacaaatttgcacaattt

SEQ ID NO: 29029 - DNA, 201 bp, Homo sapiens
atgagagtggccagcatccttcctctctccctgcaccccgcaaaacaactccatcccccactctctctcagaggtggcagcggccataattcagacacatrcaacccagccagcgtaaccaccccctacccaccccctgaaaatagaagaagaaaggatttagagtctgggcagattgcttttaaaacatttccaaccttc

SEQ ID NO: 29030 - DNA, 201 bp, Homo sapiens
gaagacaaagaacatgatgtgccagctccatattgaagtaatgggcatatcaaaatattctacctggtaattataaataaatcagttttcccgtgacccascaaggatgatgttgctaattcactgtgcatttcatcataatttatcctgagaaagttcagtgctgccatgtgcatgtataacgcagagtatacaagggtg

SEQ ID NO: 29031 - DNA, 201 bp, Homo sapiens
aatgttttgtttctgcctttccccactcttgcaatggctcaccacagtcatcccattttcccagcagcgtggaactcacagtcagaagggcccattctccmaaattaaccccacctgagagttacattatgtaacacactgggagtgggggacaaggaacatctgtctccatctgtgccaggtgctaacttcctgtgtcgc

SEQ ID NO: 29032 - DNA, 201 bp, Homo sapiens
gaggatggaaacacgaatgcaagtcccaggtctgagagtcagcagccctgtggccatggctaaagtcagggaacttgccaggcctcgttcttttttttcarcccgtaatgtgtggtacaaataccttctctgctggcctcccagggccaggttaaggatggatgtgatgatgtatagaaaatgttttaagaaaaaaaaaat

SEQ ID NO: 29033 - DNA, 201 bp, Homo sapiens
ttctcagcttgaaatatttttgaccacccagatatggagaactaagcgtgcaaacctgcatgtaattcagaccagggttcgcaattctcaggacagtttcwttcccctctgctcagtgcttatttcaagacagtcatgtcttgaatacctacaagggacaattattgggggttgattttcctgtgaaaattcacatgtgga

SEQ ID NO: 29034 - DNA, 201 bp, Homo sapiens
gttttgcatgttgccaggctggtctcaaactcctggcctccagtgatccactccctgcctcagcctcccaaagtgctggaattacaggtgtgagccactgygcctggcccattttaattattttgtgatccgtgggttatttagaaatgtatttactaatcgccacagttaagttacttggaatttgttccttttgagcct

SEQ ID NO: 29035 - DNA, 201 bp, Homo sapiens
ggagtgtgagatcacaatggcatgccttacaaaagagtgctcttgcctgctccgtcctggctgctcccaggccgaccctggctcctcaccagcaccctgcygtaaacgctcagctgccccttcccctagcagcagcgtcggcactacatttaggaccctttctgtatgtaccctgaaaacccaccggcgcagtggttaggc

SEQ ID NO: 29036 - DNA, 201 bp, Homo sapiens
tcctttcatataaggaagcagaggtataaatgtcactcaactgagacccccaaaagggagggactctccccacctcaacttgaattatttacttgattgatagtgaatagtgtggtagcgtctctcaaatcctgggatccatcctggatcctccatggctggaggtagggggagctagaatgtcaccttattggtcagtag

SEQ ID NO: 29037 - DNA, 201 bp, Homo sapiens
tccaatatagttcttttgttgttctttgggccttctttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcct

SEQ ID NO: 29038 - DNA, 201 bp, Homo sapiens
gtcctttcatataaggaagcagaggtataaatgtcactcaactgagacccccaaaagggagggactctccccacctcaacttgaattatttacttgattgatagtgaatagtgtggtagcgtctctcaaatcctgggatccatcctggatcctccatggctggaggtagggggagctagaatgtcaccttattggtcagta

SEQ ID NO: 29039 - DNA, 201 bp, Homo sapiens
gtccgggctggagtgcagtggcatgatcttggctcactgcaacctctgtcttctgggttcaagtgattctcctgcctcagccccccgagtagccgggattrtttgcgcctgccaccatgcccagctaatttttgtatttttagtagagatggggttttgcatgttgccaggctggtctcaaactcctggcctccagtgatc

SEQ ID NO: 29040 - DNA, 201 bp, Homo sapiens
ccaatatagttcttttgttgttctttgggccttctttttttttttttttaatgatcacttatctttcccttgagggaaacctacgttgtaaatagagaattttttttttttttttttttttttttgagacggagtcttgctctgtcgcccaggctggagtgcagtggcatgatctcagctcactgcaagctccgcctcctg

SEQ ID NO: 29041 - DNA, 201 bp, Homo sapiens
cgtcctttcatataaggaagcagaggtataaatgtcactcaactgagacccccaaaagggagggactctccccacctcaacttgaattatttacttgattgatagtgaatagtgtggtagcgtctctcaaatcctgggatccatcctggatcctccatggctggaggtagggggagctagaatgtcaccttattggtcagt

SEQ ID NO: 29042 - DNA, 201 bp, Homo sapiens
cctgctgggctcaagcaatccacctgcctcaacctcctgtagctgggactacaggcgtgtgccaccatccctggcttttcttttttcttttttttttttttggagacagagtctcactctgttgtccgggctggagtgcagtggcatgatcttggctcactgcaacctctgtcttctgggttcaagtgattctcctgcctc

SEQ ID NO: 29043 - DNA, 201 bp, Homo sapiens
acgtcctttcatataaggaagcagaggtataaatgtcactcaactgagacccccaaaagggagggactctccccacctcaacttgaattatttacttgattgatagtgaatagtgtggtagcgtctctcaaatcctgggatccatcctggatcctccatggctggaggtagggggagctagaatgtcaccttattggtcag

SEQ ID NO: 29044 - DNA, 201 bp, Homo sapiens
atcttggcctcccaaagtgctgggattacaggcatgagccaccgcacccagccctactttgccattctttatttctcatcttaaggtggctacttagcttrgcagtttccccttcttgttctgtaagcacctacgttgctctctaagtactgctttgtctgtatcctcaagttctggtaatgacaggtattttcactatca

SEQ ID NO: 29045 - DNA, 201 bp, Homo sapiens
gccctgcacatcaccatcttccttttcaaagaatggtgaaaataggaattgtgctctttagggaagattgtcttttttatatctttttcttttttttttctttttttttttttttttgagacagagtcttgctctgttggccccaggctggagcgccagtggcgcgatctcggctcactgcaagctccacctcccgggttc

SEQ ID NO: 29046 - DNA, 201 bp, Homo sapiens
caaagttagatttctgggcctcctcaccacctccccacttagtgctgtgtccccaccccacaggtacccggtacctttgtgctctccaagaatgccccatrctgccactttccacccccatcctcctgcctgtaccttgttgcaaatccccaacgccctgggcctcagttgactctgtacctaccccaaaaggcatctttc

SEQ ID NO: 29047 - DNA, 201 bp, Homo sapiens
ctttatatatactcagtcatcgcatgttcatggcagtctcatgggaccagcactacaaatgtgtctaaggaggtttcctcgaaatctcctttgtcacagtrgcctggagcatgcagaagcaggtaacagaaataccagcagccactcctgactcatcactgatagtggaactggtaagggacaaacttgtaaatgagcaaa

SEQ ID NO: 29048 - DNA, 201 bp, Homo sapiens
ggtgaaatgtcccttcaaatcttctgtccttttaaaaattgttttgaaagtttttaatatattctggatgcaaatcctttataagatatagtatttgcaarcattttctctcagtctgtggcttctctcttcattctcaacagcatcttttgaaaaacaaatacttgtttttttatgaagtccaatttatatgttctttta

SEQ ID NO: 29049 - DNA, 201 bp, Homo sapiens
tctttatatatactcagtcatcgcatgttcatggcagtctcatgggaccagcactacaaatgtgtctaaggaggtttcctcgaaatctcctttgtcacagyggcctggagcatgcagaagcaggtaacagaaataccagcagccactcctgactcatcactgatagtggaactggtaagggacaaacttgtaaatgagcaa

SEQ ID NO: 29050 - DNA, 201 bp, Homo sapiens
aagggggaggtcccagactctttgaaatagctggatctcatgtgaactaatagagcgagaactcactcatcaacaggggatggctctaagccattcaggarggatcttcccccaggatccagccacctcccgccaggccccccctccaacactgggaatcacatttcaacctgagctttggagggtatgaacatccaaacc

SEQ ID NO: 29051 - DNA, 201 bp, Homo sapiens
accccggcacatgggtgttcacacttagggtatgaccagcctcacagctaagttgcttagcatatggtaccagcgaacccaagtttgtaaaccagaacttsccattgctttcttgattgtcaagtttgaccctggccagcatcctctgatacactgaaaatacactctgtgtgtccagaagcagctgagcttttgtctcag

SEQ ID NO: 29052 - DNA, 201 bp, Homo sapiens
tctgagaatgatgaaaatgatgtgcaagtctcttccaggactttttgtgtgcctttcgtagtgtaatacagaccccggcacatgggtgttcacacttaggrtatgaccagcctcacagctaagttgcttagcatatggtaccagcgaacccaagtttgtaaaccagaacttcccattgctttcttgattgtcaagtttgac

SEQ ID NO: 29053 - DNA, 201 bp, Homo sapiens
  misc_feature (1)...(201): n = A,T,C or G, or insertion/deletion polymorphism (see Tables 1-2)
aatttctacaaaacatattttaagaaaacggccagtcctccagagggcgctcacgtgctgttgctttcattgtggttcaggttcaagagcaaaccaaagancccagtaagaaccctcttctcgggaagaaacgggccctgctgctgtctgagccttcgctccttcgaaccgtgcagcagatcccaggagttggaaaagtta

SEQ ID NO: 29054 - DNA, 201 bp, Homo sapiens
  misc_feature (1)...(201): n = A,T,C or G, or insertion/deletion polymorphism (see Tables 1-2)
aaatgttcagggcctgaacatgtttgtttcctcacattagtaccaagaactgtctgagttgagaaggctgaaaggggagggcagcttcttcttgacctgangccgtgcagccccgaccgatgggaggcacaaggtgctggctgacttctgtctgttcttgttggtgccccaactcaggaaggaaagcttcttggagatttt

SEQ ID NO: 29055 - DNA, 201 bp, Homo sapiens
gctgttgctttcattgtggttcaggttcaagagcaaaccaaagagcccagtaagaaccctcttctcgggaagaaacgggccctgctgctgtctgagccttygctccttcgaaccgtgcagcagatcccaggagttggaaaagttaaagctccccttctcctccagaagtttccaagcatccagcaactgagtaatgcttcc

SEQ ID NO: 29056 - DNA, 201 bp, Homo sapiens
gcagctcctgcgtgaagtaggcctagtttaggtgtagccatcatttaatcctgcacaactgaaatgtttcttaatggaccaacagaaagtgtttgaattcktctgtgtgtttttctaaacattctgaaaacgcacatttttgtaaattaatgtcttaactcctttgtgtggttcacctttcaataattttactgatgtctg

SEQ ID NO: 29057 - DNA, 201 bp, Homo sapiens
atcttggccaggctggtcttgaactcctgaccttgtgatccacccgcctcgctcggcctcccaaagtgctgggattacaggtgtgagccaccgcgcccagsctgtgttttcttattagtaattataaagggaatcttatttgacagttctttgacaaataattcagtttgcagaggggatcctgccccagaggccctggct

SEQ ID NO: 29058 - DNA, 201 bp, Homo sapiens; identical to SEQ ID NO: 7016

SEQ ID NO: 29059 - DNA, 201 bp, Homo sapiens; identical to SEQ ID NO: 7017

SEQ ID NO: 29060 - DNA, 201 bp, Homo sapiens; identical to SEQ ID NO: 7018

SEQ ID NO: 29061 - DNA, 201 bp, Homo sapiens
aatgcagggccgtgtgcgggagagcctgctcaagtgccgcctggcttttccctccttaggtggagaccatccatggaaaagaacccccctgatgatacggsccccgtgcacgtgcctttggggcatattgtggccaatgagaaatggcgcgggtcacagctggcgcaggagatgcaaggtcggtggcctgccctctgccag

SEQ ID NO: 29062 - DNA, 201 bp, Homo sapiens
aggattcaaactggaaatctaaggaagcttgctttctgaagacttccacatgggctatcaccggcttctaaggtttgcctaacattgagattgtttagttygccacatgtttattgatggtctactatgttctggcactaaaattaggcatacaatatatcgctgcaatagttgaggacattgttcctaatataaacccta

SEQ ID NO: 29063 - DNA, 201 bp, Homo sapiens
attctctgcctcagcctcccaagtggctgggattacaggtgcccaccaccaagcccggctaatttttttgtatttttagtagagacgcggtttcactatcwtggccaggctggtcttgaactcctgaccttgtgatccacccgcctcgctcggcctcccaaagtgctgggattacaggtgtgagccaccgcgcccagcctg

SEQ ID NO: 29064 - DNA, 201 bp, Homo sapiens
aaaacccggatgagtgaacaatacttcccagccctacagaagtttactgtgctggaccttggaatggtgctgcttccagtggccagccagatggaagcatyctgcctcgtcatccagttggtgagtaccgattcctacaccttcgtggtagtcctgtcctcatggacactcagctgctctccagaagcaaccatcaatcca

SEQ ID NO: 29065 - DNA, 201 bp, Homo sapiens
cgccttccggattcaagcaattctctgcctcagcctcccaagtggctgggattacaggtgcccaccaccaagcccggctaatttttttgtatttttagtaragacgcggtttcactatcttggccaggctggtcttgaactcctgaccttgtgatccacccgcctcgctcggcctcccaaagtgctgggattacaggtgtg

SEQ ID NO: 29066 - DNA, 201 bp, Homo sapiens
  misc_feature (1)...(201): n = A,T,C or G, or insertion/deletion polymorphism (see Tables 1-2)
gtgccccaactcaggaaggaaagcttcttggagattttcttggttttatcagttttgtcgtcatcatcaatggctaagcagatcatggagtacgttttctncattcccacggagtatgtggcactcttattatgctgcacatagaaaagtaagaaaaagggcgtcaggcatcatcaagatagatgataaaaactacgaagt

SEQ ID NO: 29067 - DNA, 201 bp, Homo sapiens
acattagtaccaagaactgtctgagttgagaaggctgaaaggggagggcagcttcttcttgacctgaggccgtgcagccccgaccgatgggaggcacaagktgctggctgacttctgtctgttcttgttggtgccccaactcaggaaggaaagcttcttggagattttcttggttttatcagttttgtcgtcatcatcaat

SEQ ID NO: 29068 - DNA, 201 bp, Homo sapiens
caaataattcattcttttttaggccttggtatttgctgtcttctgcacccagaattctttccttactccctgccaggcccaggccaactctccaggctgaygtcactgcccttctggtacacacatcaacagcagttcttgttttaccattgtgtacagaattatttatgggcttgtctatcctacagaccgtgtggccat

SEQ ID NO: 29069 - DNA, 201 bp, Homo sapiens
  misc_feature (1)...(201): n = A,T,C or G, or insertion/deletion polymorphism (see Tables 1-2)
acacagtacaagttacatagctaaaatacatagcattgaagactaattttaaggattgacaagagtttattttctattgtgcaatatcttaaaggaagcanccacctttgggaaagtgtatctgctgctcctagggccatgcttgtatacatatttaaataaacatattcatttacccgagttaatatttctttttacttt

SEQ ID NO: 29070 - DNA, 201 bp, Homo sapiens
atcagcagagagggtactgctctctgcagctggtcatcctgtcccctcgtctctaccatcttcatcctctggctattctctgcgctgctctggctgagccyagggtttttatggacctcagcggggaagaagtgtgtgctgattgggccattggcaggcccagaaaaggctccacgagtttccactctggtcagagggact

SEQ ID NO: 29071 - DNA, 201 bp, Homo sapiens
tagtaattcttaaatgacatcaaactagaagaaaagctgctcctacattgtttttatttaataagacaaatttggcactagactttttctagaaatagcartcatagtctatcgatataatagtaacatcttgttttaggttaatgaattcctattaggaagcagcactttgggacagtttttagtgacactaatttaatt

SEQ ID NO: 29072 - DNA, 201 bp, Homo sapiens; identical to SEQ ID NO: 7019

SEQ ID NO: 29073 - DNA, 201 bp, Homo sapiens; identical to SEQ ID NO: 7020

SEQ ID NO: 29074 - DNA, 201 bp, Homo sapiens; identical to SEQ ID NO: 7021
  misc_feature (1)...(201): n = A,T,C or G, or insertion/deletion polymorphism (see Tables 1-2)

SEQ ID NO: 29075 - DNA, 201 bp, Homo sapiens
ctcaggaaaactggtgctgctcctgctaaggccaagccggctgaagctcctgctgctgcagccccaaaagcagaacctatagcagcggcagttcctccccrtgcagcacccatacccactcgatgccaccagtgccctcgccctcacaacctccttctagcaaacctgtgtctgcagtaaaacccactgctgtcccaccac

SEQ ID NO: 29076 - DNA, 201 bp, Homo sapiens; identical to SEQ ID NO: 7023

SEQ ID NO: 29077 - DNA, 201 bp, Homo sapiens; identical to SEQ ID NO: 7024
  misc_feature (1)...(201): n = A,T,C or G, or insertion/deletion polymorphism (see Tables 1-2)

SEQ ID NO: 29078 - DNA, 201 bp, Homo sapiens; identical to SEQ ID NO: 7025

SEQ ID NO: 29079 - DNA, 201 bp, Homo sapiens; identical to SEQ ID NO: 7027

SEQ ID NO: 29080 - DNA, 201 bp, Homo sapiens; identical to SEQ ID NO: 7030

SEQ ID NO: 29081 - DNA, 201 bp, Homo sapiens
gttgtgaagaccatgacaggaggccgagcgcagagcattggcaggaggggcaaggtggaacaggtgaggaactctagcgtactcttcctgggaatgtgggrgctgggtgggaagcagccccggagatgcaggagcccagtacagaggatgaagccactgatggggctggctgcacatccgtaactgggagccctggctcca

SEQ ID NO: 29082 - DNA, 201 bp, Homo sapiens
accgtggttgagcccgtgacgtttacactcattcataaaacgcttgttataaaagcagtggctgcggcgcctcgtactccaaccgcatctgcagcgagcawctgagaagccaagactgagccggcggccgcggcgcagcgaacgagcagtgaccgtgctcctacccagctctgctccacagcgcccacctgtctccgcccc

SEQ ID NO: 29083 - DNA, 201 bp, Homo sapiens
ttctccagcatgggctcgcctgtcaacgcgcaggtaaggctggcttcccgtcgccgcggggccgggggcttggggtcgcggaggaggagacaccgggcggracgctccagtagatgagtagggggctcccttgtgcctggagggaggctgccgtggccggagcggtgccggctcgggggctcgggacttgctctgagcgca

SEQ ID NO: 29084 - DNA, 201 bp, Homo sapiens
actccaaccgcatctgcagcgagcatctgagaagccaagactgagccggcggccgcggcgcagcgaacgagcagtgaccgtgctcctacccagctctgctycacagcgcccacctgtctccgcccctcggcccctcgcccggctttgcctaaccgccacgatgatgttctcgggcttcaacgcagactacgaggcgtcatc

SEQ ID NO: 29085 - DNA, 201 bp, Homo sapiens
tcaaaaagccaagagttgttcagaaggaaaaaacagtttttctcaaagaggctaaatctctagtactaattagttgcagtagtggcatgtgtgtgtgtgtggggggggggtggcatggtaatcttgtgcctccagtgttctaaataggggcaatctttttgctcacggtctgagccatcgaatgagtaacctcgacctcct

SEQ ID NO: 29086 - DNA, 201 bp, Homo sapiens
  misc_feature (1)...(201): n = A,T,C or G, or insertion/deletion polymorphism (see Tables 1-2)
tgctttgaccacaacccttcaccactagaccagacttccccaaataaacaactacttctgcatgctggggatgggctgtgtgcggcagcatttacgtaggnggtacagacagcagcctttcacttaatgttgcaataacaccaggctaaacaatgtgcactgacttcaaaagtgtggggtcaggtctccttcaagtgccac

SEQ ID NO: 29087 - DNA, 201 bp, Homo sapiens
caaaaagccaagagttgttcagaaggaaaaaacagtttttctcaaagaggctaaatctctagtactaattagttgcagtagtggcatgtgtgtgtgtgtggggggggggtggcatggtaatcttgtgcctccagtgttctaaataggggcaatctttttgctcacggtctgagccatcgaatgagtaacctcgacctccta

SEQ ID NO: 29088 - DNA, 201 bp, Homo sapiens; identical to SEQ ID NO: 7029

SEQ ID NO: 29089 - DNA, 201 bp, Homo sapiens
aaaaagccaagagttgttcagaaggaaaaaacagtttttctcaaagaggctaaatctctagtactaattagttgcagtagtggcatgtgtgtgtgtgtggggggggggtggcatggtaatcttgtgcctccagtgttctaaataggggcaatctttttgctcacggtctgagccatcgaatgagtaacctcgacctcctaa

SEQ ID NO: 29090 - DNA, 201 bp, Homo sapiens
taggatatcaaagtcgtcttgtgcaggtatgatgggccaccccaaatgtattttgcctactgattcatccacatacaattctcagcgtatatccaaatgcrgtcaacattcctctctcagaaatacccacccacctctaactctgcattcatacatttaggctgcagccggggaatgcctatgccaaccatattagcacgt

SEQ ID NO: 29091 - DNA, 201 bp, Homo sapiens; identical to SEQ ID NO: 7098

SEQ ID NO: 29092 - DNA, 201 bp, Homo sapiens
ctagaaaatttaaaaatatataagtggctcacattcgtgactcagattacattcatcattcatactggacagtgctgggctaggcagtcaccacaggaaakcagaaagggcatctctcaagggttgcataccttcctggtccaataagaatatgagagtcaaatgcagcttctacttctcccaggcatttcaaattagtgc

SEQ ID NO: 29093 - DNA, 201 bp, Homo sapiens
agagaacaggcatatggttgttttattattttaaactcaggtaactcacaaaacagtcactaatcccaaactttgaagtattcagaagtaatagaaaattrcaaatgtatttcttcactcctagagacagggaggaaaaagtgggacaagaaggaggcagctccacctctgtagtatttgctgcccctacagggcaccagg

SEQ ID NO: 29094 - DNA, 201 bp, Homo sapiens
aattgcaaatgtatttcttcactcctagagacagggaggaaaaagtgggacaagaaggaggcagctccacctctgtagtatttgctgcccctacagggcascaggtttcgaggcaaactcctctgggtgtgaggtcagtacagctcaggggatggagacccactgtaataacagcctgtgctaaagtcattagatatggtt

SEQ ID NO: 29095 - DNA, 201 bp, Homo sapiens
aaactcctctgggtgtgaggtcagtacagctcaggggatggagacccactgtaataacagcctgtgctaaagtcattagatatggttctgccacctaagayaataacagtagaagtaccatttcttaaaggaccactatgtgcgcatctaatatttcaaaaccccacaactatcctccaagataggtgttattatctgcaa

SEQ ID NO: 29096 - DNA, 201 bp, Homo sapiens; identical to SEQ ID NO: 7054

SEQ ID NO: 29097 - DNA, 201 bp, Homo sapiens; identical to SEQ ID NO: 7079

SEQ ID NO: 29098 - DNA, 201 bp, Homo sapiens
tgatccacccgcctcagcctcccaaagtgctgggattacaggtgtgagccaccgctctcagttctacccccaggtcttcatcccctcatttctcaaccccrtatctcagatcctccttctcccacacctcatcccctgatctcaccaaccagctcaaccacatcttcctagaagtgaagagtttcagtttctcaacccaac

SEQ ID NO: 29099 - DNA, 201 bp, Homo sapiens
tgccaggcttctggctgagtactttccacgcatcagtatgcctcctcccaggcatttcttatattctgtcttcgtgatatgttatttatctgcctccctgrctcctgcgagagccatagagggcctggacctattccccatgtggacacctggcctagagcagtggctgttgggaagttggtgatgagttgtctggtggac

SEQ ID NO: 29100 - DNA, 201 bp, Homo sapiens
tacatgcccgaggcaccaggagatgttccattatttctgcgaggatgatgggaagttcctctgttttgtgtgtcgtgaatccaaggaccacaaatcccatratgtcagcttgatcgaagaagctgcccagaattatcaggtaggcatttgaggtttcttccctgttcccccatcagcccaggagttcagtgaggccctgga

SEQ ID NO: 29101 - DNA, 201 bp, Homo sapiens
actcctcctgctctgccccacacccagcaggctctgtatctcctccttggctcctgggaatcagccaagtgctgaggctgtgctgtttctctttctcttcwaggatatcaaagtcgtcttgtgcaggtatgatgggccaccccaaatgtattttgcctactgattcatccacatacaattctcagcgtatatccaaatgca

SEQ ID NO: 29102 - DNA, 201 bp, Homo sapiens
ctcaaccacatcttcctagaagtgaagagtttcagtttctcaacccaacccctgttcctctggaactggagaaaaaactcagtgaagcaaaatcaagacaygactccatcacagggagcctgaaaaaattcaaaggtaaggaagaggctgtattttctctattcacctacttccaggagattctctccctgctcactccac

SEQ ID NO: 29103 - DNA, 201 bp, Homo sapiens
gtggcgggggatgactattcctccttttgtattccaacactttcactcatccctgtgtttgaggaactccactttagaaaattactggccctcagaaagtstgagccttgaccctcttatactagactcaattcttgtcttagacatgggaattaggggccacgggaaatggacaaggaagagatggtctcatcttcgggt

SEQ ID NO: 29104 - DNA, 201 bp, Homo sapiens
ggtgatccacccgcctcagcctcccaaagtgctgggattacaggtgtgagccaccgctctcagttctacccccaggtcttcatcccctcatttctcaaccscatatctcagatcctccttctcccacacctcatcccctgatctcaccaaccagctcaaccacatcttcctagaagtgaagagtttcagtttctcaaccca

SEQ ID NO: 29105 - DNA, 201 bp, Homo sapiens
gagaccgggttttaccatgttggccaggctagtcttgaactcctgacctcaggtgatccacccgcctcagcctcccaaagtgctgggattacaggtgtgakccaccgctctcagttctacccccaggtcttcatcccctcatttctcaaccccatatctcagatcctccttctcccacacctcatcccctgatctcaccaa

SEQ ID NO: 29106 - DNA, 201 bp, Homo sapiens
gggtcccctactctgtctccctgaccctgtttttttccctcctctctgtctccatctcccatcttcatttccatatctccctatgccctacctcactcctkccccatatccctagccctgactttctgactcccagctcactatcccttaaccgccaggtcttcttctttttttttttttttttgagatggagctttgctc

SEQ ID NO: 29107 - DNA, 201 bp, Homo sapiens
atcgagcggggcgggtggtgggacgggggtatcagaggaaggtagggggtttggacaacttgacccggggttggccacctctttctcctcatcttcacacrgcccctgtgacactggacgcagcctcggcccacccggatctcatcctttcccaggatgagatagtgacgctgaacctcgcatcccagggcggttcgcaga

SEQ ID NO: 29108 - DNA, 201 bp, Homo sapiens
ccatagacattctaccaattcacataggcccggaaatgtgaatcctgaggcaggggaagcttctgtagctggaatcgtgatgcagggaggcttatgtaacwttgtggggccgtctagtctgacaactgagctgcctctagccttcactggcctctgataaggtgtctcatcccattagtcttggcaggtcccctccagatc

SEQ ID NO: 29109 - DNA, 201 bp, Homo sapiens
cctggctagtcagtccctctccttagagacaaccattgttagttattaaattcttatccttccagaaagaacttatttggatattcaagaaaataagtatatttttttctacccaaatggtagcatagtacatgcatttttctgcattatttgttttttcctttcttcacataacaacatatcttggccatattttccata

SEQ ID NO: 29110 - DNA, 201 bp, Homo sapiens
ttctgagagagtaaagcacctttgaaacactgtagattctcattttttatgtctaaatttccttcctcatgaagccatcagtacctgtttggtgacagttstttgaaactctccagtggtgttcatatgagtattttcattctctctgctgggttgcccagcttcattgaaataccaatgttcttttaaaatatttgttta

SEQ ID NO: 29111 - DNA, 201 bp, Homo sapiens; identical to SEQ ID NO: 7068

SEQ ID NO: 29112 - DNA, 201 bp, Homo sapiens
gcagaagcggggcaacccccgacgcttctacaggttccgctgagtgctgggctcgctgggcctttgctccggccgcggcgcctgggaggcggagctccaasggcccgggggcggggcctgcgtgccgggcttggccttggagctggttcccaggcggggcttcctggaggtggagcccttgaccggcttcgtggagctgca

SEQ ID NO: 29113 - DNA, 201 bp, Homo sapiens; identical to SEQ ID NO: 7080

SEQ ID NO: 29114 - DNA, 201 bp, Homo sapiens
ctcaagtcatctattctcccacaggttcaaaaacctatttatttattttaagaaagatcatgcaaagccattctagcctttctcctgccctggctagcaggctcccttgttcagtctcagagccaaattcatcttctaaatctcactcttctcttcttcactcagttcttcttgaggtcaaaacacttttctgcttactgg

SEQ ID NO: 29115 - DNA, 201 bp, Homo sapiens
cgcagcgggagggcgggcccaggtgtcggggcgggagtgagccaacgcccggagcacggattccaggggcgctcagtcagccctggccaggctcccccatycagttcccccagtcgcccgcgaggcgccgccgattacataaacagccttcaccttcctgcggaggggacaacaaagggctggggacacacaggccgagac

SEQ ID NO: 29116 - DNA, 201 bp, Homo sapiens
agcgggagggcgggcccaggtgtcggggcgggagtgagccaacgcccggagcacggattccaggggcgctcagtcagccctggccaggctcccccatccasttcccccagtcgcccgcgaggcgccgccgattacataaacagccttcaccttcctgcggaggggacaacaaagggctggggacacacaggccgagacccg

SEQ ID NO: 29117 - DNA, 201 bp, Homo sapiens
tcttcctagaagtgaagagtttcagtttctcaacccaacccctgttcctctggaactggagaaaaaactcagtgaagcaaaatcaagacatgactccatcrcagggagcctgaaaaaattcaaaggtaaggaagaggctgtattttctctattcacctacttccaggagattctctccctgctcactccactgaaatggaa

SEQ ID NO: 29118 - DNA, 201 bp, Homo sapiens; identical to SEQ ID NO: 7084

SEQ ID NO: 29119 - DNA, 201 bp, Homo sapiens; identical to SEQ ID NO: 7085

SEQ ID NO: 29120 - DNA, 201 bp, Homo sapiens
ggtaggtgatgataacctctacattttcacaaaattctgtgaggagccaaagcacctgaggtagagaattgcccttcccctactttccagatgctctaccraggcttgaactttgcatacaagatgcccaaagcattgcagtgaactggctgtgacctttcagtaggcatcaccacccacccctccactccctactcagag

SEQ ID NO: 29121 - DNA, 201 bp, Homo sapiens
gcatacaagatgcccaaagcattgcagtgaactggctgtgacctttcagtaggcatcaccacccacccctccactccctactcagagctgattgggaaatsccccataagtggtgtttggtgccccggtcattctgattttagtcaaccaccatacaaacatacctttagtccaaagttcaggacaacttatttcacttta

SEQ ID NO: 29122 - DNA, 201 bp, Homo sapiens
aagaggtagcaaggtaggactgcccatctgttttcctctctttataatattttctagatcctaaattttacgcttttctatcatttatttttttctccctyttcttttcctctctctctgctcttctaactaattggcagaatctctgacctccactttctctgactcccttctcccttcctagaaacagtatccacagtg

SEQ ID NO: 29123 - DNA, 201 bp, Homo sapiens; identical to SEQ ID NO: 7065

SEQ ID NO: 29124 - DNA, 201 bp, Homo sapiens; identical to SEQ ID NO: 7066

SEQ ID NO: 29125 - DNA, 201 bp, Homo sapiens
ttcccactgagggtttgcaccccattgcccccaccccttgggcttgagtgggcagctcgcagtcaggcacagtgggttcaaagagctgagtctggggaackgctgactctctaaatcaaggtgcaatggagaatggaaaggatgtgaaaatttgactcagaaggtttgggctcaagcccagtcttgtgagtttactgtaca

SEQ ID NO: 29126 - DNA, 201 bp, Homo sapiens
ccacgatctctggaagcagaaacatctctgccaaagctcctggaatcccctattacactgacccctcagaaaaagatccagtgagccatgtcctctcctckgcgcctcagcacctgaccggccaggcggcatcacctcccgcgtcggcctcgctattacagcgggctgactgctcagtctccaccggcagacaaggtgggg

SEQ ID NO: 29127 - DNA, 201 bp, Homo sapiens
ctccaccggcagacaaggtggggcacggaaaacccgcgctggtcttagaatcgcaagtacaggtttttaaggccgagctgcgccctcaacggattccccarttagaaaatgaagacattggccgggcgcggtggctcacgccagtaatcacagcactctgggaggctgaggatcgcttgagcccaggagtttgagaccagc

SEQ ID NO: 29128 - DNA, 201 bp, Homo sapiens
acattggccgggcgcggtggctcacgccagtaatcacagcactctgggaggctgaggatcgcttgagcccaggagtttgagaccagcctgggcaacatagmgagactctcctcttaattaaaaaaaaaaagaaagaaaactagccgggcgtggtagcacacgcctgtagtcccagctactagagaggctgggaggtgaaag

SEQ ID NO: 29129 - DNA, 201 bp, Homo sapiens
gtgaagagtttcagtttctcaacccaacccctgttcctctggaactggagaaaaaactcagtgaagcaaaatcaagacatgactccatcacagggagcctraaaaaattcaaaggtaaggaagaggctgtattttctctattcacctacttccaggagattctctccctgctcactccactgaaatggaactgtgactcat

SEQ ID NO: 29130 - DNA, 201 bp, Homo sapiens
ccacatacaattctcagcgtatatccaaatgcagtcaacattcctctctcagaaatacccacccacctctaactctgcattcatacatttaggctgcagcyggggaatgcctatgccaaccatattagcacgtggttggttgttaaagaaaccagctgttttctcagccttcctccttcttcagcacagattctactattt

SEQ ID NO: 29131 - DNA, 201 bp, Homo sapiens
aattggcagaatctctgacctccactttctctgactcccttctcccttcctagaaacagtatccacagtggactccggggctcctacagacttggcacagyttcctacagtcttgaaacagccctgttgttctgtcatggccagtgggcagtttgtgaacaaactgcaagaggaagtgatctgccccatctgcctggacat

SEQ ID NO: 29132 - DNA, 201 bp, Homo sapiens; identical to SEQ ID NO: 7049

SEQ ID NO: 29133 - DNA, 201 bp, Homo sapiens
ttcctctctctctgctcttctaactaattggcagaatctctgacctccactttctctgactcccttctcccttcctagaaacagtatccacagtggactcyggggctcctacagacttggcacagcttcctacagtcttgaaacagccctgttgttctgtcatggccagtgggcagtttgtgaacaaactgcaagaggaag

SEQ ID NO: 29134 - DNA, 201 bp, Homo sapiens
tgctgtatgtagagctcagctgtgctgtctggcaatggaggattgctgccgaggtgctcccgctgacctcttttctcctttccttctcccgcaaaggcggmagaactacatcggggccaccaaatcaccactcttcagccccatcccactccctgtttcgggcctcgtctgctgggaaagtcacttttccagtatgtctcc

SEQ ID NO: 29135 - DNA, 201 bp, Homo sapiens
gaggctgtgctgtttctctttctcttctaggatatcaaagtcgtcttgtgcaggtatgatgggccaccccaaatgtattttgcctactgattcatccacayacaattctcagcgtatatccaaatgcagtcaacattcctctctcagaaatacccacccacctctaactctgcattcatacatttaggctgcagccgggga

SEQ ID NO: 29136 - DNA, 201 bp, Homo sapiens
ggaactggagaaaaaactcagtgaagcaaaatcaagacatgactccatcacagggagcctgaaaaaattcaaaggtaaggaagaggctgtattttctctaktcacctacttccaggagattctctccctgctcactccactgaaatggaactgtgactcatacatgccaacaatccctgggcccttctagtgccaggcttc

SEQ ID NO: 29137 - DNA, 201 bp, Homo sapiens
aggctctgtatctcctccttggctcctgggaatcagccaagtgctgaggctgtgctgtttctctttctcttctaggatatcaaagtcgtcttgtgcaggtrtgatgggccaccccaaatgtattttgcctactgattcatccacatacaattctcagcgtatatccaaatgcagtcaacattcctctctcagaaataccca

SEQ ID NO: 29138 - DNA, 201 bp, Homo sapiens; identical to SEQ ID NO: 7061

SEQ ID NO: 29139 - DNA, 201 bp, Homo sapiens
cggatttactggctgggtcatgagggaacggaagcagggaaacactatgttgcctccactgagccacagttgaacgatctcaagaagctcattgattcccygaagaccaagcagaacatgccacccaggcagctgctggaggtgagtcccttgggggcagaattgcagagaggtagcagcccatccctagtctcaggtcag

SEQ ID NO: 29140 - DNA, 201 bp, Homo sapiens
tccttctcccacacctcatcccctgatctcaccaaccagctcaaccacatcttcctagaagtgaagagtttcagtttctcaacccaacccctgttcctctrgaactggagaaaaaactcagtgaagcaaaatcaagacatgactccatcacagggagcctgaaaaaattcaaaggtaaggaagaggctgtattttctctat

SEQ ID NO: 29141 - DNA, 201 bp, Homo sapiens
  misc_feature (1)...(201): n = A,T,C or G, or insertion/deletion polymorphism (see Tables 1-2)
cctgctatcacggatttactggctgggtcatgagggaacggaagcagggaaacactatgttgcctccactgagccacagttgaacgatctcaagaagctcnttgattccctgaagaccaagcagaacatgccacccaggcagctgctggaggtgagtcccttgggggcagaattgcagagaggtagcagcccatccctagt

SEQ ID NO: 29142 - DNA, 201 bp, Homo sapiens
cgggttttaccatgttggccaggctagtcttgaactcctgacctcaggtgatccacccgcctcagcctcccaaagtgctgggattacaggtgtgagccacygctctcagttctacccccaggtcttcatcccctcatttctcaaccccatatctcagatcctccttctcccacacctcatcccctgatctcaccaaccagc

SEQ ID NO: 29143 - DNA, 201 bp, Homo sapiens; identical to SEQ ID NO: 7091

SEQ ID NO: 29144 - DNA, 201 bp, Homo sapiens
tgaaaatgtgagccacatatgtaattcataaatataattctggccacatgtgtgatttagaaatgtagtttcagccacatatggaattacaaatttttctrgttagtcacattaaaatgataaaagtgaaattaattttaataaaatattttaactcaatatatctgaaatattatcctttcagcctgtaatgaatatttt

SEQ ID NO: 29145 - DNA, 201 bp, Homo sapiens
ggaaaaagtactttacccttcttctatttattttattttattttttgagatggaatcttgctctgttgcccaggctggagtacagtggcgcgattttggcrcactacaacttccgcctcctaggcccaagtcccaagtagctgggattacaggtccccaccaccacgcccagctaatttttgtattcttagcagacacggg

SEQ ID NO: 29146 - DNA, 201 bp, Homo sapiens
tcagttctttgtcacactagccacaatttccaatgttcagtagccacatgtggttggtggctaccatattggacagtgcaagtctagctggtgcttaaaayaagctgagatgattcctcctcaagtcatctattctcccacaggttcaaaaacctatttatttattttaagaaagatcatgcaaagccattctagcctttc

SEQ ID NO: 29147 - DNA, 201 bp, Homo sapiens
ccaatctccacagttcttattatgagggttggttctccctgctcggggtgactgggtctggaacacgtacgtggagaagggtgtggctgggccctgaagcygctaaaggcccttgtaggtgaagtgctcccaggcagtgtttcctatgctctaggtttgcagacccctcctaagagggcccccgcgtctccgctgagcagt

SEQ ID NO: 29148 - DNA, 201 bp, Homo sapiens
ccctgaagctgctaaaggcccttgtaggtgaagtgctcccaggcagtgtttcctatgctctaggtttgcagacccctcctaagagggcccccgcgtctccsctgagcagtccccatgactgggctggtggctctcagggaagctgcccacgcttgtcccactacctagccccaggctgtcttgtgctgtcttggggctgca

SEQ ID NO: 29149 - DNA, 201 bp, Homo sapiens
ggacagtgctgggctaggcagtcaccacaggaaagcagaaagggcatctctcaagggttgcataccttcctggtccaataagaatatgagagtcaaatgcrgcttctacttctcccaggcatttcaaattagtgccttgctgtgtgatagtgagttctttgctcaacccctctggactctcaccatttcatcccattcttt

SEQ ID NO: 29150 - DNA, 201 bp, Homo sapiens
tctaggccaggaatgggccattgtccccagcttctgggctcatcctctacctgcaaaaggagtctcttctggcaggggtgaactgggagatgaaggcactyggcctccccttgcaggagctctgtcttcgttccccctctcaagccctctttcatgggaaagagggcaggactgccatccaggctttaggagagtggggcc

SEQ ID NO: 29151 - DNA, 201 bp, Homo sapiens
gttaaataaaatatataattaaagttaattttactagtttctttctactttttaaatgtgactactagaaaatttaaaaatatataagtggctcacattcrtgactcagattacattcatcattcatactggacagtgctgggctaggcagtcaccacaggaaagcagaaagggcatctctcaagggttgcataccttcct

SEQ ID NO: 29152 - DNA, 201 bp, Homo sapiens
ttctacaggttccgctgagtgctgggctcgctgggcctttgctccggccgcggcgcctgggaggcggagctccaagggcccgggggcggggcctgcgtgcygggcttggccttggagctggttcccaggcggggcttcctggaggtggagcccttgaccggcttcgtggagctgcacagcagcggctcccagtgccaggcg

SEQ ID NO: 29153 - DNA, 201 bp, Homo sapiens
tcagctgtgctgtctggcaatggaggattgctgccgaggtgctcccgctgacctcttttctcctttccttctcccgcaaaggcggcagaactacatcgggrccaccaaatcaccactcttcagccccatcccactccctgtttcgggcctcgtctgctgggaaagtcacttttccagtatgtctcctggcctcttatgatg

SEQ ID NO: 29154 - DNA, 201 bp, Homo sapiens
tggtggagaaaatccaagctctacaagcctctgaggtgcagtccaaaaggaaagaggctacatgcccgaggcaccaggagatgttccattatttctgcgargatgatgggaagttcctctgttttgtgtgtcgtgaatccaaggaccacaaatcccataatgtcagcttgatcgaagaagctgcccagaattatcaggtag

SEQ ID NO: 29155 - DNA, 201 bp, Homo sapiens; identical to SEQ ID NO: 7046

SEQ ID NO: 29156 - DNA, 201 bp, Homo sapiens
tgaggtgcagtccaaaaggaaagaggctacatgcccgaggcaccaggagatgttccattatttctgcgaggatgatgggaagttcctctgttttgtgtgtygtgaatccaaggaccacaaatcccataatgtcagcttgatcgaagaagctgcccagaattatcaggtaggcatttgaggtttcttccctgttcccccatc

SEQ ID NO: 29157 - DNA, 201 bp, Homo sapiens
actactagaaaatttaaaaatatataagtggctcacattcgtgactcagattacattcatcattcatactggacagtgctgggctaggcagtcaccacagraaagcagaaagggcatctctcaagggttgcataccttcctggtccaataagaatatgagagtcaaatgcagcttctacttctcccaggcatttcaaatta

SEQ ID NO: 29158 - DNA, 201 bp, Homo sapiens
aagaccaagcagaacatgccacccaggcagctgctggaggtgagtcccttgggggcagaattgcagagaggtagcagcccatccctagtctcaggtcagarcatggaccactggcagaatacctgagattgccccaaccatcctacctctagcccagtgctgtccaatagcaatatgtgagccgcatgtattagaatgaaa

SEQ ID NO: 29159 - DNA, 201 bp, Homo sapiens
cccaggttcaagtgattctcctgcctcagcctcccaagtagctgagactacaggcgcttgccaccaagcctggctaattttcatatttttagtagagaccrggttttaccatgttggccaggctagtcttgaactcctgacctcaggtgatccacccgcctcagcctcccaaagtgctgggattacaggtgtgagccaccg

SEQ ID NO: 29160 - DNA, 201 bp, Homo sapiens; identical to SEQ ID NO: 7067

SEQ ID NO: 29161 - DNA, 201 bp, Homo sapiens
  misc_feature (1)...(201): n = A,T,C or G, or insertion/deletion polymorphism (see Tables 1-2)
agccctgttcttataggcgcttggtaggggagaggggagtcagagccagaggccagttgcctcttggcctggggttgggcttctagtgccaagccccaccntgccactgttatcctggcaacagtgaggtcggggcagggggaccactaagagtgggaagaggagacgaagctggtgtcgagtgggagggctgtgcctctg

SEQ ID NO: 29162 - DNA, 201 bp, Homo sapiens
gccctgtgcagtgtaggatgttcagcagcatccctggcctccgcccactagaggccagtagcacccgctctcctagtcgtgactgtcaaaacgtctccagacacactgtggaatggcctcggtggtgggctgatcacctgtggttgagaaccacttctctgtttatcttcattttggctctcttatcaagggggaacactt

SEQ ID NO: 29163 - DNA, 201 bp, Homo sapiens
ccctgtgcagtgtaggatgttcagcagcatccctggcctccgcccactagaggccagtagcacccgctctcctagtcgtgactgtcaaaacgtctccagacacactgtggaatggcctcggtggtgggctgatcacctgtggttgagaaccacttctctgtttatcttcattttggctctcttatcaagggggaacacttc

SEQ ID NO: 29164 - DNA, 201 bp, Homo sapiens
gagtctggctctgtcacttaggctggagtgcagtggcgcgatctaggctcactgcaagctctgcctcccgggttcacgccattctccagcctcagcctccygagtagctgggactacaggtgcctgccaccatgcccggctaatttttttgtattttttttttttagtagaggtggggtttcaccatgttagccaggatgg

SEQ ID NO: 29165 - DNA, 201 bp, Homo sapiens
agggcagcatggttccctgctcacgtttcttgccaggatcggggcatttcttcccagaagtatctgaacttgcctctagcagggcctacctttgcctctgmccctctcctgcccctcacaggagaacctcatgctttccatcctgcccaagcacgtggctgacgagatgctgaaagacatgaagaaagacgagagccagaa

SEQ ID NO: 29166 - DNA, 201 bp, Homo sapiens
gcaagctctgcctcccgggttcacgccattctccagcctcagcctcccgagtagctgggactacaggtgcctgccaccatgcccggctaatttttttgtattttttttttttagtagaggtggggtttcaccatgttagccaggatggtctccatctcctgaccttgtgatctgcctgcctcagtctcccaaagtgctggg

SEQ ID NO: 29167 - DNA, 201 bp, Homo sapiens
aaacccagccccagcccagtgggtgctgcctcccacctgcctcctccagactcctcagctctgcctgcccctcaggactcccagcagctgtctgccttgayaggctgccctcaagagctggtggggccccatctctggcttttcttgaaaaccttcctagaggctcatcttttctgcaaacccagagctttttccacaatg

SEQ ID NO: 29168 - DNA, 201 bp, Homo sapiens
agcagtacaaaaacggactaatacaggaagaaagctggggctgctagggagaagttaagaccaagagtgagccacggggtgtcacttgtgggggactgtcragttggtgatttgcacccctttgtgccagccaggcccagcatctgcctagcagagccccagggaccggcttgccttgtgcagcagctaacctcacccact

SEQ ID NO: 29169 - DNA, 201 bp, Homo sapiens
gccctgctacctttcaggaagatgattctggcagcgaacggtgatggctgtgagcagcagagtatgtgagaacctgcctgaacgtggcgggatacaaggasctgacctgagccaccgaagcgggtataggagagagagggattcgttcagccagcatagacggagggcctgctggtgctcagcatattagaaggtgcaaaa

SEQ ID NO: 29170 - DNA, 201 bp, Homo sapiens
gaagaaaaataggggataggcataggaagatggcctaaggcagcagcatgagagtttggtttaaagacccaggaaggctggaagctctttgccttgttttyatatctactactccaccttgaacagtgattctgtagaagagaatcacctggaggagggcacagatgcagatgccggggattctgtgggctaggaccctgg

SEQ ID NO: 29171 - DNA, 201 bp, Homo sapiens
gagagctgttgtggtttgaatgtttttgatgttccgaatgtgtttgaatgtttgtgatgaaatttgagttttgttgaatctgtggatacagaggacctacygtgtacaaggcagtgtttgaggatggagccttagaatgtcagcacagccaaatttggggaccattgacacacattgccttcccaggtgatgaaaatgacc

SEQ ID NO: 29172 - DNA, 201 bp, Homo sapiens
agggtgagggtgaaccagggatcagaagactgttagaaaatgagggctgggcgctgtggctcacacctgtaatcccagcactttgggaggccaaggcgggsagatcacttgaggtcaggagttcaagaccagccaggccaacgtggcaaaaccctgtctctactaaaaatacaaaaattagccgggcgtggtggcgggcac

SEQ ID NO: 29173 - DNA, 201 bp, Homo sapiens
cctaactcagggtgagggtgaaccagggatcagaagactgttagaaaatgagggctgggcgctgtggctcacacctgtaatcccagcactttgggaggccraggcgggcagatcacttgaggtcaggagttcaagaccagccaggccaacgtggcaaaaccctgtctctactaaaaatacaaaaattagccgggcgtggtg

SEQ ID NO: 29174 - DNA, 201 bp, Homo sapiens
ttgcagttttcttgatagaaagtgggggtccagactcagggcactcactagcaaggaggacacagatgcagctttagcagcctgatttttcgggccctgaycctcagccagggccacgctgctcccggatctgcttcaggaacaggttcccgctgctgccacagaccatccacgtgattttacagaaggggaagatgtggc

SEQ ID NO: 29175 - DNA, 201 bp, Homo sapiens
ggagcttccttcagtggcatttaggattcttggcctcagtggtgactcctcagaaacaggttttattatctcttggcagcaggggttgcaactgagaaacrtgcaaggtgggggataattggatcttgtggctcacgcctgtaatcccagcactttgggaggccgaggtgggtggatcacctgaggtcaagagtttgagac

SEQ ID NO: 29176 - DNA, 201 bp, Homo sapiens
caggcaccaggaagcaatacgttcctgcagcaggagtcctgtgctggggagacctggccaccacccaggacctgctcctgcttagcactgtaaccatggasaggtcacccctccagccccgcaaaaccccactgtctcctcatcagttacatgccggggtgagtaaggtcaaaagaggtgcttagctcggaggcctttgta

SEQ ID NO: 29177 - DNA, 201 bp, Homo sapiens
ccctccatcccccagggctgtgaccctgatgagggacagggggcctcagagaaggcccccctacaaccccggaacagcattcctcctgtctcgccctggtyctggccctggctaaggccgttctgacctgccttggggtgaggcctctttgggcctgatattggatgtggcttttccttcctggaccctgcagtagcctgt

SEQ ID NO: 29178 - DNA, 201 bp, Homo sapiens; identical to SEQ ID NO: 7243

SEQ ID NO: 29179 - DNA, 201 bp, Homo sapiens
  misc_feature (1)...(201): n = A,T,C or G, or insertion/deletion polymorphism (see Tables 1-2)
catgatgctcagcttctactacttctcccgccacgtgagtgccgcctgcacgatccccgctctgtgcccacagcccacagggcctcctgagaagcagcccngggacctaagagcccaagctcctaaggaatggggcttcccttcacccagccccacacgtgagcctggtcaggccaccgccttctctattcaggctccttc

SEQ ID NO: 29180 - DNA, 201 bp, Homo sapiens
gaactgctgtgcaaagtggtcccagacacacaccaccagcaccacgtaaatataaataagaaatagggtttattgagaaagttcggcaagcagagaaacaraacagacacacaaccccctgctgttcacagctcaggcctaagatggttgtgttctgtggccaggccccctaaggctctgtgctttcataggaactggaga

SEQ ID NO: 29181 - DNA, 201 bp, Homo sapiens; identical to SEQ ID NO: 7245

SEQ ID NO: 29182 - DNA, 201 bp, Homo sapiens
gggagagtgtgtagaatcaaaaaggaagggggcttagaatccaacacgtggagcagccaatgtgtgtcgggggggccctcagcatgggacatctgtaaccygcccctgcttcctgccgggacccatgattgtcccaggtagcctgtgctgggtagatcggccattaggaagcaggaagcagtgtctgtctgatggtgtttt

SEQ ID NO: 29183 - DNA, 201 bp, Homo sapiens
tccaggcgtggcaccatgagggccacccaccaggacggacgtaggggatggagaagatgagtttggtttgagttgcccgtgggacatccaagtggaacttkcagattattcagtggaaagttattgaacaccttctgtataccagaccttgtactcaagatctggagaagaaaggtctagagttgcagatttgagaatcat

SEQ ID NO: 29184 - DNA, 201 bp, Homo sapiens
  misc_feature (1)...(201): n = A,T,C or G, or insertion/deletion polymorphism (see Tables 1-2)
catggaccccagcaccattcctgcccctttctctcctcagcttaggttggcagcttggctctgatgtttgtattcctttcccaggaggtagagatttgcangtgcacaagcttcagaaacaccagataggattgggtttgcatttagggggatcatcttggtggacctgaatgaagtcgacatggtgcaggaggctggtga

SEQ ID NO: 29185 - DNA, 201 bp, Homo sapiens
cctgcctcagcctcctgagtggctgggactataggcgcccgccaccacaccaagctaatttttatggtgtgatcacggctcactgcagcctcaacctcttrggctcaagtgatcctcctgcctcagtctcccaagtacctgggaccacaaatatgtgccacaacactcggctaattttttgtgtttttagtagagacgggg

SEQ ID NO: 29186 - DNA, 201 bp, Homo sapiens
gggcccctccctggacattgggcaacttgaggtttgattttggtcaccacccaccccacctcctccatccccttctccatccccttttctgaagacgtgcyttcacccctggccttttctctcttcttccttggggtgcagatcctggccaacgtcttcctctacctgtgcgccatcgctgtgggcatcatgtcctactac

SEQ ID NO: 29187 - DNA, 201 bp, Homo sapiens
tgggacacgtgaagtttgcagtgcccacaagccaaggaggccagcatccatgatctggagtttggagggcgggtggggttggagacgtgaacctggcatcyccagcatgcaggctgtgctgcaacacgagacttgctgagctcaaggcagcgtgtccagatgcagagacagaaaaggactcaagaaaccaagcgagaaaag

SEQ ID NO: 29188 - DNA, 201 bp, Homo sapiens
taaacgggaatgggtgtgagcagagggtatagagaacaggtttccgggagttgtcaggttaaggtggatgtgttgagtgtgtccactgtgaagctgggggrggctgtcacaggcagactcttagcccccggcagcgagggagtgatgctgctccgtgctctgtcctttcagcacagcgacatggcaggggtgcattcctaa

SEQ ID NO: 29189 - DNA, 201 bp, Homo sapiens
tcatcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacag

SEQ ID NO: 29190 - DNA, 201 bp, Homo sapiens
gctggccattcaggtgttgactgggtggcctgaggacatatggtactgaccactcagacaggggtgggttgtcctgccccaacagacttgccccacaaacrgggtaggcgactggggctgctcagacccaagaggtcaacaggtcattacaagctggaaccagacgccagcagagcttgggaatctacacccggtgacttg

SEQ ID NO: 29191 - DNA, 201 bp, Homo sapiens
  misc_feature (1)...(201): n = A,T,C or G, or insertion/deletion polymorphism (see Tables 1-2)
gacactgggaggctgccatttcctaagcttggattgtatctcttgcttttctgaatgttcttcctctgtaacctttgcccaagcctggtcactgtttcccncaagaccttttgctattaggacaaggtgtcatcaaccctgagccctgttcttataggcgcttggtaggggagaggggagtcagagccagaggccagttgc

SEQ ID NO: 29192 - DNA, 201 bp, Homo sapiens
catcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacaga

SEQ ID NO: 29193 - DNA, 201 bp, Homo sapiens
tggggacataaattcggggggaaccctggactctgatcctgcccctcaccggctgggcaattttccaggtccaaccactactctgagctccagtttcacckgtgagctgagaatcagctcccctcaaagctccctccagccctgacactgtctggtctttgtccgcctcacttccaaggggaaaagcaaggccagaagaag

SEQ ID NO: 29194 - DNA, 201 bp, Homo sapiens
gctgggattacaggtgcgtgccaccacgcctggctaatttttgtatttttagtagaggtggggtttcaccatgatggccagggtggtctcaaactcctgayctcaagtgatccacctgcctctgcctcccaaactgctgagattataggcgtgagccaccacgtccagtcttgagcctgattcttataagacagattgctc

SEQ ID NO: 29195 - DNA, 201 bp, Homo sapiens
tgggggactgcacagagacacagctgcctctccccacctctccttctgctttaacccacttgcagggtcacctgttactagggatggtgtttttccttcakgccggtcttacagggaagaaccgcccattgaccacaagcgtcaggcccctctcctgggagccccggagcttgggacactgggaggctgccatttcctaag

SEQ ID NO: 29196 - DNA, 201 bp, Homo sapiens
atcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacagag

SEQ ID NO: 29197 - DNA, 201 bp, Homo sapiens
tcccaccttcatttcccctagccatccagcccccatccatgaatcaccagtcactattatctttttaatgtaccctttcagaggtttatagaattttcacacacacacacacacacacacacacacacacacacacacacacagatgatagcctattcactcttttgtactaaatctatttttctttttttgagacagagt

SEQ ID NO: 29198 - DNA, 201 bp, Homo sapiens
gacagctgaggtggacgctgggtgggtttccattcaggtcttgggggactgcacagagacacagctgcctctccccacctctccttctgctttaacccacktgcagggtcacctgttactagggatggtgtttttccttcaggccggtcttacagggaagaaccgcccattgaccacaagcgtcaggcccctctcctggga

SEQ ID NO: 29199 - DNA, 201 bp, Homo sapiens
gcagcaccttgaacgtgcctggcacatacttgatgctcagtgaaatattaactgcacgaatgaataaaagagtaattggcagagagaaactgaggcccctygggaagtggggatagggaggaaagtcgcttggtgccctcgtcctgctggcctgtgatgcctgactctgggctggccctggcctgccttaccccccaccca

SEQ ID NO: 29200 - DNA, 201 bp, Homo sapiens
ccaccaccacctctagctagttccgcaacatcttcccccaaaagaaaacttgggacccgagcttgatttttatttgtttttattttttttaattaattaattttttttttttgaggcggagtctcgctctgtccccgaggctggagtgcagtggcacgatctcggctcactgcaagctccgccttccgggttcacgccatt

SEQ ID NO: 29201 - DNA, 201 bp, Homo sapiens
accacgccgtctgctccatcctcatggggctggccatggtggaggccatctcgtaagtgggatgcctctgggagggaggctcccagagcaagggccccggycctggacccagggagaagcaggtcttccgcgctggccatggcccctgggtgggggatctgctggaagcagagactgggacacagcactggttgatgggtg

SEQ ID NO: 29202 - DNA, 201 bp, Homo sapiens
atatcatattgcccatctccagggacaaatttgggatattcactctttatttccatgaagagcccaatctagggtggttctttttattttttttttaaacrgtctcactctctcgcctaggctggagtgcagtggcatcatctcagctcactgaaacctccacctcctgggctgaagagattctcctgcttcagcctccca

SEQ ID NO: 29203 - DNA, 201 bp, Homo sapiens
ggaggggctggagcacaggccaggccctcccctttcagaaataccaccagctgcggattaagatcctgggcgactgctactactgcatctgcggcttgccygactaccgggaggaccacgccgtctgctccatcctcatggggctggccatggtggaggccatctcgtaagtgggatgcctctgggagggaggctcccaga

SEQ ID NO: 29204 - DNA, 201 bp, Homo sapiens
ggagcaggcagttgacctgagccctgctacctttcaggaagatgattctggcagcgaacggtgatggctgtgagcagcagagtatgtgagaacctgcctgwacgtggcgggatacaaggagctgacctgagccaccgaagcgggtataggagagagagggattcgttcagccagcatagacggagggcctgctggtgctca

SEQ ID NO: 29205 - DNA, 201 bp, Homo sapiens
  misc_feature (1)...(201): n = A,T,C or G, or insertion/deletion polymorphism (see Tables 1-2)
tgcagtagtaacaaagaagcctggaaggttatttgggatctgaaatggggaggagtaaaagccatatgagacagttctgactccattttgtagacagtggncagccattgaaagctttggagcaggcagttgacctgagccctgctacctttcaggaagatgattctggcagcgaacggtgatggctgtgagcagcagagt

SEQ ID NO: 29206 - DNA, 201 bp, Homo sapiens
gaggcgggaggatcacctgagcccagcaagatcagtgtgcagtgagctgtgactacacttcagcactccagcctgggagacagcgggaccctgtctctttaaaaaaaaaaaaaaaaaaaaaaaattcagaccacaagtatttcaggacttttctaggcactggggatacagttgtgagcagaacagattctagtgtgggca

SEQ ID NO: 29207 - DNA, 201 bp, Homo sapiens
aggcgggaggatcacctgagcccagcaagatcagtgtgcagtgagctgtgactacacttcagcactccagcctgggagacagcgggaccctgtctctttaaaaaaaaaaaaaaaaaaaaaaaattcagaccacaagtatttcaggacttttctaggcactggggatacagttgtgagcagaacagattctagtgtgggcaa

SEQ ID NO: 29208 - DNA, 201 bp, Homo sapiens
tcagcctcccgagtagctgggactacaggcacatgccactatgcccagctaatttttgtattttcagtagagacggggtctcaccatattggtcaggctgrtctcaaactcttcacctcaggtgatctacccaccttgacctcccaaagtactgggattacaggcctgagccaccacaccaggccctttccaccattttgg

SEQ ID NO: 29209 - DNA, 201 bp, Homo sapiens
gtgacctcagctcactgcaacctctgcctcccgggttcaagcaattctcctgcctcagcctcccgagtagctgggactacaggcacatgccactatgcccrgctaatttttgtattttcagtagagacggggtctcaccatattggtcaggctgatctcaaactcttcacctcaggtgatctacccaccttgacctcccaa

SEQ ID NO: 29210 - DNA, 201 bp, Homo sapiens
aacgggagtgcccacagcagtgggtccacgtcggagaagcccgaggagcaggatgcccaggtatgtgcagggctcagggcagggggtcactgagggccagmtgcgggcaggcaccaggaagcaatacgttcctgcagcaggagtcctgtgctggggagacctggccaccacccaggacctgctcctgcttagcactgtaac

SEQ ID NO: 29211 - DNA, 201 bp, Homo sapiens
ggagtgcccacagcagtgggtccacgtcggagaagcccgaggagcaggatgcccaggtatgtgcagggctcagggcagggggtcactgagggccagatgcrggcaggcaccaggaagcaatacgttcctgcagcaggagtcctgtgctggggagacctggccaccacccaggacctgctcctgcttagcactgtaaccatg

SEQ ID NO: 29212 - DNA, 201 bp, Homo sapiens
cactttgcaatccacaagcaagttctgtggcctcagattgctctctaatcccaccgcctcccacgcccttgtcacttccagacctgtccacgccactctcwtcccatgcccagatcatggctgagctctcctttcctctaggccctgcccaatggagcaccagcttcctcaaagtccagctcccctgccctcattgagacc

SEQ ID NO: 29213 - DNA, 201 bp, Homo sapiens
gtgcttcgatcatacctaattgtgcttgtttactgccactgcactccagcctgggaaacacagcaagacccactcttaaaaaaaaaaaaaaaaatgctggrataatctgactgatgtgtgagtccaaaaagctgagtgcacatgtcatgcatggaagatagatgcatttctccaacacatcatccagtcagtcggacatgc

SEQ ID NO: 29214 - DNA, 201 bp, Homo sapiens
attgatctgcaagtttttaaaaataaaatctgctttttcactgcacttgtaggtacatacaatatggggacataaattcggggggaaccctggactctgaycctgcccctcaccggctgggcaattttccaggtccaaccactactctgagctccagtttcaccggtgagctgagaatcagctcccctcaaagctccctcc

SEQ ID NO: 29215 - DNA, 201 bp, Homo sapiens
ccatgaggccatttgtctccatctgttctttctttcaggcagcccccgctgggcccaggccttctcagggacaggggactggggcctaggtagggctgaayctaaacagcaaacacaaataagcaaaagaggaatttctccggcctcttataaagtgcactgctgtaggcatcgtgatgtgggccgtacagctctgaggcc

SEQ ID NO: 29216 - DNA, 201 bp, Homo sapiens
  misc_feature (1)...(201): n = A,T,C or G, or insertion/deletion polymorphism (see Tables 1-2)
tgggattacaggcatgaaccgccacgcctggccattcctgtttttcatccttctatccagtggccagcttagagcacatgcctcgccttgtctgtgtctgnaggtagaaaaactggcacggacacttttcttgtggaagattgaggtccacgaccagaaggaacgtgtctatgagatgcgacgctggaacgaggccttggt

SEQ ID NO: 29217 - DNA, 201 bp, Homo sapiens
cctgcagcattcagttgccagctatgctggcaagttctaagaagcctttactcatgtctggagcctcagagctcctcctcctgacctctccatgtggctamcttgggcttcctcacagcatggtggtctcagagagaaggtggaagctatcacagtttttaaaggttaggctcatcactatcggctacaagaagtccaggc

SEQ ID NO: 29218 - DNA, 201 bp, Homo sapiens
ctacaaatggtacaaaaatcagccaggcatggtagcatgtgccagtagtcccagctactcagaaggctgaggtgggaggattatgagccccggatgctgcratgagccatgatcgtgacactgcactccagcctgggtgacagagcaagaccggtctcaaaaaagaataaaaaaagaatgacagtttattgtttctcatga

SEQ ID NO: 29219 - DNA, 201 bp, Homo sapiens
ctccccgcccctcacccacttcccttcacgatggcctaatgggtctgatgactctctgaggactagttacaaataacatttgcatggatcattgaagcgcwttttatctcattatgtcacttagtcctcacacccactctgtgaggtggatattcttgtcactggcattttatagaaaagaaagtggaggaggaacagagg

SEQ ID NO: 29220 - DNA, 201 bp, Homo sapiens
cgtcctcggcagggttagtgacgcacaacacctgaggcttcgagttgcatttagggaagaaagggatcatggcgctccctgttcagctggcgagccgtgcyggagccctgccatggtgcccccgcaccctcctacccctgctcccattcctccccgcccctcacccacttcccttcacgatggcctaatgggtctgatgac

SEQ ID NO: 29221 - DNA, 201 bp, Homo sapiens
cattagctttctctcttggggcctccaaagcaagtcttgtcccttttctacatagcagctttcctcagacttaaagacagcttcctaagaagaagggggtgggggggacctggggctaaggacacagcctggttaagctggaccggggcctttttatttttctgtcacacagcccagagccaaggggcttgttcaggcagc

SEQ ID NO: 29222 - DNA, 201 bp, Homo sapiens
  misc_feature (1)...(201): n = A,T,C or G, or insertion/deletion polymorphism (see Tables 1-2)
ttggcagaagtgagacctgtggatcagggctggttaggggagaccatgacaagcttgggtgttcacattgactttagcgttttccactcctggtcccgccntaaggtctcctggaaacttttcagcaataccagtgtctgggcctctggttccacttttgtggactctgcctgggcataactccccaggtgattctaaggc

SEQ ID NO: 29223 - DNA, 201 bp, Homo sapiens
  misc_feature (1)...(201): n = A,T,C or G, or insertion/deletion polymorphism (see Tables 1-2)
ctgcatggagctcggttcctttcatatggagaacctggggttaggatgtccctgtggccctagatggcctcactttgttcccctgagctttagaatcttcntcctcggcagggttagtgacgcacaacacctgaggcttcgagttgcatttagggaagaaagggatcatggcgctccctgttcagctggcgagccgtgctg

SEQ ID NO: 29224 - DNA, 201 bp, Homo sapiens
cctgttgcaccttcccctgcggcagctcctcacagtggggtcctgtgccatccttgggctttgggaagggggcaaggtcgccatacgtcgtgtcctgaggygcgcagccatttccacctcaaaacacatcgcactggctttgagggtcttgttttctgcagcttccttataccccagtcctcggttacaggttttgcctcc

SEQ ID NO: 29225 - DNA, 201 bp, Homo sapiens
ccacactcctttctgggaaaagatggggttgtgaaatatgtaaataagttgaggagtgctttagggaggggttttgaaccatagaataatgagatttgaaygctggaggagatctcaccctctagttttaacaccttgtttaatttaatctcaattccttctgtaaaaccagagtgacatcacctgcctcagcactggttg

SEQ ID NO: 29226 - DNA, 201 bp, Homo sapiens
agctactcgggaggctgaggcaggggaatggtgtgaacccagggggcagagcttgtagtgagctgagattgtgccactgcactccagcctgggagacagarcaagactctgcctcaaaaaaaaaaaaaaatgcaaaaacacactttcaattattcaccatttccccacagtaactaagaaagaccaaactgtaccttccca

SEQ ID NO: 29227 - DNA, 201 bp, Homo sapiens
  misc_feature (1)...(201): n = A,T,C or G, or insertion/deletion polymorphism (see Tables 1-2)
agctcaggagtttgaggctgtggtgagccctgaatgtgccactgcagtgcagcctgggcaacagagtgagaccctgtctctatctgcaccaccgccccccncccaaaaagaagtccacactcctttctgggaaaagatggggttgtgaaatatgtaaataagttgaggagtgctttagggaggggttttgaaccatagaat

SEQ ID NO: 29228 - DNA, 201 bp, Homo sapiens
ccggctggaaggtgggttggccccgatggtgaaggcccttagaagccagactaaagggattaaaactttctcctgtaaggcactgaggtaccaagcagagtttttttttttttttaatcagaatgacaaaggtaaagcagtgtttaggaacataaatctgacaggtggctcgccaggtcacttggagccaggataggcagg

SEQ ID NO: 29229 - DNA, 201 bp, Homo sapiens
aatcccagcactttgggaggccaaggtgggcggatcacgaggtcaggagttcgaaaccagcctggccaacatggtgaaaccccatctgtactaaaaatacaaaaattagccaggcatggtggtgcacacctgtaatcccagctacttgggaggctgaagcaggagaatcgcttgaacccaggaggcggaggttgcagtgag

SEQ ID NO: 29230 - DNA, 201 bp, Homo sapiens
ctcctctaattgtggtagtaccatatacactatcttccttttttttcaaatataatgttattgttgtactttaacaattggagcacacggtgccgggcgcrgtggctcacgcctgtaatcccagcactttgggaggccaaggcgggcggatcacgaggtcaggagatcgaaatcatcctggctaacacagttgaaaccccg

SEQ ID NO: 29231 - DNA, 201 bp, Homo sapiens
gggaggccaaggcgggcggatcacgaggtcaggagatcgaaatcatcctggctaacacagttgaaaccccgtctctactaaaaatacaaaaaaattagccrggcgtggtggcaggcgcctgtagtcccagctactcaggaggctgaggcaggagaatggcgtgaacccgggaggtggagcttgcagtgagccgagattgtg

SEQ ID NO: 29232 - DNA, 201 bp, Homo sapiens
cgggcggatcacgaggtcaggagatcgaaatcatcctggctaacacagttgaaaccccgtctctactaaaaatacaaaaaaattagccgggcgtggtggcrggcgcctgtagtcccagctactcaggaggctgaggcaggagaatggcgtgaacccgggaggtggagcttgcagtgagccgagattgtgcactgcactcca

SEQ ID NO: 29233 - DNA, 201 bp, Homo sapiens
  misc_feature (1)...(201): n = A,T,C or G, or insertion/deletion polymorphism (see Tables 1-2)
actcccttcctttcttctcggtgcgagggtggggctcaccccacggtgatggaaaggcggtcctcgagcctccccgggggcctctgtggcgcacgaactgngagagtggagagaaaagcccctcaggaggaggagtactgagctgggccgtgaagggcacgttggatttcgatcctgaggtcagtaggggaggggcagtgg

SEQ ID NO: 29234 - DNA, 201 bp, Homo sapiens
ctgggaggttccagacttccccacagtttcctgtcttcttctgagccctccaaactgttctgacctctgcctgttacccagttccaaagtcacttccacgkttttgggtatcttttcagcaatgtgccactctactggtaccaatttactgtattagtccgttttcacgctgctgataaagacatacctgagactgggaag

SEQ ID NO: 29235 - DNA, 201 bp, Homo sapiens
tgaggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactacc

SEQ ID NO: 29236 - DNA, 201 bp, Homo sapiens
acacagtcagtgtcccgactcccatcccgcagacagtaggtccactcccttcctttcttctcggtgcgagggtggggctcaccccacggtgatggaaaggmggtcctcgagcctccccgggggcctctgtggcgcacgaactgggagagtggagagaaaagcccctcaggaggaggagtactgagctgggccgtgaagggc

SEQ ID NO: 29237 - DNA, 201 bp, Homo sapiens
gtgaccgttctgtctttggcttcctaggaggaccactgccttcccccacccccattttggctgtgtgtctccttggttcgtgcctggccataggttccccmtcctcaggttatgtccaagctgactaggaagtctggagccaagcccaaaggccttgagggatgttccctttctaagaaaactgtggtccttccagagaag

SEQ ID NO: 29238 - DNA, 201 bp, Homo sapiens
gaggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactaccc

SEQ ID NO: 29239 - DNA, 201 bp, Homo sapiens
aaggtgggaggggtagggggacattggaagccagtgacaccgggattcagggtgacaaggggcatgaggggacagtggagtgtttggaggctattgagtgygtggttgtgtggtgagaacagggagaatggtggtggagctggagggagggcaggtcacctgccgtggtcgtgcttggcgtccgcgctggagttctctggc

SEQ ID NO: 29240 - DNA, 201 bp, Homo sapiens
  misc_feature (1)...(201): n = A,T,C or G, or insertion/deletion polymorphism (see Tables 1-2)
gagccagagccgcactgtcagggccttactatgttacaaaacaccagggcttcggtctgggtcctgctgcttgcacagaaagccaatcactgtgacagcanttattgccaaggaatacggctttaatcgggtgctgcggtagaggatatggggactcagtctccaatccatctctctgacctgctaaatccggggtttaca

SEQ ID NO: 29241 - DNA, 201 bp, Homo sapiens
tcgccactgcactccagcctgggtgacagagcaagactctgtctcaaaaagaaaaaaaaaaaggcaacttcatttcatatgattcaatctaacataaaagyaacaaatgtattcactgtggaaagcctggaaaatactatgtagtatgaaaaaatattacccataatattatttctgaaggataactgctattaacattga

SEQ ID NO: 29242 - DNA, 201 bp, Homo sapiens
acaaatgtattcactgtggaaagcctggaaaatactatgtagtatgaaaaaatattacccataatattatttctgaaggataactgctattaacattgagscttctcttaaacgaatatcagttttcttctatattatgaagcactattgtaagaaaataattcaacctagacaggagtacaaagaataaaagtgaaagtc

SEQ ID NO: 29243 - DNA, 201 bp, Homo sapiens
gaggacctgcgccgtgttgggtgctgtgttcctagctggggcgtagtgttggcagaagtgagacctgtggatcagggctggttaggggagaccatgacaascttgggtgttcacattgactttagcgttttccactcctggtcccgccgtaaggtctcctggaaacttttcagcaataccagtgtctgggcctctggttcc

SEQ ID NO: 29244 - DNA, 201 bp, Homo sapiens
agaaataccaccagctgcggattaagatcctgggcgactgctactactgcatctgcggcttgcccgactaccgggaggaccacgccgtctgctccatcctsatggggctggccatggtggaggccatctcgtaagtgggatgcctctgggagggaggctcccagagcaagggccccggccctggacccagggagaagcagg

SEQ ID NO: 29245 - DNA, 201 bp, Homo sapiens
cagatggtttacctcaggcagctgtgggggcggggtttagattcaagttcatggtaaagcccagagtatataggaccctgaatgccagaatgaagattttkaactcttggacaattggcagctattgaggtgttttgagcagaaggtggtacttgcaaaaatattattttggaagattaatgtgttccagggtggattggc

SEQ ID NO: 29246 - DNA, 201 bp, Homo sapiens
  misc_feature (1)...(201): n = A,T,C or G, or insertion/deletion polymorphism (see Tables 1-2)
tgctgttctcttgaacgtgtgtccctgcccgccgtcctggcctccagctcagctgtctccagtactacacgggacccagcaatgcaacggcagggatgganacggagggcagctgcctggagaaccccaagtattacaactatgtggccgtgctgtccctcatcgccaccatcatgctggtgcaggtcagccacatggtga

SEQ ID NO: 29247 - DNA, 201 bp, Homo sapiens
ttgctaattgtgtttgggcaaatctggcccgagttttctgtacaatagggacagtactaaaaatactcgagagagtttttgtgaatgtcaaatgaggcaayggcgaggctcttagctgcagttactaactttcatatgattagtccctggtaaatttccccatctttcccggtatttctgggggagccgcgggaggtggca

SEQ ID NO: 29248 - DNA, 201 bp, Homo sapiens
atagcagctgagagccaagtaccagagtctctgcccctctcctatggccttaggggagataagtgttaagtagttattgcacagtgcctgcacatagacaytcaaactctctaccatcatatgattgttggatacaattttgaagatatagaaaagtagaagaggccaccaaaacctcccttaatctgggactttttttga

SEQ ID NO: 29249 - DNA, 201 bp, Homo sapiens
aacatggtgcaaccctgtctctactaaaaatacaaaattagctggacgtggtggtgcatgcctgtaatcccagctactagggaggctgaggcaggagaatygcttgaacccaggaggcagaggttgcaatgagccgagattgtgccactgcattccagcctgggcgacagagatgctgtcttaaaaaaagagagaagaaac

SEQ ID NO: 29250 - DNA, 201 bp, Homo sapiens
aggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactaccca

SEQ ID NO: 29251 - DNA, 201 bp, Homo sapiens
gtgcataatggtgaccaactcatcaagaaaatattaaggccaggcgcggtggctcacacctgtaatcccggcactttggaaggccgaggtgggtggatcaygaggtcaggagatcgagaccatcctggccaacatggtgaaaccctatctctattaaaatacaaaaaatcagccgggcgtggtgatgcacgcctgtagtcc

SEQ ID NO: 29252 - DNA, 201 bp, Homo sapiens
tccttcttcatcacgctgcccctcagcctcagccccatcgtgatcatctccgtggtctcctgtgtggtgcacacgttggtcctgggggtcaccgtggcccmgcagcagcaggaggagctcaaggggatgcagctgctgcgggaggtgagtcctgcccactgtccccccacagcgtcctctcctgcagctctcaccaacttg

SEQ ID NO: 29253 - DNA, 201 bp, Homo sapiens
acagggctttggttaataactctaataatcagggaaaaagcaaaaacaacacaatagaggaatggcgcataggaggcaaaatagaagaaactgaccagtcrcattggctcacatctgtaatcctaacactttgggaggctgaggcaggcagatcacctgaggtcaggagttcaagaccagcctggtcaacatggtgcaacc

SEQ ID NO: 29254 - DNA, 201 bp, Homo sapiens
ggcaggagaatcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactacccag

SEQ ID NO: 29255 - DNA, 201 bp, Homo sapiens
gaggaggtgtttttgggggcatcttcaaggaacagagatgtctggggtgttgagtgttgcaaccaacagccctcatatgcaccttctctggctgtaggagrcgttgttacattataggacagcatagtaactgatgtgcataatggtgaccaactcatcaagaaaatattaaggccaggcgcggtggctcacacctgtaat

SEQ ID NO: 29256 - DNA, 201 bp, Homo sapiens
atctctctatagtgatcatggctttgcttgctggacagggctttggttaataactctaataatcagggaaaaagcaaaaacaacacaatagaggaatggcrcataggaggcaaaatagaagaaactgaccagtcgcattggctcacatctgtaatcctaacactttgggaggctgaggcaggcagatcacctgaggtcagg

SEQ ID NO: 29257 - DNA, 201 bp, Homo sapiens
tcgcttgaacctgggaggtggaggttgcagtgagccaagaatgcaccactgcacgccagtctgggcgacagagcgagactccatctcaaaaaaaaaaaaagaaagaaaaaaaagaataagtctactgggaatgaggagttaggggctccagagcctaccttggccaggggttgctggtgcccactacccagggaagagaag

SEQ ID NO: 29258 - DNA, 201 bp, Homo sapiens
  misc_feature (1)...(201): n = A,T,C or G, or insertion/deletion polymorphism (see Tables 1-2)
tcatgctgaaagagtgaaacttactttttacagacatattttgaggggcacattcattttgctaagtgagatacacatttatgaatatgaaacaggaaatntctgaatcttattagcttagagataatggccaccactgtgtatggaagctgtggaaatgataatggccaccactgtgtatggaggctgtggaaaatctgc

SEQ ID NO: 29259 - DNA, 201 bp, Homo sapiens
cgcttgagctcaggagtttgaggctgtggtgagccctgaatgtgccactgcagtgcagcctgggcaacagagtgagaccctgtctctatctgcaccaccgcccccctcccaaaaagaagtccacactcctttctgggaaaagatggggttgtgaaatatgtaaataagttgaggagtgctttagggaggggttttgaacca

SEQ ID NO: 29260 - DNA, 201 bp, Homo sapiens
agggagctgatggactttctgttgggttaaaaggaaaagagaaggccggtgcagtggctcattttgggaggctgagggtggaggatcacttgagtccaggrgtctgagaccagcctgggcaatatggtgaaaccctgtctctactaaaaaatacaaaaattagccaggcatggtggcccgcacctgtaatcccagctactt

SEQ ID NO: 29261 - DNA, 201 bp, Homo sapiens
gaggcaggagaattgcttgaacttgggaggcagagagtgcagtgagctgagattgtgcctggtgacagagggagactctgtctcacaaaaaaaaaaaaaaagaaaagaaaagaaaggaaatattaaattgcatttagcataaagtgtagtgtagtatctaaaaacattttcctcgggaatggataacacaagtttgaacaa

SEQ ID NO: 29262 - DNA, 201 bp, Homo sapiens
gtcatccccctccagtgcttatcacctagttgagggatccaaacaaggacaacctgacaaaacctaaggaccaggaccaggcccagccaaggtgaaggggyccgcctcgtggtcagactcacaggtccgtctcctctgctcaattgcccagtctttgcctagacctgctacgtgaactttgtcacagtggcaagtcagagc

SEQ ID NO: 29263 - DNA, 201 bp, Homo sapiens
  misc_feature (1)...(201): n = A,T,C or G, or insertion/deletion polymorphism (see Tables 1-2)
gtcagggctggtctagcaagctgcttctgcttgcttccatctgcagcagcaagaaggcatctttcaagggcctactgggcaggaaatccagggacagttcngcctggcaggctggtggcagaggtggctggggtgacagcagcattccagccgagagtgaggtcccgctcttagacaaacatgggctttggtcgcaagaga

SEQ ID NO: 29264 - DNA, 201 bp, Homo sapiens
ctgggctcaatggcactgacaggtaagggccacggcttcccctcctggcctgcactcacagcccttcttctagagacaggaatataacaggcccaagcccygggatctcaccctcccgggaggcacgtgacctgatacgtgcaggttagagaagctggcatgggttcctccaggagggctgcagcagtgcagtgaggaggg

SEQ ID NO: 29265 - DNA, 201 bp, Homo sapiens
  misc_feature (1)...(201): n = A,T,C or G, or insertion/deletion polymorphism (see Tables 1-2)
agtcagggctggtctagcaagctgcttctgcttgcttccatctgcagcagcaagaaggcatctttcaagggcctactgggcaggaaatccagggacagttnggcctggcaggctggtggcagaggtggctggggtgacagcagcattccagccgagagtgaggtcccgctcttagacaaacatgggctttggtcgcaagag

SEQ ID NO: 29266 - DNA, 201 bp, Homo sapiens
tatgaaaaaatattacccataatattatttctgaaggataactgctattaacattgaggcttctcttaaacgaatatcagttttcttctatattatgaagsactattgtaagaaaataattcaacctagacaggagtacaaagaataaaagtgaaagtcctccttccttcccttgctccccttctcataggtacccattgc

SEQ ID NO: 29267 - DNA, 201 bp, Homo sapiens
tgctgagaacagcgcttagtgagcacagcgggagcagtgagaccaaatagcggcccagacaagccactgtggtggccaggccaggccgaggatagaggagmatcagtggttggattccgtcgatagatgctgaatgtattttggagacagagctgacaggatttgctggcagattggttgtggggcgtgagtgtggagttg

SEQ ID NO: 29268 - DNA, 201 bp, Homo sapiens
ctccagtgcttatcacctagttgagggatccaaacaaggacaacctgacaaaacctaaggaccaggaccaggcccagccaaggtgaaggggtccgcctcgyggtcagactcacaggtccgtctcctctgctcaattgcccagtctttgcctagacctgctacgtgaactttgtcacagtggcaagtcagagctagcgtggc

SEQ ID NO: 29269 - DNA, 201 bp, Homo sapiens
tccctggatctcctcttcagcctcgcccatctccctttttcaagaagtcctcaggcgacatggtttccagaccttacatggtcctgggcactttctctagstgtagactaaagcgcattgctcaggactgccttctcctgtttgcccaggctgctcacagaaccttgtccatcctgcctagctgcgggacacaaacactgc

SEQ ID NO: 29270 - DNA, 201 bp, Homo sapiens
cccacgcagacgtgtgtatatgtgtatatatatatacacacatcttagagaaattcatgcacatactcatgtcccaggatatatgtatgagaatgtccaargtggcactgttcgtaatagacataccccctcccccaaaacaaatgaaaacaacccaaatgacatcaacaggaaatggatacataactggtatattcatgc

SEQ ID NO: 29271 - DNA, 201 bp, Homo sapiens
aagagagagggagagagacaaagagagagagaagagggaggaggaggaggaggagaagggggaggaggagaaaaaggagaaggggaaggaggaggagggtrtggctgaattagagaccaggaatggcagttagggaaagatggggtacaggtatggtaggcaagagggatatggttgaaagagggtgggtggctggtctct

SEQ ID NO: 29272 - DNA, 201 bp, Homo sapiens
gtcaccaaggctgacctggcccctctcttggctcatcttggtaaagatagattttaggctgtgggcacagactgacgccctctctaacgcagcagtaggtyctccagggcaaggtgtggcctcctggagtccccagctggtgaagccctgtctgagggtgacgaccactctcttgttctccctttctcccctcggccaatc

SEQ ID NO: 29273 - DNA, 201 bp, Homo sapiens
  misc_feature (1)...(201): n = A,T,C or G, or insertion/deletion polymorphism (see Tables 1-2)
ggtttcaccatgttggtcaggctggtctcgaactcctgacctcaggtgatccgcctgcctcggcctcccaaagtgctgggattacaggcatgaaccgccangcctggccattcctgtttttcatccttctatccagtggccagcttagagcacatgcctcgccttgtctgtgtctgtaggtagaaaaactggcacggacac

SEQ ID NO: 29274 - DNA, 201 bp, Homo sapiens
gatgagcacgggtgatgctgagtccacagccccaccagccacactctgggtagggcagcctgaagtcctggggatgggctcggctgaaccagggctgcacycccagcaccggctcggccactctgtgtggcagtgacgagggcaacccaagtttccgcgggcgttggcagctcgggtcctcgggcagcggctcctggccgt

SEQ ID NO: 29275 - DNA, 201 bp, Homo sapiens
ggctggagtgcagtggtgcgatctcggctcactgcaacctctgcctcctgggttcaagttgattctcctgcctcagcctcccgagtagctgggattacagrtgcccgccaccatgcccggctaatttttgtatttttagtagagacagggtttcaccatgttggtcaggctggtctcgaactcctgacctcaggtgatccg

SEQ ID NO: 29276 - DNA, 201 bp, Homo sapiens
tgctgggtgtggtggcatgcctgtaatcccacttacttgggaggctgaggcatgagaattgcttgaacctgggaggtggaggttgcagtgagccgagatcrtgccactgcgctccagcctggaggacagagcagactctatctcaaaaaaaaaagaagaaaggtctaaagtctgtgatggaagcttctaccttagaagctt

SEQ ID NO: 29277 - DNA, 201 bp, Homo sapiens
agtgaagccacagataagggagactactgtattaataaagaagaaaggtctaggccgggcgcagtggctcatgcctgtaatcccagcactttgggaggccraggcaggtgcatccttgaggtcaggagttcgagaccagcctggccaacatggcgaaaccccatctctactaaaatatgaaaaaattgctgggtgtggtgg

SEQ ID NO: 29278 - DNA, 201 bp, Homo sapiens
cttatgaattatttatttcttaaatttttcatttaatatttttggactgtgattgaccttgggtagctgaaaatgcaaaaagtgaagccacagataagggrgactactgtattaataaagaagaaaggtctaggccgggcgcagtggctcatgcctgtaatcccagcactttgggaggccgaggcaggtgcatccttgagg

SEQ ID NO: 29279 - DNA, 201 bp, Homo sapiens
gctagaagcagcaaagctgggtcccaggaaggatctagggccagaaggtcatgtttactgatggcttctgctcagctcgcctgctgaccagaggctgaagsggggaggggtgggtggtgagtctgtgagtgtagagtcgtaacccacatctgtgccacccaacagcgtgaggcttcctgggcacctagggctggatggggc

SEQ ID NO: 29280 - DNA, 201 bp, Homo sapiens
  misc_feature (1)...(201): n = A,T,C or G, or insertion/deletion polymorphism (see Tables 1-2)
ttcacacctctcctcctgcctgttggtctgctctgtctgatgttctagatcactcccaaaatgtaccctgtccgctgtcctcaggggagcgaccgagcctngttcctctttgttcttcaggcgggggtggactggggtaggtaggggatgctcactggaaggctagaagcagcaaagctgggtcccaggaaggatctaggg

SEQ ID NO: 29281 - DNA, 201 bp, Homo sapiens
gcagaagggtgggctagctgaatgttatgtgatgccccttttaaaagagccttaaccctcatggcctgatcccctcttaaaggccccacctcttaatagtrttacattggcagcacctgaattttgaacagacacattcaaatcatgccaagactttttgcagataattctaggctgccattttttacttctagcccttta

SEQ ID NO: 29282 - DNA, 201 bp, Homo sapiens
ggcggacctgacatccctccccgcttggccctatccaccctatcattgtttcccaacccctgactggggtgtcggaccctcagcccctgtttaataaatasccatattcaactttcctagacaatttttgtcttaaaaaatgtaaaaacggctgggcacagtggctcacgcctgtaatcccagcactttgggaggccgagg

SEQ ID NO: 29283 - DNA, 201 bp, Homo sapiens
ttcactgggataggcggcaagcactagaaatggctgtttctctggctgtcactgtcattgtgatgattattggctctgataaggaattgtagaaaagcctrgcccaaccacaagggagggaagagcagccccaggcttcttccaggatgtctcaagggcgcctggtggcttcaagccctgcccttgcctccctggttgggg

SEQ ID NO: 29284 - DNA, 201 bp, Homo sapiens
tccccccacagcgtcctctcctgcagctctcaccaacttgggacctgttggagttgctgtttgctttgcctttgagtcaaaatgtgtcctgggggcctccrgggctctcacctctctccctagtccctgccttttcacccctgtgccattacccggagtctgcctgtgcttggccccagggaaaggaggatgtcagggcat

SEQ ID NO: 29285 - DNA, 201 bp, Homo sapiens
  misc_feature (1)...(201): n = A,T,C or G, or insertion/deletion polymorphism (see Tables 1-2)
cccgggtggctttctgctttggactctgggtcaaagcactggcgtcacagtcattcgacttgaaccaccaggagctcccccacttaccaactgtgagatcnggggtaagttatttaacctctttgcctggtttctccttctgcaaaatgggtgtgataataatacctttttcactgggataggcggcaagcactagaaatg

SEQ ID NO: 29286 - DNA, 201 bp, Homo sapiens
ccagctgatttttgtatttttagtagagatggggtttcaccatgttggccaggctggtcttgaactcctgacctcaggtgatccacccgtctcggcctccmaaactgctgggattacaggcatgagccaccctttcctggttctaatttgtccacaggaagtaatgcatgtctacttcttgttttctacacagcagccctt

SEQ ID NO: 29287 - DNA, 201 bp, Homo sapiens
cacagcagcccttccagtgtttgaattcagctatgttgctctccctggatctcctcttcagcctcgcccatctccctttttcaagaagtcctcaggcgacrtggtttccagaccttacatggtcctgggcactttctctagctgtagactaaagcgcattgctcaggactgccttctcctgtttgcccaggctgctcacag

SEQ ID NO: 29288 - DNA, 201 bp, Homo sapiens
atattctgccaaatctgtcaaaatctttaaaaaatgaaataatgtcaactatgtcatatttgcatctgccccaaattagtacttacctctttagtcatgawgcaaggacctcacaaccttttaacttcatttcacaagcctctgccccccactttctgcttattagtataatgtgttttagttcaacatattttaaacccc

SEQ ID NO: 29289 - DNA, 201 bp, Homo sapiens; identical to SEQ ID NO: 7239

SEQ ID NO: 29290 - DNA, 201 bp, Homo sapiens
ctcaggtgatccacccaccgcggcctcccaaagtgctgggattacaggcacgagccactgcgcctggccaggaaaatatattgactattcattaagtggargtggatcatcaaaaggtcttcatctgcatcttcacgttgagtagctgaggaggaggagaaagagaaggggttggttttgctgtctcaggggttgccgagg

SEQ ID NO: 29291 - DNA, 201 bp, Homo sapiens
ctgggaattcattttattttattatttttatttgtttcgggatggaggctcgctctgtcacccaggctggagtgcagtggcgcagtctcagttcactgcarcctctctctcccgggttcaagcgattctcgtgtttcagcctcctgagcagctggtattacaggtgcccgccacgaagccctgctaatttttgtattttta

SEQ ID NO: 29292 - DNA, 201 bp, Homo sapiens
gacagcttcctaagaagaagggggtgggggggacctggggctaaggacacagcctggttaagctggaccggggcctttttatttttctgtcacacagcccrgagccaaggggcttgttcaggcagctactttatgctgggaattcattttattttattatttttatttgtttcgggatggaggctcgctctgtcacccagg

SEQ ID NO: 29293 - DNA, 201 bp, Homo sapiens
gatggggtttcaccatgttggccaggctggtcttgaactcctgacctcaggtgatccacccgtctcggcctcccaaactgctgggattacaggcatgagcyaccctttcctggttctaatttgtccacaggaagtaatgcatgtctacttcttgttttctacacagcagcccttccagtgtttgaattcagctatgttgct

SEQ ID NO: 29294 - DNA, 201 bp, Homo sapiens
ggaacctgggtacagaatccccctacatttttattactgttctttctttttggccaaattgttactgtcttgcctaccttgaattcaacagcaatttcttytagctacttatatttgtcaaaaatgttcaaaatactcactttactttttttagaaacaacgcgctttctttcacatccatattttatctgtgtaggttat

SEQ ID NO: 29295 - DNA, 201 bp, Homo sapiens
  misc_feature (1)...(201): n = A,T,C or G, or insertion/deletion polymorphism (see Tables 1-2)
ttcctggaccctgcagtagcctgtcctcctgtcccctttaccgacttagggggctgcctcccctttacccactaagggggctgccccagctctccttatgncagagcccaggtctccccaaagggagagtaatgagcagtcatcagctagcgggctcgcaggcagcgttttgcaggtcgcagtgcgattacacgtcttact

SEQ ID NO: 29296 - DNA, 201 bp, Homo sapiens
tcacttggaaggaacctgggtacagaatccccctacatttttattactgttctttctttttggccaaattgttactgtcttgcctaccttgaattcaacarcaatttcttctagctacttatatttgtcaaaaatgttcaaaatactcactttactttttttagaaacaacgcgctttctttcacatccatattttatctg

SEQ ID NO: 29297 - DNA, 201 bp, Homo sapiens
tggggtcgggtacacctggctgcctggagcgtcacccccacggttccttcctcatgcagcatcctctttgccgacatcgtgggctttacccagctgtcttytgcctgcagtgcccaggagcttgtgaagctgctcaacgagctctttgcccgctttgacaagctggcagctgtaagtccctggccccgcctggctctccag

SEQ ID NO: 29298 - DNA, 201 bp, Homo sapiens
cccggagcacgcggtggccgagttcccgcacaggtaaacgcaggggcagggccaggcttccgggggggaagacagcgccccgagcgtgggaagggggccgratcggagcccgagcctccaagggtttggtggaaaaaggaagtaaacagaaggaaggctcaggaatcccccacgatggtcctgatttctttccggcacatt

SEQ ID NO: 29299 - DNA, 201 bp, Homo sapiens
gatcatttgagcgagcctgagaggtcgaagctgcagtgagctgtgatggtgtcactcactccagcctgggcgacagagtgagaccttgtcttgaaaaaagaaaaaaaaaaaagacaggtattgtgcagtggataacaaagcaagaaccaactatcaactatcataaagaaactcatcttaaatataaagacacagatagac

SEQ ID NO: 29300 - DNA, 201 bp, Homo sapiens
aacataaaagcaacaaatgtattcactgtggaaagcctggaaaatactatgtagtatgaaaaaatattacccataatattatttctgaaggataactgctrttaacattgaggcttctcttaaacgaatatcagttttcttctatattatgaagcactattgtaagaaaataattcaacctagacaggagtacaaagaata

SEQ ID NO: 29301 - DNA, 201 bp, Homo sapiens
tcgagaccatcctggctaacacagtgaaaccctgtctctactaaaatacaaaaaattagccgggcccacttggtggcaagcgcctgtaatcccagctactygggaggctgaggcaggagaatggcgtgaacccaggaggcagagcttgcagtgagccgagatcgcgccactgcactccagcctgggtgacagagccagact

SEQ ID NO: 29302 - DNA, 201 bp, Homo sapiens
  misc_feature (1)...(201): n = A,T,C or G, or insertion/deletion polymorphism (see Tables 1-2)
tccccaactgttcacacctctcctcctgcctgttggtctgctctgtctgatgttctagatcactcccaaaatgtaccctgtccgctgtcctcaggggagcnaccgagccttgttcctctttgttcttcaggcgggggtggactggggtaggtaggggatgctcactggaaggctagaagcagcaaagctgggtcccaggaa

SEQ ID NO: 29303 - DNA, 201 bp, Homo sapiens
gaatatttatagaaccctgcacccaagaactagagaacatacattcttttcaagtgcactgaaatgttctcaaagacacacaacctgttacaaaacaagastcaatacactttggctgggagtggtggctcacgcctataatcccagcactttgggaggccgaggcgggtggatcacgaggtcaggagatcgagaccatcc

SEQ ID NO: 29304 - DNA, 201 bp, Homo sapiens
gttttggagcagtcctagcgtcagaatggggatctggccaggatcaagagagctgagggacagaggcctccagaaggctggagaccttggctagatgggcscacactgattcttgggacaaagatggggacactgcgtcagtctcagtcaccaaggctgacctggcccctctcttggctcatcttggtaaagatagatttt

SEQ ID NO: 29305 - DNA, 201 bp, Homo sapiens
ggtgactttggtggtgtccagagcaggcttctcaacctcatgggtttggtgagtcaccccaggacccgggactgggcagtgcagtcagctcccaggtacakctgttgcccttgggcccagaagtaaggcttcgagcgccagctgtctcgccccaggccaaggagcctcttccctctctgtctggtggtcagatggtgcctg

SEQ ID NO: 29306 - DNA, 201 bp, Homo sapiens
aagctgcagtgagctgtgatggtgtcactcactccagcctgggcgacagagtgagaccttgtcttgaaaaaagaaaaaaaaaaaagacaggtattgtgcartggataacaaagcaagaaccaactatcaactatcataaagaaactcatcttaaatataaagacacagatagactgggtgtggcagctcatgccttcaatc

SEQ ID NO: 29307 - DNA, 201 bp, Homo sapiens
gctgtcacccaggctggagtgcagtggcgcgatcttggctcactgcaacctctgcctcccgggtgcaagagattctcctgcctcagcctcccaagtagctrtgattacaggcgtgtaccaccatgcctggctaatttttgtatttttagtaaagatggagtttcactatgttggccagtctggtctcaaactcctgacctc

SEQ ID NO: 29308 - DNA, 201 bp, Homo sapiens
agcctgttcagcagaccaccgttaatctttgttgctttctttgtacatttcttatctctgatttatttatttattttgagacggagtctggctctgtcacytaggctggagtgcagtggcgcgatctaggctcactgcaagctctgcctcccgggttcacgccattctccagcctcagcctcccgagtagctgggactaca

SEQ ID NO: 29309 - DNA, 201 bp, Homo sapiens
agaaacctgcctgccattttccttcctttccatgtgcttgacaggttttggtattacggttatgcccaactcattaaataatttgagaagtttctaacccytgatagtttgaagataatttgggttattccttaaatttggaagtcacagccaggcatgtggctggcctgtaggtgtggccaggcaggtggctatgcctgt

SEQ ID NO: 29310 - DNA, 201 bp, Homo sapiens
tctcactgtgttgcccaaactggtctcaaactcctggcctcaagcaatcctcccactttagccacctggcatttttaaaaattaaatactagatattgtgratgggaaatagtagtgcttctgaataatgttgtgtctctccagggaagatttacttttcttgtggcagatggttagagcaggggcagataggaaatagct

SEQ ID NO: 29311 - DNA, 201 bp, Homo sapiens; identical to SEQ ID NO: 7244

SEQ ID NO: 29312 - DNA, 201 bp, Homo sapiens
ggtactcgcagagactgaacaggaagtgctggatgttggtctgtaaatattttgcagctatctcttccaggggaatgaagactgggactgaatggtgatgwatccggagtggtttctgtatgacaaggtccacaaaataggaatccaataggttcccctcaaaagcagtactgatgcagacacaaactcctcggctggtca

SEQ ID NO: 29313 - DNA, 201 bp, Homo sapiens
ccctttactgccctaaactgcccctgggctgggtgaggaggaaggaggggactgggctcaggaccaggacctgcaggaccagcggccaatgagtgcggacwatggggaaggcagccaggatggttgggggtggtggtgggcggggcgtgcctttagcatttggcaaagtagggactaggaactgctgacaaatattttgta

SEQ ID NO: 29314 - DNA, 201 bp, Homo sapiens
cctccagtgcttatcacctagttgagggatccaaacaaggacaacctgacaaaacctaaggaccaggaccaggcccagccaaggtgaaggggtccgcctcrtggtcagactcacaggtccgtctcctctgctcaattgcccagtctttgcctagacctgctacgtgaactttgtcacagtggcaagtcagagctagcgtgg

SEQ ID NO: 29315 - DNA, 201 bp, Homo sapiens
tcagtggttgagctcttttattgagtcatcaatttcaattatatatttttctgtcctagaatttccatttgattttaaaaactggacttaggtccctaackatgtattcctattttgtcatctattttttagaatatattaaacatttattttaaagttcctgactgacaaccataataataccaatgggtatgcattttt

SEQ ID NO: 29316 - DNA, 201 bp, Homo sapiens; identical to SEQ ID NO: 7272
  misc_feature (1)...(201): n = A,T,C or G, or insertion/deletion polymorphism (see Tables 1-2)

SEQ ID NO: 29317 - DNA, 201 bp, Homo sapiens
tcgaccctcaccccgggtggctttctgctttggactctgggtcaaagcactggcgtcacagtcattcgacttgaaccaccaggagctcccccacttaccarctgtgagatctggggtaagttatttaacctctttgcctggtttctccttctgcaaaatgggtgtgataataatacctttttcactgggataggcggcaag

SEQ ID NO: 29318 - DNA, 201 bp, Homo sapiens
tcgctcccctggcctgggtcctgccccaggacctgttacggaattacttgccctttactgccctaaactgcccctgggctgggtgaggaggaaggaggggrctgggctcaggaccaggacctgcaggaccagcggccaatgagtgcggacaatggggaaggcagccaggatggttgggggtggtggtgggcggggcgtgcc

SEQ ID NO: 29319 - DNA, 201 bp, Homo sapiens
  misc_feature (1)...(201): n = A,T,C or G, or insertion/deletion polymorphism (see Tables 1-2)
agatccccactgctgccacctccacgagacagacctgcagctgaaattaggtcccaagaggccccctacacacggaaggcctcctggatctctgctgtaantacggaggctgggaaccgcaccactattgggtggccttttgatgaggtgcaatctttgcagggtcttacttcccttgccatttagccatcttccttccag

SEQ ID NO: 29320 - DNA, 201 bp, Homo sapiens
  misc_feature (1)...(201): n = A,T,C or G, or insertion/deletion polymorphism (see Tables 1-2)
ttaaatacctggggagcagccctgatgtgaataccaggtgcagccaggaggggccaggggttgcctggctgttggagaggagcccagtgagttaagaaaantttactgcccgggggagcccgacttgatgtgaaagggcctaaggagccggggtgagctctagggctggggtggcaggaagcagcaccatctagttggagg

SEQ ID NO: 29321 - DNA, 201 bp, Homo sapiens
  misc_feature (1)...(201): n = A,T,C or G, or insertion/deletion polymorphism (see Tables 1-2)
gacctggaggctgtgctgttgaacaggcacatcgaggaggtccaacacagcgtcagaactcccacgccctcttctcagctctgccccttggtcagctgtcnggtgactcccaggcagagtccgttttgaggctcctgggactggaatacgggaccagcctgagttgctgtcagtcacgtcgcaggagaaaggactggcaaa

SEQ ID NO: 29322 - DNA, 201 bp, Homo sapiens
aaaaagcagaacaattcttttgaaataagttatttccaggaaaactttaggattaagaaacttgtaaaaagatctataaatagagaccccaggggctgtgsacctctgtcaccacagagcctgatcgtgctgtgcagtctaaaggggaccacggggcaagaagaggtgactttggtggtgtccagagcaggcttctcaacc

SEQ ID NO: 29323 - DNA, 201 bp, Homo sapiens
taaaaattcttccttctctgaaagcaacattctgttccccagcagcctttcctcattagctttctctcttggggcctccaaagcaagtcttgtcccttttmtacatagcagctttcctcagacttaaagacagcttcctaagaagaagggggtgggggggacctggggctaaggacacagcctggttaagctggaccgggg

SEQ ID NO: 29324 - DNA, 201 bp, Homo sapiens
cgtgaaggatcttgcgatgcgtaaacttccaggagggaggattttgtaaaggaatgttctcatggttgcgttctgagccgggatattagaaacactttatyaggctgtcatgggttagatgacactttagtccaagtgtttatccatttgggagatgcattttattattctaaaaatgttgtatattttaaaaaagcagaa

SEQ ID NO: 29325 - DNA, 201 bp, Homo sapiens
  misc_feature (1)...(201): n = A,T,C or G, or insertion/deletion polymorphism (see Tables 1-2)
gtgtctggggaagccatcacgacagatctgtgtagtggcacccctggcagtgcgcaacctgagaagctgctctagctgcctggcagatcatgagggacctngcctaacatgtcagatgggctggatgcctattctggaagtcctctttgttttggaagagggtagactttgaacatctcttaccaaaggcatgcacaagtt

SEQ ID NO: 29326 - DNA, 201 bp, Homo sapiens
  misc_feature (1)...(201): n = A,T,C or G, or insertion/deletion polymorphism (see Tables 1-2)
tgaagaactagggccagctgtcttcctcagacctcatctaaagcagctacctagtcactttctaccacttttattctcttttgagctctgatatgcttacntttgaaatattatttctgctaagagcttgacaagggtaaggtcacagactcgtcataacatgtggacctccacaggcagcagaggcaggctgttttggtt

SEQ ID NO: 29327 - DNA, 201 bp, Homo sapiens
gtttccttaaagtggagtaagaattaaaagtcacttggaaggaacctgggtacagaatccccctacatttttattactgttctttctttttggccaaattkttactgtcttgcctaccttgaattcaacagcaatttcttctagctacttatatttgtcaaaaatgttcaaaatactcactttactttttttagaaacaac

SEQ ID NO: 29328 - DNA, 201 bp, Homo sapiens
ttagcctactgaaaaggaaaacccataagatcatctcaattttgtcaaatgcagaaaaaagcatttgacaaaattcagcatccattcagataatacctctyagcaaactaggaaaagaagataatttcttcaacctgagaaaaggcatctttgcaaaacctacatcatatttaatagagaaagtctgaatgttctcttttt

SEQ ID NO: 29329 - DNA, 201 bp, Homo sapiens
cttttttttttttttaaagatgaggtcttgctatgttgcccaggttgggcttgagctcctgggttcaagtgatcctcccaccttgacctcctgagtagctrggaccaccggtgttagccaccaccccctcctatggccttcttttgcagctgggatgtgttgtgtgtcatttccagtttccttaaagtggagtaagaatta

SEQ ID NO: 29330 - DNA, 201 bp, Homo sapiens; identical to SEQ ID NO: 7249

SEQ ID NO: 29331 - DNA, 201 bp, Homo sapiens; identical to SEQ ID NO: 7263

SEQ ID NO: 29332 - DNA, 201 bp, Homo sapiens
ccagcttacagtgggctgtgttccagaagcttctgagtcactggtttgggactaatgtgactttttaaaaggtgcctgggttcccaggcccacccaccagrgtcttcctcaactcacagcatcccggcatttggcctctgaagatggtggaaatggggccgggcatggtggctcatgcctgtaatcccagaactttggcag

SEQ ID NO: 29333 - DNA, 201 bp, Homo sapiens
ggaacaaagaacagtaagataagtagaagacaaaaaacaagacaacagttttaaatatagccatattgataatattaaatgtaagtgatataaatattcartttaataggcagatattggcagtggctcacgcttgtaatcccagcactttgggaggctgaggaggacagattgagctcaagagttcaagaccagcctggg

SEQ ID NO: 29334 - DNA, 201 bp, Homo sapiens
caaagagatatgactcataagccaataatggagataaaatagaatggtaaacaaaaatcattcaaaagatggcaaagaaagtgggaaaaaggaacaaagamcagtaagataagtagaagacaaaaaacaagacaacagttttaaatatagccatattgataatattaaatgtaagtgatataaatattcagtttaataggc

SEQ ID NO: 29335 - DNA, 201 bp, Homo sapiens
gggcgtggtggtgtgtgcccgtagtcccagttactcaggaggctgaagcaggagaatcgcttgaacccatgaggaggaggttgcagtgagccgagattgcrccactgcactccagcctggcgacagagcaagactccatctcaaaaaaaagaaaaagaaaaatgaagataattacatcaaggcacattgtaatcagattgc

SEQ ID NO: 29336 - DNA, 201 bp, Homo sapiens
gtggctcgccaggtcacttggagccaggataggcaggagtagctggccagagacgagcagccctgaaaactgttcctgccctggcctcacctcgtcaccaygtctgctgtggaaagggctgcgacctggaggctgtgctgttgaacaggcacatcgaggaggtccaacacagcgtcagaactcccacgccctcttctcagc

SEQ ID NO: 29337 - DNA, 201 bp, Homo sapiens
gcgatctcggctcactgcaacctctgcctcctgggttcaagttgattctcctgcctcagcctcccgagtagctgggattacaggtgcccgccaccatgccyggctaatttttgtatttttagtagagacagggtttcaccatgttggtcaggctggtctcgaactcctgacctcaggtgatccgcctgcctcggcctccca

SEQ ID NO: 29338 - DNA, 201 bp, Homo sapiens
ctcccacctgcctcctccagactcctcagctctgcctgcccctcaggactcccagcagctgtctgccttgagaggctgccctcaagagctggtggggcccyatctctggcttttcttgaaaaccttcctagaggctcatcttttctgcaaacccagagctttttccacaatgtctggttagttaggttccgagacgggtcc

SEQ ID NO: 29339 - DNA, 201 bp, Homo sapiens
  misc_feature (1)...(201): n = A,T,C or G, or insertion/deletion polymorphism (see Tables 1-2)
aaactcatgattgttctcctttgagtattgctaagacataaaaccctaaaacttagaaaacagaaaaaaaaagatagaaatcaagaataaaaatattagcntcccaggggagcctgaccttggcatgcaagcagtgcctgggaggcagctttgggaacagagcaggaggggcagagagctctcaaggtccgattgggagcc

SEQ ID NO: 29340 - DNA, 201 bp, Homo sapiens
cctcccaaagtgctgggattacaggcgtgatccaccatgcccaggctgggaattcattttaaatctaacagcatctcaaatggtaggtgtcccccttctamcccccgcaacattggtacattgtgtctctcccattctgttctcctgcatttggtttgggagtctcaggtacagactatgacctctatcctttttgaattt

SEQ ID NO: 29341 - DNA, 201 bp, Homo sapiens
ttcaggccggtcttacagggaagaaccgcccattgaccacaagcgtcaggcccctctcctgggagccccggagcttgggacactgggaggctgccatttcytaagcttggattgtatctcttgcttttctgaatgttcttcctctgtaacctttgcccaagcctggtcactgtttccctcaagaccttttgctattaggac

SEQ ID NO: 29342 - DNA, 201 bp, Homo sapiens
  misc_feature (1)...(201): n = A,T,C or G, or insertion/deletion polymorphism (see Tables 1-2)
ctgccaattcctaagaaaccaaatcagtaatttcctgaaggggaatctgagcaaagcgcatggcatggtgccgagggttgttcatcctcccacgtggggcngggggccgaccccactgcccacaggcacattttctactgtggacaaccctgtcagctggagccagcccaaggagtggcacacagcctcacccttcagtgc

SEQ ID NO: 29343 - DNA, 201 bp, Homo sapiens
atttcagattctcgctagggttcaagttttccccagaggcagaattttttcctgggtcttcagttcttcacctgtaatgagaggcgatcctgatggatgcyttttagaggaacggcagctgccctgcttacccagcatcaagttcttcctgcggccacacctgcctggccctggggacagggacgatgtcacgccaccgtc

SEQ ID NO: 29344 - DNA, 201 bp, Homo sapiens
ttcatccgttttgtgctgctacaacagaatacctgaaactgggtaatttataaagaacagaaatttactacttacagttctagaggccgggaagtccaagrtcaaggcaccagcatttgctctggtgtccatacatggcagaagggtgggctagctgaatgttatgtgatgccccttttaaaagagccttaaccctcatgg

SEQ ID NO: 29345 - DNA, 201 bp, Homo sapiens
aatgaatcagaccaagtttcttcattatccttttttcatctcttttctgcgtaatcaactagctctttttcttcattgtgaaaggattattgttaagaatrtttcaaattataaaatgctgaataatattgcagaatattgtactattccttttctgtagggcatttgtctacttttttttctttctttttttttgagacg

SEQ ID NO: 29346 - DNA, 201 bp, Homo sapiens
ggtaccaaattctctccatttctgattacctaggagtgtgcttattttgctttcattttcgaaagatacctgtcttcatccgttttgtgctgctacaacasaatacctgaaactgggtaatttataaagaacagaaatttactacttacagttctagaggccgggaagtccaagatcaaggcaccagcatttgctctggtg

SEQ ID NO: 29347 - DNA, 201 bp, Homo sapiens
  misc_feature (1)...(201): n = A,T,C or G, or insertion/deletion polymorphism (see Tables 1-2)
tcaacatggtgccttggcagaactataaggctcctctggtttccccagtgcccgctgaacaggggcccacagaggagagatagggatggtggaagaacagngagtgggacagtgaagccagcaggcaggggctggagaggcagggatcaatttgttgttgttctttttatatgagggtgcctctgtgtggaactctctccc

SEQ ID NO: 29348 - DNA, 201 bp, Homo sapiens
cagctctacggtaccctcgtcttcacagctggggctgttagaggaactagagaagctgttttaaaatttattcaaagtagtggctgggcacagtggctcargcctgtaatcccggcactttgggaggccgaggcgggtggatcatctgaggtcaggagtttgagaccagcctgggcaacaaatagtgaaaccctgtctcta

SEQ ID NO: 29349 - DNA, 201 bp, Homo sapiens
catagataataaggttgttcagattttatatttccttttatataggttttagagaggtttttttcccccagaaacatgtccattcaaattttcaaaatttyggcataatattcttaatattttctttttatcttttgtctgaaatgggtaatgatgttcctttttttcattactgaagataatttgtgcctttttaaaatt

SEQ ID NO: 29350 - DNA, 201 bp, Homo sapiens
agtatccccatatgtaaaacttttgagagatttttttttctttctttttttttttttttttgacatggagtcttggtcttgtcacccaggctagagtgcartggcacaatctcggctcactgcaacctccgtctcccgggttcaagcgattctcctgcctcagcttcccaagtagctgggattacaagcacctgccaccac

SEQ ID NO: 29351 - DNA, 201 bp, Homo sapiens
tttgattcttttcccagagagggtcagggccttgacttttattaccatgctgtatttttaggataaccatcaaggacttgaaggctgaggagaatgaagastttaccctccttcttctctgtgcagaaccacatctgggcacccaggcctcggcccccagggtttggccacatccccctcctccggtccagccttccaccc

SEQ ID NO: 29352 - DNA, 201 bp, Homo sapiens
tcggctcactgcaacctccgtctcccgggttcaagcgattctcctgcctcagcttcccaagtagctgggattacaagcacctgccaccacacctggctaattttttttttttttatatttttagtggagacggggtttcaccatgttggccaggctggtctcaaaactcctgacctcaggtgatccacccgcctcggcttc

SEQ ID NO: 29353 - DNA, 201 bp, Homo sapiens
ttagcttctcaccagccaacctcatttatccaaatccctcctggcctccttgctgtaattaactcctgaatgcctcatcagagcctcagctgtaacagctygggcccctgggaacagtgctggctgcctcccccttctatctctgtcctgagccagtgcgaaccaggcctggcatgagtcatccctgagtagaagggggct

SEQ ID NO: 29354 - DNA, 201 bp, Homo sapiens
gtattataaattagatatgcagttagaaaaactcaggtttgcttcatttttttttcttttttatagagctaaaatgaaaccccttgaaagtggtttagtayactcaccatgttgtgccaccaccacctctagctagttccgcaacatcttcccccaaaagaaaacttgggacccgagcttgatttttatttgtttttattt

SEQ ID NO: 29355 - DNA, 201 bp, Homo sapiens
ggggactctggggacactggtctggtgcctgttctcatgctggaggccttgtttccaaatatgctgacttttacagttatgcagctcctccctcctctacrttcctacagcatttggctgaagactgtgaagcactcctgccctgggagaccagtctctcccacgtgtgaccattgccccacccatccaagctctttggag

SEQ ID NO: 29356 - DNA, 201 bp, Homo sapiens
tgtgtgccatctactaaaattcagtaggttttataaaaagtcagtaaaatacaggaatcacaaaaattgtgcatacatatatacatttatatgtattttaratagtttgttttaattgaaaacatttagctatacagtcatttgccaatcttttgttgaagggaaagttctttcctttttatataggtactctgtttggta

SEQ ID NO: 29357 - DNA, 201 bp, Homo sapiens; identical to SEQ ID NO: 7242

SEQ ID NO: 29358 - DNA, 201 bp, Homo sapiens
caaagtgttgggattacaggcttgagccaccgcgcctggccctttttttgagacagggtctcactccatcatccaggctggagtgcagtggtgtgatctckgctcactgcaacctctgcctcccgggctcaagcagttcttgtgcctcagcctcccaaataacttgggactacaggcatgtgccaccatatacccagctaa

SEQ ID NO: 29359 - DNA, 201 bp, Homo sapiens
tccagtttcagagtcttggctctttatgccaagggcagggggctttgaaccaggccttgaagttagtggtagcaatggaggtgggggtacattctataagragtcccagaaagagagagggagagagacaaagagagagagaagagggaggaggaggaggaggagaagggggaggaggagaaaaaggagaaggggaaggag

SEQ ID NO: 29360 - DNA, 201 bp, Homo sapiens
tagtcttgaactcctgacctcgtgatctgcccgcctctgcctcccaaagtgttgggattacaggcttgagccaccgcgcctggccctttttttgagacagrgtctcactccatcatccaggctggagtgcagtggtgtgatctcggctcactgcaacctctgcctcccgggctcaagcagttcttgtgcctcagcctccca

SEQ ID NO: 29361 - DNA, 201 bp, Homo sapiens
cacacaagcagtttctcagtccatccctccaccgtcatgtagctttggagtggctcttaggttcccaaacacatcatccccacctagtggaaggagtcttrtccctgtcatccagggagcctctgggatggacttgtttccttgaagctcctctcccagagtccgagagcacagttccatgtgcccaggcctgtgctaggt

SEQ ID NO: 29362 - DNA, 201 bp, Homo sapiens
ctccctctggctgggccaccaggctgtggcaggctgtggtgggccacggctgggccgtggtgggccttgttgggccgtggcgctgcagcacgtatgagtayggcagagtctgggtaaacaagaacctgggtagagaggaagtggagggccggctggaaggtgggttggccccgatggtgaaggcccttagaagccagacta

SEQ ID NO: 29363 - DNA, 201 bp, Homo sapiens
tgacaggtaagggccacggcttcccctcctggcctgcactcacagcccttcttctagagacaggaatataacaggcccaagccccgggatctcaccctccygggaggcacgtgacctgatacgtgcaggttagagaagctggcatgggttcctccaggagggctgcagcagtgcagtgaggagggaaggaaataccaggtg

SEQ ID NO: 29364 - DNA, 201 bp, Homo sapiens
ggcagaccatctctgatctttgaactatgaatgaatcagaccaagtttcttcattatccttttttcatctcttttctgcgtaatcaactagctctttttcytcattgtgaaaggattattgttaagaatgtttcaaattataaaatgctgaataatattgcagaatattgtactattccttttctgtagggcatttgtcta

SEQ ID NO: 29365 - DNA, 201 bp, Homo sapiens
tataattttcttgggcctttatgcccagggtggtactgagttgctgcatctgggtcaaggagagaatgcaaagggtctgctttccgccagtcacagatacraaccctccgcatccttctcaacacagggctcgaggcagctgctctctgcccatcagagttggcacagtacttgtgactacagtgttctagagctgcaata

SEQ ID NO: 29366 - DNA, 201 bp, Homo sapiens
aagaagaaataactaaattcaacgtataatggtggaaaaagaacattagtagaaaacttgaccagatttgagtaaggcttatagtttagttgttaatactrtaccagtgttaatgtcctgttctcgatcatggcactatggtttggtaatatgttaacattagaggaagctgggtgtaacttctataaacctaaaattcgt

SEQ ID NO: 29367 - DNA, 201 bp, Homo sapiens
gctagctaagaacagttcagaaaattagacaaatattttggccacattaaactttagttttcccaaactttctgaaatgtaaatatcttttctttttttakattttgaagactcttctccaaaattttgataaatggctttttataataacttaaccaatctttagagaattccatattttcagactttcacaaaatcagg

SEQ ID NO: 29368 - DNA, 201 bp, Homo sapiens; identical to SEQ ID NO: 7300

SEQ ID NO: 29369 - DNA, 201 bp, Homo sapiens; identical to SEQ ID NO: 7289

SEQ ID NO: 29370 - DNA, 201 bp, Homo sapiens
actgggagagacctcccagtaggggccgattgacacctcatacgtccgggtgcccctctgagacgaagcttccagaggaacaatcaggcagcaatgtttgycattctgcaatatttgcagttctgcagcctctgctggtgatacccaggcaaagagggtctggagtggacctccagcaaactccaacagacctgcagctga

SEQ ID NO: 29371 - DNA, 201 bp, Homo sapiens
taacagttagcccccattatatacatgtagttttatgtacatctttatttaacaacatgaacattttcttatgccttccttctttttacatgctgtaacartactgcataatttgctatctaatggatatgctataaattgtttcacttttctgtactgttgaatgtttaaactccttgggtttttactttggaaaataat

SEQ ID NO: 29372 - DNA, 201 bp, Homo sapiens
attatatcctgcgcctggcttggagggtcccacacccatggaacctcacccactgctagcacagcagtctgagatgaaactacaaggcggcagcaaggctsagggaggggcatccgccattgctgaggcttgagtaggtaaacaaagtggccgggaagctcgaactgggtggagcccactgcagctcaaggaggcctgctt

SEQ ID NO: 29373 - DNA, 201 bp, Homo sapiens
  misc_feature (1)...(201): n = A,T,C or G, or insertion/deletion polymorphism (see Tables 1-2)
atttcatgtgtggtattagaaaatatacaatgatctgcccaagggttccaagatggctgaataggaacaactccagtctacaggtcccagcgtgagtgacncagaagacgggtgatttctgcatttccagctgaggtaccgggttcatctcactgggatttgtcgtacagtgggcgcagcccacagagcatgagccgaagc

SEQ ID NO: 29374 - DNA, 201 bp, Homo sapiens
tgtttagccatttcatgtgtggtattagaaaatatacaatgatctgcccaagggttccaagatggctgaataggaacaactccagtctacaggtcccagcytgagtgacgcagaagacgggtgatttctgcatttccagctgaggtaccgggttcatctcactgggatttgtcgtacagtgggcgcagcccacagagcatg

SEQ ID NO: 29375 - DNA, 201 bp, Homo sapiens
  misc_feature (1)...(201): n = A,T,C or G, or insertion/deletion polymorphism (see Tables 1-2)
acttatacatatgaagctttatatgtttgtttggaatatgtttgtaaataaacttaataatgtctttcaatgagtagaaccagtccactgtccacagatantttacaataactcacactccattcttcctgatctcattttcttcctcagtatactacactgtacattagatctgttttagcagcatacatacacttaaat

SEQ ID NO: 29376 - DNA, 201 bp, Homo sapiens
cccctttaaatattgatgctcccccattatctgtattctttcctgcaactcactatgagttgtatagtgaacctcctatttctctttttttttttttttttgagacagggtcttggttgcccaaatgcgagtgcaatggtgcagtcatggcttattgcagcctcttgggatcaagcaatcctcccacctcagcctcctaaa

SEQ ID NO: 29377 - DNA, 201 bp, Homo sapiens
  misc_feature (1)...(201): n = A,T,C or G, or insertion/deletion polymorphism (see Tables 1-2)
aacggatagtacatgtttttggctttgtgaaccagatggtctctgtggtaactacttagatctgctgtgaaagcggcaatagacagcatgatgtggctgcnctggtttggtgactccttgctcagaacattgtaagaatccctgtagacagcagaaaatacagaacatggttttatgctaatttgttttgttagagtgggg

SEQ ID NO: 29378 - DNA, 201 bp, Homo sapiens
gattatggttggcaaatttttttgtaaagatccaaattataaatatttcaggctttgcaggccatatctctgtcacaactactcagttctgccattgtagyaagaaagtaactgtagatgatatatgaacaaataggcgtgactgtattccaatcaggctttctttgcaaaacaggcattgcagactacagtttgttgatc

SEQ ID NO: 29379 - DNA, 201 bp, Homo sapiens
  misc_feature (1)...(201): n = A,T,C or G, or insertion/deletion polymorphism (see Tables 1-2)
tgtaattttgactgtcctgaaacctttactcaagaacaccattgtggttcccagtttggcagctttaataaatgcaaatttttacttttgtatccattaanctgtcatgaatataaaaatgggttgcaaaacaataatatatgtatatttgattgtttctttatatgttcctttgaagaaatatgactatatttcagatcc

SEQ ID NO: 29380 - DNA, 201 bp, Homo sapiens
  misc_feature (1)...(201): n = A,T,C or G, or insertion/deletion polymorphism (see Tables 1-2)
tcttgctatttctagtttttttctttgcctaattttctcacttaaaaaaaaatctacttcaataaatatttatgtagtgcatactatatacagtattctanctattagggatacagtatggatcaaaatagacaaaaatccctggccttaggtaaattactttctggtgagtgatagagataattatattgtgtatattta

SEQ ID NO: 29381 - DNA, 201 bp, Homo sapiens
ccgagccctcatcttctggatgttactcacatcaatctcattaaaaattgtcagcattggcacatgtattctgggcctccttcagacgctgagcaatgcaytgccgcatcctgttcattttctcccgatgttctgaatgcagacctttgccagctcctggctcagctagtggtgggacagcagtgggttttactgcagaca

SEQ ID NO: 29382 - DNA, 201 bp, Homo sapiens
attctcactattgtctataagaactgtgtgaaacgtctagattgttctcctgtagcatatacagtcagctctccatatccatgagggaatagtttaggacmtgttgccctccatatcaaaatttttggttgccaagtctgttatacaaaatgtacagttagccctttgtatctgtgggttttgctccacagttggttaaat

SEQ ID NO: 29383 - DNA, 201 bp, Homo sapiens
ttctcactattgtctataagaactgtgtgaaacgtctagattgttctcctgtagcatatacagtcagctctccatatccatgagggaatagtttaggacckgttgccctccatatcaaaatttttggttgccaagtctgttatacaaaatgtacagttagccctttgtatctgtgggttttgctccacagttggttaaatt

SEQ ID NO: 29384 - DNA, 201 bp, Homo sapiens
tcgtggatgccaaaggcaaacttttaaaaaattaaaattttataacttttctaattataaaatactgagtatagaaaatttagaaatgttttaagtagaayaaaaatatctgtaatccctcagatatggagttaattagtattacttccttattgtagtgcctaccacatttttaaatatgtaattgtgtttttaacagtt

SEQ ID NO: 29385 - DNA, 201 bp, Homo sapiens
ttgcagtatagttatttatcttcactgttacattgtgaaaatctctaggactgaatgtcttttacctctggtttccccatatcctaatttacatcgtggtrcatagtagatattcaatacatgtttgcatgaatgaatacatgtgaaattgaatttaatgaacttgtttaaagctatctaacattttcactttttattaaa

SEQ ID NO: 29386 - DNA, 201 bp, Homo sapiens
cttttacctctggtttccccatatcctaatttacatcgtggtacatagtagatattcaatacatgtttgcatgaatgaatacatgtgaaattgaatttaaygaacttgtttaaagctatctaacattttcactttttattaaatatatgatttgttgatatacctatgcctaatttgaattatatattaagtgtttttagg

SEQ ID NO: 29387 - DNA, 201 bp, Homo sapiens
atagtgtatatttcttgtatttactatgatgaaaaaaggtcgttttaattttgaattgaataaagttacctgttcattttttattagatattttaaagacytcagaaaatataaatatgaaataatttaagaacccaaatctctgaatttaatatttctttgtaattctaaatatcgaatactgctaaactgtgttatact

SEQ ID NO: 29388 - DNA, 201 bp, Homo sapiens
agctgagattatgccattgcactccagcctgggcaacaggagcgaaactccatcaaaaaaaaggaaagagagaagggaggaaggaagggagggaggaaggaaggaagggagggaggaaggaagggaggaaaagaaaaggtttctataccagatataaatgtactccaaaagaagggagggagggagggaggaaggaaggaa

SEQ ID NO: 29389 - DNA, 201 bp, Homo sapiens
tgagctgagattatgccattgcactccagcctgggcaacaggagcgaaactccatcaaaaaaaaggaaagagagaagggaggaaggaagggagggaggaaggaaggaagggagggaggaaggaagggaggaaaagaaaaggtttctataccagatataaatgtactccaaaagaagggagggagggagggaggaaggaagg

SEQ ID NO: 29390 - DNA, 201 bp, Homo sapiens
tgatcttggcccactgcaacctctgcctcccaggttcaagcgattctcctgcctcagcctcccaagcagctgggactacaggtgcgtgccaccacgcctgsctaattttttgtatgtttagtagagacaagatttcactgtgttagccaggatggtctctatctcctgacctcatgatctgcccaccttggcctcccaagg

SEQ ID NO: 29391 - DNA, 201 bp, Homo sapiens
ttaattagtgaagaattggcttatggatgtacaggggttcagactgctattgaaggaaattctttgggggtaagtgacttagaaaattaactacctaactsagctcttgttaatgagatagttactcctgaagaagttggatttttagaagaaaaaaaaaggaaagtcagttactactaggtaaggttagtgggtacacac

SEQ ID NO: 29392 - DNA, 201 bp, Homo sapiens
caacatggcagcggggttcgggcgatgctgcagggtgagagggagcccagcggtgcggtggggctggaacatgggtattgtggtgtcggagcagggggccstgggccaaaaataggtgcggccgggaggagtgggaagtcgggctgaggaaggagccagcctaggggcccccaacctgctttcacgcctcctaccaccgga

SEQ ID NO: 29393 - DNA, 201 bp, Homo sapiens; identical to SEQ ID NO: 7293

SEQ ID NO: 29394 - DNA, 201 bp, Homo sapiens
tgggcgacagagcgagactccgtctcaaaaaaaaaaaaaaaaaaaaaaaaaagagatttgatcttatgctcttcaattcagcaccagaattcagcttttakgtattgtttctcacatccccatacaaatgattactgtagtcttaaacattcctctgtgcatttgctctcatttttcttgcttgaaataccctattatctc

SEQ ID NO: 29395 - DNA, 201 bp, Homo sapiens
aggattgcttaagcccaggagttcaagactagcctgggcaagatggtgagacctcatctctacaaaaaattagaaaattagctaggtgtggagatgcacayctgtggtcccagctacacagggggctgagtcaggaagatcccttgcgcctaggaggctgaggctgcaatgatccatgttcaaaccactacactccagcct

SEQ ID NO: 29396 - DNA, 201 bp, Homo sapiens
taaatagtgatgactttaaaaactatgagtatggtcaaaccagttgctgtactcacttatgattatcagtagtctcttatctgattaatgtttaacttatsaaatttattttaataaaagtgttctttacaggtcctgagaagtatttctcgttttcattggagatcacagcatacaaaagccaatcgacaacgtgaacca

SEQ ID NO: 29397 - DNA, 201 bp, Homo sapiens
gtgcccagactttctctaccctctatctacctgcaagattgctatcaactggcaccaatcttagaagtaaagctgtgatagagagaacactggactgaaaytcttaagtatacttctgctaattcattgtgagactgatactagaatttccttactctgcattagtttatcaataaaaagagagatttggctgggcgcagt

SEQ ID NO: 29398 - DNA, 201 bp, Homo sapiens
tattcgagggtatgagacaggtgcagagagggagagagccaggcaggaacaccaagaaaaaagctgtgactgctggttacatagtgctctgcttccttgcktgaggccaacagcatgtgcctgtcaccaggctaacctgggacccatgaggggacagggagaagactggttttcagttcctgcatgatcaatttgtagggt

SEQ ID NO: 29399 - DNA, 201 bp, Homo sapiens
tcccaccccttcccccctccccacccccaggcctcacttcttggctcaagatacaaaaaggcactctctactggccctagtgtcaaatgtcagcagcctcwggcctggatgcagttggatacaaagccatgaatcccagtagctccaaggaattccaatgattgtgcccagatccaccggcaacacatcttagaaatgacc

SEQ ID NO: 29400 - DNA, 201 bp, Homo sapiens
ataagaatcaatagtatgagcctttaaaaagccaatgtaattttaagccaaagtaatagaagtacagcatcaaatagagaaaaaatggtgacagttctggkcaacacattttaaaacatgtattgaaaaacttgactaaatctagaagcatgtaagtatcttgcattaggaggagcctacaaaacatgttctgaaaagcaa

SEQ ID NO: 29401 - DNA, 201 bp, Homo sapiens
gcctaattttttgtatgtttagtagagacaagatttcactgtgttagccaggatggtctctatctcctgacctcatgatctgcccaccttggcctcccaakgtgctggaattacaggtgtgagccaccatgcccagccaagtattgttattattttttttttctgaaatggagtctcgctctgttgcctaggctggagtgc

SEQ ID NO: 29402 - DNA, 201 bp, Homo sapiens
ttgagacggagtctcgctctgttgcccaggtcggagtgcagtggtgtgatcttggcccactgcaacctctgcctcccaggttcaagcgattctcctgcctyagcctcccaagcagctgggactacaggtgcgtgccaccacgcctgcctaattttttgtatgtttagtagagacaagatttcactgtgttagccaggatgg

SEQ ID NO: 29403 - DNA, 201 bp, Homo sapiens
caataaatgttagagtgatttcactgtacttttctttggctatattgcccttcagatgtttgagtatagttatatttatttatttatttattttttgagayggagtctcgctctgttgcccaggtcggagtgcagtggtgtgatcttggcccactgcaacctctgcctcccaggttcaagcgattctcctgcctcagcctc

SEQ ID NO: 29404 - DNA, 201 bp, Homo sapiens
tgacatgtttttatacctcaggtgcctgggaatcaacaccttctgaaacagcatcatttgcgagcatctgttatcattagaaaaatattttggattacatratgcttaagcacagaacctgtcatttttttttttataattttaccagttcatactgtaataggtgttcaataaatgttagagtgatttcactgtactttt

SEQ ID NO: 29405 - DNA, 201 bp, Homo sapiens
  misc_feature (1)...(201): n = A,T,C or G, or insertion/deletion polymorphism (see Tables 1-2)
cgaacagcagaaagaatttcaagctactgctcgtaaatttgccagagaggaaatcatcccagtggctgcagaatatgataaaactggtgaagtaggtatanacattttaaagagggaaaaatcttttacattttttacaagattatgtaatcaaactatctggatttcaaaatatattttaactcagttctttttcttcta

SEQ ID NO: 29406 - DNA, 201 bp, Homo sapiens
tttgaaaataaatgttttttatttcagatacctaaaatttcaagcaaactgtttaataaaggaatttgtacatatttgctaggaaatttgcaattttttttaacaattgagaggttagctaaacattctcactattgtctataagaactgtgtgaaacgtctagattgttctcctgtagcatatacagtcagctctccata

SEQ ID NO: 29407 - DNA, 201 bp, Homo sapiens
tctcaaaaaaaaaaaaaaagcaattaatgtgggctgggcatagtggctcacacctgtaatgtcagcactttgagaggctaaggcaggagaactgcttgagyccgggagttcaagaccagcctgggtaacacagtgagaccctgtctctaaataaataaataaatgaataaataaataaaaattaatgtgaacctgtaactg

SEQ ID NO: 29408 - DNA, 201 bp, Homo sapiens
cctctgcctcccaggttcaagcgattctcctgcctcagcctcccaagcagctgggactacaggtgcgtgccaccacgcctgcctaattttttgtatgtttrgtagagacaagatttcactgtgttagccaggatggtctctatctcctgacctcatgatctgcccaccttggcctcccaaggtgctggaattacaggtgtg

SEQ ID NO: 29409 - DNA, 201 bp, Homo sapiens
gtgagctgagattatgccattgcactccagcctgggcaacaggagcgaaactccatcaaaaaaaaggaaagagagaagggaggaaggaagggagggaggaaggaaggaagggagggaggaaggaagggaggaaaagaaaaggtttctataccagatataaatgtactccaaaagaagggagggagggagggaggaaggaag

SEQ ID NO: 29410 - DNA, 201 bp, Homo sapiens
agtgagctgagattatgccattgcactccagcctgggcaacaggagcgaaactccatcaaaaaaaaggaaagagagaagggaggaaggaagggagggaggaaggaaggaagggagggaggaaggaagggaggaaaagaaaaggtttctataccagatataaatgtactccaaaagaagggagggagggagggaggaaggaa

SEQ ID NO: 29411 - DNA, 201 bp, Homo sapiens
tagaagtttagaatggaaataaggtctgactcttgaaatccttccagcatctttttctttagcaactctgttccacaggcagtgggagaaaaaaaaaaaaattaagggtaagaataaaagactgaaggagacagctagctaagaacagttcagaaaattagacaaatattttggccacattaaactttagttttcccaaac

SEQ ID NO: 29412 - DNA, 201 bp, Homo sapiens
tgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactgtg

SEQ ID NO: 29413 - DNA, 201 bp, Homo sapiens
  misc_feature (1)...(201): n = A,T,C or G, or insertion/deletion polymorphism (see Tables 1-2)
gtggtgggacagcagtgggttttactgcagacacaggtttgctagaaggaggttgtgagggcgagggcactggtggcatcgagtgggtatgggtgctgcanggggaggaactgccgctgctataggttctgcttttggggctgcagcagcaggagcttcagccggcttggccttagcaggagcagcaccagttttcctgag

SEQ ID NO: 29414 - DNA, 201 bp, Homo sapiens
ctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactgt

SEQ ID NO: 29415 - DNA, 201 bp, Homo sapiens
  misc_feature (1)...(201): n = A,T,C or G, or insertion/deletion polymorphism (see Tables 1-2)
ctcacatcaatctcattaaaaattgtcagcattggcacatgtattctgggcctccttcagacgctgagcaatgcactgccgcatcctgttcattttctccngatgttctgaatgcagacctttgccagctcctggctcagctagtggtgggacagcagtgggttttactgcagacacaggtttgctagaaggaggttgtga

SEQ ID NO: 29416 - DNA, 201 bp, Homo sapiens
cctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcactg

SEQ ID NO: 29417 - DNA, 201 bp, Homo sapiens
tcctgggtcgagtggggacttggaggacttgtctgtctagctagatgattgtaaacacaccaatcagcactctgtaaaaatgcactaatcagcactctctgtctagctaaaggattgtaaacacaccaatcagtgctctgtaaaaatgcaccaatcagtgctgtgtctagctaaaggattgtaaactcaccaatcagcact

SEQ ID NO: 29418 - DNA, 201 bp, Homo sapiens
gcctttttttgtttgtttgttttttaagtagagacagggtttcatcatgttggccaggctggtctcaaactcctgacctcaggtgatccacccaccttggygtcccaaagtgctgggattacaggtgtgagccaccacgcccagccaggaaggatattttaaaggatacagatgaagagatgtgcagggtaaggtatgagg

SEQ ID NO: 29419 - DNA, 201 bp, Homo sapiens; identical to SEQ ID NO: 7294

SEQ ID NO: 29420 - DNA, 201 bp, Homo sapiens; identical to SEQ ID NO: 7295

SEQ ID NO: 29421 - DNA, 201 bp, Homo sapiens; identical to SEQ ID NO: 7296

SEQ ID NO: 29422 - DNA, 201 bp, Homo sapiens; identical to SEQ ID NO: 7298

SEQ ID NO: 29423 - DNA, 201 bp, Homo sapiens
tcaaatatttcttgccattaaatgactttctacctttgtcttcctgctcagactacagtgtttgcccacttttggaagcttgcactctatacctagatgcytttttccttcttctaactggttccaaccttaacttgcacctaaaccttggtaacttccgtttctagagttggtcaatttgttgtgttttattcctatctt

SEQ ID NO: 29424 - DNA, 201 bp, Homo sapiens
tacttgtcatttttccttttttttttttttaagagacagggtttcactctgtcacccaagctggatgcaaccttgacctctggggctccatggattctctsgcctcagcttcctgagcagttaggacaataggtccatgtcaaccacacctagctgattttttaaatttttaaatgttttgttgagacaggatcttgctat

SEQ ID NO: 29425 - DNA, 201 bp, Homo sapiens
gtgctgggattacaggcatgaaccactgtgcccaacctaaatgaaaattttttttcttttctctttctgtagccaaagactaaatgaaagttttcaagcastgtgaggatagccatttgggatggtggattttttttttttttttttttttttttgagactgagtcttgctctgttgctcaggctggattgcagtagctcc

SEQ ID NO: 29426 - DNA, 201 bp, Homo sapiens; identical to SEQ ID NO: 7302

SEQ ID NO: 29427 - DNA, 201 bp, Homo sapiens
cgaaaagtggaagatgcagtgagcagagatcacaccactgcactgctacctgggcgacagagtgagtgagaccctgtctcaaaaaaaaaaaaaaaaaaaaaggtgtcatcataattttgttgcttatttccaggagaagagagatctacttgtgatgtttttgggatgtcaaaaagtgtcataataatcctcttacttcag

SEQ ID NO: 29428 - DNA, 201 bp, Homo sapiens
gaactaacgaatggctaaagttagaagtttagaatggaaataaggtctgactcttgaaatccttccagcatctttttctttagcaactctgttccacaggyagtgggagaaaaaaaaaaaaattaagggtaagaataaaagactgaaggagacagctagctaagaacagttcagaaaattagacaaatattttggccacat

SEQ ID NO: 29429 - DNA, 201 bp, Homo sapiens
gcctgtgatcccagctagttgagaagctgtggtgggaagatcatttaaggccaggaggtcgaggctacagtgagtcgtaattgcaccactgcactccagcytgagtgacaaaatgagactgtctcaaaaaaaaaaagcaaaattatgatattgatattcttatatgacactttgaaataagttttattgctttatgtcact

SEQ ID NO: 29430 - DNA, 201 bp, Homo sapiens
aggtaattttaatactgcttgctttgttcaaatgtaaagacactcattttcatttaatatttagaaatgatttttaaaccacaaactaatcaatttctacyttgatagcaagaagataatgtggttttatcaagatgagtttcaaagacatttctttttagagtgtgccactattggttacttctgaacctgacactgtgc

SEQ ID NO: 29431 - DNA, 201 bp, Homo sapiens
cctgtgtaacgcgactgtaaatcagagtagatttggtctgtgactgctggacaataagcaccagagaaactgtttcacttttttttttttttttttttttkagacggagtcttgctctgtcacccaggctggaatgcaatggtgcagtctaggctcactgcaacctccgccttccgggttcaagcgattctcctgcctcag

SEQ ID NO: 29432 - DNA, 201 bp, Homo sapiens
taggaaggatatctaatttttttactttttttttaattattatttttttcatacagagtctccctcttgttgcccaggctggagtgtaatggcgtaatctyggctcactgcaacctctgcctcctgggttcaattgattctcctccctcagcctcccacatagctgggattacaggcacctgccaccatgcctggcctttt

SEQ ID NO: 29433 - DNA, 201 bp, Homo sapiens
tgaattccagtaatttgctaaagcagctcacagaactcagggaaacacatttaccagtttattaggaaggatatctaatttttttactttttttttaattrttatttttttcatacagagtctccctcttgttgcccaggctggagtgtaatggcgtaatctcggctcactgcaacctctgcctcctgggttcaattgatt

SEQ ID NO: 29434 - DNA, 201 bp, Homo sapiens
ctagaactagaaatgccatttgacccagcaatcccattactgggtatatacccaaaggattataaatcatgctgctataaagacttctatgaccaaagatrtaggaggatttcccacccacaccaagcaacagacactagctgggtatcctccaacttagttctgacactacctacccagagatagcatcagatcccacag

SEQ ID NO: 29435 - DNA, 201 bp, Homo sapiens
gttggtgggactgtaaactagttcaaccattgtggaagacagtgtggcaatttctcaaggatctagaactagaaatgccatttgacccagcaatcccattrctgggtatatacccaaaggattataaatcatgctgctataaagacttctatgaccaaagatgtaggaggatttcccacccacaccaagcaacagacacta

SEQ ID NO: 29436 - DNA, 201 bp, Homo sapiens
aaagaggacacaaacaagtggaagaacattccatgctcatgggtaggaagaatcaatatcgtgaaaatggccatattgcccaaggtaatttatagattcartgccatccccttcaagctaccaatgactttcttcacagaattggaaaaaactactttaaagttcatatggaaccaaaaaagcccacattgcccagacaat

SEQ ID NO: 29437 - DNA, 201 bp, Homo sapiens
aaaatctccttaagcagataagcaacttcagcaaagtctctggatacaaaatcaatgtgcaaaaatcacaagcattcctatacaccaacaacacacatacagagagccaaatcatgagtgaactcccattcacaattgcttcaaagagaataaaatacctaggaatacaacttacaagggatgtgaaggacctcttcaagg

SEQ ID NO: 29438 - DNA, 201 bp, Homo sapiens
caaaatctccttaagcagataagcaacttcagcaaagtctctggatacaaaatcaatgtgcaaaaatcacaagcattcctatacaccaacaacacacatacagagagccaaatcatgagtgaactcccattcacaattgcttcaaagagaataaaatacctaggaatacaacttacaagggatgtgaaggacctcttcaag

SEQ ID NO: 29439 - DNA, 201 bp, Homo sapiens
tgttttaaagataacatgaacttttgctttataatatcttaaaatactaggtagctgctggtgctgttggattagcacaaagagctttggatgaagctacyaagtatgccctggaaaggaaaactttcggaaagctacttgtagaggtaattttaatactgcttgctttgttcaaatgtaaagacactcattttcatttaa

SEQ ID NO: 29440 - DNA, 201 bp, Homo sapiens
ccaaaatctccttaagcagataagcaacttcagcaaagtctctggatacaaaatcaatgtgcaaaaatcacaagcattcctatacaccaacaacacacatacagagagccaaatcatgagtgaactcccattcacaattgcttcaaagagaataaaatacctaggaatacaacttacaagggatgtgaaggacctcttcaa

SEQ ID NO: 29441 - DNA, 201 bp, Homo sapiens
aaccgcctcttcccgccccgccccatcccgcccacgggctccagtgggcgggaccagaggagtcccgcgttcggggagtatgtcaaggccgtgacccgtgyattattgtccgagtggccggaacgggagccaacatggcagcggggttcgggcgatgctgcagggtgagagggagcccagcggtgcggtggggctggaaca

SEQ ID NO: 29442 - DNA, 201 bp, Homo sapiens
cccaaaatctccttaagcagataagcaacttcagcaaagtctctggatacaaaatcaatgtgcaaaaatcacaagcattcctatacaccaacaacacacatacagagagccaaatcatgagtgaactcccattcacaattgcttcaaagagaataaaatacctaggaatacaacttacaagggatgtgaaggacctcttca

SEQ ID NO: 29443 - DNA, 201 bp, Homo sapiens
taattagaagagcctgggaacttggtttaatgaacacacacattccagagaactgtggtaagctttctttatatttttaatactggaatgcatatgagtamgaaaaattgtggaactctactcagtcatttttttcaaatatttcttgccattaaatgactttctacctttgtcttcctgctcagactacagtgtttgccc

SEQ ID NO: 29444 - DNA, 201 bp, Homo sapiens
cttgaatcaataaatgtaatccatcacatacagaaccaacgacaaaaacttatgattatctcaatagatgcagaaaaggccttcagcaaaattcaacagtkcttcatgctaaaaactcaataaactaggtattgatggaatgtatctcaaaataatagctatttatgacaaacccacagccaatatcatactgaatgggca

SEQ ID NO: 29445 - DNA, 201 bp, Homo sapiens
cagactgctattgaaggaaattctttgggggtaagtgacttagaaaattaactacctaactcagctcttgttaatgagatagttactcctgaagaagttgratttttagaagaaaaaaaaaggaaagtcagttactactaggtaaggttagtgggtacacacagttttctttaaagaggaacacaagattcagcagtgaag

SEQ ID NO: 29446 - DNA, 201 bp, Homo sapiens
  misc_feature (1)...(201): n = A,T,C or G, or insertion/deletion polymorphism (see Tables 1-2)
gagtcttcttggtgtgagcctatgatggagagcgtgagggcagacctgggctctccttctatgatgattacaacacgtgacctcagggaacctctgctctntcctcccattcacacacccagatcccctggcctgtgcttcctggtagaggtagaagaggcatcttgaagtcaatgacaatggagaatgaaggtgccattg

SEQ ID NO: 29447 - DNA, 201 bp, Homo sapiens
ccactgtactccagcctgcgcaacagagtgagatcttgtctaaaaaaaaaaagttatgtaaatgtcctctttgtctttcaaaatatcatatatatactgtrctgcgggtaactgaaaccacagaaagtgaaaccccatggaatgggggagggcctactgtgttattaagacatagacctcaaatactagctcttccatata

SEQ ID NO: 29448 - DNA, 201 bp, Homo sapiens
gaatttgtgccttatccaaagtcacaggtttatgtggtgatactcttcctctcctagagcctttaattataattattactattattatcatcaacagtttrgcttttctctgccatctgagaagatgaactaacgaatggctaaagttagaagtttagaatggaaataaggtctgactcttgaaatccttccagcatcttt

SEQ ID NO: 29449 - DNA, 201 bp, Homo sapiens
cttctattgcaaaggcatttgctggagatattgcaaatcagttagctactgatgctgtgcagatacttggaggcaatggatttaatacagaatatcctgtrgaaaaactaatgagggatgccaaaatctatcaggtaaggttaaagatgatttttttggtttgcaaggagagagaatattcataaatgacaacgtggattt

SEQ ID NO: 29450 - DNA, 201 bp, Homo sapiens
aaggattgaggaattataatagcctgggaaagaataagaagaaataactaaattcaacgtataatggtggaaaaagaacattagtagaaaacttgaccagrtttgagtaaggcttatagtttagttgttaatactataccagtgttaatgtcctgttctcgatcatggcactatggtttggtaatatgttaacattagagg

SEQ ID NO: 29451 - DNA, 201 bp, Homo sapiens
ttggccttctaaagtgcttcttcaaaatttttattttttctctagttaaaaaccatttactcaatttatttggtctcagaaaatagttaaaggcagctgcrataactcacagctaggtacaaatgacaatctcaaagctctccagagttattttttttattatttgttgtgttttttaaagatttttcccttttctttata

SEQ ID NO: 29452 - DNA, 201 bp, Homo sapiens
ttttctatgcatattactattaaagctaagactgtctagaatttctaaacaacaacaacaacaacaaaaatctaacttaaaatttactttttgcagtattrcaaaatgaatcctaaattattggcttaatcacctgtgttaaagaagtttcaatgcagaaactagacaaaacaactaacaaaatcatcatgtcctttatta

SEQ ID NO: 29453 - DNA, 201 bp, Homo sapiens
ataatgagatttttcattactgtgaatttcacatttcatgtatgctgatagattataagagcaatgttttttaggggcttgaacaagaaattagttccccrcctcagctaaatttcaagtcaatttgtctgttaacacatccctttcagatttcctctctcgctcatgcactacagtcatggaggattttattttttatct

SEQ ID NO: 29454 - DNA, 201 bp, Homo sapiens
cagctggtggggagcctgagaatggagaaatagtttcctgtggaaacatgaagaagccaggaaaccctcacaaggagagaacatgggccagggcggagggkaggctggtgcccacggccccggccctggaccgtgggagcagtcagggaagggagtggagtgagaggacagcaggtgggttgaaggctggtgaacttgctt

SEQ ID NO: 29455 - DNA, 201 bp, Homo sapiens
atcttgcaatgcagctatcagcaatgatgagcagagacacactgtcattgctgggctaggatcaggtgtcacggaattacgtattcgggtttccctcatgkctgagatgatattgagggaggcatcctatcatttattaccaaaaaatgactaataaactggtaacgagctcaatatgttgctacataaatgtacaaaaat

SEQ ID NO: 29456 - DNA, 201 bp, Homo sapiens
tttggttctgaagattccagaaactaacaactcagtctgtgatagaaattgcagcaggtgtgacctttaatccttgtctttggcagggagacaaaggattrcctggttcttctggagagaaagggaatcctggaagaagggtaggtgtatttccacggtggtgctattatggaaagaatatcaacatttcatttagggaat

SEQ ID NO: 29457 - DNA, 201 bp, Homo sapiens
taacgagctcaatatgttgctacataaatgtacaaaaatattttatggtggaagcaggcaagaacttgcttagaaagtccttctctagcttgaaagctgayaaatacatatctttagacgtttttaaaaaacatttacttaacttgtaattaatcaacaatttaagatggtatagatgcaaagctattcaaatagttatcc

SEQ ID NO: 29458 - DNA, 201 bp, Homo sapiens
gatttctttattgacgatttcagacctgagcctggggaagagggttgttgggaaagggggatgaaaggaagaattctacttttgaaattgctttaaaacaygttgataaaatatgtgctttgtctttttcttgcagtttgggggtttggggagatgtgttggttctcttgctaaccagataatcatttgcaagtcctgtta

SEQ ID NO: 29459 - DNA, 201 bp, Homo sapiens
agggattccagcctcccactccccatcctgtgccctcaatcctgtcttgcggtagggatgggaagctctcattctctctggaatgtcagtgggggcacagytcacctcacctgaaaattgagttgtcttaaactaaagggaaaagtttccgtgttgaaataaggttttagctcctatttagggagtgagagagacagaaag

SEQ ID NO: 29460 - DNA, 201 bp, Homo sapiens
tggtatagatgcaaagctattcaaatagttatccagtagctccagaaacatttattaatttgcactttttcaccatctcttttatgttatttgtgggttgsgtagactgtaccacattttaagagttaatttcatccatcagtttattcattcacctaacaggctttaacatgcccatatgtaccaggtgctcactgtgag

SEQ ID NO: 29461 - DNA, 201 bp, Homo sapiens
cacctggatgatgtattttaagaggtgttggttagggattccagcctcccactccccatcctgtgccctcaatcctgtcttgcggtagggatgggaagctstcattctctctggaatgtcagtgggggcacagttcacctcacctgaaaattgagttgtcttaaactaaagggaaaagtttccgtgttgaaataaggtttt

SEQ ID NO: 29462 - DNA, 201 bp, Homo sapiens
ccccgctgctgctgctgcaaaaccagtggcgaccaagcctgaggtccctaggccacaggcagccaaaccagctgccaccaagccagccaccactaagcccrtgggtaagaaagcccttgctagggctgccatcttgtgacatcctcatttcctgctccagggtgtgttcctcaaagcctgcatgtaacacactcagaatac

SEQ ID NO: 29463 - DNA, 201 bp, Homo sapiens
gtccttgctgccaggaggctccaaggacaacttctgatgtgttgtgttttaaaagaattatttctttaaaaattgtctttgtatttgagtgagtgttttcktttgatgactcagcagacatttctttctttcaaggtcaatttattttagatgaatttaaattagaaccaagtattaaataatctatttttcctttatagg

SEQ ID NO: 29464 - DNA, 201 bp, Homo sapiens
cctttcttctctttgcttcttttctagcttgctgttacggtaagttgattttggtgactttctcctaaggaaaggaagcctcccttttgtagtaagtacartttgtctttaaccctccaccctctactttccacagggcccctggagtgccccgtcttcccaacagaactagcctttgctttagacacctctgagggagtc

SEQ ID NO: 29465 - DNA, 201 bp, Homo sapiens
ggttgcttgtccctaaacttgaatttaagagacattttagctcccttaaagtgagagatttttcgtggtgatggagtcccttgggttagatcacttttacygtaccttccaactataggagccttaaattctccactttctgacacagttgaacaatgtttgttctgctccctctagggaaattcgggacctccagggata

SEQ ID NO: 29466 - DNA, 201 bp, Homo sapiens
tttttctttcatcctccttgggctgttctggctcccgaggctctgtcagccgtctccttaaacagcctcttctgcagagtctagagaaaatggtgcccagyggggacttggggtccaagtgcaggaaacatgactgaggcagtagtgtcccgggcgggcgcctcttccagaacgtgctcacctatctggccatcagcaacc

SEQ ID NO: 29467 - DNA, 201 bp, Homo sapiens
cactttctgacacagttgaacaatgtttgttctgctccctctagggaaattcgggacctccagggatagttggacagaagggagaccctggctacccaggmccagctgtaagtatttatccagttctgacccggccacctggggctgggtgctttacacgtggtccctgaaaacttcccaccatctgctttgctcacaaga

SEQ ID NO: 29468 - DNA, 201 bp, Homo sapiens
aaggtttgtctttagaaaggtagagctttcctgaggacagggaccagccaggcacacatgcccctctccctctttggtcagtctgtctgtccctcctcttyagtactactggttcccactccagcctcccctgttgatcgcggcttggccagtggaatcattgtcccccaacaatccccaccataattcccaccaccatcc

SEQ ID NO: 29469 - DNA, 201 bp, Homo sapiens; identical to SEQ ID NO: 7320

SEQ ID NO: 29470 - DNA, 201 bp, Homo sapiens
ccagatgcaggaaggcatttttcatctaggatccttgaatctttaagatttctgtttcccaaaacgaattaaaagcatgggttctaattaactctattaaraatttgatttcagagttttagaaaagtgggaaatgcttcatgcattgcaagctggaaaggactcaggtgggtctccctctccttgacccagagagcttgg

SEQ ID NO: 29471 - DNA, 201 bp, Homo sapiens
aaaagttccaaaataaaaggggtccctatattggtgtattagtttcccattgctgttataacaaagtaacacaaatttagtggccaaaaacaaaacaggcygggtgcggtggctcacacctgtaatcccagcactctgggaggccaaggcgggcccattgcctgaggtcaggagttggagaccagcctgaccaacatggtg

SEQ ID NO: 29472 - DNA, 201 bp, Homo sapiens
ttgctgtgactgcagatgttatcttgcaatgcagctatcagcaatgatgagcagagacacactgtcattgctgggctaggatcaggtgtcacggaattacrtattcgggtttccctcatgtctgagatgatattgagggaggcatcctatcatttattaccaaaaaatgactaataaactggtaacgagctcaatatgttg

SEQ ID NO: 29473 - DNA, 201 bp, Homo sapiens
aataggaagtcatgtgcatgttctatgaagactgacgggaggggtgggagtgggcaggactgtggcacccatgccgatgctgctgcctggcccatgtgccrtgtttcatgccctgctccatctcgggtgccaaccctaggagcaaagagggcagtgggggcatgtaacagagggctagctggggtgatgtggctgcaagaa

SEQ ID NO: 29474 - DNA, 201 bp, Homo sapiens
aaactgatcattccctttgccctgttttctcttttaggttcatatttggtgcttagacaaattcaaaatgaggaaacatcggcacttgcccttagtggccrtcttttgcctctttctctcaggctttcctacaactcatgcccagcagcagcaagcaggtaagagccagaaacgtccttgattttgtaaaaaggaatatca

SEQ ID NO: 29475 - DNA, 201 bp, Homo sapiens
tgtgtcatgctttggagggaagtgcagattctgcagattctgaacttcgtacacagatgagatgtgaacgcaaatgatccttgaaaaatgactatctggcytacgactagctgactctcaagatggggaaagagagcccatctcttcctactgcagacccttctgtctatcaccacttaagtccttcagctctttcttttg

SEQ ID NO: 29476 - DNA, 201 bp, Homo sapiens; identical to SEQ ID NO: 7332
  misc_feature (1)...(201): n = A,T,C or G, or insertion/deletion polymorphism (see Tables 1-2)

SEQ ID NO: 29477 - DNA, 201 bp, Homo sapiens
taagttgtttccatcttttggatattacaaataatgctgaaatgaacatgggtgtgcacatatatctttgagatcctgttttcacttcttttggatatacycaaaagtgggatagatgaattatatgataattctgttttcagttttttgaggaacattcatacgatggaggctagcctttccccactgtgtagctttgtt

SEQ ID NO: 29478 - DNA, 201 bp, Homo sapiens; identical to SEQ ID NO: 7335

SEQ ID NO: 29479 - DNA, 201 bp, Homo sapiens
acgtagcctaagattagcagcagagtccccgtgaaggaagtctccgtggggaaccagagtgacccttgccaagtggggcttctcagcagaatctgtgcctsttagatatttacggaaggtgcttgttaagccaaaggcttgtagaggtgggagtgtactgaagtccggtgcatcctgcaaagtgtgcaactgtcctgcaga

SEQ ID NO: 29480 - DNA, 201 bp, Homo sapiens; identical to SEQ ID NO: 7395

SEQ ID NO: 29481 - DNA, 201 bp, Homo sapiens; identical to SEQ ID NO: 7336

SEQ ID NO: 29482 - DNA, 201 bp, Homo sapiens
ctggccgaggaggtcacatctcagttcttatcgcttgtcagatccctgtgttcttctgtttctactggtgatttctgtccagtctcctcctcatcaccaggatgtagctttcctttcctgagttgtccatctacttctaaacagccccagtctgagctgtttagggcacagtgtcctcagcttttaatccctctcttctct

SEQ ID NO: 29483 - DNA, 201 bp, Homo sapiens; identical to SEQ ID NO: 7337

SEQ ID NO: 29484 - DNA, 201 bp, Homo sapiens
gttacaccagtaggcaactgtgttattgtattaaggacgttggtgcataacatgttacccttctcttagaacatagaccttgtcttgatgctacaggtgakcacccagatgaggcactgctgtcttcatttggcatgtatcagcgattctcaccccaggcatcacgctcccagcttctggtccaaacaactagaaatgaac

SEQ ID NO: 29485 - DNA, 201 bp, Homo sapiens
ccagagcctctcctttgattactgggcccattggccgttggcttgggatggtaactccgacatctgggttccgtttcctcccattaacccacttgtgactygcagcaactcaattgaaacctcccatcgataaaatgctagtggttgtgcaggtgctgccatctcatgtctctcctcccatcccaagttttttcttgaata

SEQ ID NO: 29486 - DNA, 201 bp, Homo sapiens
tttttatcttcacgctctgatctatctttcagttaagatgtcccgtgaagtccaggtgtttgagataacagagaacagcgccaaactccactgggagaggsctgagccccccggtccttatttttatgacctcaccgtcacctcagcccatgatcagtccctggttctgaagcagaacctcacggtcacggaccgcgtcat

SEQ ID NO: 29487 - DNA, 201 bp, Homo sapiens
ttacaccagtaggcaactgtgttattgtattaaggacgttggtgcataacatgttacccttctcttagaacatagaccttgtcttgatgctacaggtgagyacccagatgaggcactgctgtcttcatttggcatgtatcagcgattctcaccccaggcatcacgctcccagcttctggtccaaacaactagaaatgaact

SEQ ID NO: 29488 - DNA, 201 bp, Homo sapiens
aaatatagtagtaacccactggaaaagtgaatcaaaactaaccacttggctgcccgggaaaagtgtgacccacacgtctcctggatgtcttaccccacggrccctcagtgagatcttctgttccaaagcttactgtgccacttctcggctttcttcccagggtaacccaggtgaacctgggctaaatggaacaacaggacc

SEQ ID NO: 29489 - DNA, 201 bp, Homo sapiens
tgattttccctggtaggtttggtagtggacaattcatgctactacttttccctccaaatttagtggaaatttctagaatatgtacccaagattgtcccctsagaaaagtgaatatgatgtttggaaatttaactatgaggatggcacaaatgaaaaattgctataaatgtcccttttttacaccatgatttctaagaggtt

SEQ ID NO: 29490 - DNA, 201 bp, Homo sapiens
gtccaccccccgacccctccactgcaaaacaaaaacaaaaacaaaaacaaaaatccttattatctgacagttttgaaggctggaaattggaaaccagtgtygctaagctaaaatcaaggtgtcaacaggctgtgttctttctgcaggttctaagggattcttcatctgctcaccttttccagcctccaggggctgcctgca

SEQ ID NO: 29491 - DNA, 201 bp, Homo sapiens
atagtagtaacccactggaaaagtgaatcaaaactaaccacttggctgcccgggaaaagtgtgacccacacgtctcctggatgtcttaccccacggaccckcagtgagatcttctgttccaaagcttactgtgccacttctcggctttcttcccagggtaacccaggtgaacctgggctaaatggaacaacaggacccaaa

SEQ ID NO: 29492 - DNA, 201 bp, Homo sapiens
cgtctcctggatgtcttaccccacggaccctcagtgagatcttctgttccaaagcttactgtgccacttctcggctttcttcccagggtaacccaggtgarcctgggctaaatggaacaacaggacccaaaggcatcagaggccgaagggtaagtttgcgtgggccttggctgcaggtgaggaatgagaacgtatgtctca

SEQ ID NO: 29493 - DNA, 201 bp, Homo sapiens
aagatattcccaatactgccctattgggaagttaatctattttattgatgtagctttgatttactcctctgccatattttcagatattactgatcatgtaygcccctaccaaaattgttcttttgtttaaaccagatcaataacacagcagtggggcatgcgcttgtcctgcctgcagggagagacctcacagacttcctg

SEQ ID NO: 29494 - DNA, 201 bp, Homo sapiens
ttggcatcacactgtaagccagccccaggccacagggtctcagccatgtttctcatgtctagggtgagcccggagagccaggaccaaaaggaggaatcggsaaccggggccctcgtggggagacggtaaggtcacagcgcgcttggggtcaggctgtcgctgactctttgctggaaggtgcaggaagccaggagagggttc

SEQ ID NO: 29495 - DNA, 201 bp, Homo sapiens; identical to SEQ ID NO: 7308

SEQ ID NO: 29496 - DNA, 201 bp, Homo sapiens; identical to SEQ ID NO: 7310

SEQ ID NO: 29497 - DNA, 201 bp, Homo sapiens
tggtgaggtgtgcatctgatcaaactcctctatttggtgttgggatctgtttcctttaaggaaagctccctgttggagagtgcgtgaactgagacgggagygagggcatctgtttttgtgtccagtggactagcagagagcttctctcttctactttacggagttaatttaagagtgttggtagaatcggaattacaagaa

SEQ ID NO: 29498 - DNA, 201 bp, Homo sapiens; identical to SEQ ID NO: 7312

SEQ ID NO: 29499 - DNA, 201 bp, Homo sapiens
gttcccaggtaagtgagtctaccttcctgtattatcagtgaggtgtgaagtgtttagtagcagtatagtgtaaaccaaatttgtttaggaaggctttgcaytgataggaagtaattgcttacatagtagaaaaatctaaaccaatgtctttttttaaagatgtcaaaaatggtgcggctgctgatataatatttctagtgg

SEQ ID NO: 29500 - DNA, 201 bp, Homo sapiens
tggacaaggcttgacatggtcccagctgctgtggttgggttgcatttggtgtaatttgggcaaagcccgttctctccataaactgaaactttcctctgagsttcttttaaacatgacttacaaacttaagctgggtgtcaaaacctgatgccttgtgcctatgagtgcttttactcctgacccatttccattctgctcttt

SEQ ID NO: 29501 - DNA, 201 bp, Homo sapiens
gagaatcagaatatcttggcattagtcttgggtcagccactcagttaactgggctaccctgagaaagacccttccttccctaaaatactctctcatctgtyaagtggaggtcataatacgtacttgtcctggtgtttatgagatttaaataaaatatgctgcaatcaaagtactctgtaagctgtgaaatgctataaccta

SEQ ID NO: 29502 - DNA, 201 bp, Homo sapiens
taaaagaattatttctttaaaaattgtctttgtatttgagtgagtgttttcgtttgatgactcagcagacatttctttctttcaaggtcaatttattttasatgaatttaaattagaaccaagtattaaataatctatttttcctttatagggagaaagaggattccctggatacccaggaccaaaggtaaataatccctg

SEQ ID NO: 29503 - DNA, 201 bp, Homo sapiens
cacatctctttcccactcttagggagatgacgggagagacggagttggcagtgaaggacgcagaggcaaaaaagtacgtatctgctgaggattatccaagygtccttgctgccaggaggctccaaggacaacttctgatgtgttgtgttttaaaagaattatttctttaaaaattgtctttgtatttgagtgagtgttttc

SEQ ID NO: 29504 - DNA, 201 bp, Homo sapiens
atgttctctgtaaaagaaatgagttcctgtgaatccacgatggtctctgcctggagagtgttttggggttttatgctgggctcaatgcccaccgccttccrtgccttcttctcccagttgttactctctcttctcatcagcccgtcccccatgccacgctggtgaaaaggacaaacaaaaccctcctggattcttttccag

SEQ ID NO: 29505 - DNA, 201 bp, Homo sapiens
aaggaatttgtaggtagaaacactctgaaatgaaaaggttcctagtcctgggcacctaaggcaggggaagaggagaggaccagtgttaccattggttttcrtttgcatatgttaatgtttgcccattttgacagtcacattgaatagatgcttgtttatcaggaatgtgagtcaggcatgtaatgcgagggcagtctggtt

SEQ ID NO: 29506 - DNA, 201 bp, Homo sapiens
aaattggcccaaatcctccagatgagctaatagagagactagaattttgaaaataatgttctgaatgcaaatggacattgagaagcaatggaaacagtgtrcaggactacatgcccggtgcctggagctgctcatgctcattccatcatggtgccgttttgtgactctggcaattaagaaaacaatcaagtgaaaatttat

SEQ ID NO: 29507 - DNA, 201 bp, Homo sapiens
tgagattattaaacatcaccgtattaactacttataatccagtcttcctaaaaatgggcttgaggggctcattacagttctgagaaagttactccaggacyatggcattgagctctaaaagtcagtgttagaagtgtgctcatagacagagtatctttccaaaagcaaagatggagtgagggtgtctcctcaaagtcattt

SEQ ID NO: 29508 - DNA, 201 bp, Homo sapiens
ttaagcgtgtgaggaacggattcctaatgaggaaagtggctgttttcttcagcaacacacccacaagagcatccccacagctcagagaggctgtgctcaarctctcagatgcggggatcacccccttgttccttacaaggcaggaagaccggcagctcatcaacgctttgcaggtctgtgctctgtgcgtgctgttggcat

SEQ ID NO: 29509 - DNA, 201 bp, Homo sapiens; identical to SEQ ID NO: 7325

SEQ ID NO: 29510 - DNA, 201 bp, Homo sapiens
ctcttagggagatgacgggagagacggagttggcagtgaaggacgcagaggcaaaaaagtacgtatctgctgaggattatccaagcgtccttgctgccagsaggctccaaggacaacttctgatgtgttgtgttttaaaagaattatttctttaaaaattgtctttgtatttgagtgagtgttttcgtttgatgactcagc

SEQ ID NO: 29511 - DNA, 201 bp, Homo sapiens
cagacatttctttctttcaaggtcaatttattttagatgaatttaaattagaaccaagtattaaataatctatttttcctttatagggagaaagaggattycctggatacccaggaccaaaggtaaataatccctggtcggtgaagcatcatcatgattttgggatggctctggtatgtccatggactgagaatcagaata

SEQ ID NO: 29512 - DNA, 201 bp, Homo sapiens
tcacggtcacggaccgcgtcattggaggcctgctcgctgggcagacataccatgtggctgtggtctgctacctgaggtctcaggtcagagccacctaccayggaagtttcagtacaagtaagtacatgatcagtacaagtcggtacctgatttctatgtagagtatcaaataggacacaaaggagacacttacttattgaa

SEQ ID NO: 29513 - DNA, 201 bp, Homo sapiens
gcaacaagggcggtcctggccagccgggctttgagggagagcaggggaccagaggtgcacaggtgagtgcttccgtgtgtgactgtgtgccctctgatatytcacaaatcatttaaaaaatgattgggtggcatttatatccggaaagttaaccattttaaagtgaacaatccagtggcatttggtacttccacaatgctg

SEQ ID NO: 29514 - DNA, 201 bp, Homo sapiens
tcaaatatactcctccattttaagtgcaatatcaaagtcttgtgaacatgggtaatcattcctcaacttgggccctcagtttccttaagtgtaaaatgaarggcttgagacagcgagtctctcagttttctatcagcagtctgcaacactcctttttagttttcctgggatttgacagctctcttatctgcaggtggtcat

SEQ ID NO: 29515 - DNA, 201 bp, Homo sapiens
cgctggcaatttctatcatatcgtcagtcgtccagcaaatgtcacctggagggacttcatctcacaccgtgaaacccccacacatccgattttgacccttraagcgcatttatgattttctgctgggcatttcttgagatctgaacatttggtttctcttcctttcggtaggacaacattgccgagaaagcttgctgtggg

SEQ ID NO: 29516 - DNA, 201 bp, Homo sapiens
tttctaactggggctgcagaaaacccatcattcatcagagcccagggcaacagatggaagagagcagtcgcaggactatggcctgttcgagcaacaggcarggagccttcttttacacaaaagggaggctgggagagattggccgaccattgctgacagaggcagtaaggaagtagaatttcccaggttactgcaataaat

SEQ ID NO: 29517 - DNA, 201 bp, Homo sapiens
ctcatgtttttattaaagatatatgcaagttgccgaaagacgaaggaacttgcagggatttcatattaaaatggtactatgatccaaacaccaaaagctgygcaagattctggtatggaggttgtggtggaaacgaaaacaaatttggatcacagaaagaatgtgaaaaggtttgcgctcctggtaagtgattcttccttg

SEQ ID NO: 29518 - DNA, 201 bp, Homo sapiens
ggcatctaaaagaattatgctccagccacttttctgtcacacatctgctgcctgtaaatggcagtgagcagcagtggatctttcattcgttaccgtggccycctgaaagcatgggtgtgctgggcctttctgccacctgctttgtcgctgctgattttgacagtgctacgtagttgctaattttggtttcaggcttttgtt

SEQ ID NO: 29519 - DNA, 201 bp, Homo sapiens
ttccaggaaactggtttttcacttctggaatcttcattagttgattcagcagcccagggccggtacccagagttagcgccaactcagctaaacccacagcyggcccggcggtgcaccagggtgctctgtttctaactggggctgcagaaaacccatcattcatcagagcccagggcaacagatggaagagagcagtcgcag

SEQ ID NO: 29520 - DNA, 201 bp, Homo sapiens; identical to SEQ ID NO: 7339

SEQ ID NO: 29521 - DNA, 201 bp, Homo sapiens
attcttggggaatattaaaaaaatgactaagacatagccccctctcttctggttggcaaacatataatttctgtttggctaattgaaatatcaaaaaaackactaccttggtggatggtttctccacgccctttatgcttcagatgaagaaagagagctcagagaggtatgcccagtgacagggccacagagctagtagca

SEQ ID NO: 29522 - DNA, 201 bp, Homo sapiens
agatcgtgctgtctccagcgtttatcctggctgcagagtcgcttcccaagattggagatcttcatccacagatagtgaatctcttaaaatcagtgcacaayggagcaccagcaccaggtatggtagagaaatgctagttgctctgccactcagttctctaatgcatgagttgagggtaggctgctggccactggtccttag

SEQ ID NO: 29523 - DNA, 201 bp, Homo sapiens; identical to SEQ ID NO: 7342

SEQ ID NO: 29524 - DNA, 201 bp, Homo sapiens
aatgactgtagagcaaagagctgacattgacaggaaccatcctgactcctccctgcatcttctcttatttcaaagggcaacaagggcggtcctggccagcygggctttgagggagagcaggggaccagaggtgcacaggtgagtgcttccgtgtgtgactgtgtgccctctgatatttcacaaatcatttaaaaaatgatt

SEQ ID NO: 29525 - DNA, 201 bp, Homo sapiens
cctttggttggtctttgtgttctcatgtttacttaagtttaacaagacctattgtgcatcatggccttgagccctgaggttcagggaggggatatatcccyaatgctaaatgacgagttgatgggtccagcacaccaacatggcacatgtatacatatgtaacaaacctgcatgttgtgcacatgtaccctaaaacttaaa

SEQ ID NO: 29526 - DNA, 201 bp, Homo sapiens
gctggggtgaggggctttcaaaaggagcgactcaccaaaatcaaattgatggactatgggcatcattttgctttgaaaattcagaagaaaatagaaatttkgaaaatatcattttaaaatgtttgagcactatttatttatttatttttaataaattgtaaagacctggatcaactgcttggaagtgagcattatttttga

SEQ ID NO: 29527 - DNA, 201 bp, Homo sapiens
cctgtttggggctaagagtgctttgctgatcccgtgattgggtttcgtaagacctgcatggatgttacctggatgggttgtggccgaagggcttgtccctygaagccttgcatgcaggtccttgctaatatttccctgaccatccagtccagtggcagctgctttccttccatatgtggctcatttccctttcccatgttg

SEQ ID NO: 29528 - DNA, 201 bp, Homo sapiens
acgctggtgaaaaggacaaacaaaaccctcctggattcttttccaggagtttgcacatgaatgttgcaatttagaaaatcattccaccgaaatctcaaagrtgaagtcagcatgttgcagcacccttacctagagcaaaagcatggcttggcatcacactgtaagccagccccaggccacagggtctcagccatgtttctc

SEQ ID NO: 29529 - DNA, 201 bp, Homo sapiens
ttttttctgtgcttcactgcagttcactcaaacaaaagggatatcatctttcttttggatggatcagccaacgttggaaaaaccaatttcccttatgtgcrcgactttgtaatgaacctagttaacagccttgatattggaaatgacaatattcgtgttggtttagtgcaatttagtgacactcctgtaacggagttctct

SEQ ID NO: 29530 - DNA, 201 bp, Homo sapiens
tacattgctcctaagcaaaactatattgaaaactgagtgggtggccgttgatgacattactgggacttctgaggtttttgttgggctaaagataatggaakagatttttggtcagaagccactgatgcagtagtttcctggttttcaaaatgagcaaccaggggctctgagatgcggaattccttgcccaggccagggagc

SEQ ID NO: 29531 - DNA, 201 bp, Homo sapiens
gctggtcctccagggctgataggagaacaaggcatttctggacctcgggtaagcctgtcctaataccagccccctctctagctgaacagagggcacatttycaagcaggctgagagagtttctcggatgatgctattgtagacagacctccctttagctctcctctttggcaacaaaaaccccagatttaacctcaggcct

SEQ ID NO: 29532 - DNA, 201 bp, Homo sapiens
catgacctcctccccagtcctcttctatctcggcagctaccatggggtgctcaggtcagtgtgctctgagctgtgacccttggtgaccaaccctgggatcygccaggcacccaacaccagcctcttgcaggaacttgcggagcagagagctgtgggcccagctcccatagcggtgggctgagtgctccacttcccaaggga

SEQ ID NO: 29533 - DNA, 201 bp, Homo sapiens; identical to SEQ ID NO: 7352

SEQ ID NO: 29534 - DNA, 201 bp, Homo sapiens
tgctggtcctccagggctgataggagaacaaggcatttctggacctcgggtaagcctgtcctaataccagccccctctctagctgaacagagggcacattktcaagcaggctgagagagtttctcggatgatgctattgtagacagacctccctttagctctcctctttggcaacaaaaaccccagatttaacctcaggcc

SEQ ID NO: 29535 - DNA, 201 bp, Homo sapiens
atcagcaacccgcaacttcccggtgtctcggtcctctgctttaggtctaaatgatccctgtttcacaaagctgtccgaggagaggtgaggcaagagtgagraacaattgtagaagtgcagggagacagctggctcctgtgctcagtgtctcacctggggttaccgctttgatcatctgttacctctggaagagctgagttt

SEQ ID NO: 29536 - DNA, 201 bp, Homo sapiens; identical to SEQ ID NO: 7359

SEQ ID NO: 29537 - DNA, 201 bp, Homo sapiens
ttgcaggtctgtgctctgtgcgtgctgttggcatctccctttcttctggggctctgagaaggttctcagacacgtccatgctcctttgtggcttcatgtcvcatagctcctaaaacgtccccaatgaggccatctgcctgagaacttctcttgtgaggtctccaggacaacctcgtggctccagcactacagggacgccta

SEQ ID NO: 29538 - DNA, 201 bp, Homo sapiens; identical to SEQ ID NO: 7360

SEQ ID NO: 29539 - DNA, 201 bp, Homo sapiens
acactcacaggggttgacctgggggcgttacacgccagcattttgaggctgccctgcacacactgttgctagaaaagtaaagcagagaagaagagggatgygggccactgaggtggagtgctgtcagcacacctggaagcagccagcacagctgcaggggagcacagaggcgggccgaggagcaaggtataaacagcatca

SEQ ID NO: 29540 - DNA, 201 bp, Homo sapiens
tcggcatctaaaagaattatgctccagccacttttctgtcacacatctgctgcctgtaaatggcagtgagcagcagtggatctttcattcgttaccgtggsctcctgaaagcatgggtgtgctgggcctttctgccacctgctttgtcgctgctgattttgacagtgctacgtagttgctaattttggtttcaggcttttg

SEQ ID NO: 29541 - DNA, 201 bp, Homo sapiens
attccattaatatacctagggcatcgttagcaaccactcaggattccagctttacaatattacatgatttgattttcagtggttaatatttgtattttttwaaataaaaccaaatgaacccccacaaaaacatctcactccactttttgctttgctcggcatctaaaagaattatgctccagccacttttctgtcacacat

SEQ ID NO: 29542 - DNA, 201 bp, Homo sapiens
ctgccaccaagccagccaccactaagcccatgggtaagaaagcccttgctagggctgccatcttgtgacatcctcatttcctgctccagggtgtgttcctyaaagcctgcatgtaacacactcagaatacagtccttgatctgggcttgtacacctggatgatgtattttaagaggtgttggttagggattccagcctccc

SEQ ID NO: 29543 - DNA, 201 bp, Homo sapiens
ggttacaatgtggtctcattttcatcttgccccattgtgatcacagagtagccttgtctgttgtgggggtcctgtgagatcatgtgtgctcaacaggagarccccaaggccatgtgtgctggaccagctccccaatgcgggggctgattctctctttcttaaacagctccatcacaagagctgctcagcttccactatgct

SEQ ID NO: 29544 - DNA, 201 bp, Homo sapiens
acggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccctt

SEQ ID NO: 29545 - DNA, 201 bp, Homo sapiens
gacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccct

SEQ ID NO: 29546 - DNA, 201 bp, Homo sapiens
agacggccactgttagacccccagtggcggtgaagccagcaacggcagcgaagcctgtagcagcaaagccagcagctgtaagaccccccgctgctgctgctgcaaaaccagtggcgaccaagcctgaggtccctaggccacaggcagccaaaccagctgccaccaagccagccaccactaagcccatgggtaagaaagccc

SEQ ID NO: 29547 - DNA, 201 bp, Homo sapiens
ttcattaattatttgctcattcattcattcaaactagctatttgttaaatgaataattactaatcgtgtgccaggtacggcgatagacaggactctttgcmcccactgggagtgattttgttacttgctttaaccacacctgagagggtggggaagggatggagctcccatattgttgctaaaaataacgataagattaag

SEQ ID NO: 29548 - DNA, 201 bp, Homo sapiens
catgtgtgcacgtgttgtaggcacacatgataaaactctccgtggttgtgtatgtctcacttttttttctgtgcttcactgcagttcactcaaacaaaagrgatatcatctttcttttggatggatcagccaacgttggaaaaaccaatttcccttatgtgcgcgactttgtaatgaacctagttaacagccttgatattg

SEQ ID NO: 29549 - DNA, 201 bp, Homo sapiens
tcctggacagcagcagaagaggctgtctgggaagtgagaggatttgttcagaagttcagggatcccctcccgtcgcttattagctcatggatccaacttgyagcccacagcataagtcgtggatgtagaggtgtcttggatctgtgtctttcaatcaccactccccaacataagacattaatcacagcaggcaaccttata

SEQ ID NO: 29550 - DNA, 201 bp, Homo sapiens
ccccacccatttaaagtaatgtgcacgccacttagcgtccctgcgtctcagatttttcacctgtaaattgagactggggcaggatgattgctaatgtcttyccttccacattggatattctatgcttttaccacagcctgtgtcggcgaaagacattgggtcatcactgccattcctcagggcttgttctgccgaacacag

SEQ ID NO: 29551 - DNA, 201 bp, Homo sapiens
ggagtgcaatggcgtgatctcggctcactgcaacctccaccttccagttttaagtgattctcctgcttcagcctcctgagtagctgggattacaggcactygccaccatgcctggctaatttttgtatttttctttcttttttttttttttagtagagacgggggtttcaccatattggtcagactggtctcgaactcctg

SEQ ID NO: 29552 - DNA, 201 bp, Homo sapiens
tgcacatgtgtgtgcttcagatattttacttaaccgagtgtgtgttgtgtttggccgggatcacttggagaacctgggactcccttccattataattaatrtatttcatgacttctcagtacagttgggaaggtggaagaaaaatagacaggttgacattcccttttcacattcctcatttgaaactggctgggatcgtgc

SEQ ID NO: 29553 - DNA, 201 bp, Homo sapiens
gcagtgagccaagatcatgccattgcactccagcctgggcaactagagtgaaactccatctcaaaaaaaaaaaaaaaaattctttgtagctatcttatttragaatagaatgggaggcagctctgtctgatgcagttcccagcttgacttttccctttggcttagcgattttggggttctgagatttatttttctttcatc

SEQ ID NO: 29554 - DNA, 201 bp, Homo sapiens
ctggaagagatcgctttcgactcctccctggtgttcatcccagctgagttccgagccgccccattgcaaggcatgctgcctggcttgctggcacctctcasgaccctctctggaacccctgaaggtatggtggtgatggcttcagacacacaatggggtggtctccaggcagggcctttaagaacaaaacaaaatgaagtg

SEQ ID NO: 29555 - DNA, 201 bp, Homo sapiens; identical to SEQ ID NO: 7317

SEQ ID NO: 29556 - DNA, 201 bp, Homo sapiens; identical to SEQ ID NO: 7318

SEQ ID NO: 29557 - DNA, 201 bp, Homo sapiens
ccaaaggcttgtagaggtgggagtgtactgaagtccggtgcatcctgcaaagtgtgcaactgtcctgcagacgggctcttcctctgtgaatcgaccccttkccctgcaatgtcttgtgcagcatttcagagctagacattcttctctgcagatgagaatctcatgctaattttccccacaccagggtgtcccagggagaga

SEQ ID NO: 29558 - DNA, 201 bp, Homo sapiens
gccccatggtaaggtgctgcacattcctagactctccctgtactgagggcaagagaaaggacacacttctcggctcatcagcagccacagaggccaaagaygtggcctttaacactgcaacgtagcctaagattagcagcagagtccccgtgaaggaagtctccgtggggaaccagagtgacccttgccaagtggggcttc

SEQ ID NO: 29559 - DNA, 201 bp, Homo sapiens
tgttgcttgtatacattttaagctcacttgcctattcacgatctggattgaggcagctgctactgcagctaagacaggataattgtgggttttggtggccrtttttggccagcagaagtgaggttccaggccctgtgggatgggcagatgccatgcagaggcttctcatggaaagtcacctcattagcactcacgatggtc

SEQ ID NO: 29560 - DNA, 201 bp, Homo sapiens
ggatatgcctttgtctcccatgagcagagggatgactttcagttctgtctgtcctttgtccacaaggaatttccctgtgggcagaatgtgagggaggtatkcagcttaaaaaaaaaaaaatctggccaggacggtggctgatgcctgtaatcccagcactctgggaggctgagacaggcggatcacctgaggttgggagtt

SEQ ID NO: 29561 - DNA, 201 bp, Homo sapiens
ctaccctcccagatctcattcccttcagggaaactgcaggttccaggccaggcctcatgcaggggcccaagaggctccctggctcacgtagcctcgatcgrcgttccccatggtgaaatctgctttctgctgcatgctgttcacagtaccctttacgctgctgcaagcccggcagagaaagggtgatgaagggctccagct

SEQ ID NO: 29562 - DNA, 201 bp, Homo sapiens
cagaacctcacggtcacggaccgcgtcattggaggcctgctcgctgggcagacataccatgtggctgtggtctgctacctgaggtctcaggtcagagccayctaccacggaagtttcagtacaagtaagtacatgatcagtacaagtcggtacctgatttctatgtagagtatcaaataggacacaaaggagacacttact

SEQ ID NO: 29563 - DNA, 201 bp, Homo sapiens
tgtatgccttttgatgaaaaatgaagactccagagcctctcctttgattactgggcccattggccgttggcttgggatggtaactccgacatctgggttcygtttcctcccattaacccacttgtgacttgcagcaactcaattgaaacctcccatcgataaaatgctagtggttgtgcaggtgctgccatctcatgtctc

SEQ ID NO: 29564 - DNA, 201 bp, Homo sapiens
attgtacctaaaacagccttcatcttcatattcacccaatgcctttatattgttataattccttcattacattcattaaaaattaaaggagtagaagaggyagataactttccaccataaactctgcattaaaatcccccaactgctaattgacactgccatgacttttcatttaacccctttaatttagtgataaaaatg

SEQ ID NO: 29565 - DNA, 201 bp, Homo sapiens
gatctcaggaagttgaagctgcagtaagctctgatcatgccactgcattccaacctggacaacagagctatactctgtctcaaaaaaaaaaaaaaaaaaaagggaaaaaagaaagaaatgtgaaatccaagttgttaaataaacagtaaaaaaacaaaatttgctatatttctttggaggtttcttggagctcttccaaaa

SEQ ID NO: 29566 - DNA, 201 bp, Homo sapiens
gtctttgtgttctcatgtttacttaagtttaacaagacctattgtgcatcatggccttgagccctgaggttcagggaggggatatatccccaatgctaaawgacgagttgatgggtccagcacaccaacatggcacatgtatacatatgtaacaaacctgcatgttgtgcacatgtaccctaaaacttaaagtataataat

SEQ ID NO: 29567 - DNA, 201 bp, Homo sapiens
agactggacaatgacgatgtcacttactctctcggaacttcttttcttttcttcttttcttttcttttctttttttcttttttctcttctcttctcttctyttcttttcatttcttttctttctttcctttttctcttttttggagtctcactctgttgcccaggctagagtgcagtggcgccatctcggctcactgcaac

SEQ ID NO: 29568 - DNA, 201 bp, Homo sapiens
tgcaaggtgcacaccaaacctgggtgagggctacttacacactgaatgtttccctttttcttctttgatctgcagcagttgagagtgatgctgcagacatygtctttctgatcgacagctctgagggagttaggccagatggctttgcacatattcgagattttgttagcaggattgttcgaagactcaacatcggcccca

SEQ ID NO: 29569 - DNA, 201 bp, Homo sapiens
aacctttggcctcagctgtttctcttcttgtacaacaaagatatagatcccagtggccttggtctcttctggtagcaacagttcatgattctgtagattayggtagcccaagattgatttctaaatgctccttacattttagaaatcagtagtaacccagaccacaatgccaaaatttaaatagagtaaattcagaaagac

SEQ ID NO: 29570 - DNA, 201 bp, Homo sapiens
gcccacaggtgaggggacatgtggcaaatgtccaaacctggggtctgaatgatatttttgatacgaggtaggcacctttctgaaaaattgtctttacttcmcacttcattttatttctaaagcattcaggactcagcaaattgcactgactttatcatcagtgccttttgtgatttcctatcctagaacttaatacgtccc

SEQ ID NO: 29571 - DNA, 201 bp, Homo sapiens
acaccacaccactgtgcaaagctttcttcagtgaggccccaagggtcagcccatggagaggccaagtgtcgcttgtaattctattaaataactggtttaawtgtggggttttttttttttttttttttttttgagacagagtcttgctctgtcacccaggctggagtgcaatggcgtgatctcggctcactgcaacctcca

SEQ ID NO: 29572 - DNA, 201 bp, Homo sapiens
atccagggtggccctggaggcctgtagtctctcagtgaggtccccaaaactatgccgactcagcacccccaatctacaccacaccactgtgcaaagctttyttcagtgaggccccaagggtcagcccatggagaggccaagtgtcgcttgtaattctattaaataactggtttaaatgtggggtttttttttttttttttt

SEQ ID NO: 29573 - DNA, 201 bp, Homo sapiens
ctcttctctcggctcctcacctcaccccacccaccccctctctcgacgctcagtgctcgccaaacccggagtcatcagtgtgatgggaacctaagcgtggstggccaacatcatatacctcttgaagaagaaggagtcagccatcgccaacttgtctctgtagaagctccgggtgtagattcccttgcactgtatcatttc

SEQ ID NO: 29574 - DNA, 201 bp, Homo sapiens
ctgtcccaatcggccctgaaggtgaatatccagggtggccctggaggcctgtagtctctcagtgaggtccccaaaactatgccgactcagcacccccaatytacaccacaccactgtgcaaagctttcttcagtgaggccccaagggtcagcccatggagaggccaagtgtcgcttgtaattctattaaataactggttta

SEQ ID NO: 29575 - DNA, 201 bp, Homo sapiens
tcttagacatcaggcactgacatagagcttagatatgttcttaaggtagctaagccatttattataggatagtcagataggatagttctaggatttatagrccttttcagatactctttatccagtgagagatgacctatttttattaaaacttgggtttggtatcttggaattggcttgaaaatgatttgtttttacatt

SEQ ID NO: 29576 - DNA, 201 bp, Homo sapiens
cgtgacatggtgtactgaggggaaaagcagtaacagggaaagccatgctgagttttagtgctgctctgccaaatgaagggggaccacagggattcttactstagagcaaagaagaccacgggattaaacagaggacccgattactttgtttcagggtattcctggagaagacggctaccgaggctatcctggtgatgaggg

SEQ ID NO: 29577 - DNA, 201 bp, Homo sapiens
ctcaatcactctctgtggctctccctgtacctttgctaagtggtccatctggacactagtctgctgctccattcatggcaaagttacatcactcatcagcyggacagactctcctctgctatcaatcttcaggtggcaaggctgagaacattagatcatcctcatccctgatttcattagctgtatggggaaaatggaatt

SEQ ID NO: 29578 - DNA, 201 bp, Homo sapiens; identical to SEQ ID NO: 7343

SEQ ID NO: 29579 - DNA, 201 bp, Homo sapiens
tcacgttggccacagtaaatgagggtgtcctttaaatggagttagctttgttgaaagtcattgttgattgtgcttggtaaggccattctaattgccttatratgttgccacctacagtcattgaagtcaacaagagagacatagtcttcctggtggatggctcatctgcactgggactggccaacttcaatgccatccgag

SEQ ID NO: 29580 - DNA, 201 bp, Homo sapiens
attcggccttggagcccaggccgcctccagggcagagcttcagcacatagctaccgatgacaacttggtgtttactgtcccggaattccgtagctttgggracctccaggagaaattactgccgtacattgttggcgtggcccaaaggcacattgtcttgaaaccgccaaccattgtcacacaaggtatgtatcctcttct

SEQ ID NO: 29581 - DNA, 201 bp, Homo sapiens
ttggcttgtgccaatagtgcagcaccctctgagccatcagagcagccgggcagtgcttggtacagtttcagtataatatggaacgagcagtctttaaacaygggcagtgcacgcacagtggctcagctaatcacatttagatcatccaagagccccgaccctgactgtcctggataacagcaagtctgctgtatgaaggct

SEQ ID NO: 29582 - DNA, 201 bp, Homo sapiens; identical to SEQ ID NO: 7347

SEQ ID NO: 29583 - DNA, 201 bp, Homo sapiens; identical to SEQ ID NO: 7349

SEQ ID NO: 29584 - DNA, 201 bp, Homo sapiens
tcttctctttgcttcttttctagcttgctgttacggtaagttgattttggtgactttctcctaaggaaaggaagcctcccttttgtagtaagtacagtttrtctttaaccctccaccctctactttccacagggcccctggagtgccccgtcttcccaacagaactagcctttgctttagacacctctgagggagtcaacc

SEQ ID NO: 29585 - DNA, 201 bp, Homo sapiens
cttctcttttttgctttgcaagggataagatcaggtttagagggagaggctgtaaacaatcaaggttatccaggggcccctttgtcttgctctgtgtattyctgggggccaaagcctgtttattcgaattccccatctgctgtgcctctcacctttcgttccttggttttacagggtcccaagggcaacaggggcgactcc

SEQ ID NO: 29586 - DNA, 201 bp, Homo sapiens
ctgctgcatgctgttcacagtaccctttacgctgctgcaagcccggcagagaaagggtgatgaagggctccagcttgcaaaatgcctttgtctctcacaayagggtgagcgtggtccgcctggtgtgaacggcactcaaggtttccagggctgcccgggccagagaggagtaaaggtgaggcgtgggtgatggggttgcta

SEQ ID NO: 29587 - DNA, 201 bp, Homo sapiens
atgacatagtaggaaacttagtgtcctgtgtgcattcatccgtgagtccagaaagggctggggacacggaaacccttaaagacatcacaggtaatggcaaygccaccaagctacgccctgccctgctgttcttgggagatgagcttggcaactgctggccttaaagcaacagctaggatggcgggtgggccagggaagaga

SEQ ID NO: 29588 - DNA, 201 bp, Homo sapiens
cgctgctgcaagcccggcagagaaagggtgatgaagggctccagcttgcaaaatgcctttgtctctcacaacagggtgagcgtggtccgcctggtgtgaayggcactcaaggtttccagggctgcccgggccagagaggagtaaaggtgaggcgtgggtgatggggttgctagcgtggggaggggtcaggtgactcgcagt

SEQ ID NO: 29589 - DNA, 201 bp, Homo sapiens
gggcaccagcagctattgagtgcatgggctcaggtccctggttcccaggtaagtgagtctaccttcctgtattatcagtgaggtgtgaagtgtttagtagmagtatagtgtaaaccaaatttgtttaggaaggctttgcattgataggaagtaattgcttacatagtagaaaaatctaaaccaatgtctttttttaaagat

SEQ ID NO: 29590 - DNA, 201 bp, Homo sapiens
gtgaacggcactcaaggtttccagggctgcccgggccagagaggagtaaaggtgaggcgtgggtgatggggttgctagcgtggggaggggtcaggtgactygcagtttctccagatgctgccagggagggaggcgctggtccaggcttcttgacctcagcattcagcagcccgtgacctctcattggaaggcagttctgag

SEQ ID NO: 29591 - DNA, 201 bp, Homo sapiens
gccaaaccttctcccaaaggcaaattgttagtcttgtaggggtctggctgcattcagcatagtatgatcctactgttctcctgaagtttaaactcatgaawtacagagaaacatttgagaattgcaagtggccagggaaaagtacaatgggaaatgtttctgtaaaaccccctgtgtgtgctatacattaggttttcagga

SEQ ID NO: 29592 - DNA, 201 bp, Homo sapiens
ctctgatgtcctgtgtgagttaccaggctgtcctcctcccagtttcaggtgaaaaggacgtggtgtttctgcttgatggctctgagggcgtcaggagcggyttccctctgttgaaagagtttgtccagagagtggtggaaagcctggatgtgggccaggaccgggtccgcgtggccgtggtgcagtacagcgaccggacca

SEQ ID NO: 29593 - DNA, 201 bp, Homo sapiens
gtccatggctctcctcctgtaggtgtattcctcttcctccaactcacctccagggtcgccagcccagctcactccaggcacagcacccacctgcagtctcraatctcattatgggtgactgggaagtctgtgcagtcactttgggccatgcccacccagacggccaggcaatgggagtgaatgaggcatggcaactgcttc

SEQ ID NO: 29594 - DNA, 201 bp, Homo sapiens
caggaagtgtgcctactcctgtaccttagtctgcaaacatttcaggagctcaaggatccacttctcaggggcagcggcagggcagagacggtggttatggygtgccaggcatggcgacctacagtcacatctctttcccactcttagggagatgacgggagagacggagttggcagtgaaggacgcagaggcaaaaaagta

SEQ ID NO: 29595 - DNA, 201 bp, Homo sapiens
tgtcaattctaagattcttggggttgacgagtctttgattctacatccaaacagaatctttaccaaaagcaaccagcagttctttctatgttagtccgccrgtgccattttgctacgggagtcctttgagcccaccgcctacagaaatggtcttgttcacacttggaagataggacaggagcaggaagtgtgcctactcct

SEQ ID NO: 29596 - DNA, 201 bp, Homo sapiens
gggtcaacagatctctagttgttgatatctgttgaaaactgtaaattaactaagtggcaattcctacatatgttagagatagtaatgtacaattcacacamgttcttctgattcttctgattcataattaatgacgtccagttctgaatgctcctcatgagagagcaacaggaacagatctgagcatgctggggggaggtg

SEQ ID NO: 29597 - DNA, 201 bp, Homo sapiens
tgctcaagctctcagatgcggggatcacccccttgttccttacaaggcaggaagaccggcagctcatcaacgctttgcaggtctgtgctctgtgcgtgctsttggcatctccctttcttctggggctctgagaaggttctcagacacgtccatgctcctttgtggcttcatgtcccatagctcctaaaacgtccccaatga

SEQ ID NO: 29598 - DNA, 201 bp, Homo sapiens
ctttgattttagatcttagacatcaggcactgacatagagcttagatatgttcttaaggtagctaagccatttattataggatagtcagataggatagttytaggatttataggccttttcagatactctttatccagtgagagatgacctatttttattaaaacttgggtttggtatcttggaattggcttgaaaatgat

SEQ ID NO: 29599 - DNA, 201 bp, Homo sapiens
cctgaggtctcaggtcagagccacctaccacggaagtttcagtacaagtaagtacatgatcagtacaagtcggtacctgatttctatgtagagtatcaaayaggacacaaaggagacacttacttattgaatctattctgaaataaccacaaattcaaaaaacaacaacagcaacaacaacaaaacaactcagcctgggtg

SEQ ID NO: 29600 - DNA, 201 bp, Homo sapiens; identical to SEQ ID NO: 7315

SEQ ID NO: 29601 - DNA, 201 bp, Homo sapiens; identical to SEQ ID NO: 7319

SEQ ID NO: 29602 - DNA, 201 bp, Homo sapiens
ctgtttctctaacaggaagatctgctcagctgcaattgcaaaacataatatccatgggagagtgagagaataatgatgatctgtaaaaagagcttgagttyaattgattcacaaagcctcgtatttaccagagtaaatactactgcagcagtttctatattaaaaatggacctcccaaaacagagcttctctttgatggcg

SEQ ID NO: 29603 - DNA, 201 bp, Homo sapiens
tacctgatttctatgtagagtatcaaataggacacaaaggagacacttacttattgaatctattctgaaataaccacaaattcaaaaaacaacaacagcarcaacaacaaaacaactcagcctgggtgctttggtggcagcctaagcttataaaacacagaatggaaatgggattccatgtgggatgcagtcctgccctct

SEQ ID NO: 29604 - DNA, 201 bp, Homo sapiens
tgatcagtacaagtcggtacctgatttctatgtagagtatcaaataggacacaaaggagacacttacttattgaatctattctgaaataaccacaaattcraaaaacaacaacagcaacaacaacaaaacaactcagcctgggtgctttggtggcagcctaagcttataaaacacagaatggaaatgggattccatgtggg

SEQ ID NO: 29605 - DNA, 201 bp, Homo sapiens; identical to SEQ ID NO: 7322

SEQ ID NO: 29606 - DNA, 201 bp, Homo sapiens
ttgttgacagattaattttaattttcatgttattagcatgcggttcaattgttttctttgttttttttctttaggtgaaaatgctttttacttgtccccasatatcaggaaacagtgtgattggttccaaggggaccaacccacaaagaaccttgtgaagtttggtcacaaacaagtgtaagtgattataattattgtctt

SEQ ID NO: 29607 - DNA, 201 bp, Homo sapiens
aaagccatgctgagttttagtgctgctctgccaaatgaagggggaccacagggattcttactgtagagcaaagaagaccacgggattaaacagaggacccrattactttgtttcagggtattcctggagaagacggctaccgaggctatcctggtgatgagggtggacccgtaagtaaaaattgttttagtccctaaaatt

SEQ ID NO: 29608 - DNA, 201 bp, Homo sapiens
agcactctcctctctccttcctccgggagggtggtgtcggggaatgagcgcggatggctgcctcattccctcttgttgaagagggcgggtggtcatctggkgagatggtgtttgacatcttttaataatctaaatgaaaaagttctccaaaatttgctgccagggaatttcgtttttttataaatggagactccaggacat

SEQ ID NO: 29609 - DNA, 201 bp, Homo sapiens; identical to SEQ ID NO: 7326

SEQ ID NO: 29610 - DNA, 201 bp, Homo sapiens
tgctccctctagggaaattcgggacctccagggatagttggacagaagggagaccctggctacccaggaccagctgtaagtatttatccagttctgacccrgccacctggggctgggtgctttacacgtggtccctgaaaacttcccaccatctgctttgctcacaagaaaatgtgctctctttgtatttgcttggttgtc

SEQ ID NO: 29611 - DNA, 201 bp, Homo sapiens
gtaggacaacattgccgagaaagcttgctgtggggttccctgcaagtgctctgggcagaggggagaccgcgggcccatcggcagcatcgggccaaaggtayggtggctttacccttgcccacgcctgagatgaggtgtcagaagcccgacattactttggtggggtaatttctctaacagaagagtgtggagatgaaggag

SEQ ID NO: 29612 - DNA, 201 bp, Homo sapiens
ctatctatctatcatctatctaactgtctatcatccatccttttgctgctggttcaaagaatgaatcagatacaaagtcttcttggaagtctaaaaaggaygtagaaagcatgggattttgagagattttgcataatgagagtcaaaaactgatcattccctttgccctgttttctcttttaggttcatatttggtgctta

SEQ ID NO: 29613 - DNA, 201 bp, Homo sapiens
tgattttctgctgggcatttcttgagatctgaacatttggtttctcttcctttcggtaggacaacattgccgagaaagcttgctgtggggttccctgcaartgctctgggcagaggggagaccgcgggcccatcggcagcatcgggccaaaggtacggtggctttacccttgcccacgcctgagatgaggtgtcagaagcc

SEQ ID NO: 29614 - DNA, 201 bp, Homo sapiens
acaccttcgccagtgagccaaacgacgtcttcttcaaattagtggacaagtccaccgagctcaacgaggagcctttgatgcgcttcgggaggctgttgccrtccttcgtcagcagtaagtcctgcgtggcacagcatgtgccctggcctggctttatgctcgggccaggagaagtgtaggaacagtcatggaaaagacaac

SEQ ID NO: 29615 - DNA, 201 bp, Homo sapiens; identical to SEQ ID NO: 7333

SEQ ID NO: 29616 - DNA, 201 bp, Homo sapiens
tggcccggaggatgcagggtggggctcgggccctctcttgctgaggatggacacgttcgctgacagtggccagcctgtttggggaacctgtttcaaggggmctactatgttagataatgaacgggtattgaagtatgggtggggtcactgggagggactagggagtggttaaagaaaaatctgcttccacaggaagctcca

SEQ ID NO: 29617 - DNA, 201 bp, Homo sapiens
gggcctactatgttagataatgaacgggtattgaagtatgggtggggtcactgggagggactagggagtggttaaagaaaaatctgcttccacaggaagcyccaggagccagtttcgaggccggtgcagaccccaggagcaaacccctctgagcacaggggagtctgctgtgctggatggggaggcagggctgtggccccg

SEQ ID NO: 29618 - DNA, 201 bp, Homo sapiens
aagctccaggagccagtttcgaggccggtgcagaccccaggagcaaacccctctgagcacaggggagtctgctgtgctggatggggaggcagggctgtggycccggctgactggcttctctccccacatacagctcaccccggcgaggaccacagggtgctagagctgcagggtgctcagagctcacggggatggtggatg

SEQ ID NO: 29619 - DNA, 201 bp, Homo sapiens
ataaacaaagtgaaagaggctttctttcttcctaactaaggcgctttgtgtgtctccaacacaagaaaggaaatgcaacatttccaaaatgtatctgcctrcaggaggcctctgtgatgctgtgtcttggccccagattgccgaggatggactttgggaatattgtcacagtgcgggtgcagcttctgttgtcaggaacgt

SEQ ID NO: 29620 - DNA, 201 bp, Homo sapiens
acagaggggctcacgaggaacagtgtggtcaccagggcccagccggcagggctcggctagagaactgggaatcaagcatcacttggaggagctgtcagccyggtgggtcttcccgggattcagcacccacagagacacagtgctgggggccacccacccttgccccacagggcagtgctgtctgcgctgctaccctcccag

SEQ ID NO: 29621 - DNA, 201 bp, Homo sapiens
ctgggcattggcaggaaggtgaacatcaaggaggtatacaccttcgccagtgagccaaacgacgtcttcttcaaattagtggacaagtccaccgagctcamcgaggagcctttgatgcgcttcgggaggctgttgccatccttcgtcagcagtaagtcctgcgtggcacagcatgtgccctggcctggctttatgctcggg

SEQ ID NO: 29622 - DNA, 201 bp, Homo sapiens
ttaattaacaccaccaacaaagctgactttttaaaatagcttactatttggcacctaacagctaccctcatttctctctgtgagaggggtggatagaattkcttctcaaagctcacacacacaggatctcattttgcacttgagtgcgatgccctggtcctctgcctgggttgtccctactgctggtataagtagagttcg

SEQ ID NO: 29623 - DNA, 201 bp, Homo sapiens; identical to SEQ ID NO: 7350

SEQ ID NO: 29624 - DNA, 201 bp, Homo sapiens
ataggctgccatgcttctttctagacatctgcaacatcgacccatcctgtggatttggcagttggaggccttccttcagggacaggagagcggcagggagygatgtggacatcgacatggctttcatcttagacagcgctgagaccaccaccctgttccagttcaatgagatgaagaagtacatagcatacctggtcagac

SEQ ID NO: 29625 - DNA, 201 bp, Homo sapiens
ctgtgcgtgctgttggcatctccctttcttctggggctctgagaaggttctcagacacgtccatgctcctttgtggcttcatgtcccatagctcctaaaaygtccccaatgaggccatctgcctgagaacttctcttgtgaggtctccaggacaacctcgtggctccagcactacagggacgcctacatgcttgtagcact

SEQ ID NO: 29626 - DNA, 201 bp, Homo sapiens
tgggcaaccacatggcataggggaactgatcataggaagcaagatttatgaacagatttttctcctacacttttaaaaatggttaccaccaagatggccaytgggacaggaggtaggaggtgaggtgactgatggagagtcagtctcttgtgaatacacatggatggtggggcaggaaaaagagagttgaggcttggaggc

SEQ ID NO: 29627 - DNA, 201 bp, Homo sapiens
attcattttactgatggagcagacggagatctggctgatttacacagagcatctgagaacctccgccaagaaggtaggtgccaaggctttctaaatatgasaagtaaaccctggtgaggcggggtgtactgctctgctggagagaaacctctctgctaatgcagcgccccaagggagcagcgttgtcttgggagactcttc

SEQ ID NO: 29628 - DNA, 201 bp, Homo sapiens; identical to SEQ ID NO: 7355

SEQ ID NO: 29629 - DNA, 201 bp, Homo sapiens; identical to SEQ ID NO: 7356

SEQ ID NO: 29630 - DNA, 201 bp, Homo sapiens; identical to SEQ ID NO: 7357

SEQ ID NO: 29631 - DNA, 201 bp, Homo sapiens
tggaaaccagaggctgcgggactgtgtcatgataatgacagtgcccttttgggtcagtaatgtggcttttcctctcttctctcggctcctcacctcacccyacccaccccctctctcgacgctcagtgctcgccaaacccggagtcatcagtgtgatgggaacctaagcgtgggtggccaacatcatatacctcttgaaga

SEQ ID NO: 29632 - DNA, 201 bp, Homo sapiens; identical to SEQ ID NO: 7358

SEQ ID NO: 29633 - DNA, 201 bp, Homo sapiens
ttttctctatcaataatgagtgtgggttgtaattgcttagtaagtaattttgtttatgtaaacgtacatttgttaaattttttttcttaggtaatcccgtwtgttggcaccattcctgatcagctggatcctggaactttgattgtgatacgtgggcatgttcctagtgacgcagacaggtaaaatcactgtgctaaagga

SEQ ID NO: 29634 - DNA, 201 bp, Homo sapiens
tgagtgtgggttgtaattgcttagtaagtaattttgtttatgtaaacgtacatttgttaaattttttttcttaggtaatcccgtatgttggcaccattccygatcagctggatcctggaactttgattgtgatacgtgggcatgttcctagtgacgcagacaggtaaaatcactgtgctaaaggaaggagcatgaataggc

SEQ ID NO: 29635 - DNA, 201 bp, Homo sapiens; identical to SEQ ID NO: 7765

SEQ ID NO: 29636 - DNA, 201 bp, Homo sapiens
  misc_feature (1)...(201): n = A,T,C or G, or insertion/deletion polymorphism (see Tables 1-2)
gaactatgtgtcaaaggtttgaagagcaccaaattttcttaactctatataaaaattaagttgtaatgagctgttacgagtaacctgtatccacaatagangcccaaagcagccccctctgcatttgtgtgccgtccctggacggattcgagagtcaaccaggcctgcctctgagccattcctgtgtatttcctcagcacc

SEQ ID NO: 29637 - DNA, 201 bp, Homo sapiens
tgtttatgtaaacgtacatttgttaaattttttttcttaggtaatcccgtatgttggcaccattcctgatcagctggatcctggaactttgattgtgataygtgggcatgttcctagtgacgcagacaggtaaaatcactgtgctaaaggaaggagcatgaataggctgtctttttgtgattgtggaatgataacagagta

SEQ ID NO: 29638 - DNA, 201 bp, Homo sapiens; identical to SEQ ID NO: 7769

SEQ ID NO: 29639 - DNA, 201 bp, Homo sapiens; identical to SEQ ID NO: 7770
  misc_feature (1)...(201): n = A,T,C or G, or insertion/deletion polymorphism (see Tables 1-2)

SEQ ID NO: 29640 - DNA, 201 bp, Homo sapiens
gtcttttgagatcgtgattatggtgctgaaggacaaattccaggtaggttttggagagggacaggttgagtcctcattagtgagcaggagtgcacaggggkgcttttcacatttgtgagcccagccttatatttcctacacctgagatatagtttgtttggctttgtagtttttctccataaaaggaccaggaaggcacct

SEQ ID NO: 29641 - DNA, 201 bp, Homo sapiens
ggttttttggtttttcattgtttgagttttgggcatagatgactgtgaagggcgaacactgccgatggatcaatgaatttgtagtatgtgcaccacttccracttacgggatacccagctttgacggctttggacaaacacactgaggccaagatgtgctgagcttatcaggatcaggatcaccaagcagctgtaaaaacc

SEQ ID NO: 29642 - DNA, 201 bp, Homo sapiens
gtgaatgaatgaggagggattggtcagtcccttgtcactgggcctggagtgtagtgcctgctggtcctttactggtggctttcctttctgagcactcatgrggcccctgtgtcttccctcatatagattccaggtggatctgcagaatggcagcagcatgaaacctcgagccgatgtggcctttcatttcaatcctcgttt

SEQ ID NO: 29643 - DNA, 201 bp, Homo sapiens
agaaaagattagacagtcagctctttaggcctcatagtgaatgaatgaggagggattggtcagtcccttgtcactgggcctggagtgtagtgcctgctggkcctttactggtggctttcctttctgagcactcatggggcccctgtgtcttccctcatatagattccaggtggatctgcagaatggcagcagcatgaaacc

SEQ ID NO: 29644 - DNA, 201 bp, Homo sapiens
tgttttctccccagctttgtcatgtatttagtggccttatgtagacagtttcctttgaaacatctcttggacttctctgctcttccagggccattgccacygacctggaatgtgtccttatcgtttcacgccaggcttatggcagcagtcagtcacccagatgacctcctgacctctggcttatttcacccccactggact

SEQ ID NO: 29645 - DNA, 201 bp, Homo sapiens
ccccagaaggaaagcaggtgtttagcataaccatattatttgcatgaacagttcaggtacaggaaatccccgttaccagttaggttggtgggtgcccttcycaaatcccaagttcccagacaccagccaggggcctgcctcgtaaggaggcctttccaggacagcagtcaggcctgccaatgttaattcttttctgcatac

SEQ ID NO: 29646 - DNA, 201 bp, Homo sapiens
atatgcttgcattgagattatctcaggtctttccattatgccattactttcattttaaatcttcttgctctttcaaatacactttagttgtatctacagtmttttaaaaacaatctcattcagtgttgtaatttcatctgtgggctcttcctctggatgaaatccgtgttccagctgttcggcagcatcagatggttgtga

SEQ ID NO: 29647 - DNA, 201 bp, Homo sapiens; identical to SEQ ID NO: 7860

SEQ ID NO: 29648 - DNA, 201 bp, Homo sapiens
cgagccagggacagtgctgctgcaggggacccagctgggaccaaggcagactgtctctcccctcctgggatttacagggtcatggctctgaaacattccgkagtgttctttggacacgagttttccctggagatcgctttctgcaggcctcttggtcctgactgtggcttcttttcagaggctgccattcgctgcaaggtt

SEQ ID NO: 29649 - DNA, 201 bp, Homo sapiens
tttgatacaggatacagtgtgtattagcaaggttttctttttaatgtttatatttatttagttgagatcatactatatatggctctatagattactttctcacttatattactaacttgtgttattaaatattctgcataaagataattttaagatgaaatttgatgttataaaaacttctcattttattaagagattaac

SEQ ID NO: 29650 - DNA, 201 bp, Homo sapiens
tttcatcgtctaaaatgtaatcatgtgtgtttgcttcgagccagggacagtgctgctgcaggggacccagctgggaccaaggcagactgtctctcccctcstgggatttacagggtcatggctctgaaacattccgtagtgttctttggacacgagttttccctggagatcgctttctgcaggcctcttggtcctgactgt

SEQ ID NO: 29651 - DNA, 201 bp, Homo sapiens
gaatctcccaaactccattcacctctcccttctctggccttttgagcccgtgtctgtatcattctttttcacagtttttaacagttgtgctttggctttaygtgtttattttgcctccacaatgggattttaagctccctgagtcagagactatattgtatgctgctcgcgttttctgcctataacctaacgtggtacctg

SEQ ID NO: 29652 - DNA, 201 bp, Homo sapiens
tctctggccttttgagcccgtgtctgtatcattctttttcacagtttttaacagttgtgctttggctttacgtgtttattttgcctccacaatgggatttwaagctccctgagtcagagactatattgtatgctgctcgcgttttctgcctataacctaacgtggtacctggcatttgagagggagggaggaggagcctcg

SEQ ID NO: 29653 - DNA, 201 bp, Homo sapiens
cttttgagcccgtgtctgtatcattctttttcacagtttttaacagttgtgctttggctttacgtgtttattttgcctccacaatgggattttaagctccytgagtcagagactatattgtatgctgctcgcgttttctgcctataacctaacgtggtacctggcatttgagagggagggaggaggagcctcgtagcgtgc

SEQ ID NO: 29654 - DNA, 201 bp, Homo sapiens
cacacagtcacttagggtcattggtttaggttatcattctacagcattttaaactgacacattgtctggaccatgtgggttcttgaggactcatcaaaacycgttactaaaagcatgaatatcaggcggaatagatagcaatgtgacattcatatttatccctaagttccagtctaatgcagtgccctggtatgtggagtg

SEQ ID NO: 29655 - DNA, 201 bp, Homo sapiens
gaatactgtaattctcattttatggaaatgaaaatctaaatgaatacctctggtaattgtacgggactgtttgattagtatttaccattaattaattaaattttttttttttttgagatggagtctcgttctgttgcccaggctggagtgcagtggcacaatctcggctcacttcaacctccgtctcccaggttcaagcaa

SEQ ID NO: 29656 - DNA, 201 bp, Homo sapiens; identical to SEQ ID NO: 7761
  misc_feature (1)...(201): n = A,T,C or G, or insertion/deletion polymorphism (see Tables 1-2)

SEQ ID NO: 29657 - DNA, 201 bp, Homo sapiens
gagcaaagattcgactgtcaatcacactttgacttgcaccaaaataccacctatgaactatgtgtcaaaggtttgaagagcaccaaattttcttaactctrtataaaaattaagttgtaatgagctgttacgagtaacctgtatccacaatagaggcccaaagcagccccctctgcatttgtgtgccgtccctggacggat

SEQ ID NO: 29658 - DNA, 201 bp, Homo sapiens
tttttttttttgagatggagtctcgttctgttgcccaggctggagtgcagtggcacaatctcggctcacttcaacctccgtctcccaggttcaagcaattstcctgtctcagcctcctgagtagctgggactacaggtgcatgccactacgtctggctaatttttgtatttttagtagggatgggatttcaccatattggt

SEQ ID NO: 29659 - DNA, 201 bp, Homo sapiens; identical to SEQ ID NO: 7764

SEQ ID NO: 29660 - DNA, 201 bp, Homo sapiens; identical to SEQ ID NO: 7768
  misc_feature (1)...(201): n = A,T,C or G, or insertion/deletion polymorphism (see Tables 1-2)

SEQ ID NO: 29661 - DNA, 201 bp, Homo sapiens
aatcacttgaacctgggaggcggaggttgcagtgagccgagatggtgccactgcactccagcctgggtgacagagcgagactccatctcaaaaaaaaaaamcccccccacacacaaaacctgttttcttgaatcatggttgttttgttactgataggttcaataagtaaatatatttattgtctgttgtattctttattag

SEQ ID NO: 29662 - DNA, 201 bp, Homo sapiens
ttttgagatcgtgattatggtgctgaaggacaaattccaggtaggttttggagagggacaggttgagtcctcattagtgagcaggagtgcacaggggtgcytttcacatttgtgagcccagccttatatttcctacacctgagatatagtttgtttggctttgtagtttttctccataaaaggaccaggaaggcacctaaa

SEQ ID NO: 29663 - DNA, 201 bp, Homo sapiens
ctctatataaaaattaagttgtaatgagctgttacgagtaacctgtatccacaatagaggcccaaagcagccccctctgcatttgtgtgccgtccctggayggattcgagagtcaaccaggcctgcctctgagccattcctgtgtatttcctcagcacctccctgcttggctgcttccccttcaggcagaacacagtactg

SEQ ID NO: 29664 - DNA, 201 bp, Homo sapiens
tattaggcattataaacacaccgccactttttaatttttatttcattaatgtttccaattttttttttttttttttttaagacagaggctcgctctgtcayccaggctggagtggagtggtgcagtcttaccccactgcaacctccacctcctgggctcagccttgtaaatagctgggactacaggcatgcaccaccatgc

SEQ ID NO: 29665 - DNA, 201 bp, Homo sapiens
cctgggctgctttctcacctgttccctcctagcctgaggccgagcgccacctccaagtggaggaatctggggaagtttccttcccggaatttgtagtgacygtggagtgacctccattgcgttccctgcctctaacacgctctttaggatgccgagtcatttgactgcagtgttaaacattgcaaagcgcaagtcatgtga

SEQ ID NO: 29666 - DNA, 201 bp, Homo sapiens; identical to SEQ ID NO: 7771
  misc_feature (1)...(201): n = A,T,C or G, or insertion/deletion polymorphism (see Tables 1-2)

SEQ ID NO: 29667 - DNA, 201 bp, Homo sapiens
ctgctggtcctttactggtggctttcctttctgagcactcatggggcccctgtgtcttccctcatatagattccaggtggatctgcagaatggcagcagcrtgaaacctcgagccgatgtggcctttcatttcaatcctcgtttcaaaagggccggctgcattgtttgcaatactttgataaatgaaaaatggggacggga

SEQ ID NO: 29668 - DNA, 201 bp, Homo sapiens
actgtttccctacagcctagtaatagaggaggagacatttctaaaatcgcacccagaactgtctacaccaagagcaaagattcgactgtcaatcacacttwgacttgcaccaaaataccacctatgaactatgtgtcaaaggtttgaagagcaccaaattttcttaactctatataaaaattaagttgtaatgagctgtta

SEQ ID NO: 29669 - DNA, 201 bp, Homo sapiens
caaatgccaaaaggtcagtatccttcggtaccagtcacagtgcagatacttccgtgcctgttaccgccttccacccgtgaacggtcctgtgagctggaagwagggctagcgtcagaatcttcatttccaaagtgagatgattcaagcaggaggtggttagattgtgaacagccagtgggcagcagagccgactaaggccgt

SEQ ID NO: 29670 - DNA, 201 bp, Homo sapiens
gaggcgcacacaagcacacgcacatatacttatgactgcctgtttgtctggggagagacagttcctggtgcttaatcaaatcaggaactcaaaagaagttyggaagcactgctagtgttttgggtgctttcggttaccatttggtcatgtgtgtggagacctgtgggaacaggtataaaactggacgcaaggaaacattta

SEQ ID NO: 29671 - DNA, 201 bp, Homo sapiens
gcacacgcacatatacttatgactgcctgtttgtctggggagagacagttcctggtgcttaatcaaatcaggaactcaaaagaagtttggaagcactgctrgtgttttgggtgctttcggttaccatttggtcatgtgtgtggagacctgtgggaacaggtataaaactggacgcaaggaaacatttaaatttggataata

SEQ ID NO: 29672 - DNA, 201 bp, Homo sapiens
ctggggagagacagttcctggtgcttaatcaaatcaggaactcaaaagaagtttggaagcactgctagtgttttgggtgctttcggttaccatttggtcaygtgtgtggagacctgtgggaacaggtataaaactggacgcaaggaaacatttaaatttggataataagttaatttattaactgtttttttttggtggcgg

SEQ ID NO: 29673 - DNA, 201 bp, Homo sapiens
gtgcctgttaccgccttccacccgtgaacggtcctgtgagctggaagaagggctagcgtcagaatcttcatttccaaagtgagatgattcaagcaggaggwggttagattgtgaacagccagtgggcagcagagccgactaaggccgtgttctgacctcggctttttctggccagacaagagagtagcatttttgtccacg

SEQ ID NO: 29674 - DNA, 201 bp, Homo sapiens
ttgcatagaaaatgaacagtttaaaccgtggagggcagcttcattcattccattccttactgtagaactgtttccctacagcctagtaatagaggaggagrcatttctaaaatcgcacccagaactgtctacaccaagagcaaagattcgactgtcaatcacactttgacttgcaccaaaataccacctatgaactatgtg

SEQ ID NO: 29675 - DNA, 201 bp, Homo sapiens
tcaggaactcaaaagaagtttggaagcactgctagtgttttgggtgctttcggttaccatttggtcatgtgtgtggagacctgtgggaacaggtataaaaytggacgcaaggaaacatttaaatttggataataagttaatttattaactgtttttttttggtggcggggggggctctgtcttctgtatctctctaggtgg

SEQ ID NO: 29676 - DNA, 201 bp, Homo sapiens
catggctctgaaacattccgtagtgttctttggacacgagttttccctggagatcgctttctgcaggcctcttggtcctgactgtggcttcttttcagagsctgccattcgctgcaaggttgaacacccccatgggccctggacgaactgtcgtcgttaaaggagaagtgaatgcaaatgccaaaaggtcagtatccttcg

SEQ ID NO: 29677 - DNA, 201 bp, Homo sapiens
gattctgagatttatgtgcagccttaaaaagtgtagtttttctctatcaataatgagtgtgggttgtaattgcttagtaagtaattttgtttatgtaaacrtacatttgttaaattttttttcttaggtaatcccgtatgttggcaccattcctgatcagctggatcctggaactttgattgtgatacgtgggcatgttcc

SEQ ID NO: 29678 - DNA, 201 bp, Homo sapiens
tccaaaccagtggcttttccttttaaaaaaatttaaagataatatgtgcaaatcatttttttaaaattcaaacagtatttaagagtttcagtgaaacatgmattttccttctaccctggtacttagttttactccccaagggcaatcactttttactggtttttaaaaatatatccttcctgagatacttatgaatatcca

SEQ ID NO: 29679 - DNA, 201 bp, Homo sapiens
agacaggggttcaccatgttggccaggctggtctggaactcctgacctcaagtgatccgcccacttcgccctcccagtgctgggattacaggtgtgagtcrccacgcccagcccaggcaacattttttagggcccctcttgtcatgtgatttagaaaatttctgctttaacaactttttccacagacgtccagccttctga

SEQ ID NO: 29680 - DNA, 201 bp, Homo sapiens
actacaggcgcccgccacccacgcctggctaatttttttgtatttttagtagagacggggtttcaccatgttagccaggatggtctcgatctcctgacctygtgatccacccatctcagcctcccaaagtgctgggattacaggcgtgagccaccgcgcccggccccattttattacctttatttgcttggatccttctta

SEQ ID NO: 29681 - DNA, 201 bp, Homo sapiens
gaatacctgcttgagaggatcccaggctcctgcagcctgaagtagtcattcagtttagcgttaaaccttccatttctgtccaaccacatctcagcctcaaygctgattttaaagggttttttttttcgtatttttattttgcaagtaacgaattagtggaatgctgactgggtttaaaatttcaacttcacctgcattccc

SEQ ID NO: 29682 - DNA, 201 bp, Homo sapiens
  misc_feature (1)...(201): n = A,T,C or G, or insertion/deletion polymorphism (see Tables 1-2)
tttagtagagacggggtttcaccatgttagccaggatggtctcgatctcctgacctcgtgatccacccatctcagcctcccaaagtgctgggattacaggngtgagccaccgcgcccggccccattttattacctttatttgcttggatccttcttagcttcttcaatgttaaagatattgacagttttcctcttactgaa

SEQ ID NO: 29683 - DNA, 201 bp, Homo sapiens; identical to SEQ ID NO: 7760

SEQ ID NO: 29684 - DNA, 201 bp, Homo sapiens
aggatggtctcgatctcctgacctcgtgatccacccatctcagcctcccaaagtgctgggattacaggcgtgagccaccgcgcccggccccattttattayctttatttgcttggatccttcttagcttcttcaatgttaaagatattgacagttttcctcttactgaaatttataaatccattgactcccttgatattat

SEQ ID NO: 29685 - DNA, 201 bp, Homo sapiens; identical to SEQ ID NO: 7763

SEQ ID NO: 29686 - DNA, 201 bp, Homo sapiens
tatcttcttcataaactgtctttggctacctcagttagaattccttatcccattttcctgaagcatttctttgactcttctttactgctcccccacccttttttttttttctttgagactgaattttgcttgttgcccaggctggagtgcaattgcccgatctcggctcattgcaacctccgcctcctgggttcaagtgat

SEQ ID NO: 29687 - DNA, 201 bp, Homo sapiens
tttcctgaagcatttctttgactcttctttactgctcccccacccttttttttttttctttgagactgaattttgcttgttgcccaggctggagtgcaatkgcccgatctcggctcattgcaacctccgcctcctgggttcaagtgattctcctgcctcagcctcctgagtagctgggattacagtcatgtgccaccatgc

SEQ ID NO: 29688 - DNA, 201 bp, Homo sapiens
cctcctgggttcaagtgattctcctgcctcagcctcctgagtagctgggattacagtcatgtgccaccatgcccggctaattttgtatttttagtagagayggggtttctccacgttggtcaggctggtcttcaactcccaacctcaagtgatctgcccaccttcgcctcccaaaatgctgggattacaggtgttagccac

SEQ ID NO: 29689 - DNA, 201 bp, Homo sapiens
gtgaggttacagtttttgaaaatgggacagcaataagaatcctgggagcaggggtgggataagtggtccatttaaatcaagtcctaactcagtatgtggargttgtgtatgttttttgtttacttggagattgtaatttgcccctttttataacgtgggcaatcagtataaatggcaaagccagtagagtgtcaaattatg

SEQ ID NO: 29690 - DNA, 201 bp, Homo sapiens
tctccacgttggtcaggctggtcttcaactcccaacctcaagtgatctgcccaccttcgcctcccaaaatgctgggattacaggtgttagccactgcgccygacccccattttttttttttaaagatgttgaattggtcagggtttgtagttacaagcaacagaagccaactctttaagcagaaaaggaatttgctaaatg

SEQ ID NO: 29691 - DNA, 201 bp, Homo sapiens
catttgtaagaaattcttttcttcaggagtcctggggagaagaagagagaaatattacctctttcccatttagtcctgggatgtactttgaggtgaggttmcagtttttgaaaatgggacagcaataagaatcctgggagcaggggtgggataagtggtccatttaaatcaagtcctaactcagtatgtggaagttgtgta

SEQ ID NO: 29692 - DNA, 201 bp, Homo sapiens
aaaggtcagtatccttcggtaccagtcacagtgcagatacttccgtgcctgttaccgccttccacccgtgaacggtcctgtgagctggaagaagggctagygtcagaatcttcatttccaaagtgagatgattcaagcaggaggtggttagattgtgaacagccagtgggcagcagagccgactaaggccgtgttctgacc

SEQ ID NO: 29693 - DNA, 201 bp, Homo sapiens
aactgacacattgtctggaccatgtgggttcttgaggactcatcaaaactcgttactaaaagcatgaatatcaggcggaatagatagcaatgtgacattcrtatttatccctaagttccagtctaatgcagtgccctggtatgtggagtgtagacagatgtgggctaatcatggaaggttccctgaagttgtggatattgg

SEQ ID NO: 29694 - DNA, 201 bp, Homo sapiens
  misc_feature (1)...(201): n = A,T,C or G, or insertion/deletion polymorphism (see Tables 1-2)
aactgtcgtcgttaaaggagaagtgaatgcaaatgccaaaaggtcagtatccttcggtaccagtcacagtgcagatacttccgtgcctgttaccgccttcnacccgtgaacggtcctgtgagctggaagaagggctagcgtcagaatcttcatttccaaagtgagatgattcaagcaggaggtggttagattgtgaacagc

SEQ ID NO: 29695 - DNA, 201 bp, Homo sapiens
caaacaaacagaatccaaagtgctatcatgaaccctctgagaggggctgactcagcagcccagggagcttgaagaaggctccacagaggaggctgtgcctsaaggcgatttcggtttaggagccaccaatttataaccacttttctgtggcccgtcttattttatttcttatttcttgacaatcagaagtaccttgggtag

SEQ ID NO: 29696 - DNA, 201 bp, Homo sapiens
ccatcatcccccatgaaaactattgttatcatttttgtctgatttctttagtgtttctctttttctttttttaatttttaatttttttgagtatgtagtakgtatatctatttatggggtatatggcatattttgatacaggatacagtgtgtattagcaaggttttctttttaatgtttatatttatttagttgagatca

SEQ ID NO: 29697 - DNA, 201 bp, Homo sapiens
ttttcctctatttttactttacacagggccagtgcctcagtttcaatccaggtaacctttaaatgaaacttgcctaaaatcttaggtcatacacagaagakactccaatcgacaagaagctggaaaagaatgatgttgtccttaaacaacctacagaatatcatctataacccggtaactgatttctataagataactttt

SEQ ID NO: 29698 - DNA, 201 bp, Homo sapiens
attacctcccaaagcaaccccagtactttgggaggatcactttgagcccaggagttccagaccagcccggccaacatggcaaaaccccatctctctaaaastacaaaaaattagctgggcatggtggcacatgcctgtagtcccagctacttggatggctgaggcaggagaatcgcttgaacccgggaggcagaggttgca

SEQ ID NO: 29699 - DNA, 201 bp, Homo sapiens
ttgatacaggatacagtgtgtattagcaaggttttctttttaatgtttatatttatttagttgagatcatactatatatggctctatagattactttctcacttatattactaacttgtgttattaaatattctgcataaagataattttaagatgaaatttgatgttataaaaacttctcattttattaagagattaacg

SEQ ID NO: 29700 - DNA, 201 bp, Homo sapiens
aatggtttactctgacaccgttagcatgtaacaaacacaaaattttaaactaaggggaaccactaatggcatgtatcctttcctttcagatgataatttaytgtgatgttagagaattcaaggttgcagtaaatggcgtacacagcctggagtacaaacacagatttaaagagctcagcagtattgacacgctggaaatta

SEQ ID NO: 29701 - DNA, 201 bp, Homo sapiens
gtgtgtattagcaaggttttctttttaatgtttatatttatttagttgagatcatactatatatggctctatagattactttctcacttatattactaacwtgtgttattaaatattctgcataaagataattttaagatgaaatttgatgttataaaaacttctcattttattaagagattaacgctatgaaacctgctg

SEQ ID NO: 29702 - DNA, 201 bp, Homo sapiens
gcagccacatagcacaggtccccagccagtggactgggaagacagtgtagtcatctctggggaaggggaatgacaagatctggcagtgtggcaggtcccasaaaaaaagggctgggttctgggcagtgagggtgcaggttgagacctgaatactgggtggagccagctgtcagagtccacgcctgcagactggactggtcc

SEQ ID NO: 29703 - DNA, 201 bp, Homo sapiens
agtgggtggaaacccagcctggcactggcagcgtggcaccagaagtatgaagtgtaggtgtaaaggtgatgtaaaaggctagtaggttttttggtttttcrttgtttgagttttgggcatagatgactgtgaagggcgaacactgccgatggatcaatgaatttgtagtatgtgcaccacttccaacttacgggataccca

SEQ ID NO: 29704 - DNA, 201 bp, Homo sapiens
cctccccttcctgattttccttgacagtcctttccactgctcctatcaaaagaatggaaaccctcaacttgctgctttgcagattcaggttttgtgcttcwttctggcctctcggggtggggccgggttagcagcaaggctgagctgcccctctttcttctgaagccttcatgggggcgaggagcacagggagagctcagt

SEQ ID NO: 29705 - DNA, 201 bp, Homo sapiens
ctctttcgctgttttattaactcaatcctcagaacaaaccaatgatgtgaatactgtaattctcattttatggaaatgaaaatctaaatgaatacctctgrtaattgtacgggactgtttgattagtatttaccattaattaattaaattttttttttttttgagatggagtctcgttctgttgcccaggctggagtgcag

SEQ ID NO: 29706 - DNA, 201 bp, Homo sapiens
  misc_feature (1)...(201): n = A,T,C or G, or insertion/deletion polymorphism (see Tables 1-2)
gatggtctcgatctcctgacctcgtgatcctcctgcctcggcctcccaaagtgctgggattacaggcgtgagccaccgcgcccggccgcagttcctttttntagctgtttgaataggaaagatgacttggaaaatgctggattctgagatttatgtgcagccttaaaaagtgtagtttttctctatcaataatgagtgtgg

SEQ ID NO: 29707 - DNA, 201 bp, Homo sapiens
agctaacatagcgcttactctttcgctgttttattaactcaatcctcagaacaaaccaatgatgtgaatactgtaattctcattttatggaaatgaaaatytaaatgaatacctctggtaattgtacgggactgtttgattagtatttaccattaattaattaaattttttttttttttgagatggagtctcgttctgttg

SEQ ID NO: 29708 - DNA, 201 bp, Homo sapiens
tgaaacatataattaaaaatatttttctggctatagaaatatcgatgcttattatagacatctgcaaagtatgaaaatatatgaagaaaaaaattaaaatsccatcatcccccatgaaaactattgttatcatttttgtctgatttctttagtgtttctctttttctttttttaatttttaatttttttgagtatgtagta

SEQ ID NO: 29709 - DNA, 201 bp, Homo sapiens
atgtgtgtggagacctgtgggaacaggtataaaactggacgcaaggaaacatttaaatttggataataagttaatttattaactgtttttttttggtggcggggggggctctgtcttctgtatctctctaggtggctgtaaatggaaaacatactctgctctatggccacaggatcggcccagagaaaatagacactctgg

SEQ ID NO: 29710 - DNA, 201 bp, Homo sapiens
cctgctggtcctttactggtggctttcctttctgagcactcatggggcccctgtgtcttccctcatatagattccaggtggatctgcagaatggcagcagyatgaaacctcgagccgatgtggcctttcatttcaatcctcgtttcaaaagggccggctgcattgtttgcaatactttgataaatgaaaaatggggacggg

SEQ ID NO: 29711 - DNA, 201 bp, Homo sapiens
aaaaaaaaaaaaaaagtgatgggaatagattgttttgtctcaaaaagctctttccaacactaaaatgaaacatataattaaaaatatttttctggctataraaatatcgatgcttattatagacatctgcaaagtatgaaaatatatgaagaaaaaaattaaaatcccatcatcccccatgaaaactattgttatcatttt

SEQ ID NO: 29712 - DNA, 201 bp, Homo sapiens
aaagctgggaaggatgtggaaggctgaaggttggcttttctagatttagggcatgatttgaacaagtccttagaggtgggaagggcagcacagggttgttrgcttggcaagagtcaaggcgcaaagggtgacttggggttcactggagggaaacagaggtgagtgctctagaaggaagttgagccttgtggtgggtgacag

SEQ ID NO: 29713 - DNA, 201 bp, Homo sapiens
aaggctgaaggttggcttttctagatttagggcatgatttgaacaagtccttagaggtgggaagggcagcacagggttgttagcttggcaagagtcaaggygcaaagggtgacttggggttcactggagggaaacagaggtgagtgctctagaaggaagttgagccttgtggtgggtgacaggaaaccaatgatgtaactt

SEQ ID NO: 29714 - DNA, 201 bp, Homo sapiens
tgaacaagtccttagaggtgggaagggcagcacagggttgttagcttggcaagagtcaaggcgcaaagggtgacttggggttcactggagggaaacagagrtgagtgctctagaaggaagttgagccttgtggtgggtgacaggaaaccaatgatgtaacttgtttttgacctatctgggccccaagtttggatctgctat

SEQ ID NO: 29715 - DNA, 201 bp, Homo sapiens
gggccccaagtttggatctgctatattaatataaaaaaggataataatgatacattcaaataatgctgaaaaatactaagatgaaaatacctccaacttcrtaattcaaaccataccattaggattaggtgaaccacattccaggcatttttttgcagagacagtgaaagggatggctggctgaaggaatgaatagatgaa

SEQ ID NO: 29716 - DNA, 201 bp, Homo sapiens
  misc_feature (1)...(201): n = A,T,C or G, or insertion/deletion polymorphism (see Tables 1-2)
atgatacattcaaataatgctgaaaaatactaagatgaaaatacctccaacttcataattcaaaccataccattaggattaggtgaaccacattccaggcntttttttgcagagacagtgaaagggatggctggctgaaggaatgaatagatgaatgttatatgcttttgaacaatcgtcttttccatttaattttctaat

SEQ ID NO: 29717 - DNA, 201 bp, Homo sapiens
aaaatactaagatgaaaatacctccaacttcataattcaaaccataccattaggattaggtgaaccacattccaggcatttttttgcagagacagtgaaarggatggctggctgaaggaatgaatagatgaatgttatatgcttttgaacaatcgtcttttccatttaattttctaattcaggagcagtaattatccttgt

SEQ ID NO: 29718 - DNA, 201 bp, Homo sapiens
  misc_feature (1)...(201): n = A,T,C or G, or insertion/deletion polymorphism (see Tables 1-2)
ttgttctgttttcttctaggcaaaggatgtgccttcttttcatttgcagtagtctgctcacccggaagcatgtcatttctttgccacttgcttgtaattcnctggctttgcacttgctctgatacagtacaggtaactaattgactccctctgctgccaacttggttttccttctgagctatagcatcaggctgtgtgttt

SEQ ID NO: 29719 - DNA, 201 bp, Homo sapiens; identical to SEQ ID NO: 7779

SEQ ID NO: 29720 - DNA, 201 bp, Homo sapiens
atccaaaattatttagtatatgagcacactggtaagaatgggaggcagatcgttgattgtaataatattctattatttggtaaatatcagtaacataatayataatttaaattttaaaataggatatgaagaaaaatgctacatgcttacttttcttttcctctatttttactttacacagggccagtgcctcagtttcaa

SEQ ID NO: 29721 - DNA, 201 bp, Homo sapiens
ggctggaacttttctatgtataatcaaatggtttactctgacaccgttagcatgtaacaaacacaaaattttaaactaaggggaaccactaatggcatgtwtcctttcctttcagatgataatttattgtgatgttagagaattcaaggttgcagtaaatggcgtacacagcctggagtacaaacacagatttaaagagct

SEQ ID NO: 29722 - DNA, 201 bp, Homo sapiens
gtttcatagagttagaatcatagttcaagtctggtcactaacattgctgaaattgccactactctgtcctacttggttaattaaggtttttttttttcttyctttctcaaaagctttaatgttgacctactagcaggaaaatcaaaggatattgctctacacttgaacccacgcctgaatattaaagcatttgtaagaaat

SEQ ID NO: 29723 - DNA, 201 bp, Homo sapiens
tttttctggccagacaagagagtagcatttttgtccacgaggcctatccttgccttgtagaactccagagcagccccgtaagatcaggcaacatcttttcttttttttttttgagatggagcctcactgtgtcacccaggctggagtgcagtgtcacaatcccagcacaccacaacctccgcttcctgggtgttcaagcca

SEQ ID NO: 29724 - DNA, 201 bp, Homo sapiens
agaggatcccaggctcctgcagcctgaagtagtcattcagtttagcgttaaaccttccatttctgtccaaccacatctcagcctcaacgctgattttaaagggttttttttttcgtatttttattttgcaagtaacgaattagtggaatgctgactgggtttaaaatttcaacttcacctgcattcccatgtccatgtgga

SEQ ID NO: 29725 - DNA, 201 bp, Homo sapiens
atgtggatacgtgtgtttcatagagttagaatcatagttcaagtctggtcactaacattgctgaaattgccactactctgtcctacttggttaattaaggtttttttttttctttctttctcaaaagctttaatgttgacctactagcaggaaaatcaaaggatattgctctacacttgaacccacgcctgaatattaaag

SEQ ID NO: 29726 - DNA, 201 bp, Homo sapiens
acagaagcttcatcttggccagctgttatcagagtgcaggacttgggctgaaatttcctccccttcctgattttccttgacagtcctttccactgctccthtcaaaagaatggaaaccctcaacttgctgctttgcagattcaggttttgtgcttcattctggcctctcggggtggggccgggttagcagcaaggctgagc

SEQ ID NO: 29727 - DNA, 201 bp, Homo sapiens
atttcagcattgtgggaggccaaggcaggaagatattgtgagcccaggagtttgagaccagcccgggcaacacagtggaccctgtctctacaaaaaaaaawttttaaattagctgggcatagtggtgtgcgtctatagtcccagctactcctggggctgaggtgggaggatcacttgagggaaaccctgtctcaaagtggc

SEQ ID NO: 29728 - DNA, 201 bp, Homo sapiens
tctcctgtctcagcctcctgagtagctgggactacaggtgcatgccactacgtctggctaatttttgtatttttagtagggatgggatttcaccatattgstcaggctggtctctaactcctgaacctcaggtgatccacccgccttggcctcccaaagtgctgggattacaggtgtgagccaccatgcctggcctatttt

SEQ ID NO: 29729 - DNA, 201 bp, Homo sapiens
aggtgtaaaggtgatgtaaaaggctagtaggttttttggtttttcattgtttgagttttgggcatagatgactgtgaagggcgaacactgccgatggatcdatgaatttgtagtatgtgcaccacttccaacttacgggatacccagctttgacggctttggacaaacacactgaggccaagatgtgctgagcttatcagg

SEQ ID NO: 29730 - DNA, 201 bp, Homo sapiens
gggatgggatttcaccatattggtcaggctggtctctaactcctgaacctcaggtgatccacccgccttggcctcccaaagtgctgggattacaggtgtgrgccaccatgcctggcctattttagtatttttaataataaattccatgttagaaattttctactgatgtattttttaagtcaatatttcctacactcacaa

SEQ ID NO: 29731 - DNA, 201 bp, Homo sapiens
ggtgtaaaggtgatgtaaaaggctagtaggttttttggtttttcattgtttgagttttgggcatagatgactgtgaagggcgaacactgccgatggatcaatgaatttgtagtatgtgcaccacttccaacttacgggatacccagctttgacggctttggacaaacacactgaggccaagatgtgctgagcttatcagga

SEQ ID NO: 29732 - DNA, 201 bp, Homo sapiens
  misc_feature (1)...(201): n = A,T,C or G, or insertion/deletion polymorphism (see Tables 1-2)
cagaagtaccttgggtaggttttaccatgcacatcgtaatttgagtgagcttagtgtgaggcttaacggtgtgtgggctgtacatcctggtcagatgctcnagatggaggcagatggttgtgatgcaggagaggcagccacatagcacaggtccccagccagtggactgggaagacagtgtagtcatctctggggaagggg

SEQ ID NO: 29733 - DNA, 201 bp, Homo sapiens
  misc_feature (1)...(201): n = A,T,C or G, or insertion/deletion polymorphism (see Tables 1-2)
ttcgagccagggacagtgctgctgcaggggacccagctgggaccaaggcagactgtctctcccctcctgggatttacagggtcatggctctgaaacattcngtagtgttctttggacacgagttttccctggagatcgctttctgcaggcctcttggtcctgactgtggcttcttttcagaggctgccattcgctgcaagg

SEQ ID NO: 29734 - DNA, 201 bp, Homo sapiens; identical to SEQ ID NO: 7773

SEQ ID NO: 29735 - DNA, 201 bp, Homo sapiens
tttgaagcttttacagattaaatgaagtctgagatttgcttcaaaatgaaccagtggtggggaggaagtgggtgaggtgtaggtgaaacaagattggccasgtcgataattgctggagctgggcgatgaaagcacaggtatttatcacaccatctctctacttttgtgtgtttttttgtttgtttttggttttggttttaa

SEQ ID NO: 29736 - DNA, 201 bp, Homo sapiens
tcttggccagctgttatcagagtgcaggacttgggctgaaatttcctccccttcctgattttccttgacagtcctttccactgctcctatcaaaagaatgraaaccctcaacttgctgctttgcagattcaggttttgtgcttcattctggcctctcggggtggggccgggttagcagcaaggctgagctgcccctctttc

SEQ ID NO: 29737 - DNA, 201 bp, Homo sapiens
ggctgactcagcagcccagggagcttgaagaaggctccacagaggaggctgtgcctcaaggcgatttcggtttaggagccaccaatttataaccacttttstgtggcccgtcttattttatttcttatttcttgacaatcagaagtaccttgggtaggttttaccatgcacatcgtaatttgagtgagcttagtgtgaggc

SEQ ID NO: 29738 - DNA, 201 bp, Homo sapiens
gtgatccatctgcctcggcctcccaaagtgctgggattacaggcataagccaccgcgcccggcccatgtatactatttatacatttttagtatcattttgyctttacattttacataatttcagatacattttcctcatatcaaataattcagcattttttagtactaacatcatagtctgtaagccattcaaaaaatgta

SEQ ID NO: 29739 - DNA, 201 bp, Homo sapiens
aggcctgccagagcccactttccagacaggtgagagttcattcattcaccatgcagttaccgatcgtctcttgacctgtgtcctggggaggtaaaggtgaygagccagttctgccccatgcagctcacagtctaggcaaagctacatgcaaacaaacagaatccaaagtgctatcatgaaccctctgagaggggctgactc

SEQ ID NO: 29740 - DNA, 201 bp, Homo sapiens
tcctcattagtgagcaggagtgcacaggggtgcttttcacatttgtgagcccagccttatatttcctacacctgagatatagtttgtttggctttgtagtytttctccataaaaggaccaggaaggcacctaaatgtgaggtatggcaccactactctccagccagttgttgccatgcagaaatatggtccactgtgacca

SEQ ID NO: 29741 - DNA, 201 bp, Homo sapiens
tgggcaaggaaagaggacaatatagatgaaaaagaaattgatcctaccagaagtgatccttttatctgcataactctcaggcagttgtggcaaataattgscagtatctattgttctgaaactggttttcgcaacttttattgggaacaccatcccctctcctgcatgatcagtttctcctctccacggatcattcacatg

SEQ ID NO: 29742 - DNA, 201 bp, Homo sapiens; identical to SEQ ID NO: 7776
  misc_feature (1)...(201): n = A,T,C or G, or insertion/deletion polymorphism (see Tables 1-2)

SEQ ID NO: 29743 - DNA, 201 bp, Homo sapiens
  misc_feature (1)...(201): n = A,T,C or G, or insertion/deletion polymorphism (see Tables 1-2)
tccttttttaccttacaatttagtcttaaaacacaacacagtcaagtctttcttttgtaacctgtgagataccttctagcctttgtgctgtttttcttctntttttgctgcctgccttcctgactgagagtggatttcctcactaaggctctgccctctgatttttcactctcttttcttttttggttttactagtgaaat

SEQ ID NO: 29744 - DNA, 201 bp, Homo sapiens; identical to SEQ ID NO: 7777
  misc_feature (1)...(201): n = A,T,C or G, or insertion/deletion polymorphism (see Tables 1-2)

SEQ ID NO: 29745 - DNA, 201 bp, Homo sapiens
gacaccactctcagcaaattcccctggttgtcccttctcagtctcatttattggcgttgtcttatctccccagggctgtccgaggtgattttctcccactrctctcctaggtggtgccatccaatctcatgatgtcatatcattcttccctcatgcttcagccatactggttggtggcctttgtttcctgaacacatttaa

SEQ ID NO: 29746 - DNA, 201 bp, Homo sapiens
gtttatccttttctgcttagtattctaagtactccttttttaccttacaatttagtcttaaaacacaacacagtcaagtctttcttttgtaacctgtgagrtaccttctagcctttgtgctgtttttcttctctttttgctgcctgccttcctgactgagagtggatttcctcactaaggctctgccctctgatttttcac

SEQ ID NO: 29747 - DNA, 201 bp, Homo sapiens
aaggacaaattccaggtaggttttggagagggacaggttgagtcctcattagtgagcaggagtgcacaggggtgcttttcacatttgtgagcccagccttrtatttcctacacctgagatatagtttgtttggctttgtagtttttctccataaaaggaccaggaaggcacctaaatgtgaggtatggcaccactactctc

SEQ ID NO: 29748 - DNA, 201 bp, Homo sapiens; identical to SEQ ID NO: 7778

SEQ ID NO: 29749 - DNA, 201 bp, Homo sapiens
tttgttaactctgctctctggccctttcactcagccccgtttgcacctaaatatgacttacaaaagaaacacagcatttatgtgtacttatttcaacttaytttagctttgtaaagaagtacaaggttgactcagggcccagcttggtgtctcatgcctgtaatttcagcattgtgggaggccaaggcaggaagatattgt

SEQ ID NO: 29750 - DNA, 201 bp, Homo sapiens
  misc_feature (1)...(201): n = A,T,C or G, or insertion/deletion polymorphism (see Tables 1-2)
gttgactcagggcccagcttggtgtctcatgcctgtaatttcagcattgtgggaggccaaggcaggaagatattgtgagcccaggagtttgagaccagccngggcaacacagtggaccctgtctctacaaaaaaaaatttttaaattagctgggcatagtggtgtgcgtctatagtcccagctactcctggggctgaggtg

SEQ ID NO: 29751 - DNA, 201 bp, Homo sapiens
aagcattacactatgcactggagactgtataagacaagttccttttctcaaactacagtcgagttggatagataaaacacacaacacataccaaaagacarctataaatccaaggcagtgtatgtcaagggtaaattcacctattcagattggatcttgagaagtgcatcaggcttggaaaatgggtaaggaggagagaaa

SEQ ID NO: 29752 - DNA, 201 bp, Homo sapiens
caaaagtgctgggattacaggcgtgaggcaccatgcctggccaacttagttatttaaagataatcaattagtatattttataagctagacttaggaaaackgttttcagctgggcatggtggctcacacctgtaatcccagcactttgggaggccgaggcaggtggatcacgaggtcaggagttcaagaccagcctggcca

SEQ ID NO: 29753 - DNA, 201 bp, Homo sapiens
atgaggcagacagtgccaccaccagggacactttagttagattagggtcttggaagtcagaaggaagtcagcagcagcaggctggaacttttctatgtatwatcaaatggtttactctgacaccgttagcatgtaacaaacacaaaattttaaactaaggggaaccactaatggcatgtatcctttcctttcagatgataa

SEQ ID NO: 29754 - DNA, 201 bp, Homo sapiens
taaaacacacaacacataccaaaagacagctataaatccaaggcagtgtatgtcaagggtaaattcacctattcagattggatcttgagaagtgcatcagrcttggaaaatgggtaaggaggagagaaaagcaacagtgaatcagaacatgagttcccagttatgggacttgtaatgaattcctcaattaaaacaaaaaat

SEQ ID NO: 29755 - DNA, 201 bp, Homo sapiens
aagtctcttctggcactgtctggacttggatccgaggcagacgaggaagctgagaaaaccctggcgttgaccccgtggacctgggcgccccgggaaggccrgcgcttggtccaggcaggcggggcctgtgcggtgaccaccctggtcctgaaaagtcccagccccgagcgccctccctcctagacctggaggcctggaaca

SEQ ID NO: 29756 - DNA, 201 bp, Homo sapiens
tgactcttaggcttctttcaagctgcagtctgcctaatagagagccttgcatttaatcatcaaaaaggcaaagcaatattaatcagcaagggtgttttggsaaataacagcaaacctgactgtggcgtaagcttgtggtattgtctccagtgtgatcagatctgtattttaattttttaaatgtaaattaataatgatctg

SEQ ID NO: 29757 - DNA, 201 bp, Homo sapiens
  misc_feature (1)...(201): n = A,T,C or G, or insertion/deletion polymorphism (see Tables 1-2)
tctgtgctcgtcccacagcaagccagtcgcggtccaaggctccagaggctgtgcaggaggccgagctgggtggcgatcagcggcgggtccctgtccaaaanccagcagagccgccagggacgccccagacacagaaggcggggcgcggggagggtggggagaccacagcagtgaggcgcgcgagccgggaagtgaacgagg

SEQ ID NO: 29758 - DNA, 201 bp, Homo sapiens
  misc_feature (1)...(201): n = A,T,C or G, or insertion/deletion polymorphism (see Tables 1-2)
ctgttatgtttcctgggtgtctgactcttaggcttctttcaagctgcagtctgcctaatagagagccttgcatttaatcatcaaaaaggcaaagcaatatnaatcagcaagggtgttttggcaaataacagcaaacctgactgtggcgtaagcttgtggtattgtctccagtgtgatcagatctgtattttaattttttaa

SEQ ID NO: 29759 - DNA, 201 bp, Homo sapiens
ggtccctgtccaaaacccagcagagccgccagggacgccccagacacagaaggcggggcgcggggagggtggggagaccacagcagtgaggcgcgcgagcygggaagtgaacgaggactgactcctgtcgcttcccgtagccgcccacggacgccagagccgggaaccctgacggcacttagctgctgacaaacaacctgc

SEQ ID NO: 29760 - DNA, 201 bp, Homo sapiens
tttgatgggtgggacagtgtccagtccaccccgacccgccggtcctcaccgcggcagagccggggctgggtggcggggacgctgcctctgcaggcgaggcrctccggggcataagggattatcaggagtcgcggcctttcttggacatccctggctggggtcaggctgtttgccctggggtgtctcctcgctgcaaaccca

SEQ ID NO: 29761 - DNA, 201 bp, Homo sapiens
  misc_feature (1)...(201): n = A,T,C or G, or insertion/deletion polymorphism (see Tables 1-2)
tcttacttcctgaattgagtcacggagccagagttttgaggttttgactaacgaattaagttaatgacatggggctatatttaggtggtaaaccaagaggnatacagttttttttcttaataaagaaaaagtgatagatttgatcggtgtgtattgttggtgtgcagtataatgacagaattgctggaagtaaaatacagg

SEQ ID NO: 29762 - DNA, 201 bp, Homo sapiens
gcaaggaaagaggacaatatagatgaaaaagaaattgatcctaccagaagtgatccttttatctgcataactctcaggcagttgtggcaaataattggcartatctattgttctgaaactggttttcgcaacttttattgggaacaccatcccctctcctgcatgatcagtttctcctctccacggatcattcacatgagt

SEQ ID NO: 29763 - DNA, 201 bp, Homo sapiens
  misc_feature (1)...(201): n = A,T,C or G, or insertion/deletion polymorphism (see Tables 1-2)
ctcctgagtagctgggactacaggtgcatgccactacgtctggctaatttttgtatttttagtagggatgggatttcaccatattggtcaggctggtctcnaactcctgaacctcaggtgatccacccgccttggcctcccaaagtgctgggattacaggtgtgagccaccatgcctggcctattttagtatttttaataa

SEQ ID NO: 29764 - DNA, 201 bp, Homo sapiens
gaatattaattatccattgggagacagggcaagaataaaagccagtgaacatatttaaagcacctactatgtaatagagatggtggtgggtgctgattacraaacagctcttgtcctctagtggaggaagaagtcacaatgataatatgacgtgatgaaacagtgttatgaacagggaacgtctgggtagagtggagggaa

SEQ ID NO: 29765 - DNA, 201 bp, Homo sapiens
gaggttacagtttttgaaaatgggacagcaataagaatcctgggagcaggggtgggataagtggtccatttaaatcaagtcctaactcagtatgtggaagytgtgtatgttttttgtttacttggagattgtaatttgcccctttttataacgtgggcaatcagtataaatggcaaagccagtagagtgtcaaattatgca

SEQ ID NO: 29766 - DNA, 201 bp, Homo sapiens
gcagtctagatgaggtctaatgttcataagctaggggattttcagatatggaaagggataccaattttcaacagccacatagagtatcacattttcactcyatgtttcctgggtgtctgttatgtttcctgggtgtctgactcttaggcttctttcaagctgcagtctgcctaatagagagccttgcatttaatcatcaaa

SEQ ID NO: 29767 - DNA, 201 bp, Homo sapiens
ggttatcattctacagcattttaaactgacacattgtctggaccatgtgggttcttgaggactcatcaaaactcgttactaaaagcatgaatatcaggcgraatagatagcaatgtgacattcatatttatccctaagttccagtctaatgcagtgccctggtatgtggagtgtagacagatgtgggctaatcatggaagg

SEQ ID NO: 29768 - DNA, 201 bp, Homo sapiens
ggcagttttgtcacctgctcttaccttgttgcagtctagatgaggtctaatgttcataagctaggggattttcagatatggaaagggataccaattttcarcagccacatagagtatcacattttcactctatgtttcctgggtgtctgttatgtttcctgggtgtctgactcttaggcttctttcaagctgcagtctgcc

SEQ ID NO: 29769 - DNA, 201 bp, Homo sapiens
ctctgccctctgatttttcactctcttttcttttttggttttactagtgaaattttgtctttaatgtctctttcttttatgtctttaccgatcactcataratttttttttccatatgtatccagttccaacctttcacctaatgtgaacccccaactctcagttgctcagccagcccttcaagactaggagttcaaaacc

SEQ ID NO: 29770 - DNA, 201 bp, Homo sapiens
attcaaacagtatttaagagtttcagtgaaacatgcattttccttctaccctggtacttagttttactccccaagggcaatcactttttactggtttttaraaatatatccttcctgagatacttatgaatatccaaaagtgtgtgtgttgtgtatatcaccttttatatatcctgtctctttacgtgcatgcattttacc

SEQ ID NO: 29771 - DNA, 201 bp, Homo sapiens
tatttagaacttcctcatttattttaacagctgcataattagcagtaaaacttatgtaagcagtcccttgtgaagggctgtgtctttttgcgattatatcyggtgctatagtgtacatccttgtgtgtgcatcttggtgtgcctgtgctacgtatttctgtaggataaatctgtaaaagtggaatcactaggtcagagggt

SEQ ID NO: 29772 - DNA, 201 bp, Homo sapiens
gctatagtgtacatccttgtgtgtgcatcttggtgtgcctgtgctacgtatttctgtaggataaatctgtaaaagtggaatcactaggtcagagggtatgrtccattttctttacttatttattttatttatttattcatttatttttgagacagagtcttgctctgtcgcccaggctggagtgcagtggcatgatcttgg

SEQ ID NO: 29773 - DNA, 201 bp, Homo sapiens
ccgatctcggctcattgcaacctccgcctcctgggttcaagtgattctcctgcctcagcctcctgagtagctgggattacagtcatgtgccaccatgcccrgctaattttgtatttttagtagagacggggtttctccacgttggtcaggctggtcttcaactcccaacctcaagtgatctgcccaccttcgcctcccaaa

SEQ ID NO: 29774 - DNA, 201 bp, Homo sapiens
tgtcctccgttttcacagaagccacatagtcgtgggttaaatgagtcagcggcagggcactgtgtctcatagttaaaaaaaaaaaaaagtattactgaagyaatgcaggatcttttctgaagtagaaggcatgatgaacccagaaaactaaagcagcaagtggccaccgttcttagcatagttgtttctcaaactggaaca

SEQ ID NO: 29775 - DNA, 201 bp, Homo sapiens; identical to SEQ ID NO: 7780

SEQ ID NO: 29776 - DNA, 201 bp, Homo sapiens
taggtccttccccattctctacacacaaaatcagatactctgatgtgcagctgtagccccagtctacactgtctgttgtattttttgttttctggtgtcaygtgcctcccaccctgctcctagcaattgccatgacaacaaatagataattggcttccgtaatttctcatcttattgcctaaggcaacagagagcttgtgg

SEQ ID NO: 29777 - DNA, 201 bp, Homo sapiens
tcattccattccttactgtagaactgtttccctacagcctagtaatagaggaggagacatttctaaaatcgcacccagaactgtctacaccaagagcaaakattcgactgtcaatcacactttgacttgcaccaaaataccacctatgaactatgtgtcaaaggtttgaagagcaccaaattttcttaactctatataaaa

SEQ ID NO: 29778 - DNA, 201 bp, Homo sapiens
tattgtatttttagtagaaacagggtttcaccatattggccaggctggtctcaaactcctgacctcaagtgatccacctgcctcggcttcccaaagtgctsggattacaggagtgagccaacgtgcctggtcaaaatttttgttttcgtaattttaagtatgtgtgtagtaagtctcaatggaaatgtaattcttatggca

SEQ ID NO: 29779 - DNA, 201 bp, Homo sapiens
aaaataaaaatatgaaatatgagtgtgaactctgagtagagtatgaaacaccacagaaagtcttagaaatagctctggagtggctctcccaggacagtttscagttgctgaatagtcttttggcactgatgttctacttcttcacattcatctaaaaaaaaaaaaaaaaaatcaaaattaaaatctgagtcagtccgcctg

SEQ ID NO: 29780 - DNA, 201 bp, Homo sapiens
agtacaggtaactaattgactccctctgctgccaacttggttttccttctgagctatagcatcaggctgtgtgttttgtgttttcttgagattttgttaartatatctggggtcccttctacctggttggaactgggattcccaccattcttgtggggatagaatctcaggttacacctatttccccaatcctctgtagcc

SEQ ID NO: 29781 - DNA, 201 bp, Homo sapiens
cagaccccaggcacagggggccttcctggcgtgtttcactcatacagagggcatcgggtcccaccctgtcactcatttcatcgtctaaaatgtaatcatgwgtgtttgcttcgagccagggacagtgctgctgcaggggacccagctgggaccaaggcagactgtctctcccctcctgggatttacagggtcatggctctg

SEQ ID NO: 29782 - DNA, 201 bp, Homo sapiens
ccagaactgtctacaccaagagcaaagattcgactgtcaatcacactttgacttgcaccaaaataccacctatgaactatgtgtcaaaggtttgaagagcmccaaattttcttaactctatataaaaattaagttgtaatgagctgttacgagtaacctgtatccacaatagaggcccaaagcagccccctctgcatttgt

SEQ ID NO: 29783 - DNA, 201 bp, Homo sapiens
cctttccactgctcctatcaaaagaatggaaaccctcaacttgctgctttgcagattcaggttttgtgcttcattctggcctctcggggtggggccgggtkagcagcaaggctgagctgcccctctttcttctgaagccttcatgggggcgaggagcacagggagagctcagtgcagggcctcccagtggccttctcagag

SEQ ID NO: 29784 - DNA, 201 bp, Homo sapiens
ttccttgacagtcctttccactgctcctatcaaaagaatggaaaccctcaacttgctgctttgcagattcaggttttgtgcttcattctggcctctcgggktggggccgggttagcagcaaggctgagctgcccctctttcttctgaagccttcatgggggcgaggagcacagggagagctcagtgcagggcctcccagtg

SEQ ID NO: 29785 - DNA, 201 bp, Homo sapiens
  misc_feature (1)...(201): n = A,T,C or G, or insertion/deletion polymorphism (see Tables 1-2)
tgaagaggttttgagtgacatctggtgcactggtgtgctaggtagcagtcttgaaagtccggggttccaatgggaggaggagcatgggaggaagactagtntaaaagcccaccccagactgggttagtgtactatgccttcctactgatggtcccttgcaaccatcccccattgacccaagaaagaggagaggttcgacac

SEQ ID NO: 29786 - DNA, 201 bp, Homo sapiens
ttcacaggatcatgttctaattgagctcacccaggctggattgaaaggctccacagagggaagtgagagctatgaagaagatccctacttggtagttaacmctaactacttgctcgaagattgagatagtgaaagtaactgaccagagctgaggaactgtggcacagcacctcgtggcctggagcctggctggagctctgc

SEQ ID NO: 29787 - DNA, 201 bp, Homo sapiens
gatgctggtggctctacatctccatccacagaggacccgctaacagtcactgcatgcaaagaaaggggcagctttctcacagagctaaagccaaagcttaycgccatctgtgaaggcggtggggagagcagtaggcagacctggcttccgaaggcctggcaggaagctgccttatgagataggaaacttatgcctagtcct

SEQ ID NO: 29788 - DNA, 201 bp, Homo sapiens
acctcggcatcccgtcaatggctgtgcggatttggggtaccgtgcagcctctgctggggtctcagagatctgagaactcaaatcagcgccagagcaccaaycaccctgtgtcacactctcctagatgccggacccaccatcagccccgtgagacaggaggaggtgcagttcctggggctaatgctcggcaccacagaagca

SEQ ID NO: 29789 - DNA, 201 bp, Homo sapiens
gatgggtacctccacctcggcatcccgtcaatggctgtgcggatttggggtaccgtgcagcctctgctggggtctcagagatctgagaactcaaatcagcrccagagcaccaaccaccctgtgtcacactctcctagatgccggacccaccatcagccccgtgagacaggaggaggtgcagttcctggggctaatgctcgg

SEQ ID NO: 29790 - DNA, 201 bp, Homo sapiens
aacactcagcatttcctttgaaaaatatctttgaggctcacgcctgtaatcctagcactttgggaggccgaggtgggcggatcacttgaagtcaggagttsgagaccagcctggccaatatggcaaaaccccgtctctactaaaaataccaaaattagccagggatggtagcaggcgcctgtgatcccagctactcgggag

SEQ ID NO: 29791 - DNA, 201 bp, Homo sapiens
tcctagcactttgggaggccgaggtgggcggatcacttgaagtcaggagttcgagaccagcctggccaatatggcaaaaccccgtctctactaaaaatacmaaaattagccagggatggtagcaggcgcctgtgatcccagctactcgggaggcttaggcaggagaattgcttgaacccaggaggcagatgttgcagtgag

SEQ ID NO: 29792 - DNA, 201 bp, Homo sapiens; identical to SEQ ID NO: 7888

SEQ ID NO: 29793 - DNA, 201 bp, Homo sapiens
gttgcagtgagccgaaatcatgccactgtactacagcctgtgcgacagagcaagacacaatctcaaaaaaaaaaaatatgtatatatatatatatatatatatatacacacatgtatctttgaaataccccttgcccagtcttgagttgtgcaagcactgattgtctttctgtcttcctttccgtctatgtcctgctaccc

SEQ ID NO: 29794 - DNA, 201 bp, Homo sapiens
ggatctactaccttcggacttacatcaatgaggccctcaaaggtacgacgggcccgcccttccccagcgtgcacctttccctgttggaaacatctgctatytgcaggagtgtgatacagcgtccttgggccacagtaagaagagaacgataaggcttcttgctcctgtgggggttaagctttgctttagggccgcactctg

SEQ ID NO: 29795 - DNA, 201 bp, Homo sapiens
ttcgccttccactccttcggggacctagttgggatctggttcaccttcagtgacttggaggaagtgatcaaggagcttccccaccaggaatcaagagcgtyacaactccagaccctcagtgatgcccacagaaaagcctatgagatttaccacgaaagctatgcttttcagggtgagtacacattgacctgatggtgaccc

SEQ ID NO: 29796 - DNA, 201 bp, Homo sapiens
  misc_feature (1)...(201): n = A,T,C or G, or insertion/deletion polymorphism (see Tables 1-2)
cctgtaacatctgaggagagtttgattttaattttttaaaaacaagagaagttttggtctattggtttgacatttctgtaaatgcctcagaatgagtggtntatgttctccaggttcataattaccttaaaaacaaaatcttgaagctgcagctcctgcttggtcaagtgtcagcttccctgcaggaagaagccacttgcc

SEQ ID NO: 29797 - DNA, 201 bp, Homo sapiens
ctagagtaaagtcatttggatgatttcttcaggtccataggaaatgaatcccccagtggtttccacagtcagagcctcctgccctcgctcacctgctgttygtgtctctggttggtttcaggcggaaaactctctgttgtcctgcgagctgaagatatcccggagctcctgctagaaccacccatatctgcgcttgcccag

SEQ ID NO: 29798 - DNA, 201 bp, Homo sapiens
tgacccaaatgcctcttaaaagtccataacctctcaataatgttacactggcaattaaatttcaacatgagtttttgtagggacaaaccacatccaaaccytagcacacctggaccccatcccagcaatgggttggctccacagggcccctgaagtttatccatagataccatttaataatgcttatctgaactcaccttt

SEQ ID NO: 29799 - DNA, 201 bp, Homo sapiens
  misc_feature (1)...(201): n = A,T,C or G, or insertion/deletion polymorphism (see Tables 1-2)
catgcattcaggatcacctgtacatgctgcacacaagtgtattagtcaggttctacaggagaggcttttcactcagagtgcctggaaaatgctccatctanaggttaagaagccaaagttcccaggctcacaagtaatctcagcactttgggaggctgaggcaggaggattgcttgagaccaggagttcaagaccagcctg

SEQ ID NO: 29800 - DNA, 201 bp, Homo sapiens
  misc_feature (1)...(201): n = A,T,C or G, or insertion/deletion polymorphism (see Tables 1-2)
ttgctagggaagttgggaaagctggcagtcacaagcctcacctagctcccatgcagccagcaaggccagtctcactcctgctgtgccctgccaacagtgcncagggcagagatctcaccccaggccacaagccttctctctgagaaagcaaacagggctttcaggccttgcccctccccacctgcccacactgttggctgt

SEQ ID NO: 29801 - DNA, 201 bp, Homo sapiens
ctataaccaatacctttgttttcatgtgtaagaaaaggcccattacttttaaggtatgtgctgtcctattgagcaaataactttttttcaattgccagctwctgcttttattcatcaaaataaaataacttgttctgaagttgtctattggatttctttctactgtaccctgattattacttccatctacttctgaatgtg

SEQ ID NO: 29802 - DNA, 201 bp, Homo sapiens
  misc_feature (1)...(201): n = A,T,C or G, or insertion/deletion polymorphism (see Tables 1-2)
ttttgaagcaaatcccagacatccatagatggtggcctcttaactaagcttcttaagtagcacaggctctggatgtgagcagtggccttgttcctgatccnaacaccgtgcctggctctaagaggtgccctgtaagcctgtgatgaaagaagaggtgaaggtgggggttggtggggagggtagactatgttattgaaaatt

SEQ ID NO: 29803 - DNA, 201 bp, Homo sapiens
tcttttggtagcttttagttgctcagaggaggaaaaagttactgtgagtaaaatgaccaaactccaagccccgcaaaaaaggtaatttaaagtgaagtcaracagcatgtcagccctgagacgttttccttgatactgaaatggctagaaataagaagaggaaattacatttgcttccattttaatgataacagctaatat

SEQ ID NO: 29804 - DNA, 201 bp, Homo sapiens
agagatgggctttcaccatgttggtcaggcttgtctcaaactcctgacctcaggtaatccacctgcctcggcctcccaaagtgctggaattacaggcttgrgccaccgcgccagcctttaactataatttttaaaagaaaaattaaaataatctgggaagtgaacagctttgggcccccttgggcagctgggcagtctgga

SEQ ID NO: 29805 - DNA, 201 bp, Homo sapiens
ctaaaatctttcagctagagtaaagtcatttggatgatttcttcaggtccataggaaatgaatcccccagtggtttccacagtcagagcctcctgccctcsctcacctgctgttcgtgtctctggttggtttcaggcggaaaactctctgttgtcctgcgagctgaagatatcccggagctcctgctagaaccacccatat

SEQ ID NO: 29806 - DNA, 201 bp, Homo sapiens
ttaaaataatctgggaagtgaacagctttgggcccccttgggcagctgggcagtctggaagccatgggaaccaccgccggtctccgtagttctgcagcatygccctggtgctgtagagatgttgtgctgctcattggcgtctgtgcgttgatgggggccccaggagtcagggtctggtcttcagattttccatttcaaaca

SEQ ID NO: 29807 - DNA, 201 bp, Homo sapiens
ctggcagaaaagtaagatcaacagatgatctgttggtctctcagggtgtatgtcacttttaggaccacaaccttgaattgaggagctggcagtgggttggstgcatggaggtcctgactcctggtgtcaagctctcctctgctccctttgggatgttcccagcctacaggctcgatggtatagaccttcgagggtatgtcg

SEQ ID NO: 29808 - DNA, 201 bp, Homo sapiens
gccctggtgctgtagagatgttgtgctgctcattggcgtctgtgcgttgatgggggccccaggagtcagggtctggtcttcagattttccatttcaaacaygatggaaccaagactgataaggttctggagggacaactcccaggctgattgcacggccagaatggcacctaaattagtttacagagggcgataactgcta

SEQ ID NO: 29809 - DNA, 201 bp, Homo sapiens
ataaggggagaaacaaaaaagcgtacttctgagaggctgttagtcttgacagtgcttaggttctaatgaccctatttaactactattttcaggacacggtsgatttcctctctcttgatttgtcttatgaatgccaaaatgaggcaagtctgcggcagaagctgagtaaattgcaggtaatttgagcccttttccacatta

SEQ ID NO: 29810 - DNA, 201 bp, Homo sapiens
ggggttggtggggagggtagactatgttattgaaaattgtagatctttctccttcagagtctagagttgactcctttaattaactgagatacttagaggtsatttccaaagccagagtaagtgccacagcttctcatcttgaaactctgtccctgttatcaagatgctttccaggaggcttcagttcacttgctggtcctt

SEQ ID NO: 29811 - DNA, 201 bp, Homo sapiens
gtggcctcttaactaagcttcttaagtagcacaggctctggatgtgagcagtggccttgttcctgatcctaacaccgtgcctggctctaagaggtgccctrtaagcctgtgatgaaagaagaggtgaaggtgggggttggtggggagggtagactatgttattgaaaattgtagatctttctccttcagagtctagagttg

SEQ ID NO: 29812 - DNA, 201 bp, Homo sapiens
aagaaaaaaatctttgagcctttttgtctcataagtcactctcaggatttgcagcagacgttgatgctggcacatctaacctagggcttcccatggaaagyatgactgatgcaacagctgatctggcttcttcccaggtgaccatttaccactgggacctaccacagacgctccaagatgtaggaggctgggagaatgaga

SEQ ID NO: 29813 - DNA, 201 bp, Homo sapiens
  misc_feature (1)...(201): n = A,T,C or G, or insertion/deletion polymorphism (see Tables 1-2)
cagcatgtcttgttctctgactggcagcctggcccttcagcctgaccagcagcaggaccacgagaccacggactcctctcctgcctctgcctatcagagantctgggaagcatttgccaatcagtccagggcggaaagggatgccttcctgcaggatactttccctgaaggcttcctctggggtgcctccacaggagcctt

SEQ ID NO: 29814 - DNA, 201 bp, Homo sapiens; identical to SEQ ID NO: 7892

SEQ ID NO: 29815 - DNA, 201 bp, Homo sapiens
atcatggtggatggcagaatgagagcgtggtggatgccttcctggactatgcggccttctgcttctccacatttggggaccgtgtgaagctgtgggtgacyttccatgagccgtgggtgatgagctacgcaggctatggcaccggccagcaccctcccggcatctctgacccaggagtggcctcttttaaggtacttccca

SEQ ID NO: 29816 - DNA, 201 bp, Homo sapiens
  misc_feature (1)...(201): n = A,T,C or G, or insertion/deletion polymorphism (see Tables 1-2)
agccaaagttcccaggctcacaagtaatctcagcactttgggaggctgaggcaggaggattgcttgagaccaggagttcaagaccagcctgggcaatatantgagactttgtctttacaaaaaatttaaaaattatctaggcatggtgacgcacacctatattcccaactacttgggaggctgaggtgagaggattgcttg

SEQ ID NO: 29817 - DNA, 201 bp, Homo sapiens; identical to SEQ ID NO: 7895
  misc_feature (1)...(201): n = A,T,C or G, or insertion/deletion polymorphism (see Tables 1-2)

SEQ ID NO: 29818 - DNA, 201 bp, Homo sapiens
atgccttcctggactatgcggccttctgcttctccacatttggggaccgtgtgaagctgtgggtgaccttccatgagccgtgggtgatgagctacgcaggstatggcaccggccagcaccctcccggcatctctgacccaggagtggcctcttttaaggtacttcccaaccctgcagctcctactaattggaggagaaagg

SEQ ID NO: 29819 - DNA, 201 bp, Homo sapiens
ggggtgagaggtgtggtgtgaggaagcgcaggaagcggcagtcactgcccacgggaacatgcccaccgctccaaggctggcgggaatcaagtgtgaattcycaacatagtctttgagtcctgcccctagacgcccccatatagtccagctgaggattaaaaatccagctcccaggccgggtgcggtggctgacgcctgtaa

SEQ ID NO: 29820 - DNA, 201 bp, Homo sapiens
tgaaaatctctttgatgattccttaagagtagactacttcaatcaatatatcaatgaggtgctcaagggtaagaacaatggatgtgccagtgattggaagktgggtggtacttctccaagtcttcaaagtttcgtttaataagacaaagaaagtctcctagagaaatggagccaaagaaagcataatagtggggagtcctt

SEQ ID NO: 29821 - DNA, 201 bp, Homo sapiens
tgtaggaggctgggagaatgagaccatcgtgcagcggtttaaggagtatgcagatgtgctcttccagaggctgggagacaaggtgaagttttggatcacgytgaatgagccctttgtcattgcttaccagggctatggctacggaacagcagctccaggtaagtcccagccctggctcataggctctttgaatcatggcat

SEQ ID NO: 29822 - DNA, 201 bp, Homo sapiens
aatcgtgagaactgagaaattcaaactcaaatactcaatttgcaaattatttcccctgctactttgaagatcttgaagctattattattattattattatwattattattattagagttggagaaaagaggcatgcctaaacaaaccccaagaggagcagagaaacttggaaagggcagaaaacggaaatacaaattacac

SEQ ID NO: 29823 - DNA, 201 bp, Homo sapiens; identical to SEQ ID NO: 7884

SEQ ID NO: 29824 - DNA, 201 bp, Homo sapiens
gagaactgagaaattcaaactcaaatactcaatttgcaaattatttcccctgctactttgaagatcttgaagctattattattattattattattattatwattattagagttggagaaaagaggcatgcctaaacaaaccccaagaggagcagagaaacttggaaagggcagaaaacggaaatacaaattacacaagata

SEQ ID NO: 29825 - DNA, 201 bp, Homo sapiens; identical to SEQ ID NO: 7885

SEQ ID NO: 29826 - DNA, 201 bp, Homo sapiens
cacccgggttccagtgattcccctgcctcagcctccaagtagctgggattacaggcgcgtacctccacgcctggctaattttttttttttttttttgtatwttagcagagacggggtttcatcatgttggccagaatggtctcggctaattttgtgtttttagtagagacagggtttctccatgttggtcaggctggtctc

SEQ ID NO: 29827 - DNA, 201 bp, Homo sapiens
gaggctcatcgatacactgctggccgccagcatccagccccaggtatggtgggtcctggcaaggccttgggaaagtccacatgcaggaaccagcagggctsggggagcacatttatcatgtaaacaaaatgctggtttcaaatttagcttttgttgttattgttgtttttgagacgtagtctcgctctgtcacccaggctg

SEQ ID NO: 29828 - DNA, 201 bp, Homo sapiens
actatgtaagcaaaaaagcaagatgcaaggtagaatatataatatgatcccatttatttaaaaaataaagattacatatttgcttatatacgcatacaaattttctgaaaattacataagaaattgttaatagattacctctggagaatagtactggggtaagaggtgagggggcagaattctcattttacagccttatat

SEQ ID NO: 29829 - DNA, 201 bp, Homo sapiens
gcctggcactgccccctacattgttggccacaatctaataaaggctcatgctgaggcctggcatctgtacaacgatgtgtaccgcgccagtcaaggtggcrtgatttccatcaccatcagcagtgactgggctgaacccagagatccctctaaccaggaggatgtggaggcagccaggagatatgttcaggtctgtttttc

SEQ ID NO: 29830 - DNA, 201 bp, Homo sapiens
cacaaatgtaaatgacaattatccagtttcaattatacaggctgagaatccttcatctgaaaattcaaaatccaaaatactccaaaatctgaaactttttyagcatgactggcatgacaacacaaatggaaaattcaacacctgaccccatgtgacaggtcgcagtcaaaacacagttaaagctttgtttcatgcacacaa

SEQ ID NO: 29831 - DNA, 201 bp, Homo sapiens
cagtttcccctactcactgccaagtgcctggggttcggagagctcccccgccccagccctatgacgttctcttctcaaagcatggctctccctgaagcccygccctcaatggcttcttccacccaggctgccagaatttacagagagtgagaagaggaggatcaacggcacctatgacttttttgggttcaatcactacac

SEQ ID NO: 29832 - DNA, 201 bp, Homo sapiens
gcttcctgcaccgcctgaaggacctcttctccttccctgccagtttcccctactcactgccaagtgcctggggttcggagagctcccccgccccagccctrtgacgttctcttctcaaagcatggctctccctgaagccctgccctcaatggcttcttccacccaggctgccagaatttacagagagtgagaagaggagga

SEQ ID NO: 29833 - DNA, 201 bp, Homo sapiens
cgcgcgcgcgcgcgtgggtgcgtgtgtgtgtggtccttcaggtttcagaggctcttgtagagacctagggaagccaggtttatggtctggcgggaggagcygcaggtgcttcctgcaccgcctgaaggacctcttctccttccctgccagtttcccctactcactgccaagtgcctggggttcggagagctcccccgcccc

SEQ ID NO: 29834 - DNA, 201 bp, Homo sapiens
tcaataaattggagtcattgttattattagctatgttttacaaataatgaattataagaagaataaagtatggtactaacactgaagacaatattcaaggkcaatctaatacagagaacagtagcattgttcctgttttaaccatgaaagagcaagaatcactcacctcagaaggggtaataataataattttcccatctg

SEQ ID NO: 29835 - DNA, 201 bp, Homo sapiens
  misc_feature (1)...(201): n = A,T,C or G, or insertion/deletion polymorphism (see Tables 1-2)
cttggctgcaggcctcaacaagtctcggtaagggcctggtgcccgcagtggtgagggcatgggcgtcggggtcacagaggcatgtctcgggcaagttaccntgactgagcttctttgcttgctgggaagttacatgtgatcatatatgtaaagcttagcccagcacctggcactgctatatgcttgacagaggggtttgct

SEQ ID NO: 29836 - DNA, 201 bp, Homo sapiens
tgtaagcaaaaaagcaagatgcaaggtagaatatataatatgatcccatttatttaaaaaataaagattacatatttgcttatatacgcatacaaattttytgaaaattacataagaaattgttaatagattacctctggagaatagtactggggtaagaggtgagggggcagaattctcattttacagccttatatactg

SEQ ID NO: 29837 - DNA, 201 bp, Homo sapiens
cctggctaattttgtatttttagtagagacggggtttccccatgttggtcagtctggtctcgaacttctgacctcgtgatccacctgcctcggcctcccaragtgctgggattacaggcatgagccaccacacccagcccccgtttcttttagtctcagtttcctcctgtgtaggatgaggataaatcattgtagtaccca

SEQ ID NO: 29838 - DNA, 201 bp, Homo sapiens
  misc_feature (1)...(201): n = A,T,C or G, or insertion/deletion polymorphism (see Tables 1-2)
agcggccactccccaacggcacacagctgtctgagggcctgagaacagcctcaagcccagaaatgaagagctgcggcacactccagggttctcggttctgnaggaggcacacgaggaggtcccccatccacttatcagaaaaagctgtgctcccagggagttctccgcttggcagaagacaggctgggggcctccgaggct

SEQ ID NO: 29839 - DNA, 201 bp, Homo sapiens
atacaaaaattaaccaagtatagtggcacgaacctgtaatcccagctccttgggaggctgaggcacaacaatcgcttgaacccgggaggtggaggttgcartgagccgagatggcgccactgcactccagcccaggggacagagagagacttgtctcaaaaaaaaataaagaaaaagaaaaagaagtccaagggtttggaa

SEQ ID NO: 29840 - DNA, 201 bp, Homo sapiens
cataggaaatgaatcccccagtggtttccacagtcagagcctcctgccctcgctcacctgctgttcgtgtctctggttggtttcaggcggaaaactctctrttgtcctgcgagctgaagatatcccggagctcctgctagaaccacccatatctgcgcttgcccaggtgacagcagcccaaaaatatacctgtaacatctg

SEQ ID NO: 29841 - DNA, 201 bp, Homo sapiens
tttgcatcaggaaggaaaggcaagggtttctctctggattggttcccactttgggctccgtggaagagtctgccaactgtggcactataactctctcgggrgaaacaccatgggccttggtttgccaaactcttcacaagagaacttgacaaagatagtcaaattaataaatgcaacgaagggcttaattttctggtctgc

SEQ ID NO: 29842 - DNA, 201 bp, Homo sapiens
aacagacctcaatgacactgcaaggatctactaccttcggacttacatcaatgaggccctcaaaggtacgacgggcccgcccttccccagcgtgcaccttyccctgttggaaacatctgctatctgcaggagtgtgatacagcgtccttgggccacagtaagaagagaacgataaggcttcttgctcctgtgggggttaag

SEQ ID NO: 29843 - DNA, 201 bp, Homo sapiens
gagttcaagaccagcctggccaacatggtgaaatcctgtctctactaaaatacaaaaattagccagatatgttggtgggcgcctgtaatcccatctacttrggaggctgaggcaagagaatcacttcatcctgggaggcggaggttgtagtgagccgagattatgccactgcactccagcctgggcagcctgggtgacaaa

SEQ ID NO: 29844 - DNA, 201 bp, Homo sapiens
  misc_feature (1)...(201): n = A,T,C or G, or insertion/deletion polymorphism (see Tables 1-2)
ttgctgtgcccacctgtaacgcctgggctgtctcccccaccctacccgcagttcatgggaggctggtttgcacatcctattttcaagaatggagattacantgaggtgatgaagacgcggatccgtgacaggagcttggctgcaggcctcaacaagtctcggtaagggcctggtgcccgcagtggtgagggcatgggcgtc

SEQ ID NO: 29845 - DNA, 201 bp, Homo sapiens
cacgtatccccgcacatgataaggatggcctaggcctcattagagaaaataggtcaaacggttccccactctggggctgtgaaagcccattaagagttatyctttgcccggaaagtcaggaaagccttgcatttcagccctccccagaaagttctgtttgctccttgggcactttgatgaggaagtgcagccgctcagtgg

SEQ ID NO: 29846 - DNA, 201 bp, Homo sapiens
gatttggggtaccgtgcagcctctgctggggtctcagagatctgagaactcaaatcagcgccagagcaccaaccaccctgtgtcacactctcctagatgcyggacccaccatcagccccgtgagacaggaggaggtgcagttcctggggctaatgctcggcaccacagaagcacagacagctttgtacgttctcttttctc

SEQ ID NO: 29847 - DNA, 201 bp, Homo sapiens
aagctgtgtgcaaggagaagttactcataatcaccaggaatccaggctcctttgttgttgctttgtcacctttaacaaggtttctacctcatggttcaggrtggatgcttgagctcctgccattatgtcagaaatccaagcagcatgaagaaaggaagcagtagccaggactgatattcaactggtccacatcagtgtact

SEQ ID NO: 29848 - DNA, 201 bp, Homo sapiens
agcttgttaaggtgaatatttacatagatcctctgcttgcttgtgtagaaatctgccgagaattgagattctggggttcattctgagttttaaaaaggcarctcatcaatgggggtgatggttccataacgataagcgtccacttaacaccactgaactatacatttaatggttatgatggtaatttttttttttgagatg

SEQ ID NO: 29849 - DNA, 201 bp, Homo sapiens
tcataggctctttgaatcatggcattcttagcacatcaagagttgaaatccagatggcacaggacgaggcaaccaagaaagccccatggcagaaaccctgyctcttgctcagggctgtagaggtttccctcctggcattgcattgttaaacatgaatttcacatctcaattcctcaaggtgggttcatttctttgctctgt

SEQ ID NO: 29850 - DNA, 201 bp, Homo sapiens
ccttcggggacctagttgggatctggttcaccttcagtgacttggaggaagtgatcaaggagcttccccaccaggaatcaagagcgtcacaactccagacyctcagtgatgcccacagaaaagcctatgagatttaccacgaaagctatgcttttcagggtgagtacacattgacctgatggtgacccctcggcaaccttc

SEQ ID NO: 29851 - DNA, 201 bp, Homo sapiens
acagcagagaccggctgagttgtgtctggggagatttccattgcaagcatccctagagaacatcggatgttaggcagtctttcctagaagggatacaaggkttagcttgttaaggtgaatatttacatagatcctctgcttgcttgtgtagaaatctgccgagaattgagattctggggttcattctgagttttaaaaagg

SEQ ID NO: 29852 - DNA, 201 bp, Homo sapiens
gtaagcaaaaaagcaagatgcaaggtagaatatataatatgatcccatttatttaaaaaataaagattacatatttgcttatatacgcatacaaattttctgaaaattacataagaaattgttaatagattacctctggagaatagtactggggtaagaggtgagggggcagaattctcattttacagccttatatactgt

SEQ ID NO: 29853 - DNA, 201 bp, Homo sapiens
tgggttcaatcactacaccactgtcctcgcctacaacctcaactatgccactgccatctcttcttttgatgcagacaggtaagtccaccaacagggagccyggagccatctctggaaaaggcagaaaggtgcccttggctgtgctctctgaggcctgcccagcctcaaaacagggcctccaacgccgaatgtgccggggtt

SEQ ID NO: 29854 - DNA, 201 bp, Homo sapiens
tcccagcgggaagaaacagacctcaatgacactgcaaggatctactaccttcggacttacatcaatgaggccctcaaaggtacgacgggcccgcccttccmcagcgtgcacctttccctgttggaaacatctgctatctgcaggagtgtgatacagcgtccttgggccacagtaagaagagaacgataaggcttcttgctc

SEQ ID NO: 29855 - DNA, 201 bp, Homo sapiens
atgctggtggctctacatctccatccacagaggacccgctaacagtcactgcatgcaaagaaaggggcagctttctcacagagctaaagccaaagcttacygccatctgtgaaggcggtggggagagcagtaggcagacctggcttccgaaggcctggcaggaagctgccttatgagataggaaacttatgcctagtcctc

SEQ ID NO: 29856 - DNA, 201 bp, Homo sapiens
gacttgttgacattggtttggatttcttgacattgttgacttgttgacattgttagtatcagtcttaacttgttgtttatgttgttaacttgttaactttrttattgacttgttaacatcattgatgttagtgtcaacattgttatttgttgatgacttgatgttaacattagtgctgatgttgtcaatattgacaatgtc

SEQ ID NO: 29857 - DNA, 201 bp, Homo sapiens
atgtaagcaaaaaagcaagatgcaaggtagaatatataatatgatcccatttatttaaaaaataaagattacatatttgcttatatacgcatacaaatttyctgaaaattacataagaaattgttaatagattacctctggagaatagtactggggtaagaggtgagggggcagaattctcattttacagccttatatact

SEQ ID NO: 29858 - DNA, 201 bp, Homo sapiens; identical to SEQ ID NO: 7891

SEQ ID NO: 29859 - DNA, 201 bp, Homo sapiens
ccgcccttccccagcgtgcacctttccctgttggaaacatctgctatctgcaggagtgtgatacagcgtccttgggccacagtaagaagagaacgataagscttcttgctcctgtgggggttaagctttgctttagggccgcactctgagtttttttccttcctatgtctaagctcagcaagcaagcccagtggcctgatg

SEQ ID NO: 29860 - DNA, 201 bp, Homo sapiens
tatattttgatacatgtatacaatgtgtgatgatgaaatcagaataattagtatattcatcacctcaaacattcatcatttctttgtgttgggaaaattcsgagtcctcttttctagctttttgcaaatatacactaaattcttttgtatcattattttttattcattttttatttttttgagacagagtctagctctgtt

SEQ ID NO: 29861 - DNA, 201 bp, Homo sapiens
cattgttatttgttgatgacttgatgttaacattagtgctgatgttgtcaatattgacaatgtcaatgttgttgttgtctttattgacttgttgacattgwtgttgacttgttattggttcattagtcctgttgttgtcattgttattattactaatcactgtatttccttcttactttttcacaaggtggctcacttggt

SEQ ID NO: 29862 - DNA, 201 bp, Homo sapiens
gattacaggcatgtgtcaccatgcccagctaatttttgtatttttagtagaaatggggtttcatcatgttggccaggctggtctcgaactcgtgacctcargtaatccgcccgcctcagcctcccaaagtgctgggattacagatgtgagccactgcacccagcctaaattattgttaactacattcactctacagtgcca

SEQ ID NO: 29863 - DNA, 201 bp, Homo sapiens
  misc_feature (1)...(201): n = A,T,C or G, or insertion/deletion polymorphism (see Tables 1-2)
ggctgtggcttcacaaaagaaaactcaagaagccgtaataaaatgggttccctgaaaagccagtgattacaagtgacaccagctcggagattctctcagcncttggtggtgctttgcctgaaggggagggccaacacaggcttacattaaacggacagccaggggcccctactcaggaggatgtggttggagaacccgctg

SEQ ID NO: 29864 - DNA, 201 bp, Homo sapiens
atcaccatcagcagtgactgggctgaacccagagatccctctaaccaggaggatgtggaggcagccaggagatatgttcaggtctgtttttcctctgggcrcttgttcttactcttgtccatctttccttccagcctaatggaaacagattgtgaatcaaagatttagggtgtggtggctcatgtctataatcccagcact

SEQ ID NO: 29865 - DNA, 201 bp, Homo sapiens
  misc_feature (1)...(201): n = A,T,C or G, or insertion/deletion polymorphism (see Tables 1-2)
cccgcagtggtgagggcatgggcgtcggggtcacagaggcatgtctcgggcaagttaccatgactgagcttctttgcttgctgggaagttacatgtgatcntatatgtaaagcttagcccagcacctggcactgctatatgcttgacagaggggtttgctattatggttattatattgtggaacagccaggaaatctgttc

SEQ ID NO: 29866 - DNA, 201 bp, Homo sapiens
cactttataatttctttgtggtttgtgaaaagtttctaaataggctgtaagacttcggattctttcatctccttggtgcccaagcatgtggtatgtgtcargttgctacttagagacacattttcagtctcagttttagtatttacttaagcatggtgatgaaagttaagaaaaacattgaaatcaaacctacatggagaa

SEQ ID NO: 29867 - DNA, 201 bp, Homo sapiens
ctattacacgaacatgtagcaaatatgcgttggaacatgtctcatgttatttaccccagagaacccagtgttactcttgatttcatcagtgcagtcaaagyggaatgtcccatgttttcctttctttagtcaacacttctaaaatcagcagactgaagctttgcaaaaaattcagcaatatccttctgaactgtggaatta

SEQ ID NO: 29868 - DNA, 201 bp, Homo sapiens
actctgtcatctttttttcttaatagtaagagcaggtgcttccatttatcattcaaggtgtactgttgcctccttttttctttagcaaagtcagtgttaaaaaaggcttcccctgagaagtcaaaggctgctacctgacatctggttgagaaggctcggttctcttgtgagctgggaggagtttcagtggattaagcactc

SEQ ID NO: 29869 - DNA, 201 bp, Homo sapiens
ctgttcagagaaggctgagacagggatcagggaggctgtggggggcgtctaactgcctctgcttcccagtcacctccccatgcttatatcttaagctcctrtcaaccccccggtttcggacatatctggtgggactcgtttcagagcctttcaaggcttctgtaggagccactgtgttggtgctcagcttttctgctgaag

SEQ ID NO: 29870 - DNA, 201 bp, Homo sapiens
tctactgacttcctctgcttgcacgaaggtaatgttcagagaaatggtatggatgcatgggatgaggatccaactgtcttagcagttgcttcatttatttaaaaaaaaaaagagaaatcttctctcaagtttttagaagttctagcaagcagtattctttgtgcaggatccaaaaagagacacacacacacacacacacac

SEQ ID NO: 29871 - DNA, 201 bp, Homo sapiens
gcttggccatgtggccagtgctctgtgagccacagtcacttgtgacgtttgtcaacatgggtgctggaaccaggaatctgaatgtactggaaacgctgtgsagagtgtgactttctttgtattttattatctctcagtgtgtttctacacacacacaacacacacacacacacagagtccccttgccactctgccttctga

SEQ ID NO: 29872 - DNA, 201 bp, Homo sapiens
agtggctctatctcggcttactgcagcctctgcctcctgggttcaagcagttctctgcctcagccttctgaataactgggattacaggcgcccgccaccamgcccagctaatttttttgtatttttaatagagaaggggtttcactatcttagccaggctggtcttgaactcctgatcttgtgatccagccgcctcggcct

SEQ ID NO: 29873 - DNA, 201 bp, Homo sapiens
ctactgacttcctctgcttgcacgaaggtaatgttcagagaaatggtatggatgcatgggatgaggatccaactgtcttagcagttgcttcatttatttaaaaaaaaaaagagaaatcttctctcaagtttttagaagttctagcaagcagtattctttgtgcaggatccaaaaagagacacacacacacacacacacaca

SEQ ID NO: 29874 - DNA, 201 bp, Homo sapiens
aggtatgtatgtgtttgtaacttttggtgtaaacagtatttaattttaatatctatcatttacacatcacatcataaaagagtcctgctgtgaatcaaaasccttcatataggtaatggcaaataactctttgtttatgagtaaaaaatgaatagtttttttttccccccagaaatccgtgtttggtgtttgtatttgttt

SEQ ID NO: 29875 - DNA, 201 bp, Homo sapiens
tagtgactgttatttgttatgtacctgttatgtgcaagacacagtgcctgctccccaaggcactcacaatccagattcccatggctcactttttattccayttcgacatacctggggagtgtcccagacctacacactgagagaaatcgctgtctgtgtctatagttctcagcgtctgcaggggccccacgtggcaggtgc

SEQ ID NO: 29876 - DNA, 201 bp, Homo sapiens
cctctgcttgcacgaaggtaatgttcagagaaatggtatggatgcatgggatgaggatccaactgtcttagcagttgcttcatttatttaaaaaaaaaaagagaaatcttctctcaagtttttagaagttctagcaagcagtattctttgtgcaggatccaaaaagagacacacacacacacacacacacacacacacaca

SEQ ID NO: 29877 - DNA, 201 bp, Homo sapiens
tttaatccagtgacgacttcattgttatttattgaaaagcagtgacattacctcttaatgtctggggctggggagctttggagatttagtcggtgcctgcygagcccccaaaaagatgctcgtggaagattgcaggtaagtatgtgtgatgatgtggctccaaataacaccccttggcttgtaaatggagacgtatttatg

SEQ ID NO: 29878 - DNA, 201 bp, Homo sapiens
acatttaaagcagagtctaagactttgcagaggacagtggctggattcacttgagaaactcaaatctagttttgagcattttcattccacaagtagcttattttttttttactaaaatctagttttgagcattcaaactattaagtatgattctacaagtagtttattattattttttccaatctgctaacccacaaaata

SEQ ID NO: 29879 - DNA, 201 bp, Homo sapiens
gtattaaggaacatatgacattaaagcgtcacccagtgccgcggaggattatggctcttattagtggagcaaaatgtaaaacgttttggtttagtaaatcyataaggcttgatttattcataagcgcatgcaatgcttgcaaggggcagctgccaaataattattgtttatggtgagaatgtatggaaatcatttaatcca

SEQ ID NO: 29880 - DNA, 201 bp, Homo sapiens
gctctagcacgtgctgcctgtgcttgaggaattctcagtaaagattcactgagtaatcgagtgatttactgaagaaggtaaaagtgcggcttacatggtcrtctgaaatagcaaggaaaagaacagtcattgttacgaaaggaggaagcacgtgcgctctccttcacctttcctccttgagctgccagtagtgctgtgtgc

SEQ ID NO: 29881 - DNA, 201 bp, Homo sapiens
atgctgagaacctccttcctttccgcatcctcctcctgctccagctgtcagcatagctccctcttccacctgcaccaaggttgacactgtctgtgctcatrggccaggtcacaccctatctgcaccacgtggctgcctgcgccttcagtgttcatcacggttgcagttgtactattcttttcttttcttttttaagatcta

SEQ ID NO: 29882 - DNA, 201 bp, Homo sapiens
tgattccttaaggttgaaatcagcattcagagcaacttccagccaggaatgaaattggaagtggctaataagaacaacccggacacgtactgggtggccacgatcattaccacgtgcgggcagctgctgcttctgcgctactgcggttacggggaggaccgcagggccgacttctggtgtgacgtagtcatcgcggatttg

SEQ ID NO: 29883 - DNA, 201 bp, Homo sapiens
acaaatgaactatcagatgaaagaatcgtttcccttctttctctctcctctctctgttcatgtctgtgtgtgtgtatagccttcaaaagtttctcatcttscttcctacagcctattactatggaaagagaaagaagatctccaagccccccatcggggaaagcaaccccgacagcggacaccccaaacccgccaggcgga

SEQ ID NO: 29884 - DNA, 201 bp, Homo sapiens
gagggagtgctcagtgatgaataactcagagggtgggtcagtcgtttggggattctgtatccaactcagtacgggaaagggagctgggagcaaaggctttygtcagaagaacaaatagattgctttgggaaagacaaattggatttgaggaaagcaagtgagaagtaagaaagtttgtgctaatgtttgtttatgcaggtc

SEQ ID NO: 29885 - DNA, 201 bp, Homo sapiens
atctcagagaaggaaggaagggagggaggaagagagggaggcaggggagggagggaaggagggagggagggaaggagggagggagggagatctcagcattwaaaaagaaatcaaaacataaaattaaaatctcagcattaaaaaaacaaaacaaaaacaaatcatgttccacgaaatcctgttgctcacaaacctgaaatg

SEQ ID NO: 29886 - DNA, 201 bp, Homo sapiens
cactttgggaagctgaagcagcaaatcgcttgagtccaggaattcaagaccagcctggacaacatagtaagaccctgtctctacaacaaataaaatatttwtatatatatatatatgtgtgtgtgtgtgtgtgtgtgtgtgtgtgtatgtgtatatatagtatgtatgtatgtgtatatgtatgtatatatatgtcatata

SEQ ID NO: 29887 - DNA, 201 bp, Homo sapiens
cctatgctagaagaaactgataggaaattgtggcatgaatgacgtaacttttcagcatttaaattgctactttaaaatgggtacctctttgctttataacstatttttaaaaatggacttgccccactaacaaagctgattttctttttccgttttgccttttctacagcacaaaagaagagaaagattgcagtcgtgcaa

SEQ ID NO: 29888 - DNA, 201 bp, Homo sapiens
gcagtggctcgatctctgctcactgcaacctccacctcccgggttcaagcgattcttctgcctcagcctcctgagtagctaggactacaggtgtgcaccamcatgcccagctaatttttgtatttttttttctttagtagagatggggtttcaccatgttggccaggttggtctcgatctcttgacctcatgatccgcctg

SEQ ID NO: 29889 - DNA, 201 bp, Homo sapiens
agaaagtatttttactgatttctaaactgtgttttcctttttattttgctttttcttaccctttgtagcaaagataaaataagtcatgccgtttcgtatayacccctcctcttattgaccatgttttgtataacacatggattggggtatgtgcatctgtcttttagaacctaggtaggcacctctccaggttcaagactc

SEQ ID NO: 29890 - DNA, 201 bp, Homo sapiens
ttttaatcccagggacattcttttcccctgtctcttaaaatgatgcagattctggccaggcgtggtggctcacgtctataatctcagcactttgggaggcygaggcgggtggatcacctgaggtcatgagctcgagaccagcccggccagcatggcacaaccccatctctactaaaaatacaaaaaattaaccaggcatgg

SEQ ID NO: 29891 - DNA, 201 bp, Homo sapiens
ggatatattgagattgcttattgaaaataattcgtattctttgcttgggaatacaagtggaggcaaccagtatcttcagtgtcttgagtttctttctttctttttttttttttttgagatggagtcttgctctgtcacccaggctggagtgcagtggggagatctcggctcactgcaacctccacctcactgcaacctctg

SEQ ID NO: 29892 - DNA, 201 bp, Homo sapiens
aagagctgcagtttgagtctgaagcagggggagccagtgttgcagatgaagtccgaaggctgcctgctggagaatcccctcgggctttggggaggtcagcytttcaatctatttgggccttcgactgatttgatgaggcccacccacaagcaagaggatgatctgctggtcagtgtgtacttatttaaatgttagtcgcat

SEQ ID NO: 29893 - DNA, 201 bp, Homo sapiens
aaattaaccctgccaggcgtggattcagagctagagctgaatcgcccacttgctctcccctggcgtcatcttaatgccttctggagaggcagaacattttrtgtacacttggaatcactgtgctactttgccctaacagacaatgttcagttgatatttctgaatatagatgcccttaacagaaagctctggtaggaattc

SEQ ID NO: 29894 - DNA, 201 bp, Homo sapiens
tttaggacttcagaggtttgagagctaatggaaaatgaggaccccatgtaataaggggagcccagtggtgtggccatgccaccgggccttgcccttcagcrctgtcacccctgcccccagggagggcacactgaggaggctggcctactttgctgggtgtcaataaaaggtgtggggactgttcattcctgagctttctct

SEQ ID NO: 29895 - DNA, 201 bp, Homo sapiens
tcccctgagaagtcaaaggctgctacctgacatctggttgagaaggctcggttctcttgtgagctgggaggagtttcagtggattaagcactcttatttayctctttttcctccagagaccccattaaaatggtagggaaaaataaaaagtacatatatcaacaacacaaagaacttaaaggccaccagcatggaaaaggg

SEQ ID NO: 29896 - DNA, 201 bp, Homo sapiens
gactctggggaatcaatcccacacccttcaggacgggcagaggcacttccacattggatgcctctggggagagtctctttacgttttgtctgttttgaacrtattctttcttgtttgattcctttagcaattaggctaaatgttggtcaagtcttacaatattagacagaaacaatgtctatttatttaaccttgttcaaa

SEQ ID NO: 29897 - DNA, 201 bp, Homo sapiens
ttccttttgaagtactacttttaatgaccttgaaaatgttatttgtagctaaatgtaaatctggaaagataaatatatttagtagaggaatctaacctgtyagcaaaatgtttgagtagctaagaaacaaatgctctttgggtctgcggaggagaaaatgaccttgtgtaccaggaacctgcccggggacctgctttattg

SEQ ID NO: 29898 - DNA, 201 bp, Homo sapiens
ggaaaagaatttgaaatgatgaagtgagtaaaggtcccgaagaggaggaggaggaggggacagaggagtctaagctgttggaatgtcagggaaatgagcahgttctagggacggaataattaactgttgcttacaacatagccagcaagacttgattttatctagaaattatcagattagaaatggctctccatagacaga

SEQ ID NO: 29899 - DNA, 201 bp, Homo sapiens
ttcagccatctgtgcccagcgtggcctcgtctttctctgtggctttggacggtcacgctgtgcacacggatctgagtgcccatgcccatggcatcacacayggatctgagtgcccgcaccatggcctcgcacacggatctgagtgcccgcgcccatggcctcgcacacggatctgagtgcccgcgcccatggcctcgcaca

SEQ ID NO: 29900 - DNA, 201 bp, Homo sapiens
tcagatgtagaggttagaatcccccagtcctgctcttcagccatctgtgcccagcgtggcctcgtctttctctgtggctttggacggtcacgctgtgcacrcggatctgagtgcccatgcccatggcatcacacacggatctgagtgcccgcaccatggcctcgcacacggatctgagtgcccgcgcccatggcctcgcac

SEQ ID NO: 29901 - DNA, 201 bp, Homo sapiens
ttctgagctctcaagattgcccctgtgagtatacatccatcatcgttcttgggaggattgtgaggcaatacctgtaaaccactgtttcattctgtttcgtrttcctataacagaatacccgagtctgcataatttataaagaaaaggtttattcaactcctgattctggtggctgcgaagtctatgacgggcagctgcatc

SEQ ID NO: 29902 - DNA, 201 bp, Homo sapiens
gctttggacagtaagtttttggagttcaggaattgcctccttgtaccacgaacttcacattccacactgacaagcacagcacttacgtgcaaggcaggtcygctacgtgtgtagtttctgatttctgcaagtgtgtttgaggagcagtatggggatcccataagtccgtagaatttcctcataggtatttaaacacaagaa

SEQ ID NO: 29903 - DNA, 201 bp, Homo sapiens
agagagaatgaagaggaaattctcaggagccagagagggactctgtgatggacctggttccttgagaatgtgctcaagtcttaggcactgagctgctcctrgtggctgggatgaacagacaatcccatgggggtctataccgcctagcgagtttgtctactgtgttcgatgcacggggagccatccctagtagaccctcaa

SEQ ID NO: 29904 - DNA, 201 bp, Homo sapiens
ggaggttgtagtgagctgagatcgcgccactgcactccagcctggatgacagagcaagactccatctcaaaaaaaaaaaaaaaaaaaaaaaattacaggtrgacaaaaagtagtgatagtctccagaagaaggcattcttatttggccccatgtcccctggcctatctgataggatcggatatcagttctctaccagccac

SEQ ID NO: 29905 - DNA, 201 bp, Homo sapiens
agtagctgagattacacgcacgcaccaccacacccagctaattttttgtatatttagtagagaaagggtttcactatgttgcacaggctggtctcgaactsctgacctcaggtgatccgcctacctcggcctcccaaagtgctgggattataggcatgagccactgtgcctggcctattatgtataattttaaatgtagga

SEQ ID NO: 29906 - DNA, 201 bp, Homo sapiens
agaggaggaagaacaggtttggaaggagacagatttgaatagcaacagttgcattttaagatacggatggggattccaggtgaggaggcatagggagtggygggaattttgacactgaggccctcatcagaggctacaggatatgtggggacggtgaccacaaactttgcttaaacgaggagacttttagaagcaaacggg

SEQ ID NO: 29907 - DNA, 201 bp, Homo sapiens
cacatatatactggagttctctttagtactaaccaattcgctggtatttgggttgtttcacttggagaccttggagccttcacaatgaacacatggtaactttttttttttttttttaatgaggcagtgagctgcggaccaagtagatttaagaaggaaaaaggaattaatgaaggtcttcaacttctcaactcttcattg

SEQ ID NO: 29908 - DNA, 201 bp, Homo sapiens
caggttgcatgccccagacctcgtgattgggactggccagaacagacaagaccccatcagcaggatggacaagaccccatcagcgggatggaccccatggaaaaaaaaaaaatctaggaactaagacacgattgggcaggaggctgggaaacttactaggaaggatcaaggttgactttgccaccatgacctagccacgaa

SEQ ID NO: 29909 - DNA, 201 bp, Homo sapiens
agaaggttcgcctgcttgcattgtcttccttagcatctttttttggagtcttgtttctcagaatcatttttcctggacacctggctaaatatatacatgcrcgccacttacatgcacttcaaatgagacctggtagatttctagctcacgtttagcagttaatgcaagagattgacaagaacttttgggtggtttcattga

SEQ ID NO: 29910 - DNA, 201 bp, Homo sapiens
attcgctggtatttgggttgtttcacttggagaccttggagccttcacaatgaacacatggtaactttttttttttttttttaatgaggcagtgagctgcrgaccaagtagatttaagaaggaaaaaggaattaatgaaggtcttcaacttctcaactcttcattggcacactcaactaaaaactggagctcaaataacta

SEQ ID NO: 29911 - DNA, 201 bp, Homo sapiens
taatacaagttactttcagtcttaggtctctagcattatggccgcacacactggctcccacactcacagctctgcctttccacaaaccaagtgactttctrttcatttccagtcctttttttatgggacaaatacattggtccagcagttcggtatgctctcctagctctttagcccagaagaaggttcgcctgcttgcat

SEQ ID NO: 29912 - DNA, 201 bp, Homo sapiens
cttattccccagagtgttttcattgggtagtgatgaaaattagttagtgttaggaaacagatcagaaaatatacattgaccatttttccagacctgattcrttgttctaaaaagtgtttgtaaacagtctgttgagtcttatctgttgaatagtatattacctgtaattattgctcaaaatcatgcatctttttcattact

SEQ ID NO: 29913 - DNA, 201 bp, Homo sapiens
gctattaagatctgcctggggttcaattccattgctcttgacattttctctgttgcttaattccccagaccctacggcttcccacgtcttaaaaaagagtratgaacaacatttagtgtatatttaacattttgggcagtattttcttctttgtcctgttctctttgaatacagatttttgattttctagcaaagaaatag

SEQ ID NO: 29914 - DNA, 201 bp, Homo sapiens
aggttttcaagtagaatggcctctttctggaattcacgaaagtgtagacacaggcaacgtggcaacatttctgtagcttacaggaatagaacatggctttrttttcacagctccacctagagttgggtgaactgctcttggagaagcaagattccttctgtattttgtaatgactaaatttaacttgctatctaacactat

SEQ ID NO: 29915 - DNA, 201 bp, Homo sapiens
gaagtttagggttccaaaatcaatgtgaaataaatggaaattcccaaaaagttgattgcttagtaggttttcaagtagaatggcctctttctggaattcamgaaagtgtagacacaggcaacgtggcaacatttctgtagcttacaggaatagaacatggctttattttcacagctccacctagagttgggtgaactgctc

SEQ ID NO: 29916 - DNA, 201 bp, Homo sapiens
ttttttattttactttaagttctgggatacgtgtgcagaacgtgcaggtttgttacataggtatacatgtgccatggtggtttgctgcacccatcaacccrtcatctaggtttgaagccccgcatgtattaggtatttgtcctaatgctctccctccccttacccccaccccttgacaggccccagtgtgtgatgctcccc

SEQ ID NO: 29917 - DNA, 201 bp, Homo sapiens
catcactttcaaaattagagtcatttgatccaagttggagtcagacacagtatttgagctgcacggcttctgggttctcccaccttatttgatcatattcraaagattatttcctgtgtttgctttgatttgttcctcagtacattaaaatgatccacaccttgaacactgccctctctagaaggttgattttgatcagcc

SEQ ID NO: 29918 - DNA, 201 bp, Homo sapiens
gagatcatgccactgcacttcagcctgggtaacagagtgagactccatcacaaaaaaaaaaacaacaacaacaaaaaataggatatattgagattgcttawtgaaaataattcgtattctttgcttgggaatacaagtggaggcaaccagtatcttcagtgtcttgagtttctttctttctttttttttttttttgagatg

SEQ ID NO: 29919 - DNA, 201 bp, Homo sapiens
aagcaattctcctgcctcagcctcctgagtagctgggattacaggcatgcaccaccactcccgcctaatttttgtatttgtagtagagacaaggttttacratgttggtcaggctgttctcaaactcctgacctcatgatctgcctctgcctcagcctcccaaagtgctgggattatgggtgtgagccaccgcacccagac

SEQ ID NO: 29920 - DNA, 201 bp, Homo sapiens
aaatatctgagcatcatggccaggcacattgacacacacaatggaccctcacaggggatcgtgacgttttactcttgtgctgccggattggctggcttgcttgcttgcttttctttctttctttctttctttctttctttctttctttctttctttctttctttctttctttctttctttctttctctttctttctttctc

SEQ ID NO: 29921 - DNA, 201 bp, Homo sapiens
taactcaggaaatagcagaggtccaggaagagatagtggaacagaaggagatcttgactttaacaaagtccgtcttccaaaaccccagacagatgggatcrttgtgttacagagatgtgtcttcacagatggagtcgtgagtcttcttagaggaatgccttgttaggtaactgctcgtcatccagccacgttacacttttc

SEQ ID NO: 29922 - DNA, 201 bp, Homo sapiens
tccctccccccactccacgacaggcccctgtgtgtgatgttccccatcctgtgtccaagcgttctcattgttcaattcccacctatgagtgagaacatgcrgtgtttggttttctgtattttttgtaagtgcttcgtaaaaacattctgggccagggaaatgaagagatttttagtttgcgacttgtagagtgaaaagaaa

SEQ ID NO: 29923 - DNA, 201 bp, Homo sapiens
acaaatagcaccctagtagaggtagcagtaaaacatagtgactgttatttgttatgtacctgttatgtgcaagacacagtgcctgctccccaaggcactcrcaatccagattcccatggctcactttttattccacttcgacatacctggggagtgtcccagacctacacactgagagaaatcgctgtctgtgtctatagt

SEQ ID NO: 29924 - DNA, 201 bp, Homo sapiens
ttagaaatggctctccatagacagagtgtggaggactgggtgaatagatagaaggcctgaatgtacgtccaagaaaacacgaggcatgacattttagagartgggttgaagctcattagaagttagttatagaaagcccagcttaatgtctttgtgtagggaatagcggtgacttccaggtgggaaagttttatctgaaca

SEQ ID NO: 29925 - DNA, 201 bp, Homo sapiens
gggtggagagtgacttgccctcccagcaaggggcgataagcttgggaagcaattcccgcagcaacccacctgttccagctctttctacccaccagggtagrtatgtgagtttcagagtagccagagtgcccttagccaaaagctcttgtatttgtattgttgttttttgttgttgtttagagagtctcctgctgtgttgcc

SEQ ID NO: 29926 - DNA, 201 bp, Homo sapiens
ttttatctagaaattatcagattagaaatggctctccatagacagagtgtggaggactgggtgaatagatagaaggcctgaatgtacgtccaagaaaacaygaggcatgacattttagagagtgggttgaagctcattagaagttagttatagaaagcccagcttaatgtctttgtgtagggaatagcggtgacttccagg

SEQ ID NO: 29927 - DNA, 201 bp, Homo sapiens
caatcatatacaggttaaggtgaacactgtgaagtttcctcctcctttaggattttggatctgtctgttgtgcttggctctttcccagggggtcaggcatccccaccccgctaacaaagaccaggggagacaagtattccaaactcatttttcacctgagagatcctaagtctggacctttttgtagtagtaactggaatt

SEQ ID NO: 29928 - DNA, 201 bp, Homo sapiens
gttggaatgtcagggaaatgagcatgttctagggacggaataattaactgttgcttacaacatagccagcaagacttgattttatctagaaattatcagaytagaaatggctctccatagacagagtgtggaggactgggtgaatagatagaaggcctgaatgtacgtccaagaaaacacgaggcatgacattttagagag

SEQ ID NO: 29929 - DNA, 201 bp, Homo sapiens
cacagatctcatttgaggaccccaccctcataactccatctaactctaatcatctcccaaaggcatccctttggggttagggcttcaagtaagaattgtgrggagaaacatttagtccataacactttctctgacgtttactatcttttaacaacatagattcatctttcttcactggataggacctggaggagcagaagg

SEQ ID NO: 29930 - DNA, 201 bp, Homo sapiens
aaacttgggcttgaaaggagaaagatcagctgtcaattggaagagtaaggcattgcaaaaatgccccgaagtgctgctctgtgagttgtgaaactttctcrgaaaggactgagaacctgttcttagaacttaggttctgttgcatcaacatttatgcacatatctgggtcctggtatttgctgactttgaagatgattgta

SEQ ID NO: 29931 - DNA, 201 bp, Homo sapiens
agggcttcaagtaagaattgtgaggagaaacatttagtccataacactttctctgacgtttactatcttttaacaacatagattcatctttcttcactggrtaggacctggaggagcagaaggacatagaagttttttggagggaggtggataaaagaagagttgtttctctaggtctttgtttattgatgattatgttat

SEQ ID NO: 29932 - DNA, 201 bp, Homo sapiens
gatgtattacatgtggatttggctctgaaagtggaattggcctacaggccccaggccagaggtccccttggtttcttcgcgacctagagccaaacacttayttcacagtactcccaaatccccccagctgcaatcagccttttctgtagcatctgaaaagaaagtaaaataacatgtatgagcactatagagcaagggaaa

SEQ ID NO: 29933 - DNA, 201 bp, Homo sapiens
tggaagagcccttttaaattatggtaagactttggaatgtagtagttccttctaaagcttgtggtccctgatagttttattttctctgttgacagattgcygcccacagtgcctgttaagaaaatacctcatgacctttgtttattccctcacctggacaccacaggtaatcagtcccatttagggggtctctgtgccttc

SEQ ID NO: 29934 - DNA, 201 bp, Homo sapiens
tgtcattgaacataatggttaagccaactgtccatggtttaatgacatccacagaacagaacagaatagaacatcagccctctgcctacttaaaatgtgtktttatgaggcccatggtacctggaagactttgagtccctacacccatgccctcttggtgtaatttgatgtattacatgtggatttggctctgaaagtgga

SEQ ID NO: 29935 - DNA, 201 bp, Homo sapiens
gtgagctgagatcgcaccattgcactccagcctggcaacagagtgagacttaatctccaataaaataaaaagttttccataccaaatccttttccacttgaaaaggcaccttcttaaccagtttccattttaaatgcttaaggttttatctgtttcatgttgctttttaaaaaaataatcttcataatgacccatattaca

SEQ ID NO: 29936 - DNA, 201 bp, Homo sapiens
tcaggctttcttgggccatccaaagaattggacaacaacttttctgaaatgctgttttcatctggtcttactggcattgctcccatacacacattctattstatggtcctcttatctgagatttctggaagagcccttttaaattatggtaagactttggaatgtagtagttccttctaaagcttgtggtccctgatagtt

SEQ ID NO: 29937 - DNA, 201 bp, Homo sapiens
agtttgtctggttctattttcatagactgggctgctgcctggggccagctgtagatagtagcctcgggtcctcctgctcatctcccttgaaccaggctgtygtctgccctctgtgagctgctcactgctcagctctggctttcagggctctttcaggttttggttttttattttttactttttttttggtgtctggagatt

SEQ ID NO: 29938 - DNA, 201 bp, Homo sapiens
cctgataaggcattttgcattaaagttcatttctctgccctccctcaagttggttagtttccttatgtggtttgtgattgttgattatgaactaatttcaktggtggttgttatttatgtggcagttccatgtgccctggattgaagtcatctctatttatttgttactgtctctatccatccactaggaaataaacttca

SEQ ID NO: 29939 - DNA, 201 bp, Homo sapiens
tcttttttcctgataaggcattttgcattaaagttcatttctctgccctccctcaagttggttagtttccttatgtggtttgtgattgttgattatgaacyaatttcagtggtggttgttatttatgtggcagttccatgtgccctggattgaagtcatctctatttatttgttactgtctctatccatccactaggaaat

SEQ ID NO: 29940 - DNA, 201 bp, Homo sapiens
aaatccactcatctataactaagcacatacaacactctaaataaaattttacctatgcattcagctttcatcagtcagagacagcgcaataagcagactgytcaaatgctcaactgaccttaatgaaaaaatttcaggatagtttataggcttagtccagattaagctgtcctttctctacttctctagatctcaatacct

SEQ ID NO: 29941 - DNA, 201 bp, Homo sapiens
gagtgtgtgtgtttgaagttgtgttaaggtgttcagattcaggatcattagactggcggaagcactcttttttcctgataaggcattttgcattaaagttyatttctctgccctccctcaagttggttagtttccttatgtggtttgtgattgttgattatgaactaatttcagtggtggttgttatttatgtggcagttc

SEQ ID NO: 29942 - DNA, 201 bp, Homo sapiens
acttgaggtcaggagttcgagaccagcctggccaacgtggcaaaaccctgtctctactgaagaaaaaaaaaaaattagctgggcgtggtggtgggtgcctktaatcccagctacttgggaggctgaggcaagagaattgcttgaacctgggagggagaggtagcagtgagccgagatcgtgtcactgcactccagcctggg

SEQ ID NO: 29943 - DNA, 201 bp, Homo sapiens
ggttgcgtgtgtgtgtgtgtggtatgtagtgtgtggtgtgagtgtgtgtgtttgaagttgtgttaaggtgttcagattcaggatcattagactggcggaascactcttttttcctgataaggcattttgcattaaagttcatttctctgccctccctcaagttggttagtttccttatgtggtttgtgattgttgattatg

SEQ ID NO: 29944 - DNA, 201 bp, Homo sapiens
ccgagacaggcagatcacttgaggtcaggagttcgagaccagcctggccaacgtggcaaaaccctgtctctactgaagaaaaaaaaaaaattagctgggcstggtggtgggtgcctgtaatcccagctacttgggaggctgaggcaagagaattgcttgaacctgggagggagaggtagcagtgagccgagatcgtgtcac

SEQ ID NO: 29945 - DNA, 201 bp, Homo sapiens
tactctcttgtgagagtgcagtatatttatttttgtaattaaactgaatgagcatttagaggaggaggtggtggtggtgattgtggtagtggtgttttacrgtttccttttgaggtggttggtttcacatcttgcatctcaacaccaggattaagagtcatattgtagagatgtttcaaagaccattcttcactttatgaa

SEQ ID NO: 29946 - DNA, 201 bp, Homo sapiens
ttgttgtgtgggtgggtgtggggagggatgcgaggagcttaatttttattcttcactaaatagttacgtttaaggaaagcagtattgcacttgatatttayatatgatggcaagacagtgccatctcttcaagcaatgtttgttgacgtttttggattcccatatataaaatcagttccttgtggataactataaaaggcg

SEQ ID NO: 29947 - DNA, 201 bp, Homo sapiens
taatgttcctccttcttagtaattctagagagtttggggggcctaaagcaacctaattcatgtcagtggaccatggctttacacaattcagatggtcaatrtatcaaagcagtcagagaattacaattttagggaataattttacaagggtctgtggttaaaagacagtcatggcttcattcattgactcccttactctct

SEQ ID NO: 29948 - DNA, 201 bp, Homo sapiens
  misc_feature (1)...(201): n = A,T,C or G, or insertion/deletion polymorphism (see Tables 1-2)
cacgaggaacatacggtgttcccagttgtgctgtttcttttgtttttttttttttttttttttttttcgaaaatgcaacaaaagcaataagcaagaaccgncccaacgtgggtcctggagtccctcttcaaaggcacggagagggaagtctctacacatagggtcaatggagggcctagaaaaaccaacagccattcaagg

SEQ ID NO: 29949 - DNA, 201 bp, Homo sapiens
gtgtttttggggtatgagggacagaggtggggaatgtggcataagggatgaaggtagacatgacgtgtaacaataccatttttatctttttttcttttctrtctaaataaatgtgttacctattaaaaggtaacacatattattaaaaatggagggtttttataactgaaagggatcctaaagatgatttcatcaacctta

SEQ ID NO: 29950 - DNA, 201 bp, Homo sapiens
atattggttaaatagactttggagatccttctaatgagatctgtgccattgttgaaaagaatgagggacgtctctatgaactgatgtggaaggctgtccargatacactgtgagtggtacagtaggtatcgtatgacacttcctatgttagagaagaggcaaaacagtacctatgagtgtttgcttatatttttgtagtta

SEQ ID NO: 29951 - DNA, 201 bp, Homo sapiens
ggccaggctgggaaacgtccccagagaggagatttatggcagctttactcttacgtctctctcctgggaggagaagctgcccccaaagagggaatttatgrcagtctccatttctctaaagtttctattttacagcagataatgggagctccaacaagacttcttgctgtatctgtcgaatctcaactatcttgagcttaa

SEQ ID NO: 29952 - DNA, 201 bp, Homo sapiens
cataatagcaaaggcatggaatcaacctcaatgcccatcaacagcagactggataaaggaaatgtgttacacatacaccatggaatactacgcagccattaaaaaaaaaaagcaagatcatgtcctttgcagcaacatggatgtatgtccctggaggccatcctaagcaaactaatgcaggaacagaaaaccagatgctgc

SEQ ID NO: 29953 - DNA, 201 bp, Homo sapiens
ggatcgtaggtctccaggcagagcttgggtcctgggactgtgtcccctggtagcggtgaggactccaggaggccttggtgtttgtttctctgttggtacayactggctttgcaccctgagccacatcactgcttcagttttcaagactgtccagtggagacacctgtgggagtccccaggtgccagcagagttaaaatgag

SEQ ID NO: 29954 - DNA, 201 bp, Homo sapiens
gcctggacaacatagtaagaccctgtctctacaacaaataaaatatttatatatatatatatatgtgtgtgtgtgtgtgtgtgtgtgtgtgtgtatgtgtrtatatagtatgtatgtatgtgtatatgtatgtatatatatgtcatatatacatatgacattcagtcctcttggttgattatgggagctgttgtacacaat

SEQ ID NO: 29955 - DNA, 201 bp, Homo sapiens
cagaacacagtttaccagtcactgtttttaatgcctaattcattcactcctcaaagtgaactatgaagaatctaagtcacagagagtttatataacttgcrcagggtcatttggatcgtaggtctccaggcagagcttgggtcctgggactgtgtcccctggtagcggtgaggactccaggaggccttggtgtttgtttct

SEQ ID NO: 29956 - DNA, 201 bp, Homo sapiens
ggatgcattaaaataattttaaattgggattcaagaaccacattgttagtgagtgccagtcttagagtttaccagtgtggtttgttgtcctctataggtcrggtttattcaggaagaaagcagtaagatgagaggtgagactaagagaagaataataaaggtatagtaagaagaagaaaattggaaaaagatgagaaaagt

SEQ ID NO: 29957 - DNA, 201 bp, Homo sapiens
aagtttgtagtagtagtgggggcagaaaacataagcaagtgtttataatggagaaatccttcttattttaaaacttttctgcaaaattcaatacagtccaygtacacctaatggacacagatataataaaagtacaaaaatcttagctcccattaaaaccttccctgcctctaaataagccagaaactcgctcccgctcca

SEQ ID NO: 29958 - DNA, 201 bp, Homo sapiens
gctaagtgattgagctcaaagacttgaaagtgtctgagaagtggctttacaaatgtaacacaatgttggtgaagcatttctttagagtgtttatttccagygagctaagctttctccagagtcaatttgctttcagatatccgacaattagatgctataatactttaaaataattacactgggagccaggatgcattaaaa

SEQ ID NO: 29959 - DNA, 201 bp, Homo sapiens
taaaacttatttatggtctaatcataatctgccaaatcaccaaagtggaagagaatatatgtaaataagaagagggtttatttgcagaaaatggcaggccrattaacgatgctgctacatttcatcatttccttctttctcaagaaatatttaagtgagcttcacctatagctcagagaaaaacatgtttttctaatattt

SEQ ID NO: 29960 - DNA, 201 bp, Homo sapiens
tgatggtccatctgatttttaccctctgctttgtttatcggcatgtcttgttcttatttcttcattgatgtttcttcttatattcagtggacatttatccygttcctatgtacaaagcactttctatgcatttggaaatacttgtgttaacaaaaagacatcactctcctctaataacttatgctctatggcattggaaga

SEQ ID NO: 29961 - DNA, 201 bp, Homo sapiens
actagttgacttcttaatggtcattgagatgtaacatttgagaaatgatgtttttttaaaagagtaaaacagttttcagtggctagaggatatctaagcckcctttagagaaggcacctgccctattcatagtgaaaattgagaaatatgaaataatttgtatgatcggtaatattttcctctatagttaacttatactag

SEQ ID NO: 29962 - DNA, 201 bp, Homo sapiens
  misc_feature (1)...(201): n = A,T,C or G, or insertion/deletion polymorphism (see Tables 1-2)
attcaatatccgatgcttttcataatttaattgctgcctgctcccaggctgaattgaactccagaaggcattttcttttcgcagtcacaaaatgcatctcnatatgcagcaaataacatgcagctctggggttttctcagcgaaacccaatgaaaagaatctgttgaaattttattgtctgttgataaacactgtgtgcgt

SEQ ID NO: 29963 - DNA, 201 bp, Homo sapiens
ggggccaggaatcatagctttgtaaaactctcaaggtttcctaagaaagactgggttatgtctgttgaattgggaaagggatctttttttctggcctgttktagatactaagttacttaaatccatcttgcttttcagtgatggtccatctgatttttaccctctgctttgtttatcggcatgtcttgttcttatttcttc

SEQ ID NO: 29964 - DNA, 201 bp, Homo sapiens
atggtgccagtgcactccagcctgggtgagagcctgtctcaaaaaaaaaggaaagaaagaacaggtcatccccctacccagccatccccaggtctgtcacrtggagctcaaacccctgtccactgtgcctgggaagatcgtgtaaggatcaagtgatcaaatgctgtaagatccttgagaatatgtcagtagcttcattac

SEQ ID NO: 29965 - DNA, 201 bp, Homo sapiens
tccccactggaatttccaggaagagacgctgaaggccaagtaagtgttttcaattctggaaagcaagggtttttgtaatacttccccatgctactttgaamcttgccacttctctttgtgacacagccctgagaaatggaacaaactgaaggacgttcgttctgcagttctatgggcgacacgtaaatttcttggcatttt

SEQ ID NO: 29966 - DNA, 201 bp, Homo sapiens
atttattgagcattcataggctcaattctggacaatgttcccattgtggagcttttattttaatggagggagacagactataaacagaatcaataagtaartaaatctagtatgttacatattaaatgctaaggagaaaaatacaccaaggcagggatgttggggtcctgggactgtgccccccggtagcagtgaggaccc

SEQ ID NO: 29967 - DNA, 201 bp, Homo sapiens
ttttctagccagagagattgtattttaccacgctttttgtccatggatggtgaaacaactcagtgttagcctggcaagtgttctatcagacttaatcacgkttcttcacttcatgtgggtgtagtggcgagctgttcctaaatgtcagtggtgtggttttcaaagcatccttgtgttagtaggaatgaatgcaattgcagc

SEQ ID NO: 29968 - DNA, 201 bp, Homo sapiens
acctggtgttttctgaagacaccctgctgtgttaggatgacagattgcctcccttactctgctgtgcttcagttaatagcaccaaggacgagcaaagcagwgtcatgtgaacttttgcttagtgtaaatttaagcatggccaggaagccttgttgcctctcccttggaaaagcaatttagcctgcagaaaataattaaatc

SEQ ID NO: 29969 - DNA, 201 bp, Homo sapiens
ttgctttttgaaaggtgagcaccttaggggtctgaggtccttgtccctttcattagagaaactcattgaggttaacaggaacatcgtatctccccagggtyagcagctggaactcttagaaatgcctgctctttctgagccccatggtagacacatgcttgttttcttggacttgggagtgaggggtggatgggggaaata

SEQ ID NO: 29970 - DNA, 201 bp, Homo sapiens
tggtacatatataccatggaatattgcatagccataaaaaagaatgcaagtatgttctttgcagcaacatggatggagctgaaggccgctattgttagcaractaatgcaggatcagaaagccaaatacctcatgttctcgcttagaagtgcgagctagaccttgagcacacacggatgtaaacatgggaccagtagacac

SEQ ID NO: 29971 - DNA, 201 bp, Homo sapiens
tcgatatgcagcaaataacatgcagctctggggttttctcagcgaaacccaatgaaaagaatctgttgaaattttattgtctgttgataaacactgtgtgygttattgcagtcagtactaattagatttatttttaaactgagtttctgtaaattgtactgacagtaaacaataaaatcagatgattattctaatacagaa

SEQ ID NO: 29972 - DNA, 201 bp, Homo sapiens
ttggagcaagagttttgtggaacagagagaagcacagaatctggaatggagggaatgaagagggcgggtagaccagaagccccgtggctgtcaggatgccyctagagcagagactctcaggaaagccggggtgatagaggcagccagggagaagacccatgcttgtccccgtgcaccagacctcaggaatgcctcaccctg

SEQ ID NO: 29973 - DNA, 201 bp, Homo sapiens
ggcttgtttttttgctccagtgtaactctccaccccgtttgctgagatgctggtgagaccagggcactcagctgaggtccaaagactgggtgtgaaggcgyagaccagcagaatcaaagaagtagtgcggcacccctgaaccagaatgcggtgtgccccggacccccggccctgagtcagagacgccccactgcaaatagt

SEQ ID NO: 29974 - DNA, 201 bp, Homo sapiens
cttctaccccaacctctcccggagtaccagggtccccaaaagagagataaaccatgatctatgtcatatcaggagattgctcgcctcctatgaccaaaagrgtcttgtcggctgttgcgttcctttgcattgcacgaggtgttcaggaaatttttgccttgtaacttacataccatctcatgaatcaccaggcctgtagtc

SEQ ID NO: 29975 - DNA, 201 bp, Homo sapiens
agtctcgggtacatctttatcagtgaaaatggactaatgcatacctattttgttctgttaaagtcctactcatctttcattttcaaatatagattccccaraggagtccttccctggacccctgaccctggcccagatgaacttgagcctctgttggtgtccttcagcagcttgttctgtcacagttatgcttaatcattt

SEQ ID NO: 29976 - DNA, 201 bp, Homo sapiens
  misc_feature (1)...(201): n = A,T,C or G, or insertion/deletion polymorphism (see Tables 1-2)
tctgtgaatggatttccactagggcaatgttgtctgcctgtatttctgcctgtttttgttgtgagtgataggatgaggacacaacaactgacaaaaatacngagagctgatgggcttcttcgaagctgcctgcaagcctgtttcacgtgacgtgttccgttgttgaaatgacaccttcccttatctgccagctctgttaac

SEQ ID NO: 29977 - DNA, 201 bp, Homo sapiens
cgggtacatctttatcagtgaaaatggactaatgcatacctattttgttctgttaaagtcctactcatctttcattttcaaatatagattccccagaggartccttccctggacccctgaccctggcccagatgaacttgagcctctgttggtgtccttcagcagcttgttctgtcacagttatgcttaatcatttgtgca

SEQ ID NO: 29978 - DNA, 201 bp, Homo sapiens
atgccctgtgtgtaggtagagaaaggctgaggcaggacacagtggggcaacagatctgtgtacgagcgacacctcgctctggggagtgtgtgtctgtaaakggtgtgtgtgtgtgtgtgtgtgtgtgtgtgtgtgtgtgtgtttccctttatggaaacctgtgctgtcgttggcatatctgtcttgagcatcttctcaccc

SEQ ID NO: 29979 - DNA, 201 bp, Homo sapiens
cgctgaagtcattacccataagcatttccaatacagtccgcagccctgagtggatagggttatctcagggacacattgctgtctgctgtatttccaagcarcggcagccactgcctggtgtctgctagatgactgtgaacacaggaagtcctcagagagggcagggcttctggggacacagagtttccacacagcacgggg

SEQ ID NO: 29980 - DNA, 201 bp, Homo sapiens
gtgtgtaggtagagaaaggctgaggcaggacacagtggggcaacagatctgtgtacgagcgacacctcgctctggggagtgtgtgtctgtaaatggtgtgtgtgtgtgtgtgtgtgtgtgtgtgtgtgtgtgtgtttccctttatggaaacctgtgctgtcgttggcatatctgtcttgagcatcttctcacccatcctaa

SEQ ID NO: 29981 - DNA, 201 bp, Homo sapiens
cacaccaaccagttcttcaactctctggacagcaagtgaatatcctgcagtttaattcatttctgacactgtctgaaagcagtgcagaccccacaagtgargggctcggtaccataagatgcctccactttgatgccagttacaagtcctgggcttcctgtacttgatggctataaattagggttcctgaaaccccctcct

SEQ ID NO: 29982 - DNA, 201 bp, Homo sapiens
acaaatacctgtgtttggatgctgcaacctctcagaatgtctggcttctcttttcagtatatgaaacaagagtgtttaaggggttttgtgtagtttggaargaaaaacagatgcatttctgtgagtaagaagtgtcttgactataacttacgaactgtttttacccacaacacttctaacatcacatgtgtgggttttttc

SEQ ID NO: 29983 - DNA, 201 bp, Homo sapiens
gtccctggcccacatgagcgtccagtcgatgggaaagatgagtatgtaaatagaaggtagccacgtggtcccaggttccaggacaggacctggcatgcacrctgtgagatcacaccggaggcatctgcaatctgtggggactgcggaacaggtggcctgcccctggtagggagaggagcaggaacaaggctggggcatctg

SEQ ID NO: 29984 - DNA, 201 bp, Homo sapiens
cacatacagcatggatatctttcatgttttttaaagttctccaatggccagaagtttcagtggcaaaccccgtcagaaaatattgtcacgctcttgcagtmaaacgtttctgaaatcgtcattcatcaataatataaacattagagtagcaggtttagccaaactcttaattgttttgtctttattcttgagtcttctcaa

SEQ ID NO: 29985 - DNA, 201 bp, Homo sapiens
tattattcttatttcatagttgaagaaagtgtgtttgttcccagatcaggcagtttgaagtagattttaagctaagaggattctggccagttctgaaatcratgctttgaaaatagcaggaggtctgtaaatatttgtttattgattagattatatcattaagactttagattaaaatggtcagactgaatatcactgaga

SEQ ID NO: 29986 - DNA, 201 bp, Homo sapiens
tggcttattttaacaggattttttaaaaagctgtgggctcagtttctgaaggagggaataggcattggaagcagttcagctggcatttaccgagacctccrttctctccatcctgtgggctgaagccagagatacacaaatggaaaaatgatgctctgacccatgaaaggctccccatctagagggagggacacacatctg

SEQ ID NO: 29987 - DNA, 201 bp, Homo sapiens
ctttgacaaatggagggtgttctgtgtattccatgcaatagctgttagtctcctgtgcggtgcctcagtggtttctgatcagtgcttattggatgaatgakagaatataggattggaatggatgtcaagacatcattgggtttttgtcatcccttcagtttaattcgataaatatttatggaagcctttcttgggtgagcc

SEQ ID NO: 29988 - DNA, 201 bp, Homo sapiens
ttttcctgttttatataattcaaactttagaatggttttaaaagaaccatgacagctaccctttcatagtctataattgtaattttactccttttcttttrtatccagaagaataacatttctgcttcctacctctgctggttcctagttgaagtctttatgagagcaagccttcctagactgttaaattaccatcccaga

SEQ ID NO: 29989 - DNA, 201 bp, Homo sapiens
ctcctgagtagctaggactacaggtgtgcaccaccatgcccagctaatttttgtatttttttttctttagtagagatggggtttcaccatgttggccaggwtggtctcgatctcttgacctcatgatccgcctgtctcagcctcccaaagtgctgggattacagatgtgagccaccgcgcctggcccccagaatcttttat

SEQ ID NO: 29990 - DNA, 201 bp, Homo sapiens
ctgcacgatttgaatgagaagagcagctctgtaggtatttttttgtgggtttggttctaaatgcagtttatctggctcataaccagactccacgttatccrcctgatggggaagtagagagatttcataacacgcctgtgaccgaatccaaacttgaatccatcactccttaaatgcacagcccgtggattaacggttctc

SEQ ID NO: 29991 - DNA, 201 bp, Homo sapiens
gattgcagtcgtgcaaccagagaaacagtacgtgcttttttcccctccagactacactgtataccgataaactgtagtgtctttatggaggatgggaagcrtggctgtttttattggagttatctaacaaatagcaccctagtagaggtagcagtaaaacatagtgactgttatttgttatgtacctgttatgtgcaagac

SEQ ID NO: 29992 - DNA, 201 bp, Homo sapiens
ctttttccaaaccttcgttttctctgaaccccttttattcctgcctttttatatttcaaggagttttgtctctgataagattaaagactcctctaaagtcrtctcttccatatggctattttgtttttgtttttgttttttaatgtataaaggaatgtttttccccatgttagggatgctctattattgttgtccttctat

SEQ ID NO: 29993 - DNA, 201 bp, Homo sapiens
gctgtttcctcattgagtgaaaaaaaggaaaagtatttatatcagcattttggctgcttgatcactccattatggcagaggtttcatagttgtcaatgttktcagaattttaagatacattttctatgaattacataaaaagatcattgacatagcttagaagttcaccaggaaaatggatgtgcctatttggatacttga

SEQ ID NO: 29994 - DNA, 201 bp, Homo sapiens
aggtggcttctgagctttcaggatttgtccaccaagatgctctctgtttggatgaatctgcgggcatgttcaggaggaatgtctttgtttctggcactccrtttatgtaatagataggattgttgacgtatgcatcgcattggtgatgctttgctgaatttgttagcttgctataagtgctctttaacggaatgcgtatta

SEQ ID NO: 29995 - DNA, 201 bp, Homo sapiens
ttgaaatcaacaaatttattggattagcttaatcggaacgagagaggaaagagtccatgaccttgaaaatagaaattattttgtctgaaaaacagaagatsggcagggaaatgaaggacaaatggaatctcaggatctgagggacaattattatgtagaattgaagacccaaaagaggtggctgaataagaattaaaaaag

SEQ ID NO: 29996 - DNA, 201 bp, Homo sapiens
gaatgagaccctgtctcaaaaaaaaaaaaagaagatggggattgaaccccagcagatcttaatggcttagctagtttccccacctgtaaaaatcaggacaytcttactgctgtttgtgttaggtaattaacagccgtaaagcatgctgaaagtagaaactgctaaatacacacagaggcctgaccacatgaggacacaggg

SEQ ID NO: 29997 - DNA, 201 bp, Homo sapiens
catggagggtctgaaagaccctgggccttgaatctccatgtcagcccgcaaaacactgaggttagactctttaaactttactttcttcatctgaaaaatgaaaagtgcttcctattacttaacctcccagaatggtggtaagaatgaaaaggaattccatatattggctctcagcaggtgtgactttactgttctctgcaa

SEQ ID NO: 29998 - DNA, 201 bp, Homo sapiens
acgtaccctatacacacatgtgaggagttgaaggagtgagccaatgggaaattacagatgcccaccctccggtctaagcctcggagctgccaggccagtgragcccccgctgcagccccaggtctgcctccctgcgggaccagggcacccggggcctcacagctgtgcgggtcctgcctgtgcctctctttgtggcgttcc

SEQ ID NO: 29999 - DNA, 201 bp, Homo sapiens
aacggctaccaagttctttacacttcaaaaattatgcttcacacttacgtgaaatagaatattaggttctggacaaagatggtccattcaggttcatccarggaaatcataaaacaggcccatggagtgtgggcggcgacccaacaccattggcgtccttggacagttctcaatgtggttgtgacgggcagacatccagtt

SEQ ID NO: 30000 - DNA, 201 bp, Homo sapiens
gtttactgactttctttgtagcatattgttatggaaatattttcaccccctcacttcctactacagaaacaaaaggaaatatagcaagtctaattttgacrtttagtaaaaatgacagaaaatgactcatctcgtggtggttcagttttcttgatgtcccgaggttctgctaagtaccaggccttccaccaggtgctcccg

SEQ ID NO: 30001 - DNA, 201 bp, Homo sapiens
tactaaaaatacaaaaattagccaggcgtgtggtgtgtgcctgtaatcccagctacttgggagtgtgaggtaggagaattgcttgaactggggaggcagargttacagtgagctgagatcgcaccattgcactccagcctggcaacagagtgagacttaatctccaataaaataaaaagttttccataccaaatccttttc

SEQ ID NO: 30002 - DNA, 201 bp, Homo sapiens
accctttttgagaataaaatcatctacaaagttttccggccgggcgcagtggctcatgcctgtaatcccagcactttgagaggctgaggtgggcggatcaygacatcaggagatcgagaccatcctggctaacatggtgaaaccctatttctactaaaaatacaaaaattagccaggcgtgtggtgtgtgcctgtaatccc

SEQ ID NO: 30003 - DNA, 201 bp, Homo sapiens
aatcccttattgatgctgccaaatttcctcttccaatggaagtgtttaaggtaagatgttgattcttagcaatgtatctaccctttttgagaataaaatcrtctacaaagttttccggccgggcgcagtggctcatgcctgtaatcccagcactttgagaggctgaggtgggcggatcacgacatcaggagatcgagacca

SEQ ID NO: 30004 - DNA, 201 bp, Homo sapiens
acagatccaaaccatatcaaggtggaaccttggaatagaatgaaatgatgctcttgcaaagaaaccctgtcctcatgcaggggagcagcctacgttttctrtctttgggcctaatagcagcggctttgaacagatatccatacgtttagtaggacatttgactaccatggcattttgcatccttgtaagctttcatctaaa

SEQ ID NO: 30005 - DNA, 201 bp, Homo sapiens
ctctattaagtttattcttcatttctgacagcagaatcccaagttgctatttaatttcagaaagtcctttcagcaggtggctgctcatggtgggtatgggstgtgaacactcacggtcactgaccgtgctgaggtatcaggaaagcctgggaattagcatgcaggaaagagtcacccggcagaacgtgttagtccttcaac

SEQ ID NO: 30006 - DNA, 201 bp, Homo sapiens
tgaagaagagctctattaagtttattcttcatttctgacagcagaatcccaagttgctatttaatttcagaaagtcctttcagcaggtggctgctcatggygggtatggggtgtgaacactcacggtcactgaccgtgctgaggtatcaggaaagcctgggaattagcatgcaggaaagagtcacccggcagaacgtgtta

SEQ ID NO: 30007 - DNA, 201 bp, Homo sapiens
tgttgtcataactgcaaatgccagactagagtcgtttgtagtttagaaatgtatcagataataagttcctcatcagtgggcattgctttcctaggtgatakgtggaattttggcccatggatgactgaaggtttttgctaatgtgattaataccattaaattacttacagaatgccaactaaatgcatacaaatgttccct

SEQ ID NO: 30008 - DNA, 201 bp, Homo sapiens
gatcttagccaaaaggccgagaagcaatgtgtcaggatttttctataaaatgataaaggtcttcagtggaacattcagctttgcctatgaactttttgcartcctcaaataatcaaggagaagcattgtggacattcttttaatagattattttgcatgctattgggtctcctgtcttggaaaataattagtctgagtcca

SEQ ID NO: 30009 - DNA, 201 bp, Homo sapiens
cagcaataggtaaaaacagtgctcaacgtttttttttttccttttaattttgcattcagactgtgtaacctccatctgtaaatcttgccccccctcccacygcctggggaaaaatatgggcaacatgtggtgtgttaagcaacatttcaagtgtaaatattaaacttggtaaattttaatttaccttttaataattttctg

SEQ ID NO: 30010 - DNA, 201 bp, Homo sapiens
accacacaaaacagtctgtaagtggttcccagttgagggggggtggatgacaccagtgatctttgtgaataaattggcagcttcataaagaaattataacmaagttctaaagaacaaataagatttttgattttccaccaagaacccatgttttcatgatctcgcttaatctttaagtgtttgcatgagatgatgtcacag

SEQ ID NO: 30011 - DNA, 201 bp, Homo sapiens
aagctgattttctttttccgttttgccttttctacagcacaaaagaagagaaagattgcagtcgtgcaaccagagaaacagtacgtgcttttttcccctcyagactacactgtataccgataaactgtagtgtctttatggaggatgggaagcatggctgtttttattggagttatctaacaaatagcaccctagtagagg

SEQ ID NO: 30012 - DNA, 201 bp, Homo sapiens
tattttgatgaaaagaattaagatgaagtagactgggtatagtgatattttatcttttaatctgttaggtgatttctgtgactagaacataaattatgtgaaaatctagatttttaactaaatagttaattttgctgaaaggaaggccaaatagataaagataaaatcatttatgacttacgtctttatctgattactcat

SEQ ID NO: 30013 - DNA, 201 bp, Homo sapiens
aaagctcaaggtgagttcaaaagctatgaggatcaaaatagatcgcttcatgctaaaaagcagacatgcaagaaattaaaaatacagtcccaaaggtttaytgttgctttttaactgtgcttaatttcatattcatatcctaagcgtctgtctgaagtagcctgggttgatatattgaaggcataaacatatctacttcca

SEQ ID NO: 30014 - DNA, 201 bp, Homo sapiens
gaatatatgttatttcccccttttaaacagatggtagcatactatatatgcacagtgttctgcaccctgccttttatactcggcagtgcatcttggagatstgtacatctgagtatattaagaggtgtctgattcttttttatagctgcagaatattccttcatatggatatacccagatttacttaagtgctttcccata

SEQ ID NO: 30015 - DNA, 201 bp, Homo sapiens
tccctgtggacacccactgtgttagtattttgcatttccttccagatttattttatgcacatatgaatatatgttatttcccccttttaaacagatggtarcatactatatatgcacagtgttctgcaccctgccttttatactcggcagtgcatcttggagatgtgtacatctgagtatattaagaggtgtctgattctt

SEQ ID NO: 30016 - DNA, 201 bp, Homo sapiens
acctgcaacacgatcattttaagaaaatggtcgatgttctttgaatggtactatttattgtccattaacttgctagtataaccagcatgactccatctcayggaatgcacatggggactgttgttctctgctggttgtgtcaggctgtcaaaactgcagttgattttcaccttttcatgaaagaagtctgccttgctgtgg

SEQ ID NO: 30017 - DNA, 201 bp, Homo sapiens
ccaggtttaaatccttcagctgccacttgccggccgctggatttcttccggtgcctcagtttactgatctctgaaatggggatgaaaacaccccgtatctyttagggttgttgtgaggattgaacgcttggaatggagtaagcactgtgtttgctactgtgtgggtctctctcctctctcccctccccacaccccccccat

SEQ ID NO: 30018 - DNA, 201 bp, Homo sapiens
gacagggtctcactctgtctcccaggctggagtgcagtggcatgatctcggctcattgcagcctcaacctcccaggttcaagtgatcttcccatcgcagcytcccaagtggctggaactacaggcatgtgccaccatccctggctaattttttaatctcttattttgtagagatgggatctcactatgttgctcaggctgg

SEQ ID NO: 30019 - DNA, 201 bp, Homo sapiens
aaagttttccataccaaatccttttccacttgaaaaggcaccttcttaaccagtttccattttaaatgcttaaggttttatctgtttcatgttgctttttwaaaaaataatcttcataatgacccatattacaagatgctgattaaaattgtttaggtttactgactttctttgtagcatattgttatggaaatattttca

SEQ ID NO: 30020 - DNA, 201 bp, Homo sapiens
aaagatagccgcccaccccaggtgctttctaaggctctggagctggactgcccaggtttaaatccttcagctgccacttgccggccgctggatttcttcckgtgcctcagtttactgatctctgaaatggggatgaaaacaccccgtatctcttagggttgttgtgaggattgaacgcttggaatggagtaagcactgtgt

SEQ ID NO: 30021 - DNA, 201 bp, Homo sapiens
atctacttgccagtgtacaaatttacagcaaagcaaaggatgactagtggcttcttatgttctctgtgatgtttctttcctgggaagttatgggactcacrctcacgagcaggaatggaacatgcctccgtggaagcttaggaaatactcgcttatgagctgtctccctctttagataatttggggtctttataatatatg

SEQ ID NO: 30022 - DNA, 201 bp, Homo sapiens
gaaataaaaacgaggaaggaaaaagatagccgcccaccccaggtgctttctaaggctctggagctggactgcccaggtttaaatccttcagctgccacttrccggccgctggatttcttccggtgcctcagtttactgatctctgaaatggggatgaaaacaccccgtatctcttagggttgttgtgaggattgaacgctt

SEQ ID NO: 30023 - DNA, 201 bp, Homo sapiens
ctgccttggatgagagagagagagagggagagaaagagagagagagaaagagaaagagagaggaactttgactgtgcttgcacctctgtggctgtgttttkgggtctctttattatgcagtctagctgtgatgcagtatctcatagtcatcttaatgatcttaacgactatgagggccagtggagcttgcccttggtattt

SEQ ID NO: 30024 - DNA, 201 bp, Homo sapiens
agcaccatgtttttacaggcggtcctgtgaactttgcttgctcagcgtttgctgagtagatctgaggaagaaataaaatgtgtattcctaaatgaaatagygatttaagatacagcagtccattaagaactgctgtttggccaaccgaatttggggacagtgagatcttttatactggaagctaaaattcagaaactcctt

SEQ ID NO: 30025 - DNA, 201 bp, Homo sapiens
gggtgaggcccacccacgtcagggaggacggcctgctttactcaaagcccagcaattaaaatgttaatctcacccaaaatcaccctcccagaaaaatccgragtcgcattcaaccacatatctgggcactgtggcccaggcaaggtgacataaaattaaccatcacagacagcaacctaaatactgttgaacaagaggcca

SEQ ID NO: 30026 - DNA, 201 bp, Homo sapiens
tttccagcttcatccatgtccctgcaaaggacatgaactcattcttttttgtggctgcatagtattccatggtgtatgtgtgccacagtttctttatcccrtctatcattgatgggcatttagcttggttgcaagtctttgctatcgagtagagactaaattccataacatgacactcagcaacccatcctctgtaggcac

SEQ ID NO: 30027 - DNA, 201 bp, Homo sapiens
gccttcaactgattgggtgaggcccacccacgtcagggaggacggcctgctttactcaaagcccagcaattaaaatgttaatctcacccaaaatcaccctyccagaaaaatccggagtcgcattcaaccacatatctgggcactgtggcccaggcaaggtgacataaaattaaccatcacagacagcaacctaaatactgt

SEQ ID NO: 30028 - DNA, 201 bp, Homo sapiens
acacatgcatgcacatagacgcacatacagacatatgcatacacactcacacatatttcacagccttgtatttcattgtatgggctcataatccctggggygtccatcccagacctgttgatgagttaagaacctttggtttagaggaggcaataactggtcagactgagacttcaggaataggcctgtccggagctaggg

SEQ ID NO: 30029 - DNA, 201 bp, Homo sapiens
tttcagccgcctcctacctgctgtctctgccctcttcatggggctttgaggttatttctgtaaaatacaggcattgccttcctcctaatacacagtaggtmtgtgtttcttttttttcttaatttttttattttactttaagttctgggatacgtgtgcagaacgtgcaggtttgttacataggtatacatgtgccatggt

SEQ ID NO: 30030 - DNA, 201 bp, Homo sapiens
ttcgccatgttggccaggctgctttcgaattcttgaactcaggtaatccacccgccttggcctcccaaagtgctggggttacagatgtgagccaccatgascagcccaaagctacattttaatgtaataatattttctatgcagtagttgttcgtaatcctttcagggtcatggtgctctttgagaatttgatgaatccaa

SEQ ID NO: 30031 - DNA, 201 bp, Homo sapiens
cccatggcatcacacacggatctgagtgcccgcaccatggcctcgcacacggatctgagtgcccgcgcccatggcctcgcacacggatctgagtgcccgcrcccatggcctcgcacacggatctgagtgcccgcacccatggcctcacactcacaactccctttccatcccctgcaaaacatctccacgtggcagcagcat

SEQ ID NO: 30032 - DNA, 201 bp, Homo sapiens
ttactcttatgatagtttattttgctgtgcagaagctctttagtttaattagaacctatttgtcaattttggctttcgttgcaattgcttttggctttttygtcatgaagtccttgcccatacctgtgtcttgaatagtattgcctaggttttcttccggggtttttatggttttagaataagtgtcatgtggcactgaga

SEQ ID NO: 30033 - DNA, 201 bp, Homo sapiens
gtgggctggtgtgaagccaattcttatcctttgactgcaccacacaaaacagtctgtaagtggttcccagttgagggggggtggatgacaccagtgatctktgtgaataaattggcagcttcataaagaaattataaccaagttctaaagaacaaataagatttttgattttccaccaagaacccatgttttcatgatctc

SEQ ID NO: 30034 - DNA, 201 bp, Homo sapiens
ttgtgaataaattggcagcttcataaagaaattataaccaagttctaaagaacaaataagatttttgattttccaccaagaacccatgttttcatgatctygcttaatctttaagtgtttgcatgagatgatgtcacaggttgacaaactttaacagtgagggacagttgaaagtcacagagaggcagaggaaaaatatct

SEQ ID NO: 30035 - DNA, 201 bp, Homo sapiens
atgaagaccacctggttctttcttcatgaacagtgggaaggacaaacacatacgtgagcctgtcttgtcgatgtaagatgcgtgtgcgtgcatttctttcyctttcttcatctgcccagctttgtcctgctgcgtcagcactggctcagtgttggtctcgtttctcttgcagacatcattcagtcgaggtttcacaaagaa

SEQ ID NO: 30036 - DNA, 201 bp, Homo sapiens
tgggttaaaatatattgttagaattaaatttattcttttttgttcttaacgtggctggctgcaaatgtaaagtttagcattacgtttgtggcttccatagygtattacttagataaatacatgcctgttttagagcaacaggaatattgtttgtaagtgccatattttttagtggtttttgtcatcttctggatgtattgt

SEQ ID NO: 30037 - DNA, 201 bp, Homo sapiens
tgccttaggcagtttaggaaagagacattgatcacaatttttccttcctttctgtactgagaagttatcaatttctctctgtatggagtcactcctatttyctttgattcagtcaatcctcccacctcccttttaatcacaatatagtgtcctgggggccagagctggaggctgtccttcaggctgcagaagtccccaggt

SEQ ID NO: 30038 - DNA, 201 bp, Homo sapiens
ggccacggcttcctgtgtcttcccttttcctgcttttttggctgtagactgtttcagggttcaccaacatggagagacagactcatcactttgaaacctcyctaggattctgcaggagacacgggtggtggcagtggtggtttctggtgcatgatacaggtgggagaaggagggggaaagtacttcataagagctccagct

SEQ ID NO: 30039 - DNA, 201 bp, Homo sapiens
tggttatatttagtgtctaaataaggccctattttattacaccaccctttctttctctttttctgtctctctgtctctctctctctctctttttagtctcrgattaccccatctttccgtggtggaaagaataatggttgcaaagtgagtaggaaatttatttctctgtactcatctggcatgaattgtttgctctacata

SEQ ID NO: 30040 - DNA, 201 bp, Homo sapiens
gaatatgtgtttgaattcagcagtgagtcatctgagatgcgtgttgttatggaaaattgccatagcgttcagctgttacgagacagaagtcaaagctaagsacatttaatggccggagatgagcggtatttccaagaagttctttttattatttttacactttagatgaaatgggtatttggatgggatgagtcccattat

SEQ ID NO: 30041 - DNA, 201 bp, Homo sapiens
tcattctcggagtcctacgtagaaccttgtgcctccttcggcccaggactgagtttcatgccgatgtcttcttcccaggtgctcttcttcttcctcacacrcaggttctgggagctcagtccactcttctcctcttcgcaggtggccacggcttcctgtgtcttcccttttcctgcttttttggctgtagactgtttcagg

SEQ ID NO: 30042 - DNA, 201 bp, Homo sapiens
aggggaactcccctttatgaaaccatcagatctggtgagacttactccctgtcacaagaacagcatgggaaagacccaccccacgattcagttacctcccrgtgggtccctcccaagacacaagtgaattgtgggagctacagttcaagatgagatttgggtggggacatagccaaaccatgtcagtgagtgatttgcttg

SEQ ID NO: 30043 - DNA, 201 bp, Homo sapiens
gaaggataaatagttgatgaaataggtttaaaaaaactcaaaggacattaaaagcctcattttattgaaaaataaataatgacttttttttcttgaagacsaaccctgttgtttagaggcctaaaagatttgccaaaactatccatatactatccatgtctataacaagtctgtagaggtgactgcactgtatatcaccgt

SEQ ID NO: 30044 - DNA, 201 bp, Homo sapiens
gcctcactcttcacgctgggaactggtcctgtgtgactcaatggtattcccttttttccttaaccctcctttgaatagctgtggcttcccctggctaggtratttgtgtgtgtgtgtgtgtgtgtgtgtgtgtgtgtgtgtgtgtgtgtgtgtggttttttcttttctcctagagtaactctggccatcgggtagttggat

SEQ ID NO: 30045 - DNA, 201 bp, Homo sapiens
ttggaacataaccagttcagtccagtgccatttctacttttgtcgccttgcctctcctgcattcttctagaaaatttgagtctcccgaaagggtagacctktgctaagtcaatggtgcagtattgataaggctgccccagactgccagttaggtatctggttttcccgttgatttcactctgtctggatgatcttccttcc

SEQ ID NO: 30046 - DNA, 201 bp, Homo sapiens
tagttgatgaaataggtttaaaaaaactcaaaggacattaaaagcctcattttattgaaaaataaataatgacttttttttcttgaagaccaaccctgttrtttagaggcctaaaagatttgccaaaactatccatatactatccatgtctataacaagtctgtagaggtgactgcactgtatatcaccgtggctctcagt

SEQ ID NO: 30047 - DNA, 201 bp, Homo sapiens
gcaagcagaacaatatgctgacacagtgttcagtagattccttgacattctttttacaggcttgcgacgtgaaatttcctgatgaagtctatagataaagyggtgttgcacatttagacagggtgagcctcagtggagagaattatgctgaaaatgtgagcttgattcttcttcttggcatttggtattaactggagaacc

SEQ ID NO: 30048 - DNA, 201 bp, Homo sapiens
tcagttgctgtgataaaagcaagcagaacaatatgctgacacagtgttcagtagattccttgacattctttttacaggcttgcgacgtgaaatttcctgaygaagtctatagataaagtggtgttgcacatttagacagggtgagcctcagtggagagaattatgctgaaaatgtgagcttgattcttcttcttggcattt

SEQ ID NO: 30049 - DNA, 201 bp, Homo sapiens
agtggctggattcacttgagaaactcaaatctagttttgagcattttcattccacaagtagcttattttttttttactaaaatctagttttgagcattcamactattaagtatgattctacaagtagtttattattattttttccaatctgctaacccacaaaatatttccagtcctggaatcacttggtgagatatttgg

SEQ ID NO: 30050 - DNA, 201 bp, Homo sapiens
aggctatgcgtaggacatttactgaattactattttaacatgagagtaaggcgagcatatatgttcccttataaaaatgtagtagggtaagtaacaagggcaggttcagggtgcctcagtagctgctgcgacaggtcagcacatctcagggcctgatgctgtgatgtttaattttgttgatcctgtcacagtccaatgtga

SEQ ID NO: 30051 - DNA, 201 bp, Homo sapiens
cgcgtctagccctggctgacattttttgcacacgaagcctttttttcaaacctgcctgtttcctctatggagctagcatgtagtcagaaaatgcacagcarcttcatatgagccttagcaaaagaaaattctgaagaagatccatttaggaagaggaaaaatcagacagactttgccaaaagtaaatgtcagtgattcctg

SEQ ID NO: 30052 - DNA, 201 bp, Homo sapiens
gttcaaagagggcaattatgttcttagtaattcaggtgctcgatagactgggaagaagagatttgttctgtgtacaattacatggattgtataatgggacrtcttaagatttagaatgaaacagtttgttttttttttaggggaaactttgtaattgtaaccctggctgacagtttagtttgttttgttttattttgtttt

SEQ ID NO: 30053 - DNA, 201 bp, Homo sapiens
aagatggactacctagagatagccattggaaatgtttagctctagattaatcttgttaagttcaaagagggcaattatgttcttagtaattcaggtgctcsatagactgggaagaagagatttgttctgtgtacaattacatggattgtataatgggacatcttaagatttagaatgaaacagtttgttttttttttaggg

SEQ ID NO: 30054 - DNA, 201 bp, Homo sapiens
ctctctcctctctctgttcatgtctgtgtgtgtgtatagccttcaaaagtttctcatcttccttcctacagcctattactatggaaagagaaagaagatckccaagccccccatcggggaaagcaaccccgacagcggacaccccaaacccgccaggcggaggaagcgacggaaatccattttcgtgcagaagaaacggag

SEQ ID NO: 30055 - DNA, 201 bp, Homo sapiens
tctctgttcatgtctgtgtgtgtgtatagccttcaaaagtttctcatcttccttcctacagcctattactatggaaagagaaagaagatctccaagccccscatcggggaaagcaaccccgacagcggacaccccaaacccgccaggcggaggaagcgacggaaatccattttcgtgcagaagaaacggaggtcttctgcc

SEQ ID NO: 30056 - DNA, 201 bp, Homo sapiens
cttcaacactggggacgggccaagttcagcccgaacaccttccagacctgaagctttggagcagtgcttctcctgtgggtctgttttctcagaatgacttygtaaggcacaaatgaactatcagatgaaagaatcgtttcccttctttctctctcctctctctgttcatgtctgtgtgtgtgtatagccttcaaaagtttc

SEQ ID NO: 30057 - DNA, 201 bp, Homo sapiens
cttgaagctgtgaaccccaggaatccaggagaactgtgtgtggcctccgttgtgagtgtgaaggggcggctaatgtggcttcacctggaaggtacgtactygctgggggtagcagtcgctggggggaatgtagagtttgtcgaaatggcaacgtgtggaggaaagcagcccttctcagaaggggccttacttctctttcat

SEQ ID NO: 30058 - DNA, 201 bp, Homo sapiens
ctcctcccaaaggtttgtattctgtgaaggtatgcagggtctggagattcaggagggtgtcttactgtcattgaagtaacacctgcattaatctggggagkctggttgtgtaaagggtttagatgtagtagaaatagggcgttcttcatcagcttgacataggtgtcagttacagctccatcccctggcgaggcgagtggc

SEQ ID NO: 30059 - DNA, 201 bp, Homo sapiens
ggaggaagattacgccttcgctatgtgggattggaggacactgaatcctatgaccagtggttgttttacttggattacagacttcgaccagttggttggtktcaagagaataaatacagaatggacccaccttcaggtaagggccaaagcttttgctgctgtaaagtattttagaaaaagatgtgatattttcctggatgt

SEQ ID NO: 30060 - DNA, 201 bp, Homo sapiens
ggtggatcagactcttgttctatacaggcctgcgatggatgggatgtggcccacccatagcatctgctctactcaatctgctgattcaaatgctaatgtcmgccagaaacaccccaagaaacacccagaataatgtttgaccaaatatctgagcatcatggccaggcacattgacacacacaatggaccctcacaggggat

SEQ ID NO: 30061 - DNA, 201 bp, Homo sapiens
tgggaaaaagccatcatcccccaaaggcagtgaggcaggagggattctccctcacttgggggtggatcagactcttgttctatacaggcctgcgatggatrggatgtggcccacccatagcatctgctctactcaatctgctgattcaaatgctaatgtcagccagaaacaccccaagaaacacccagaataatgtttgac

SEQ ID NO: 30062 - DNA, 201 bp, Homo sapiens
atcttccatagctgttcttgcctctcttttccttctccctttgacaaatggagggtgttctgtgtattccatgcaatagctgttagtctcctgtgcggtgyctcagtggtttctgatcagtgcttattggatgaatgatagaatataggattggaatggatgtcaagacatcattgggtttttgtcatcccttcagtttaa

SEQ ID NO: 30063 - DNA, 201 bp, Homo sapiens
attcttattttgaatactagacagagaggactaggttatagtgcagcaacacatcacttcagaatctcagtggcctgggcaggaaacgtctacaaatcacygtagcatggagtcgttgtgcaccatcctgcagggtttgttgtgagtgagaagagcagggttggaggtctcggaccagcagtcatctgctctggctcgcaa

SEQ ID NO: 30064 - DNA, 201 bp, Homo sapiens
agtcctagcctgaggcctgagaactggaactggtggaatagttcttgtctgaaggcctccaagctcgagacccaggaagagccaatatttcagatagagtyggaaggtgggaaaaagccatcatcccccaaaggcagtgaggcaggagggattctccctcacttgggggtggatcagactcttgttctatacaggcctgcg

SEQ ID NO: 30065 - DNA, 201 bp, Homo sapiens
agggtgttctgtgtattccatgcaatagctgttagtctcctgtgcggtgcctcagtggtttctgatcagtgcttattggatgaatgatagaatataggatyggaatggatgtcaagacatcattgggtttttgtcatcccttcagtttaattcgataaatatttatggaagcctttcttgggtgagccacgtagcataaat

SEQ ID NO: 30066 - DNA, 201 bp, Homo sapiens
ctcctccctcagcctcctgagtagctgggattacaggcatgcgccaccacgcctggctaattttgtattttcagtagagatggggtttctccatgttagtyggctggtcttgaactcctggcctcaggtgatctgcccgctttggcctcccaaagtgctgcgattacaggtgtgagccaccacgctggccatgatatgtct

SEQ ID NO: 30067 - DNA, 201 bp, Homo sapiens
atttggtgagtacctacattgtgcaccttaagatgggatattttatccctgacgttattttaccctgaatcactgttaagatgctcataaatgccgggcayggtggctcacgcctgtaatcccagcactttgggaggctgaggagggcagatcacaaggtcaggagatcgagaccatcctggctaacacagtgaaacccca

SEQ ID NO: 30068 - DNA, 201 bp, Homo sapiens
ggtggttatgtgtgcggttggacggacagacttgcttttagcagccacttgtccttgctggcagccactggtatttatatgtctgtccccagtgcccaacrtggtgtctggcataaataaatcagatgttccattaatacacacacaagaaaactgcatggtatcagcacttatctgtctggcattagttttaaaattgta

SEQ ID NO: 30069 - DNA, 201 bp, Homo sapiens
acttttgtgctgtgctgtgtatgtgtgtgtgtgtgtgtgtgtgtgtcttccataagttttcatttcaaattcttaaaaattttcttgtatattccttctaraatttctaaaaagtaaagatctttaatccatctggaatcgatgcctgtatatagggcagtcattgttcagggccagtcagtttcagctgggagcgccctt

SEQ ID NO: 30070 - DNA, 201 bp, Homo sapiens
ctataggcacctgccaccatacctggctaactttttgtatttttagtagagacggagtttcaccatattggtcatgctgcaaactcccaaactcaggtgaycaacccgcctcagcctcccaaagtgctgggattataggcgtgaaccaccgcgcccagctccatttatgttttatattgcatgtatatttcaccataaatc

SEQ ID NO: 30071 - DNA, 201 bp, Homo sapiens
aaggctccaatgagcatctcatgtgagcatcttgttggccctcaaaaagtttcaggtttggggcttgggattttcagagttgggattccagtttgtatacrcagaacctagttagtctcagcacagagttactacatcttagtaggagagtgagaactgctcaggctctggagggaataaagctgatgaaaccagggtgca

SEQ ID NO: 30072 - DNA, 201 bp, Homo sapiens
tctgactatgaggagtaactcagggaactcagattggggtggagttcacaagatcctcggctgcagtttgggctctacctcttggtttttggagctccccygcctggtctcctccgcgtcttctctttttacttctggctcttcactctgcaccatcacctcttactccttattccattatttttcaacgttgcattgttg

SEQ ID NO: 30073 - DNA, 201 bp, Homo sapiens
tagtcatggtatttgttaattgttgatgaaggttgtgactggctgtaggtaaacattttggaagtaatttttaggactggaatgcactcacatgctttttycttaagccactgaaaagtgcgaggaattaacagcaaaacttggaggttttaagtaaatgatcagtgttagtagctatcactttttaacttagcaatagct

SEQ ID NO: 30074 - DNA, 201 bp, Homo sapiens
gtgtactagattaaccacgttggtcagagtaacctgtcttggttaacatcgataacatcgcatggaagtcggtatcgatggaggataattgatgaagcacygtggacattttgctgcacatatttcctaaatcttcattgcttactgtataaacacacaaaagtagtcatggtatttgttaattgttgatgaaggttgtga

SEQ ID NO: 30075 - DNA, 201 bp, Homo sapiens
gtgcagtggcgtgatctctgctcactgtaacttctgcctccggagttcaagccattcccctgcctcagcctccccagtagctgggattacaggcgcccacygccacgcccagctaatttttatatttttagtagagatggggtttcataatgtaggccaggctgctctcaaactcctgacctcagtgattttctaagtaaa

SEQ ID NO: 30076 - DNA, 201 bp, Homo sapiens
aaagattatagcctcctcttacttgagatctgtaacaacagtgcaaagcactcgctggtcagagacttgtttgctgagcatgtcttcctggagcttgcggkttcgttgctgccacactgtcattgcactctagacataacaatatgaaaaacgaagcgagaaaggggtggctgcataggcagaagttcaaaagtgagtgca

SEQ ID NO: 30077 - DNA, 201 bp, Homo sapiens
cgagctgctgcacctggcttacatgctaatgttatggtgaggatgttaggattattactatttttgtaagttatgtggctttgagaattcttccctaaacyttagttttcataagctgtcttattttcagcactcatatttgcaaaatgggacacttttcaggaacagatatgtgatattatagcagaaattcttgctttt

SEQ ID NO: 30078 - DNA, 201 bp, Homo sapiens
acgtctcggggtgtggatgcagacatggtctttggcaaggctcagtgcaggctgcagagtccagttctgggttctgtctgagtgggccgctttataagagmggacgaagtttctggcaaaagtggtctttaatgcatggctctactcacttgatgggtgttagagttgagtggggtttggcaggaccacgagcgtgtctgg

SEQ ID NO: 30079 - DNA, 201 bp, Homo sapiens
gcacctggcttacatgctaatgttatggtgaggatgttaggattattactatttttgtaagttatgtggctttgagaattcttccctaaactttagttttmataagctgtcttattttcagcactcatatttgcaaaatgggacacttttcaggaacagatatgtgatattatagcagaaattcttgcttttaatagtttg

SEQ ID NO: 30080 - DNA, 201 bp, Homo sapiens
tgaaggacagcagggaggagacgatgcttttcatggtagtccgcagggcatggcgacatccctatgtttgtcttttatttacggtgactttcctaaaatayattacccaaagaattgcatggagaaattactgtgcaacccctttccccaaggggaacaccaaaagggaatctagttcggttttaagagcagctttggaag

SEQ ID NO: 30081 - DNA, 201 bp, Homo sapiens
gggaaaacagtttggcagttcttacaactttaaacatacacccaccatacaacccagcaattgtactcctgggtatttaaccttgagagatgaaaacttaygttcacataaaacctgggtaagatgtttatagcagccctattcatagttgccagaaagtggaaacagcccaggtgtctttaagcagtgaatggacaaatg

SEQ ID NO: 30082 - DNA, 201 bp, Homo sapiens
gggatttgtgggttgggattaggcaagagttcatagacatgagaacagacaacaaattgataaagtggacttcatcaaaatgaaaaatttcctgtgtgaargacacttaaaagaatgaaatgtcaaaggacaaatacagactgagagaaaatattttcaaatcacatacctgacaaagctcttgttgtatctagaataaaa

SEQ ID NO: 30083 - DNA, 201 bp, Homo sapiens
ctgctcctgggccatcctgtgctaaggttgcattgctgaacggatgacagggtgggtggtgtatgtccctaaggccaccagagatggtttactcaattcayatgcttcctccacctgggatgaaagcggttaattaatgtttgattctaagaagtcaggtgatgtgattcagattagttatggggttgtgctgaagcgcgg

SEQ ID NO: 30084 - DNA, 201 bp, Homo sapiens
cacgtagaggggtttgcaagctctctgtgtttactggcctccacgttggtgtctgggaagggcaaaacagaagctcagactgctgggtggagaagttttgygccttcccagctcttgcttctttctgtgaagcatgctggcgtcatgtttccatgacagcagttgagttaatgcatttaggggccccctcagcgtccacca

SEQ ID NO: 30085 - DNA, 201 bp, Homo sapiens
agtttgagaccagcctggccaagatggagaaaccccatctctactaaaagtacaaaaattagctgggcgtggtggtgtgcgcctgtaatcccagttactcrggagggtgaggcaggagaatcacttgaacccaggaggcggaggttgcagtgagctgagatcatgccactgcactcccgcctaggcaacagagcaagagtc

SEQ ID NO: 30086 - DNA, 201 bp, Homo sapiens
cttcagtggacatgtggcaaagccaggagacatttcagttgtcccaggtgggggatgcagtcagcatctagtggatagaccccagagatgcagttgcaacrtcctacagtggcagaacagccccccaacaaagattctggcccccaaaggccaatagtgttgaggctgaccatccctgtttctcacctggaagtggttgat

SEQ ID NO: 30087 - DNA, 201 bp, Homo sapiens
ctaggcatggtggcacacacctgtggtcccagctactcgggaggctgaggcaagaggattgcttgagtctaggaattcgaggtggtagtgagctatgatcrtgccactgcactccagcctgggtatcaaagtgaaaccctgtcccttaaaaaaaaaaaaaaaaggtaagcctcaaagttatcctcatccaccagatattta

SEQ ID NO: 30088 - DNA, 201 bp, Homo sapiens
gaggcagtgggagggtaacagcagcaccaggtctgcagtgtagactggcagcaccgggtctgcagtgtagactggcacaaatgtaagtgtgaatttccagktcttgctgagacagcatcagagtgagtcaaaattaacagggttggttggcactgctgatcacaccaaggggctgaagggtgggtactagagtgagttaat

SEQ ID NO: 30089 - DNA, 201 bp, Homo sapiens
tggtggctttggctgtgtcactgggaaggtggagggggtggcctctcggaggctgcacggtgggtttctgagcctggttctccaggccaggtggatgtgayggtgcctggctgtcagcggccaggccggctgtggatgacgcttgcctttttcctcttgatagaccatcatgttgctcccatcgtcagcaatgagttgtcg

SEQ ID NO: 30090 - DNA, 201 bp, Homo sapiens
ttcaaagtggaggcagtgggagggtaacagcagcaccaggtctgcagtgtagactggcagcaccgggtctgcagtgtagactggcacaaatgtaagtgtgratttccagttcttgctgagacagcatcagagtgagtcaaaattaacagggttggttggcactgctgatcacaccaaggggctgaagggtgggtactagag

SEQ ID NO: 30091 - DNA, 201 bp, Homo sapiens
tcctccctagcttctgtctggctgtgtcaggcctgtttcaggtgttaatttctgtgatcatttccctggtaaactcctggatggcaggttctaggttttaytcctgtcgtcctggaacttcacgcttgtctctgatgcagtgcaggcctcagctccgtagggaggttaacaaatgaagctgagttccgcaaggcagcccaa

SEQ ID NO: 30092 - DNA, 201 bp, Homo sapiens
agaacccattgctgccatagtggtagtaggcagtgggttaaggagtacttgagttattgttattgtcctgtgcatgcaaagcacctcttgtaccaccataytgtggtcaccattgtttatggttattgctgtcattcataacagcatctttgaatcttatacactagacattcaaagtggaggcagtgggagggtaacagc

SEQ ID NO: 30093 - DNA, 201 bp, Homo sapiens
ttacttcaaggcaatatttaatttacaaatgatttaagattttaaaaactgttggaactgagttaagatgggtggaaatattaagtacttcagtttttctrtgctgcctgatactttgtactagccagtaaaatatttgttaaagaagtgtttgtccttcctttgaggtattttctttttttttctttttagtggctgagt

SEQ ID NO: 30094 - DNA, 201 bp, Homo sapiens
ataccaggtcgagtagggttttctgtctggtctttgtgtgagaaggccctttaatagataaaggcttccttggggaccagtaccatttcaggtgactggtstgcttgtctgtaggttggaaatgattgcttactccttgcaaacagagaacccattgctgccatagtggtagtaggcagtgggttaaggagtacttgagtt

SEQ ID NO: 30095 - DNA, 201 bp, Homo sapiens
attttcttaggcaagccagtctagaaattttgcggtcagctgtgggcttttactatctgtaaaactcttgcaggagccaagtattactattgtatccagakagaatcctagctaattctagtgtaaagaaatcagtgaggagaaaagtaaaacataattatgcaggaaagtaggcttttatgactcaattaacatatttta

SEQ ID NO: 30096 - DNA, 201 bp, Homo sapiens
gagagactgcaggtctataaacaatgggacagggagccaaggcatggccagagtgttacaaaccctggctttctgtgtgataagccactcaccttgaggaygtttttggaatatgcattaacctttcagacctttcgggatagcataaaaaggtacgaaggaaaaacataattgaagccatagatgaatcataggaactca

SEQ ID NO: 30097 - DNA, 201 bp, Homo sapiens
tccagttcgttgaatacccgttcctggcaacatacagaactgcgaggtggggttcatctgtgggatcctttgcctgttctgggtacttgaactgaagcacrtgaattccatggcaaaaaaggaccagcggggccatctagtttttatgagtattggagaaaatcttataagagacacactaaagagggcaacattggtcaa

SEQ ID NO: 30098 - DNA, 201 bp, Homo sapiens
ctcactgcaacctctgcctcccgggttcaagcaattcttctgcctcagcctcctgagtagctgggattacaggtgcacacgaccatacccagctaattggtttttttttttttttttcctatttttaatagagacagggtttcgccatgttggccaggctggtctcaaactcctggcctcaagtgatctgcccgcttcagc

SEQ ID NO: 30099 - DNA, 201 bp, Homo sapiens
tcaaaaaagaaaagaaaagaaaagaaaagaaatagaggctgttttgatggtaggtgattttgttagcagactggtgcatgtccctctgtgatctcggtgcyattgattgaacttgggaggtttctaccccatggctggagccgggtctgttctctcaggcatccccagtgtctgggcctgaaagcacggttctgcagagtg

SEQ ID NO: 30100 - DNA, 201 bp, Homo sapiens
tcactgcaacctctgcctcccgggttcaagcaattcttctgcctcagcctcctgagtagctgggattacaggtgcacacgaccatacccagctaattggtttttttttttttttttcctatttttaatagagacagggtttcgccatgttggccaggctggtctcaaactcctggcctcaagtgatctgcccgcttcagcc

SEQ ID NO: 30101 - DNA, 201 bp, Homo sapiens
aaagatgtgatattttcctggatgtgtttctagaaaatgtatgagctttctggtatcttttatatctgagtatgtgaatattaagcactttaacttcacartgctttccatagagactaaaacctaagacctcaatcaatagtgttctcaaaggagaaagcaatgttagaggccttagggaaattgatctagttccttggg

SEQ ID NO: 30102 - DNA, 201 bp, Homo sapiens
gtaaggaagacgcgggcttctcttacgatagattgtgaggctgcagtttctatggtgactggtttctttttcccttattcagcagctaaatgcagcaacaytcaaacacttgtagctgagtttggccttcaggtgggacacttacattctccaggcatttgccttaagcccatatatagagacagagcttaattttttccc

SEQ ID NO: 30103 - DNA, 201 bp, Homo sapiens
cccttccgacggtgcaggagtgcatggagctgaagctggggcctgccatcaagttatgccaccagatcgagagagtcaaagtggctttctacgcccagtaygccaactgagtctgccctcgggaggtggcccattattgctgggatgcggtgttggtaaaggtttccaggactgaaactttgattttccgggatatgttaa

SEQ ID NO: 30104 - DNA, 201 bp, Homo sapiens
ttatactagcattatatgtaactctaaagaattaacctttggctcccccattttttttcttttaggtttttaacaatcacttttttcaagtgactattgaygacctaagacctgaaccaagtaaactgtcaatgctgtgccatgcagattctttggggattttgccagtacagtggtgccttaaaaatggagtcagcctca

SEQ ID NO: 30105 - DNA, 201 bp, Homo sapiens
aaaatagtacctggaggatgactttctccccaaatgtctaataaacagaatttaggcttgtttgttcagtgatgttgaaactatcctttatagctatagcrtatttacaggtgcaagaaaattcacagaatgctgtattttgtgaacagaatcctgatcatactttatatttaagtagaaaaccatattttctaggtggtg

SEQ ID NO: 30106 - DNA, 201 bp, Homo sapiens
aacattctccaaaagttgccttgaagtttggtggtgtggctctgccatgaagacccatgagtgttgattttcttaggcaagccagtctagaaattttgcgktcagctgtgggcttttactatctgtaaaactcttgcaggagccaagtattactattgtatccagagagaatcctagctaattctagtgtaaagaaatcag

SEQ ID NO: 30107 - DNA, 201 bp, Homo sapiens
ataagagctggatgaagggggaaggcccttatcatcagatctcatgagagcttactcactatcaggagaatagcatgggagaaaccgcctgcatgattcarttacgtccccacaacatgtggggattatgggagctataattcaaaatgagatttaggtggggacacagccaaaccatatcagctaatttttagatttttt

SEQ ID NO: 30108 - DNA, 201 bp, Homo sapiens
tcttagaaacatactttcttgaccatagtagcactcattaaatacctgtccaataaatgcgtgaattcatggacatatgtcttcaactccttgaatttaatttttttttttttttttttttttggaggcaatcttgccctgtcacccaggctggagtgcagtggcatgatctcagcttggccccctgcaacctctgcctcc

SEQ ID NO: 30109 - DNA, 201 bp, Homo sapiens
tattcctgatcctcagttttctctcagctgttctgctaaaattgcatgttctggtctccagcagttctcttagtgtgaaactcagtggcctttccctgttmaccttctcataaatttgttacatttttcatttgattactccctcagttcccccaatgttagttccctagtcattcactatccggatctctcgattgattg

SEQ ID NO: 30110 - DNA, 201 bp, Homo sapiens
tcatggaggttacagggatccaaggtcatgataactgaggcttgtactgcatctggactcagaacagagcaaatgtgtgcctggtctaagtacttccgtaraatacccagtgtcttggtgtccttctgcagcacagtctctgtcgtctttgacataagtatcgagattatacacacatcactgataagggataaaaggcac

SEQ ID NO: 30111 - DNA, 201 bp, Homo sapiens
tccctcacttcctacgggtgtctgcttaaaattagaaaaccctggactgggcgtggtggctcatgcctgtaatcccagcagtttgggaggccgaggtgggtggatcacctgaggtcaggagttcgagaccagcctggccaacatggtgaaaccccatctctactaaaaatacaaaaattatctgggcatggtggtgcttgc

SEQ ID NO: 30112 - DNA, 201 bp, Homo sapiens
tgaccacagcttgtcacagcaaggaagggacatatctgaaatgtcactaacatctatgatcctttttttatcctttaaagaagggaaattgttggaacttytttgtgttctttaaaaaaatattgaaaatctcagtgtgtttgaaattctaaatgagctactcagagatttgccttagagtgcagggaattatgcataaga

SEQ ID NO: 30113 - DNA, 201 bp, Homo sapiens
ccctcacttcctacgggtgtctgcttaaaattagaaaaccctggactgggcgtggtggctcatgcctgtaatcccagcagtttgggaggccgaggtgggtkgatcacctgaggtcaggagttcgagaccagcctggccaacatggtgaaaccccatctctactaaaaatacaaaaattatctgggcatggtggtgcttgcc

SEQ ID NO: 30114 - DNA, 201 bp, Homo sapiens
gtttccttagaggaatacagaaatatagctgggagaagacagaagctctctagcttactttgttcatgaccacagcttgtcacagcaaggaagggacatayctgaaatgtcactaacatctatgatcctttttttatcctttaaagaagggaaattgttggaacttttttgtgttctttaaaaaaatattgaaaatctcag

SEQ ID NO: 30115 - DNA, 201 bp, Homo sapiens
agtgaggtcatgcggattggtggtgaagtgcgtctcccttccagaaatctgaaaaacagaacagctccctcctcggactcaaacacagccttcgattcaaatgtatgtatgtatgtatgtatgtatgtatgtatgtatgtatgtatgtgtgtatgtgtgtgtgtgtgttttgagacaggatctcacctgttgcccaggttg

SEQ ID NO: 30116 - DNA, 201 bp, Homo sapiens
tttctagttaatggaaataaaatattgtttccttagaggaatacagaaatatagctgggagaagacagaagctctctagcttactttgttcatgaccacascttgtcacagcaaggaagggacatatctgaaatgtcactaacatctatgatcctttttttatcctttaaagaagggaaattgttggaacttttttgtgtt

SEQ ID NO: 30117 - DNA, 201 bp, Homo sapiens
gtgaggtcatgcggattggtggtgaagtgcgtctcccttccagaaatctgaaaaacagaacagctccctcctcggactcaaacacagccttcgattcaaatgtatgtatgtatgtatgtatgtatgtatgtatgtatgtatgtatgtgtgtatgtgtgtgtgtgtgttttgagacaggatctcacctgttgcccaggttgg

SEQ ID NO: 30118 - DNA, 201 bp, Homo sapiens
tgtcacgtgtctgacatttacgagcctccatattactttttcgttcccagcaattcttataaatcgtattccatatctgagatcctacgtgtttgcaaatrttaaattgtacaagtttcactgacaactcatttgtccaccaaaaagatctataaataagaaacagcaattcccaattttctagttaatggaaataaaata

SEQ ID NO: 30119 - DNA, 201 bp, Homo sapiens
tgaggtcatgcggattggtggtgaagtgcgtctcccttccagaaatctgaaaaacagaacagctccctcctcggactcaaacacagccttcgattcaaatgtatgtatgtatgtatgtatgtatgtatgtatgtatgtatgtatgtgtgtatgtgtgtgtgtgtgttttgagacaggatctcacctgttgcccaggttgga

SEQ ID NO: 30120 - DNA, 201 bp, Homo sapiens
tatgacatatcccaatgtccactcaagcaaaacgccccagtttccataaaagctttttatttttgtcttttgcgaaggactactaggaagggtttctgtcrgtttgtttctgtcatcaaacaatgaagtttattacaggacagactcagtcttttggtcaataatgtctttgttgcctcagttttccagttcactgagtgt

SEQ ID NO: 30121 - DNA, 201 bp, Homo sapiens
ccatcatttgattaacttatgacatatcccaatgtccactcaagcaaaacgccccagtttccataaaagctttttatttttgtcttttgcgaaggactacyaggaagggtttctgtcggtttgtttctgtcatcaaacaatgaagtttattacaggacagactcagtcttttggtcaataatgtctttgttgcctcagttt

SEQ ID NO: 30122 - DNA, 201 bp, Homo sapiens
gaggtcatgcggattggtggtgaagtgcgtctcccttccagaaatctgaaaaacagaacagctccctcctcggactcaaacacagccttcgattcaaatgtatgtatgtatgtatgtatgtatgtatgtatgtatgtatgtatgtgtgtatgtgtgtgtgtgtgttttgagacaggatctcacctgttgcccaggttggag

SEQ ID NO: 30123 - DNA, 201 bp, Homo sapiens
gatctaggttgcacggtccttatgagaatctaatgcctgatgatctgtcactgtctcccatcacccccagatgggactgtctagttgcaggaaaacaagcycaggattcccactgattctatatcatggtgagttacagtattatttcattatatagtacaatgtaataataatagaaataaagtgcacaataaatgtaat

SEQ ID NO: 30124 - DNA, 201 bp, Homo sapiens
agagtgtgtgcagctttttcaggtgcccagtgagggagcaaagggaggcagtggcttccggccaggaacggccgaggcctggagagtgctggagaggaccmagccagctgactgtgccgcagctgagctcctcctgccctttctctgcaggacacgaaacaggaggaggaggagagactggttctggagagcaacccgttg

SEQ ID NO: 30125 - DNA, 201 bp, Homo sapiens
cagggggcatcatcactgagccaagaactttctcagggactgagagtgtgtgcagctttttcaggtgcccagtgagggagcaaagggaggcagtggcttcyggccaggaacggccgaggcctggagagtgctggagaggacccagccagctgactgtgccgcagctgagctcctcctgccctttctctgcaggacacgaaa

SEQ ID NO: 30126 - DNA, 201 bp, Homo sapiens
tcacaagcagcatggggcgcaggaagcccctcccttctgcttccgaaatgtaagaagcttctctcttacctaatttttaaaaatcatagattttgtctacygtaagttttataacttgctttttattgatgaagcacggttggagtattacagtgcactggagaactacaaaatgtctgtagtttttggaaagctctgctt

SEQ ID NO: 30127 - DNA, 201 bp, Homo sapiens
gtagtgtctttatggaggatgggaagcatggctgtttttattggagttatctaacaaatagcaccctagtagaggtagcagtaaaacatagtgactgttayttgttatgtacctgttatgtgcaagacacagtgcctgctccccaaggcactcacaatccagattcccatggctcactttttattccacttcgacatacct

SEQ ID NO: 30128 - DNA, 201 bp, Homo sapiens
tgccacatgcaataatccaaatgcattctggttatgaaataaagcaggcagaacttacagtcagcctcagaatgacttattgacagctacaggtgcagcatttttttttttaacattgtaacccttttgcaaagtttttattgaaatgttttatgatatagtgtttttgatttgtctatttgaagaatcatagaagacaaa

SEQ ID NO: 30129 - DNA, 201 bp, Homo sapiens
gggccaccatgcctccattccagggccatgcagatgttctagggccatgctgatgtctcagggccatgcagatgttcaagagccatgccttcattccagagccaccatgcctccattccagggccaagtagatgttctagcgccatgctgatgtcccagggccatgctgatgttctagagccgtgcctccattccagggcc

SEQ ID NO: 30130 - DNA, 201 bp, Homo sapiens
catgcagatgttcaagagccatgccttcattccagagccaccatgcctccattccagggccaagtagatgttctagcgccatgctgatgtcccagggccaygctgatgttctagagccgtgcctccattccagggccatgcagatgttctagggccatgcagatgttctagaaccatgcctcccttccatggccatacaga

SEQ ID NO: 30131 - DNA, 201 bp, Homo sapiens
tgcctccattccagggccatgcagatgttctagggccatgttgaggtcacagggccatgcagatgttccagggccatgttgatgtcacagggccatgcagatgttctagggccatggtgatgtcacagggccatgcagatgttctaggcccatgcagatgttctagggccatgttgatgtcactgggccatgcagatgttc

SEQ ID NO: 30132 - DNA, 201 bp, Homo sapiens
catagagtgggtgggagcctcaggccccatccttgttgccgacggttttaccatcacattcatgactcactcttcaagtttaacacttgaatcttgaaagscccttggaaaggatgtaagatggtttcattttgtaatagcttctctagtgaatagttttagagacaagttctggggtcttgaatctgaatactctaagag

SEQ ID NO: 30133 - DNA, 201 bp, Homo sapiens
aggctacgctttattatttcataattctataataattccccttttccaaagatgaaagggtttatacttaaatggggaaggatatttacctgcaaaagccrtgatcgggactcatttcccgctgatgggtactggggacatggttgtctgacaggaacgttcactttttgagatggagtctcaccctgtcacccaggctgg

SEQ ID NO: 30134 - DNA, 201 bp, Homo sapiens
caggagtttaagaccagcctggccaacatggtgaaatgctgtctctattaaaaatacaaaaattagccaggcgtggtggcacatgcctgtaatccctactygggaggctgaggcaggagagttgcttgaacccgggaggcggaggttgcagtgagccaagatcatgccactgcactccatcctgggtgagggagcgagact

SEQ ID NO: 30135 - DNA, 201 bp, Homo sapiens
tgattattatttctactgttatttatctttgatttaagagatcactgtgaatagctttggatgccatactttactgggaattctgacttaccttatttggmaaatacagatcatttccaaaatgtacattcagttgaaggataaatagttgatgaaataggtttaaaaaaactcaaaggacattaaaagcctcattttatt

SEQ ID NO: 30136 - DNA, 201 bp, Homo sapiens
caatacgagactgttgggataagagtctggggcatataggctgctgttaaagtagtacttatgtatatttttatttatttatttttttgttttatttatatttttttttttttggagagggagtctcgctctgtcacccaggctggagtgcagtagcgtgatctcggctcactgcaacctccaactcccgggttcgagcga

SEQ ID NO: 30137 - DNA, 201 bp, Homo sapiens
ggcaaaggaggagaaaggcacgtcttacatggtggcaggcaagagagcttgtgcagggcaacttccctttataaaaccatcagatcttgtgagacttactyactatcaggataccagtatgaggagaactgcccccatgattcaatggtctccacctggccccacccttgacacatggggattatcataattttaggtgag

SEQ ID NO: 30138 - DNA, 201 bp, Homo sapiens
ggaggttgcagtgaactgagatcatgccactgcactccagcctgggagacaagagcaaaactccgtctcccccccgcaaaaaaaaaaaaaaaaaaaaaaaraaaagaaaagaaaagaaaaaagagtcagggcttgaaagtgagaggatccaaactgcatcctgtcctgcccacagggtgttctgtccaccttaagtttgac

SEQ ID NO: 30139 - DNA, 201 bp, Homo sapiens
cagaacagccaaatgagaactttcttgattccctctcttcttgcatggtggttgtattagtcagttctcatgctgctaataaagacatatccaagactggrtaatatatatagaaaaaaagggtttaatggactcacaattccacatagctggggaagcctcacaattatggcagaaggcaaaggaggagaaaggcacgtc

SEQ ID NO: 30140 - DNA, 201 bp, Homo sapiens
agtaaggattaaaaaactacctatcaggtactaggctaattatctgggtgacaaaattatctgtacatcaaattactctgacaccctgacacatatgtatctcctccttctccccacaaaaaaatctaataaaattcttcaaaagatgtggaaatgttagtaacattgctttcgacaatttttgaatcaaagtggtttatg

SEQ ID NO: 30141 - DNA, 201 bp, Homo sapiens
gtaaggattaaaaaactacctatcaggtactaggctaattatctgggtgacaaaattatctgtacatcaaattactctgacaccctgacacatatgtatctcctccttctccccacaaaaaaatctaataaaattcttcaaaagatgtggaaatgttagtaacattgctttcgacaatttttgaatcaaagtggtttatgt

SEQ ID NO: 30142 - DNA, 201 bp, Homo sapiens
aaactcccaggctcaagccatcctcctgtctcagcctcccaagtagctagaaccacaggcatgcaccagcacacctagctaatgtattagtttgttctcaygctgttagggaagacatacctgagactgggtgatttataaaggaaagaggtttaattgactcacagttcagcaaagctggggaggcctcaggaaacttaa

SEQ ID NO: 30143 - DNA, 201 bp, Homo sapiens
tgtgcgggtcctgcctgtgcctctctttgtggcgttccagcctgtgtatgcttccctaagtgggatgctgagtcctgttgacaggatgggaagtgggcacygtcctcattgttcagagagggccctttccctactctgaagagggaagaaagctggatgtggtctgggcaccacactggctttgcttttcctcagagtgga

SEQ ID NO: 30144 - DNA, 201 bp, Homo sapiens
tacctgttatgtgcaagacacagtgcctgctccccaaggcactcacaatccagattcccatggctcactttttattccacttcgacatacctggggagtgwcccagacctacacactgagagaaatcgctgtctgtgtctatagttctcagcgtctgcaggggccccacgtggcaggtgcagtttcgagtcgcagcccctc

SEQ ID NO: 30145 - DNA, 201 bp, Homo sapiens
gccgccatgggtaagttccacccttcctcacctggcttcagatagtgtgttatagtaacgatggtttacctgtgtttagtactttaatttttccaaaatayttcatctgagcttatgaaatctgaagtgctgttaggcatcagaggacattatcttttgggagcctaaactttcaccccttctgattttgctcatctgtct

SEQ ID NO: 30146 - DNA, 201 bp, Homo sapiens
tatgtgtcaagttgctacttagagacacattttcagtctcagttttagtatttacttaagcatggtgatgaaagttaagaaaaacattgaaatcaaacctmcatggagaaaactgctgtgattttaagttgattggatactttgctgctgtgttgaagtgttttttttgttttgttttgtttttctttctcctttgtcttg

SEQ ID NO: 30147 - DNA, 201 bp, Homo sapiens
ttatgataagtgagtttgcactcatagaatctgtgacaatatggggaaaagaaactgggggatttggataaaaaaacataagaaatctcttagagatttayttcatgtagatttccaccaacagagagcactgtcaatgaagatactaggggcatttacacacttcagtgaatcacagttggactgtgtttttcctttgct

SEQ ID NO: 30148 - DNA, 201 bp, Homo sapiens
taaggattaaaaaactacctatcaggtactaggctaattatctgggtgacaaaattatctgtacatcaaattactctgacaccctgacacatatgtatctcctccttctccccacaaaaaaatctaataaaattcttcaaaagatgtggaaatgttagtaacattgctttcgacaatttttgaatcaaagtggtttatgtt

SEQ ID NO: 30149 - DNA, 201 bp, Homo sapiens
acctaagacaggtcaactttattgtgtaatagaaacaaaaaaattaaacaatcttattattttgttgttgttgtggatacgagagaggaatagggagaacttttttttttttttttttcaaggaagacctggtttcccccagtggtctggtggcccaaattagagtgacatgaagggaagcactgggggcaaaagtccctc

SEQ ID NO: 30150 - DNA, 201 bp, Homo sapiens
gacttttgtgatacttgacagtttgggaaaactgtcttataaacctatctggagctgttgatgttgttggtgttttattgagtgtgaatttatttcctttmgtggatataagtttagtcagggtaaccatttgtgagatagttttggtaatgtacatgtattttacagtattgtctgtttcagctgtattttcagatttat

SEQ ID NO: 30151 - DNA, 201 bp, Homo sapiens
agacatgagggtttcctttgtccattcgcctccccactgtcccctcttccatttcaacataccctgtttattagaccttacttttgtgctgtgctgtgtatgtgtgtgtgtgtgtgtgtgtgtgtcttccataagttttcatttcaaattcttaaaaattttcttgtatattccttctagaatttctaaaaagtaaagatc

SEQ ID NO: 30152 - DNA, 201 bp, Homo sapiens
gacatgagggtttcctttgtccattcgcctccccactgtcccctcttccatttcaacataccctgtttattagaccttacttttgtgctgtgctgtgtatgtgtgtgtgtgtgtgtgtgtgtgtcttccataagttttcatttcaaattcttaaaaattttcttgtatattccttctagaatttctaaaaagtaaagatct

SEQ ID NO: 30153 - DNA, 201 bp, Homo sapiens
cgtgccattccacaccatttggagatcgagcagaacaggtttgattgatgccgggtcattttgttttagatcattttcacatttatgatctctgggattayggaagaggtctgtgattcttgtgatttcaagagaggggatttaaaaatggatagggaggtttgtcacagattcatgagacctgggagtgagaaggaaagc

SEQ ID NO: 30154 - DNA, 201 bp, Homo sapiens
tctagaagttgctagcattgcacagagcatcctggagtagggacaatgttttctcttttcctctttgtcatttgtcatatcattttctctttccttcctcttttttttccccccttttcttggcttcatcttctgtatcattttttttttagttgctatttgtggcatatattatatttgtagatgattattattaattct

SEQ ID NO: 30155 - DNA, 201 bp, Homo sapiens
ttgcctctttgagagttggcttcccatagggacatcctagacactggaagatttttgcatcggcatcttcagtccatcaaatactgtccttgaaatcccastgtcctcagttggtgatggacaggggacagacatttgtggtctcatgctgagggtcttaggaaggcaagaggtggataaaagagtcagggattgagggcc

SEQ ID NO: 30156 - DNA, 201 bp, Homo sapiens
ttgctagcattgcacagagcatcctggagtagggacaatgttttctcttttcctctttgtcatttgtcatatcattttctctttccttcctcttttttttycccccttttcttggcttcatcttctgtatcattttttttttagttgctatttgtggcatatattatatttgtagatgattattattaattcttttaaagc

SEQ ID NO: 30157 - DNA, 201 bp, Homo sapiens
aggctgggaaacttactaggaaggatcaaggttgactttgccaccatgacctagccacgaacacgatgggaagaaggctgtggagtggggctgtgggcagygcctcccggggccctgaatgaagcaagcttggagagggagctggtgtgtgggtctgagtggcttctttaatgtcagcatgcgcctatgaggtgctgacgt

SEQ ID NO: 30158 - DNA, 201 bp, Homo sapiens
gaactctgtcatctttttttcttaatagtaagagcaggtgcttccatttatcattcaaggtgtactgttgcctccttttttctttagcaaagtcagtgttaaaaaaggcttcccctgagaagtcaaaggctgctacctgacatctggttgagaaggctcggttctcttgtgagctgggaggagtttcagtggattaagcac

SEQ ID NO: 30159 - DNA, 201 bp, Homo sapiens
aactctgtcatctttttttcttaatagtaagagcaggtgcttccatttatcattcaaggtgtactgttgcctccttttttctttagcaaagtcagtgttaaaaaaggcttcccctgagaagtcaaaggctgctacctgacatctggttgagaaggctcggttctcttgtgagctgggaggagtttcagtggattaagcact

SEQ ID NO: 30160 - DNA, 201 bp, Homo sapiens
caagattgtaaaaacctgctgttctaggagttgaaatgtattattattatggctatggtagaactcttctcttctttgtcatgcagacttaaagtataaarcagtctttattccagcttgttaaaagtgggaatgccgtaaaccaacacagtgagcctggagcaatgacaagctacacaaaaattaaacatatttgtattt

SEQ ID NO: 30161 - DNA, 201 bp, Homo sapiens
tctaatgccttttaccagaggagcggatagccccatccacagatccagagggtgtgtggctactaccaagggaattgccagccattgcatagtaaagcagmataattgatttatggcactcaatcctccaaaaagttgtaaatttctttggtgtctaccaagtaggtggcaacagcaaaggctaacctcagggggatttgc

SEQ ID NO: 30162 - DNA, 201 bp, Homo sapiens
tgtttgcttgattaataacttgtaaatcttaaacatgtgctacgtgagctacatttgtatttgcacttggtgtgtctgggcctgttttagggttcagatasagcccctgtgaactagaagtctttctaaggatgatttgggcacgcgtggatttagggagccagtttctacatccaccaggcctgtctcttccatgagact

SEQ ID NO: 30163 - DNA, 201 bp, Homo sapiens
tgggactgctagtctgaattggcccacagctgaattctgccctttcttatttttttcagttgaaggatttctgtataggatttctgttggatctgttctarctacacagaataagctcttcgtgtcaggaagagcagcatcttttggaatttggcggcattcttgtgttgtagttttgtgtgggagtgtgggattttgcac

SEQ ID NO: 30164 - DNA, 201 bp, Homo sapiens
atagtgatcatgaaacatatctttctgcagatgacctgagaattaatttatggcacttagaaatcacagatagaagctttagtatccttcctcagagggayactggcgtcttcccgagggtgctctttagatagtaatttctctcgtccctttatacacctgtatctcggagtctagtcttgtaaataccatcgctgcaca

SEQ ID NO: 30165 - DNA, 201 bp, Homo sapiens
  misc_feature (1)...(201): n = A,T,C or G, or insertion/deletion polymorphism (see Tables 1-2)
ggtccctgccgtcctccctctgctgtccagtggcttgagctggggttccatgtcgtatgttggttttcttagttgtttcagcttgaagggtgaaactgggnctgctagtctgaattggcccacagctgaattctgccctttcttatttttttcagttgaaggatttctgtataggatttctgttggatctgttctaactac

SEQ ID NO: 30166 - DNA, 201 bp, Homo sapiens
  misc_feature (1)...(201): n = A,T,C or G, or insertion/deletion polymorphism (see Tables 1-2)
tccagaaaatacggcaggctgcatttggcagacctgctccagagaacacggcaggctgcgtttggcagacctgcttcagaaaatacggcaggctgcattcngcagacctgctccagaaaacacagcaggctacattcgacaggctgaattcggcagacctgctccagaaaatacggcaggctgcattcggcaggcctgctt

SEQ ID NO: 30167 - DNA, 201 bp, Homo sapiens
ctccagaaaacacggcaggctgcattcggcagacctgctccagaaaacacggcaggctgcattcggcagacctgctccagaaaatacggcaggctgcattyggcagacctgctccagagaacacggcaggctgcgtttggcagacctgcttcagaaaatacggcaggctgcattcagcagacctgctccagaaaacacagc

SEQ ID NO: 30168 - DNA, 201 bp, Homo sapiens
cctgctccagaaaacacggcaggctgcattcggcagacctgctccagaaaacacggcaggctgcattcggcagacctgctccagaaaatacggcaggctgyatttggcagacctgctccagagaacacggcaggctgcgtttggcagacctgcttcagaaaatacggcaggctgcattcagcagacctgctccagaaaaca

SEQ ID NO: 30169 - DNA, 201 bp, Homo sapiens
ttaatgaaacttcccagcaccgacagttacaggagtttctcttttaaaagactcagtccattataattaagtttgaaaatcactgacagagctagaatackattaattatgtaattttatacaccctctgggtataaatgacatagatttagacctttttaatccaatacataatattttagtttcatttaagcaagttag

SEQ ID NO: 30170 - DNA, 201 bp, Homo sapiens
gcattcggcagacctgctccagaaaacacggcaggctgcattcggcagacctgctccagaaaacacggcaggctgcattcggcagacctgctccagaaaayacggcaggctgcatttggcagacctgctccagagaacacggcaggctgcgtttggcagacctgcttcagaaaatacggcaggctgcattcagcagacctg

SEQ ID NO: 30171 - DNA, 201 bp, Homo sapiens
gccggtggagacccaccaggtccacgagtacctgcgcagcaagctctgctctctctatgagaacgactgcatctttgacaagtttgagtgttgctggaacrgttcggataggtaaggcctgcgtggagatgagctgtcgccccaagcttgctggtttccgagagtgcaaggtcagtgagggaggcgagctgtcctccagcg

SEQ ID NO: 30172 - DNA, 201 bp, Homo sapiens
gctgcattcggcagacctgctccagaaaacacggcaggctgcattcggcagacctgctccagaaaacacggcaggctgcattcggcagacctgctccagaraatacggcaggctgcatttggcagacctgctccagagaacacggcaggctgcgtttggcagacctgcttcagaaaatacggcaggctgcattcagcagac

SEQ ID NO: 30173 - DNA, 201 bp, Homo sapiens
cttcatcatacacatgagacgatcaagtatcaggaagatgaagttacttggtgaaggtctcagagctaataggtgctatacccattatttgcatgcagacmttctgagtccagagcccatacttaagtttttaaccaggctgcctttttatgtggctcattttatcctttttgatggctgcatagtattcccttagttatt

SEQ ID NO: 30174 - DNA, 201 bp, Homo sapiens
tgtggagatgaaggtgtgtgctgatcccccatccccatgtggagatgaaggggtgtgttgatcccctgtccccctgtggagatggtgtgtgctgatccccrtccccctgtggagatgaaggtgtgtgctgatcccccatctccctgtgaagatgaaggggtgtgctgatcccccgtgcccctgtggacatggaggcgtgtg

SEQ ID NO: 30175 - DNA, 201 bp, Homo sapiens
agcagccagagacagtatgtgcacacatgggcctgactgtgttccactaacacttgccttaaatacggcaggctgcattcggcagacctgctccagaaaayacggcaggctgcattcggcagacctgctccagaaaacacggcaggctgcattcggcagacctgctccagaaaacacggcaggctgcattcggcagacctg

SEQ ID NO: 30176 - DNA, 201 bp, Homo sapiens
ctctacccagatggtgcagaagcagccagagacagtatgtgcacacatgggcctgactgtgttccactaacacttgccttaaatacggcaggctgcattcrgcagacctgctccagaaaacacggcaggctgcattcggcagacctgctccagaaaacacggcaggctgcattcggcagacctgctccagaaaacacggca

SEQ ID NO: 30177 - DNA, 201 bp, Homo sapiens
cctggtctttttcactctccctctagcttcccagagttgctcatgattttgaagatggcatatgtcttcccaagcatgtttctccacttctgtaacagacwtgttctgtacgtacgtaagcagcacctcactctgggcacctgtgcagcctgcttcacttgtgcagcactgtgcggttgtctgtgctggctcatttatctc

SEQ ID NO: 30178 - DNA, 201 bp, Homo sapiens
ttcctttagcatatgtactaaagtgttaaacacctaagatattagatattggttatagagcaagaatgaaagtactggcgtccttgattttgaattatgamatatttaatacttaatagaaaatttcacttagggcatacagaagattcagaggttaatatagatgtacctgcaaacccaccacccagaggttatcccttc

SEQ ID NO: 30179 - DNA, 201 bp, Homo sapiens
gcccacagctgaattctgccctttcttatttttttcagttgaaggatttctgtataggatttctgttggatctgttctaactacacagaataagctcttcrtgtcaggaagagcagcatcttttggaatttggcggcattcttgtgttgtagttttgtgtgggagtgtgggattttgcacagatggtactagcttggtttt

SEQ ID NO: 30180 - DNA, 201 bp, Homo sapiens
cctgacagctagggagggtggacaccagttcatctgcctactagcctagggtccgatttgctagtgcctccggtagggcgctagttttccttataaccacytcctgggctgctaggccacctcagttcctggtggccaggtggagaccatcaggaaggggcagtggcctcgcgagcagcacctggtctgtggttatgtgcc

SEQ ID NO: 30181 - DNA, 201 bp, Homo sapiens
ctgttggatctgttctaactacacagaataagctcttcgtgtcaggaagagcagcatcttttggaatttggcggcattcttgtgttgtagttttgtgtggsagtgtgggattttgcacagatggtactagcttggttttcctatttatatgattaagtatgtactatcttgctattaagggctttctgtataacattaata

SEQ ID NO: 30182 - DNA, 201 bp, Homo sapiens
ccggcaccttgcctctgcccagcgtgtagaggagagaagtgattgggtgggtaatggtaggaaacgaactcgttgccagagtaggggtgcgttgaaatggktgaacttgccgagtcagggtagcagagcgctggctacagcgagttcatgaaggactgggaggagagggtgtggtgaccacgagtccaaagagctgcctag

SEQ ID NO: 30183 - DNA, 201 bp, Homo sapiens
gtatgcacacagctctgccaggtgccgcagagcaggaaacaaatggccttgcccggcaccttgcctctgcccagcgtgtagaggagagaagtgattgggtsggtaatggtaggaaacgaactcgttgccagagtaggggtgcgttgaaatgggtgaacttgccgagtcagggtagcagagcgctggctacagcgagttcat

SEQ ID NO: 30184 - DNA, 201 bp, Homo sapiens
  misc_feature (1)...(201): n = A,T,C or G, or insertion/deletion polymorphism (see Tables 1-2)
gcatctgtgtctgcttgtagaaaatttcttacttccagctgagcgcagtggctcacgcgtgtaattcagtactctgggaggctgaggcaggaggatcgctngagcccaggagttcgtgaccagcctggacaacatagtgagaccctggctccacaaaacattaaaaaaggtagacaatttcccacttttcttgtctgtcag

SEQ ID NO: 30185 - DNA, 201 bp, Homo sapiens
accatctttctttccagagtggcaacacagtgcaggggggtccctgtcttagcagtgacttgctggtgtgcagaggggtcactctcttagcagtgacttgygggtgtgcagggggttcaccaccttaccagtgacttgcagggggtccctgtcttaacagtgacttgcgggtgtgcaggggggttcgctgtcttagcagtg

SEQ ID NO: 30186 - DNA, 201 bp, Homo sapiens
tcacttctattagtttatgtctggtttttgaacagaatggactttttgcctttgggtgagcttctttgaaaagacacagaaacgtgtgtatatgtgtgtgygtgtgcatctgtgtctgcttgtagaaaatttcttacttccagctgagcgcagtggctcacgcgtgtaattcagtactctgggaggctgaggcaggaggat

SEQ ID NO: 30187 - DNA, 201 bp, Homo sapiens
atggtgttgcagccgccaagagggtgaagctgctgcccatcaagcgaccccagctcccagttagaagctgcagcaaggttcacaggcgtccacgtgtgcgkcttagaatcgaaggagcgtggaggattcggaaggctagtgagtgagcaccagattgtggaaggtgcagggcctgagattcaggagtcaggtccatagagg

SEQ ID NO: 30188 - DNA, 201 bp, Homo sapiens
  misc_feature (1)...(201): n = A,T,C or G, or insertion/deletion polymorphism (see Tables 1-2)
tgtgcgcggcctgggtctgccatcagccatgcggggcctctgagcctgggaacggggccttggatgcttctgccttgctttctctgttgtgtttctagaantcgtcagctgggaggtgggccaccgaaactgatcctctgattgtcttatccttcctgtcatccatgtctttctttccactctgccctttggaggagatct

SEQ ID NO: 30189 - DNA, 201 bp, Homo sapiens
gtatgttaaaccaaccttgcattcctaggatatggtatacttctcatatttcaaaaatattgtttgttcctgtagcagagaaatttttagttctttctgasttctgtattttagaataatttgccacaaacttttttttagtgcttaagtgactagaaagtagtatgcagaattttctattttgtcacattttatccagtc

SEQ ID NO: 30190 - DNA, 201 bp, Homo sapiens
ccatgtggtctttgtcctttaatgttattagtatggtgtattacattgatttgtttttgtatgttaaaccaaccttgcattcctaggatatggtatacttmtcatatttcaaaaatattgtttgttcctgtagcagagaaatttttagttctttctgagttctgtattttagaataatttgccacaaacttttttttagtg

SEQ ID NO: 30191 - DNA, 201 bp, Homo sapiens
ccacggccacagtgggagccagaagccgtgtgacagatccagcaagtgtgactccttactctccaccgccagcttagaatcaagccttgaagtagatgctrgttcaagaatctgcttgtgataaaggcattttcaaatgggaaacaatgtatcacaacaggaaactcagtagagcgagctgtaaagggagcctggccctgc

SEQ ID NO: 30192 - DNA, 201 bp, Homo sapiens
agtgacttcctctgatggggaagccgccagtcaatcccaccagactgagccgctgctcatgtgcagcggcgcccccagtgcctcggtggaatgtgcccacrgaccgtgtgcagcagccttttcgcctgttctctttcctgaggttgagtgtgtttttaagaattcgtatttctactagaattcctgcgatgaggatgagtg

SEQ ID NO: 30193 - DNA, 201 bp, Homo sapiens
caagcatgagccatggcatgtggccgccacttgccttttttcattaagagtctataattggagatcttacagggaactgggctttctgctcagccatactygagctcatttgacccccggccactgccccttgagatgtaagtactactgtgttgccttcatcatacacatgagacgatcaagtatcaggaagatgaagtt

SEQ ID NO: 30194 - DNA, 201 bp, Homo sapiens
tgtggcgctgtgggctcctggatggaagcaggagatgggaaataaacatggatcgctgaatgcagtttctcttctctgagttcgtctttttttttttttttcccctgctttgaagttttagacaaggtcagtcagacactaggtatttgccagcagccagggtcagtgctgggccatggaagggaagcggcccgcttcttt

SEQ ID NO: 30195 - DNA, 201 bp, Homo sapiens
aggaatgccctgcacgtcagactcagtgcagcgacgcggggcaggcgaggcgctcagcttctgcccgtggaggcttcggtggaaggaatgccctgcacatyggactctgcagcagtgcgggtgtgggtagcttcttgggatgtcttctcctgatacttgatcagattggaaatatcaaggaacatctgtttagacttgaaa

SEQ ID NO: 30196 - DNA, 201 bp, Homo sapiens
agtccattcactctcaaaaacacgcccgtcttcctacctggaaacttctgttgagggatgcgatgaaggggagtgaggcgtttcagtgctgcctcagcccratcctgattctccgtgtggcagcgccttcttgtgttctaggtcgccccacagaaccagttatgtgcttacgcctgtgtctctgtctgtgctgttcccttc

SEQ ID NO: 30197 - DNA, 201 bp, Homo sapiens
cttgatatatttcaaatattgcaaaatacccttagattacatatccccaagaacatctaaaagcgttcccagtaacatttgcttagtccattcactctcamaaacacgcccgtcttcctacctggaaacttctgttgagggatgcgatgaaggggagtgaggcgtttcagtgctgcctcagcccaatcctgattctccgtg

SEQ ID NO: 30198 - DNA, 201 bp, Homo sapiens
gggggttcactgtcttagtgacttgcgggtgtgcggggggttcactgtcttagtgacttgcgggtgtgcgggggggttcacttagtgactttcgggtgtgwgggggttcactgtcttagcagtgacttgcgggtgtgtgtgggaggttcactgtcttagcagtgacttgcgggggttccctgtcttagcagtgacttgcag

SEQ ID NO: 30199 - DNA, 201 bp, Homo sapiens
gggtgtgcggggggttcactgtcttagtgacttgcgggtgtgcggggggttcactgtcttagtgacttgcgggtgtgcgggggggttcacttagtgacttkcgggtgtgtgggggttcactgtcttagcagtgacttgcgggtgtgtgtgggaggttcactgtcttagcagtgacttgcgggggttccctgtcttagcagt

SEQ ID NO: 30200 - DNA, 201 bp, Homo sapiens
tcagaaaacctagagaatcagaaagatcagaagacctagtgttgaggccaagcccttccagagtctctctgaaggggccacttcctacttgaacttgaaaatgatttgttctctgatttttaaacagaagctgaaaacattttattttgtttttcagtttttgaagagcctgaagatcccagcagtaggtccttcttctca

SEQ ID NO: 30201 - DNA, 201 bp, Homo sapiens
agctcatcctttgtgaagtgtgcgggtgaatattcagttttgtggccatctgaattggataattctagaacctttccatcacccctaaaagaaacccactrgcagtccctcccattccctccaccctctgccctctggtaaccactgattactttgtttctgtggatttgcctgttcacgtgtcatgtaaatggagtcatg

SEQ ID NO: 30202 - DNA, 201 bp, Homo sapiens
tttctctatgttggccaggctggtcttgaactcctgacctcgtgatccgcctgcctcggcctctcaaagtgctgggattacaggcatgagctactgcgccyggccattatctgtcaatttttttcttaaaaaaaattggaaagtagccaaaaagaaaacaaagtccctttaggtttaaataggaaaatgaatttagtaatt

SEQ ID NO: 30203 - DNA, 201 bp, Homo sapiens
tttgccaaattgcctctcgcagcagtttcctgagaaagcatttgtttgttttggctctttgcatattcgaaaacatttttactgctccctcagatttgatygaaaacttgactaggtctagcatttcaggttgaaaattgttttctcccagaattttgagggtagtttgaggtttcatccaccatgtttcctgcaacctgt

SEQ ID NO: 30204 - DNA, 201 bp, Homo sapiens
gagttcatccgttgccatttgatgagggctctgggagtcaaaaggcttccctgaacaaggaacccttgagctcagatgcaaatgagggatgggcctggacygggatgggggatgggaggagcctgcaaaggggagagagggtgggaggacttgacatgggagaagaacaggctggggcaatggggtgtgaaagcaaaggga

SEQ ID NO: 30205 - DNA, 201 bp, Homo sapiens
tgtgttgcccaggatggtcttgaactcctggactcaagtgatcctcccacctcggcctcccaaaatgctgggaatacaagcatgagccatggcatgtggcygccacttgccttttttcattaagagtctataattggagatcttacagggaactgggctttctgctcagccatactcgagctcatttgacccccggccact

SEQ ID NO: 30206 - DNA, 201 bp, Homo sapiens
ctccagatgcatacctagaagtggagtcgaagagtcggaaatcaagttcgttcttttttttttttttttccctgagtttcatctgagatttttttgagccrggattttttagctttaaaaaatatgtatggtcatttgatattcaaatttatagtactgaaattttctctacactgtgctttgttcattaaaacagctctc

SEQ ID NO: 30207 - DNA, 201 bp, Homo sapiens
cacatgagacgatcaagtatcaggaagatgaagttacttggtgaaggtctcagagctaataggtgctatacccattatttgcatgcagacattctgagtcyagagcccatacttaagtttttaaccaggctgcctttttatgtggctcattttatcctttttgatggctgcatagtattcccttagttatttagtccactg

SEQ ID NO: 30208 - DNA, 201 bp, Homo sapiens
agtgacttgcggttgtgtgtgggggggttcactgtcttagcagtgacttgcgggggggtccctgtcttagcagtgacttgcaggtatgcgggggttcactrtcttagtgacttgcaggtgtgcgggggttcactgtcttagtgacttccagttgtgcggggggttcacttagcagtgacttgcgggtgtgtggggggttca

SEQ ID NO: 30209 - DNA, 201 bp, Homo sapiens; identical to SEQ ID NO: 7909

SEQ ID NO: 30210 - DNA, 201 bp, Homo sapiens; identical to SEQ ID NO: 7906

SEQ ID NO: 30211 - DNA, 201 bp, Homo sapiens
attgatcattcctgatttctgaaagtaactgggttgtgggggagggtggcgtgcgctgtgcaccccaggggtggggtctgagtccttgctgccgctccccycactgaggagtgctgctgtctgctcttgttttgaacagcgccatcatgaccgggtcctataacaacttcttcaggatgtttgatagagacacgcggaggg

SEQ ID NO: 30212 - DNA, 201 bp, Homo sapiens
ttgtctcacttggtaatgatgtcatcattatcagtggtggtaactgtatccagacaatgacatggaacttctactgtctagaatattacattgtacagaarccaacaaaagttattgcatagaatattaacaacatttttattactattatataagaatcagatttattttaaaagttaacattaggtatgcattataaaa

SEQ ID NO: 30213 - DNA, 201 bp, Homo sapiens
aaaagagttaacattaatcatcatagaaatggtattaatgagcaaagatatgaccggcctcacacctgtaatcccagcactttgggaggccaaggcaggargatcccttgagcccaggaggtcaaggctgctgtgagctgtgatcacaccactgcattccagcctgggaacagagtggaccctgtctcaaataagcaaaga

SEQ ID NO: 30214 - DNA, 201 bp, Homo sapiens
tcccaggccagggattcccgtgtgaggccagcgaacagtgccagccgcgggagcttgctgtgtagatgttggtggaaatccttcactaacacgattaaaaygcctttgcagacctgtcagaattgcattctagccacttttggagggagctgtttgagtcacttcagctttagggcccatttcttcttagtaggttgttta

SEQ ID NO: 30215 - DNA, 201 bp, Homo sapiens
tgtctgtgaaattggttcatagcctgtccctgctcttgagtgtttatccaaatagatccatgggttgccttttatcagacagaggccgatggggaattgcrgctctgccgtggccgcgcttctccagctccctgcaactttgtcagaccctagagatctgttcagtgtcacaggtcacatttcttagatgttgacttcgtt

SEQ ID NO: 30216 - DNA, 201 bp, Homo sapiens
  misc_feature (1)...(201): n = A,T,C or G, or insertion/deletion polymorphism (see Tables 1-2)
tttttctgctttcttctgacacctgggcgggggtgggagggtaaaggagatgaacacacacgcatggcccaccatgttcggcgggaggtctgagaggactnggggtggctgcggacactttgcggatttgatgggacccggatgttgaatgaggattgcacagccagacagccagctggcagcagtgccacggcaggtgga

SEQ ID NO: 30217 - DNA, 201 bp, Homo sapiens
tattttgtttttcagtttttgaagagcctgaagatcccagcagtaggtccttcttctcagaaataatttcatccatatccgatgtaaaattcagtcatagkgggcggtacatgatgaccagagactacctgtcggtgaaggtgtgggacctcaacatggagagcaggccggtggagacccaccaggtccacgagtacctgc

SEQ ID NO: 30218 - DNA, 201 bp, Homo sapiens
ctgttttctctgatttgggatggtaagaaatccttttgtgaataataagtatatcgttaatatttcttcacagtttgatacatttataattttgcatttttatctcagaagtagaatatcacacaatgctacttaagaaccatataccttggccaggcacagtggctcacgcctgtaatcccagcaatttgggaggccgag

SEQ ID NO: 30219 - DNA, 201 bp, Homo sapiens
cttttttcattaagagtctataattggagatcttacagggaactgggctttctgctcagccatactcgagctcatttgacccccggccactgccccttgaratgtaagtactactgtgttgccttcatcatacacatgagacgatcaagtatcaggaagatgaagttacttggtgaaggtctcagagctaataggtgctat

SEQ ID NO: 30220 - DNA, 201 bp, Homo sapiens
atggaaaataagtgaacgggataaaagagcagaaggttataacctgaaagacgaagatggaagacttcgagacccatttaggatcacggcgctacgggtayacgttgcctttgctttatccaatgctgttgagaagttaagaataaacgtttcagtctgctgtctggagagtgctgcgcggtggagtactgtgaggtctgc

SEQ ID NO: 30221 - DNA, 201 bp, Homo sapiens
gatagccttagggaagatgcctcatccctgcctaacagattttaggttagaaaatggaatttctcttgtttttgtgaatcgttgcttaacctaaataatartagtctcaaatataaaacaaaccctgataaaagtcaagcatctcgttctaaaagatactgggtattatagagtgttaagtgcttttttaagatgaagttg

SEQ ID NO: 30222 - DNA, 201 bp, Homo sapiens
  misc_feature (1)...(201): n = A,T,C or G, or insertion/deletion polymorphism (see Tables 1-2)
atttctcttgtttttgtgaatcgttgcttaacctaaataatagtagtctcaaatataaaacaaaccctgataaaagtcaagcatctcgttctaaaagatantgggtattatagagtgttaagtgcttttttaagatgaagttgttatgtgagtgacagatttatacaggagcaagtccctactgaagttgttcagccagct

SEQ ID NO: 30223 - DNA, 201 bp, Homo sapiens
catccgtggaaatgacaacagcgtgaaaacggcagatgatgtacaaggattatgatgaaaatagtcttgacctcacggaccctctgagaggttcttgaccrttgcaccctcaagggcccacagaccgcactttgagaactgctgcttgaatgcaagctattagcagtaggagtgtcaaggacagggcagacttcaggatta

SEQ ID NO: 30224 - DNA, 201 bp, Homo sapiens
cctaaagtttgagatgtgcttttccccttttgataccagctctcagagtgatgatcgtttctgtataggcaagggaaatacttgtcactgccttcttgctrgtttgactgactctgaaatacttaaagatagttgtatttgttgttgcatgtctagatctgccacgggggagaggccagagaggctttgctgacgtgcagg

SEQ ID NO: 30225 - DNA, 201 bp, Homo sapiens
atccgtggaaatgacaacagcgtgaaaacggcagatgatgtacaaggattatgatgaaaatagtcttgacctcacggaccctctgagaggttcttgaccgytgcaccctcaagggcccacagaccgcactttgagaactgctgcttgaatgcaagctattagcagtaggagtgtcaaggacagggcagacttcaggattaa

SEQ ID NO: 30226 - DNA, 201 bp, Homo sapiens
agtgtagggacctcacacaggtggaatgacacagtgtagggacctcacgcgggtggagtgacacagtgtagggacctcaggcaggtggaatgacacagtgkagggacctcacgtgggtggagtgacacagtgtagggacctcacgcgggtggaatgacacagtgtttgtggggacctcacgtgggtggaaggacataatga

SEQ ID NO: 30227 - DNA, 201 bp, Homo sapiens
ggtggaattacacagtgtttgtagggacctcacgtgggtggaatgacacagtgtttgtagggacctgacgtgggtggaatgacacagtatagggacctcasgcgggtggaatgacacagtgtttgtagggacctgacgtgggtggaatgacacagtgtagggacctcacacaggtggaatgacacagtgtagggacctcac

SEQ ID NO: 30228 - DNA, 201 bp, Homo sapiens
gtttgtagggacctcaggcgggtggaatgacacaatgtagggatctcacgtgggtggaatgacagtgtttgtagggacctcaggcgggtggaatgacacagtgtttgtagggacctcaggcgggtaggatgacacagtgtagggacctcacgcgggtggaatgacagtgtttatagggacctcaggccggtggaatgacac

SEQ ID NO: 30229 - DNA, 201 bp, Homo sapiens
tgtttgtagggacctcaggcgggtggaatgacacaatgtagggatctcacgtgggtggaatgacagtgtttgtagggacctcaggcgggtggaatgacacagtgtttgtagggacctcaggcgggtaggatgacacagtgtagggacctcacgcgggtggaatgacagtgtttatagggacctcaggccggtggaatgaca

SEQ ID NO: 30230 - DNA, 201 bp, Homo sapiens
aacctccgcttcccaggttcaaacggttctcctgcctcagcctcccgaggtgtgattacagggatgccaccatgcccggctaattttttttttttttttttgtatttttagtagagttggggtttcaccatgttggccaggctggtctcgaactcctgagctcaagtgatccgcccacctcggcctcccaaagtgctggga

SEQ ID NO: 30231 - DNA, 201 bp, Homo sapiens
tccacgagggctgtgtgcgggcatcgggagggaccggcgtgtttccagatctggcttctactctgtttgcagactgacctgccagcctgtagcatctcacrgatgttgactgaagacatgaggttcccgggttctcatggcacagctggcagcatgagcctctcgttggcctgggttccccacgggtggacacttgaggcc

SEQ ID NO: 30232 - DNA, 201 bp, Homo sapiens
cttagcagtgacttgcgggtgtgcagggggttcaccaccttaccagtgacttgcagggggtccctgtcttaacagtgacttgcgggtgtgcaggggggttygctgtcttagcagtgacttgcgggtgtgcgggggggttcactgtcttagcagtgacttgcgggtgtgcagggggtttcactgtcttagcagtgacttgcg

SEQ ID NO: 30233 - DNA, 201 bp, Homo sapiens; identical to SEQ ID NO: 7924
  misc_feature (1)...(201): n = A,T,C or G, or insertion/deletion polymorphism (see Tables 1-2)

SEQ ID NO: 30234 - DNA, 201 bp, Homo sapiens
ggaagcggacaaatactcagagcaggtcagggcctacctgagggcaagtgcatggagtggctccgcagacacctggagaacgggaaggagacgctgcagcrcgcgggtaccaggggccacgggggcgcctccctcatttcctgtagatttcccgggctggcctcccaccaggagagtaggaaaatgggaccaatgctagaa

SEQ ID NO: 30235 - DNA, 201 bp, Homo sapiens
tgtgccatgtgcagcatgaggggctgccagagcccctcaccctgagatggggtaaggaggggtgtaagttgtctcctctcagggaaagcaggagaccttcygcagggcagggctgaggcctgggggtcagaacccctcacctccctctcctttcccagagccgtcttctcagcccaccatccccatcgtgggcatcgttgc

SEQ ID NO: 30236 - DNA, 201 bp, Homo sapiens
ctgagggcaagtgcatggagtggctccgcagacacctggagaacgggaaggagacgctgcagcacgcgggtaccaggggccacgggggcgcctccctcatytcctgtagatttcccgggctggcctcccaccaggagagtaggaaaatgggaccaatgctagaatatcgccctcccactggtcctgaatgggaagaatcct

SEQ ID NO: 30237 - DNA, 201 bp, Homo sapiens
ttcccagagccgtcttctcagcccaccatccccatcgtgggcatcgttgctggcctgtttctccttggagctgtggtcactggagctgtggttgctgctgrgatgtggaggaagaaaagctcaggtagggaaggggtgagaggtggggtctgggttttcttgttccactgtgggtttcaagccacaggtagaattgtgact

SEQ ID NO: 30238 - DNA, 201 bp, Homo sapiens
gagccgtcttctcagcccaccatccccatcgtgggcatcgttgctggcctgtttctccttggagctgtggtcactggagctgtggttgctgctgcgatgtygaggaagaaaagctcaggtagggaaggggtgagaggtggggtctgggttttcttgttccactgtgggtttcaagccacaggtagaattgtgacttgcttc

SEQ ID NO: 30239 - DNA, 201 bp, Homo sapiens
gccttccggagaggagcagagatacatgtgccatgtgcagcatgaggggctgccagagcccctcaccctgagatggggtaaggaggggtgtaagttgtctkctctcagggaaagcaggagaccttcagcagggcagggctgaggcctgggggtcagaacccctcacctccctctcctttcccagagccgtcttctcagccc

SEQ ID NO: 30240 - DNA, 201 bp, Homo sapiens
ccttccggagaggagcagagatacatgtgccatgtgcagcatgaggggctgccagagcccctcaccctgagatggggtaaggaggggtgtaagttgtctcrtctcagggaaagcaggagaccttcagcagggcagggctgaggcctgggggtcagaacccctcacctccctctcctttcccagagccgtcttctcagccca

SEQ ID NO: 30241 - DNA, 201 bp, Homo sapiens
caaaatccccgcgggttggtcggggcgggagcggggctcggtgttcggggctgacggcgggggcgaggccatggttctcacaccatccagaggaagcatgrctgcgacgtgggcccgacaggcgcctcctccgcaggtatgaacagttcgcctacgatggcaaggattacatcgccctgaacgaggacctgcactcctgga

SEQ ID NO: 30242 - DNA, 201 bp, Homo sapiens
cttctggtttattttttcatttttattttttgagatggagttttgctcttgttgcccaggctggagtgcaattggcgtgatctcagctcactgcaacctcygcctcctgggttcaagcgattctcctgcctcagcctgcccagtagctgggattataggcatgcgccaccacacctggctaattttgtattgttagtagag

SEQ ID NO: 30243 - DNA, 201 bp, Homo sapiens
ccaggtgtggtggtgggtgcctgtagtcccagctactcgggaggctgaggcaggagaatggtgtgaacctgggaggcggaggttgcagtgagctgagatcrcgccactgcactccagcctgggcgacagagtaagactccatctcaaaaaaaaaaaaaccaaaaaaaaaaaacgggcggtctcttgactctgtcaggaccc

SEQ ID NO: 30244 - DNA, 201 bp, Homo sapiens
cagagaattaggtaggacgaggagggatttggggctggatgggtaagttggggctagccggatgcagggcaggggaggatgtctgtgcagtttttttttttgttttgagtcagagtctcgctctgtcacccaggctggagtgcagtggcgtgatctcagctcactgcaacgtccgcctcctgggttcaagcgattctcctg

SEQ ID NO: 30245 - DNA, 201 bp, Homo sapiens
aactttcagaaacgaaaacccaaagaaatggggacatttgtgtagttgtatagacagtcaggcagatgtatgattgcaaggacaaaagtgtatgagctaayggtgataaactgagaagttggaaaggcctgtctattcagtttcttcttggcatacctgtgtggcagtccctccctcagggcataggagaggatgcctgtt

SEQ ID NO: 30246 - DNA, 201 bp, Homo sapiens
ctacctcctgcccctctttgagccctgtggggatttctagcgttcagagccctggtagtttttgtggcctgcactgtgcttcagagcaccactgatgctcrgctccgtggggaaagtaagccaagtgtgaccacaagaacgcatcatccacagtcactgggatctcctgggacagcctgggatccaggcctttggcctggc

SEQ ID NO: 30247 - DNA, 201 bp, Homo sapiens
tgcaattttattgtttaagtagactttatttcttacaacacttttagatttacagaagaattgagaagatagtacaaacttcccacatgctccaaaccggrtcccctgttattaacatcttacctcagtgtggtacatttgttgcagttaaccaatatcaatacattattattgaccaaagtccatagtgtgttcagattt

SEQ ID NO: 30248 - DNA, 201 bp, Homo sapiens
tggctttggctgttgggagctcttttcacattggctcctgtgctctttcatagtatttttatagagctttttgctaatgagacactcgtacttatgtgacyttgcctcaacctcaaatagcctggtaaacttggcaaaatattttccccttgttaagaggtaaggagactgaaggcctaaggcagtgggtgacttcttaga

SEQ ID NO: 30249 - DNA, 201 bp, Homo sapiens
agttgagacagggtctcactatgttgctgaggctggtttcaaactcctcggttcaagtgatcctcctgcctcagccacccaaagtgttggatttacagggkgagccatgtcacattgccctctcttagttcttgaaacctgaaaccttgaggagcaaacaaaaggggtctcttggccaggtgcagtggctcacgcctgtaa

SEQ ID NO: 30250 - DNA, 201 bp, Homo sapiens
aagacactgcaaacccccgaagagagtccatggtctgtattgaggcttcttggaatgacttcagacttggacccccccaggatcagaatagaaaagacacrgagaatgggaagttggtttgagaagacaaaaacataaattggctggcatcaggatgaattagattttgccagctttatagaaatggaattttgttcttcc

SEQ ID NO: 30251 - DNA, 201 bp, Homo sapiens
acccccgaagagagtccatggtctgtattgaggcttcttggaatgacttcagacttggacccccccaggatcagaatagaaaagacacggagaatgggaarttggtttgagaagacaaaaacataaattggctggcatcaggatgaattagattttgccagctttatagaaatggaattttgttcttccccccaaaattgt

SEQ ID NO: 30252 - DNA, 201 bp, Homo sapiens
aaaaattgtatagttagagagcagcaattaagtaaaatcagctcataatcacatggatgagcctcacaaacatgttgacagccccccacccaaatacatgsaaaaaaaaaaaaaaaaaggaaaaaaattccattcatttgaggctcaaaacctgagaaaataaactctgtttatggggtgtatacctaggtctaaaactaa

SEQ ID NO: 30253 - DNA, 201 bp, Homo sapiens
tggtatccttggggagggagatcctggaacccatcacccactgataccaagggacaactgtagttagaaaacaggcagcacattatgtacttgattagagwtggggttggggggaactgatcaaatggttctgattttctggggaactgtgtatgttgaggaagtgggcagtggaggagtagtggggtcagggccagtggt

SEQ ID NO: 30254 - DNA, 201 bp, Homo sapiens
cctcatcactgccatcacaagccctcttaacaagtcattggcagacacttagcagctggtggaagctttttatggtgttgtggttgggggtggctgagggrgggctgaccagcagctcctctcaaagacccagaggatctggaagagatagggtaactggggaagggagacagagatggccaggttttctttggcccatgg

SEQ ID NO: 30255 - DNA, 201 bp, Homo sapiens
attggctggcatcaggatgaattagattttgccagctttatagaaatggaattttgttcttccccccaaaattgtgtgtgtgtggagggaggccaagagakatctaggtaatgtgtgtgggcaagaatgtctaatctaaagagagccctggaagcctgctgctgaagcagaattttaatgtgggaaaggggggtgtgtagt

SEQ ID NO: 30256 - DNA, 201 bp, Homo sapiens
ataccaagggacaactgtagttagaaaacaggcagcacattatgtacttgattagagatggggttggggggaactgatcaaatggttctgattttctgggraactgtgtatgttgaggaagtgggcagtggaggagtagtggggtcagggccagtggtgagtcattaggcctagggagagggaaacagtaagctagagaca

SEQ ID NO: 30257 - DNA, 201 bp, Homo sapiens
tgccctggtaacccgggcaggccctgcaggatcaggtggcatgcttgtaccctgcttctcctgctgtacacccccgtgaagaactttcttgatgctctctsttagtaaccgggcacatcccctccgggagcttgccatgactcattgccgcagccccactgctcggctctgcctgtttcatgacagcttcagatgtcttgg

SEQ ID NO: 30258 - DNA, 201 bp, Homo sapiens
gtgagaagagtcctccaggagacttgggcggatcacttccctccagaggccctgtatgtggctgtggatgggggctcctgagtctttcagcctcttctcckcagggccagccctgccctggctctcgggacccaccctctctgggctgctcacaacctttaacctttagaggactcttctttctcctgtatgattctctcc

SEQ ID NO: 30259 - DNA, 201 bp, Homo sapiens
tctcatactcaacctcatttctcctaattctgaaatcttgagatcctctatcactaagaaggaaaactactgtccaacagggacactttattgctcacccyatatgtgaaagtttgtcatagctaaggctagggtgcttttggtcagtatcagcagaatatatgccccctttcttttgtcagcattactccgcttacaaag

SEQ ID NO: 30260 - DNA, 201 bp, Homo sapiens
cagcctgcaccccaccggcccctgctcccatcccccttcactctgctctcttttcccgtggtgcgtatcactcacgtagtatgatgtatttgctacattgrttattgtctgcttccccctgctagaatgtcagctctacagaagtagggatttgtctctctctctcttttttttttttttttttaactgttctgaggcttc

SEQ ID NO: 30261 - DNA, 201 bp, Homo sapiens
gatcacagagaatatactgacggcataaaagggcagaaccatagcagggtgcggtaagttggggaagagtttttggagagggtgaattttgcattggacckgacagaattgtgtatggggaaggggagcggttattctggtctgctcacatctctcatactcaacctcatttctcctaattctgaaatcttgagatcctct

SEQ ID NO: 30262 - DNA, 201 bp, Homo sapiens
gcacttaataaatatttgtggaatgagtgaaaggaaggcaaaaatcaattaatacagggtattaaggaggcttttgactcacaaaagggaatctgagcatstcagaatagccctcttcccactcaccctgccctaccacctgtctgtcacagagatagcaccaccattctcccccctgtacaaaccatgctctgttcttgt

SEQ ID NO: 30263 - DNA, 201 bp, Homo sapiens
ccttggcaccagacactgcttcctagccatgtgctcttgggcaagttgcttaaccctgctgagcctcagtttcctcagaaggagtctgtataagcaagggragggattggtcatagaagtggtactgtgtttcatttatctagttatggcagactctcaaaaacaaatggttctatacaactaacattgtctgcaattccc

SEQ ID NO: 30264 - DNA, 201 bp, Homo sapiens
ctgttgagatcacagagaatatactgacggcataaaagggcagaaccatagcagggtgcggtaagttggggaagagtttttggagagggtgaattttgcaytggacctgacagaattgtgtatggggaaggggagcggttattctggtctgctcacatctctcatactcaacctcatttctcctaattctgaaatcttgag

SEQ ID NO: 30265 - DNA, 201 bp, Homo sapiens
agaccagaggccatatccaccacaggccccactattgtgccccctctcagccctgcagttaggttgtacactgcataccaaccaccaaggagcgccatccwcatagaccaagatgtgaatggtgccccttggattgtgaagactggtggtctcctcctggctcactttcacacttgctttcgtgagaaccattgaggaggt

SEQ ID NO: 30266 - DNA, 201 bp, Homo sapiens
gtaggagctggtggtgtctgtcgattgactgagtgctggagctggcagccctgtgcaggctgccacctttgcccctttactgtgcttgctcctgactctaygtcgcgtctccaaggagaagaagtcctcaccagtgaacggagacctctctgaactaagaataccatggccacgtcagccccactacggagcctggaagag

SEQ ID NO: 30267 - DNA, 201 bp, Homo sapiens
gctggacaaaggggaaaaagacaaaatgctgggctggggtagaagggaaggacgcgggtgttaaatgtgggcgtggtttcttctgaatgtcccacccactycactatacattgcttaaatgcagtgcaaatttccctacccccagcggaggaggggtgaagattcagcaggttttagggtctaggaccctgagctcctcca

SEQ ID NO: 30268 - DNA, 201 bp, Homo sapiens
tcttcaggagttgccgaatgcccgaatgccctcttttctaatcccatggatgacagcttaatttgtgcaataaaattgctgaagttgacagggtcagtttwggaagatgcttggaaggaaaaggaaggactgatatggaagaaattattcaggaaattgaaaatgttgttatagatgcaagctgtggcagagacatgaaac

SEQ ID NO: 30269 - DNA, 201 bp, Homo sapiens
gagctgggaggtgcacctcaccccacctcgtgctagtgctggccttgctgccagccagctctgctgctgggcaaatgagtccgaggctctggcactcactktcctcctctgtaaataaggggttctagtgattcacagtcctggatagactttagaatctcctgggaagtttgttttttaataccagagcctgggccacct

SEQ ID NO: 30270 - DNA, 201 bp, Homo sapiens
cttgactctgtcaggacccccatgactgctcgtgtgtcttgtgctttgcacagttgagtgaaggagcactgtgtccacagtagacattgtagatttatatrtgtatcattatgagtttcccagcaggtagtgagagattttttattacagttggtgcattacagcgattttccaacagatagaaggaaagggtgttgaggc

SEQ ID NO: 30271 - DNA, 201 bp, Homo sapiens
agatcctaagtcagttggtctaggtatgttttgaagactcaccagtttgaagactacaaatctgatgtgtagtcaaggtttgaaccattccacaagatgawaaaggattccttcctatatttggtgcaaagcaccaagtgacacttaggaatattttagacaagagagcttggttcatgattcaacattagacagatattc

SEQ ID NO: 30272 - DNA, 201 bp, Homo sapiens
aagactaggccagttgccatgtgcaatgtccagcattctggatttatctggttctttccttatggtgtggtttaattcctccatcggtactttttcagttrtaacatacttcagagtattcctttcctttatattttttataaactggaagttagatctaaagtcttgactagattcattcaagtcaaacatttttggcac

SEQ ID NO: 30273 - DNA, 201 bp, Homo sapiens; identical to SEQ ID NO: 7932

SEQ ID NO: 30274 - DNA, 201 bp, Homo sapiens
atacctagggagccaagagttatattcccccttcttgagggcaagtatctacatattattgtttgcagttattctgcatggaagatttgtttctctcttctccccaatttattaatttattcaatcattaatttcagtgtagactcagggacatttattttatactttggtttataatccaatactacttaattttgttgc

SEQ ID NO: 30275 - DNA, 201 bp, Homo sapiens
taagcggggcctggatgaccgtccggttgcttggagcctggtagataggcgactaatccagctccctgaccaaagtgtcatgctttctttctctttctttytttttttttttttgttcggagtaaaccggtttagccacaaatacttggagctgtgctttcactccttccagctcattagcatttttcttactgattttct

SEQ ID NO: 30276 - DNA, 201 bp, Homo sapiens
gtatggtgccagaggtactcacatcccatggttcatcctgatgcctttctgaggagcaggacacatcattgagaactggagacttgctctcctccttatgagttctctgtgtagccccagctccttggcccactggccttatttgaggtgggacagagcagagaggttagaaacatggcttagtagacagagcgccctgga

SEQ ID NO: 30277 - DNA, 201 bp, Homo sapiens
ttgcttgagccagggaggccgaggttgcagtgagcccagatagttccactgcactctgggggacagagtaagaccctgtctcaaaaaaaaaaaaaaaaaaagaaagagaggaaataattttttaatatgatctaacacccagcctacttacaaatttcccacaatagttccaagactatttttataaccttttttttcttt

SEQ ID NO: 30278 - DNA, 201 bp, Homo sapiens
cccttgtttatgttcccccgcttctgaccaggtgcatttgaattcatggggagtggtatggtgccagaggtactcacatcccatggttcatcctgatgccyttctgaggagcaggacacatcattgagaactggagacttgctctcctccttatgagttctctgtgtagccccagctccttggcccactggccttatttga

SEQ ID NO: 30279 - DNA, 201 bp, Homo sapiens; identical to SEQ ID NO: 7935

SEQ ID NO: 30280 - DNA, 201 bp, Homo sapiens
tgccagaggtactcacatcccatggttcatcctgatgcctttctgaggagcaggacacatcattgagaactggagacttgctctcctccttatgagttctstgtgtagccccagctccttggcccactggccttatttgaggtgggacagagcagagaggttagaaacatggcttagtagacagagcgccctggatgtgga

SEQ ID NO: 30281 - DNA, 201 bp, Homo sapiens; identical to SEQ ID NO: 7937

SEQ ID NO: 30282 - DNA, 201 bp, Homo sapiens
attgccatgaggattgagagataagtatgaaggaaagtaagaagagctgagtaacagcttgttatgtatgtcatcttcttaggtatccacggaagaagttytgggttgggaaacccattgctcgagtggttaaaaaaaagaccggagaattctcagataaactcctctctctgcaacgaggcctgagggaattccagggta

SEQ ID NO: 30283 - DNA, 201 bp, Homo sapiens
tctcctgaggattgaggggactcctgtatgaatgtatctttagcggatggggggtgctactgtatgaagcactgtgatagtgctattgtagaaatacagtrtatgcaaagctgcaggaggagggatacattcaactcagaggtgggatgggtacaggaaacacctcacagataaggggacaaattgtattcaagccttcaa

SEQ ID NO: 30284 - DNA, 201 bp, Homo sapiens
acccaggctggagtgcagtggcgtgatctcagctcactgcaacgtccgcctcctgggttcaagcgattctcctgcctcagcctcccgagtagctaggactrcaggcgcgtgccaccatgcccggctaatttttgtatttttagtagaggctgggtttcaccatgttggccaggatggtctcgatctcttgacctcatgatc

SEQ ID NO: 30285 - DNA, 201 bp, Homo sapiens
gtggtgtctgtcgattgactgagtgctggagctggcagccctgtgcaggctgccacctttgcccctttactgtgcttgctcctgactctatgtcgcgtctycaaggagaagaagtcctcaccagtgaacggagacctctctgaactaagaataccatggccacgtcagccccactacggagcctggaagaggaggtgacct

SEQ ID NO: 30286 - DNA, 201 bp, Homo sapiens
gttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccactgggg

SEQ ID NO: 30287 - DNA, 201 bp, Homo sapiens
tgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccactggg

SEQ ID NO: 30288 - DNA, 201 bp, Homo sapiens
ggtctaaaactaaagaaaagggaaggagtgattctcactattacaatttactccacaacaaccattttctcagacacagctttttcttctcctggtttctrtaagttgctggagcgaaaccttggatacgatgatttgctggtgacgtgcagcccactgttcttgctgctacagggaatatgaagaaattgcttctctctc

SEQ ID NO: 30289 - DNA, 201 bp, Homo sapiens
ctgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccactgg

SEQ ID NO: 30290 - DNA, 201 bp, Homo sapiens
ggcacctctctgggtggcatctaggagccggaggcaggccagagtttcacccaggctggagtgcagtggcgcagtcatggctgtctgcagcctcaacttcycgggctcgggagatcctcctgcctcaacttcctaagtagctggaactataggcatgtgccatcgcacccagctaattcagctaatttctttttttggaga

SEQ ID NO: 30291 - DNA, 201 bp, Homo sapiens
actgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccactg

SEQ ID NO: 30292 - DNA, 201 bp, Homo sapiens
aggactgatatggaagaaattattcaggaaattgaaaatgttgttatagatgcaagctgtggcagagacatgaaacagatgctcttgaagcttgtagaacyccagtgcagtaattggggtagagtccatgcaacttcatcatacagaaatacaacagccaaaaaagatcccaattactatgtgaatgaaccaacattttat

SEQ ID NO: 30293 - DNA, 201 bp, Homo sapiens
gcacctctctgggtggcatctaggagccggaggcaggccagagtttcacccaggctggagtgcagtggcgcagtcatggctgtctgcagcctcaacttccygggctcgggagatcctcctgcctcaacttcctaagtagctggaactataggcatgtgccatcgcacccagctaattcagctaatttctttttttggagac

SEQ ID NO: 30294 - DNA, 201 bp, Homo sapiens
ccactgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatccac

SEQ ID NO: 30295 - DNA, 201 bp, Homo sapiens
tatgatctaacacccagcctacttacaaatttcccacaatagttccaagactatttttataaccttttttttctttttacaggatccaatcaaggttcacrtattgcatttggttattatttctctttagtctgtaaaaatcaaaagcagttctttcgaaggtttttttttatgacattgactttttaaaagactaggcca

SEQ ID NO: 30296 - DNA, 201 bp, Homo sapiens
cctgagtctcccttcctgccccagcccagagcatccacctgttgccactgcttgtttttccacaggaaaaaatcctgaaccacctgagtaccctaaggagrgacagagacaaaattcagggcttccaggcaaagggagaagctgatatcctggccgcgctggtaagtgaggctgtttcaggaagccctgaggcggtgcgcc

SEQ ID NO: 30297 - DNA, 201 bp, Homo sapiens
cccactgttccttcatcacaagaagggtaagtacagtacaagatagtttgagagagagagagaccacatgcatataacttttattacggtatattgttatagttattctgttgtgttattattgttaatctatttctgtgcctactttataaactttattacaagtgtgtatgtgtaggagaaacaggtttcagacatcca

SEQ ID NO: 30298 - DNA, 201 bp, Homo sapiens; identical to SEQ ID NO: 7934

SEQ ID NO: 30299 - DNA, 201 bp, Homo sapiens
catatagtgccatgccagaaagcacatgccactttgccccgtctgctgatgacgctggatttggtcacttagttaagataaccactggatctcttccttaygaaggtatgtcaggaagtaatccattcattggtgctttggcaccatgggtactatctcatcccccaaaacttttcacctaatagttttagcatctattga

SEQ ID NO: 30300 - DNA, 201 bp, Homo sapiens; identical to SEQ ID NO: 7936

SEQ ID NO: 30301 - DNA, 201 bp, Homo sapiens
ccatacataatcattaatagtattgatttgcctgtaattcaggttgcttcattccagcctcgcagtcacctctgtgccctgctggttgtcttcccagcgcygctgtagttgccttccatggatctataggagagcaagtcctccaggtactgccctgtgacgatgttgttgaactctgtagcacgtgtgtcactgtggctg

SEQ ID NO: 30302 - DNA, 201 bp, Homo sapiens; identical to SEQ ID NO: 7939

SEQ ID NO: 30303 - DNA, 201 bp, Homo sapiens
gagtcctttctgtgtgtccccgctccctgtacaagccaaggcctcacagcacatagcagccacagccacctgaggattcctgccatctagacgaggcagtyacagccaagaacaagtccactgaggctaagctgtgctcctctggagggctgtgtttagagtccagccttctaggggaagcaaattaaacccaaactatag

SEQ ID NO: 30304 - DNA, 201 bp, Homo sapiens
ctgccacctttgcccctttactgtgcttgctcctgactctatgtcgcgtctccaaggagaagaagtcctcaccagtgaacggagacctctctgaactaagrataccatggccacgtcagccccactacggagcctggaagaggaggtgacctgctccatctgtcttgattacctgcgggaccctgtgaccattgactgtgg

SEQ ID NO: 30305 - DNA, 201 bp, Homo sapiens
gagtgggggtggagtgggtcatctctgaggttttttttttttggctctgattttggtttctgtctgcccaggagtcaggaatggagagaagggtaatggtkttacctcttattgtggaaacctgttgagatcacagagaatatactgacggcataaaagggcagaaccatagcagggtgcggtaagttggggaagagtttt

SEQ ID NO: 30306 - DNA, 201 bp, Homo sapiens
ttgcacacctccagcactgggccctccaccctgagcagaggtgtcagcccttctccccttcctgccccctgcagaagaagctccaggaccagaggcagtayattgtggctgagtttgagcagggtcatcagttcctgagggagcgggaggaacacctgctggaacagctggcgaagctggagcaggagctcacggagggca

SEQ ID NO: 30307 - DNA, 201 bp, Homo sapiens
cccatatgtgaaagtttgtcatagctaaggctagggtgcttttggtcagtatcagcagaatatatgccccctttcttttgtcagcattactccgcttacaragcccttccatgtagatgacctcatctgagcttcctaacaaaggagctggtattagaccccattttacagtgtgcctgggtagggaagagagtgtagtgg

SEQ ID NO: 30308 - DNA, 201 bp, Homo sapiens
agaaaactccgcctgcagagattctgactgctcacttttcccccaggtagccccttttgcaacaggaagaatttcccagctgcacaatagaagcccccctycctctttgcactttctaatcagcctactctttagtctgcagtagaggcctctgcttgctagtctgatccttctctgccctgtgtttgcttttctttttcc

SEQ ID NO: 30309 - DNA, 201 bp, Homo sapiens
aataggaacatttccctgccccatacctccctccaaagacccagttcatacctttcagcaaactattttgtgtttgccttgctgggattacaggtgtgagycaccacaactggctgaatttttattattttagagacatggtcttactctgtcacctaggctctagtgatggtgcactcgtagcttactgtggccttgagc

SEQ ID NO: 30310 - DNA, 201 bp, Homo sapiens
ggcggttgtacatttggtctagcgatgaaaactgagggaaaggatgtagggcctcctggcctaaccagccaggggaaaggggaggtttccggtgtcagctstctctggttgtctccataaccagttcttacttgcctgtgcagactttgaggggaaggttgtgaagacttcggttgtgttccaccaactggggacagccat

SEQ ID NO: 30311 - DNA, 201 bp, Homo sapiens
gaatggcataccacaccagacagatgcgttcagccgatgaagggcaaactgtcttctacacctgtaccaactgcaagtgggtattctttcccctccctctrctcagtctgtttgctaactaaacaaatccagtgatttatttttttgtacgaaatggccgtttcccttggtcccatcccttatttctgtgcagttctggta

SEQ ID NO: 30312 - DNA, 201 bp, Homo sapiens; identical to SEQ ID NO: 7984

SEQ ID NO: 30313 - DNA, 201 bp, Homo sapiens; identical to SEQ ID NO: 7974

SEQ ID NO: 30314 - DNA, 201 bp, Homo sapiens
tgccatgcccttctggcataatttttggtaattttgtttcattggggggttgtagtacttgtctaaatggtttgttcttaaattctccagcctttcctgtytgatgtatgtgcctttctatgtgtttcatctctctctcaggtaccaaacagtactgttttagtccttctacgctctgggttgttttctcctccatttttt

SEQ ID NO: 30315 - DNA, 201 bp, Homo sapiens
aagagaaacagcttgctccctacagagtatttcacactcctcctgatatttctgcattatcaactgtcttgctgctgttgtatgcacaccacctagattcygtcaaaatgaagtcagaaatttataatgtgatcatctttttcctttgaacacatttaaacaggagccaagcccaccctccctaatgacaccaggaaaagc

SEQ ID NO: 30316 - DNA, 201 bp, Homo sapiens
gccctcgatgtggtcatgaaggaatggcataccacaccagacagatgcgttcagccgatgaagggcaaactgtcttctacacctgtaccaactgcaagtgrgtattctttcccctccctctgctcagtctgtttgctaactaaacaaatccagtgatttatttttttgtacgaaatggccgtttcccttggtcccatccct

SEQ ID NO: 30317 - DNA, 201 bp, Homo sapiens; identical to SEQ ID NO: 7969

SEQ ID NO: 30318 - DNA, 201 bp, Homo sapiens
ctttgacgcatttggtgccgtggaagggaaaaagggggactgcagtatgcgtcacacccggaagcggcgagccggaagtggggttagccaggttatccccrggggtggagaagcggaggcccaggaggagggggaataaagaaggtggaggatcctggctaccactctgaatccgataccgcttctcttagacctcagcga

SEQ ID NO: 30319 - DNA, 201 bp, Homo sapiens
tactactagaaactcatcttttggtgaatataacaagtcctttctttcctcataggttccaggagaaggaagactcttgacctttttcctgggcaactctrcagtccctccctcctttcggaaggtgaaggatactgggtttttagatgccttgtccatcctgtctggttgcaatgttttgctcccagaagagaatcagat

SEQ ID NO: 30320 - DNA, 201 bp, Homo sapiens
tctcttggcccctctctaccccttactgggatctggttttcattttccggtccttttgccatacacagttacagagatcagtcaaatccataccaccactragatctcatttattgccacagatgcacaaaataaataacccaaaatcacaaaatgtgttaaatatgggcccatttatacttatggggaagggtgtgagac

SEQ ID NO: 30321 - DNA, 201 bp, Homo sapiens; identical to SEQ ID NO: 7968

SEQ ID NO: 30322 - DNA, 201 bp, Homo sapiens
tttacctgctttcttctctgtgcgttctggatgccatgcccttctggcataatttttggtaattttgtttcattggggggttgtagtacttgtctaaatgrtttgttcttaaattctccagcctttcctgtttgatgtatgtgcctttctatgtgtttcatctctctctcaggtaccaaacagtactgttttagtccttct

SEQ ID NO: 30323 - DNA, 201 bp, Homo sapiens
aggggatatgaccaggcctccctaacccaccagtttcttcccaggttgacaggcgctgccctcgatgtggtcatgaaggaatggcataccacaccagacaratgcgttcagccgatgaagggcaaactgtcttctacacctgtaccaactgcaagtgggtattctttcccctccctctgctcagtctgtttgctaactaaa

SEQ ID NO: 30324 - DNA, 201 bp, Homo sapiens
tctacacctgtaccaactgcaagtgggtattctttcccctccctctgctcagtctgtttgctaactaaacaaatccagtgatttatttttttgtacgaaawggccgtttcccttggtcccatcccttatttctgtgcagttctggtaatagggagatttgtagttgttttttatttttttaagttacacttttttaaacct

SEQ ID NO: 30325 - DNA, 201 bp, Homo sapiens
cggcgagccggaagtggggttagccaggttatccccaggggtggagaagcggaggcccaggaggagggggaataaagaaggtggaggatcctggctaccamtctgaatccgataccgcttctcttagacctcagcgacagaaaaagggaagggtgtctcatcccccttcctcctctcctccctgtcctgagccttagccat

SEQ ID NO: 30326 - DNA, 201 bp, Homo sapiens
attctttcccctccctctgctcagtctgtttgctaactaaacaaatccagtgatttatttttttgtacgaaatggccgtttcccttggtcccatcccttawttctgtgcagttctggtaatagggagatttgtagttgttttttatttttttaagttacacttttttaaacctttttataaccagtgaaataaacctttta

SEQ ID NO: 30327 - DNA, 201 bp, Homo sapiens
aaataattatcagttctttaatcatattttaaattgttccttttattattctttaaatatatatttaaaatattaaatatggttattatattctatgtctyataattctgatatctgcggattttgtgtgtctgatgctgctgtcttttgtttctgctgtctctctcatagtgctttttttctttgttttgtgatttttga

SEQ ID NO: 30328 - DNA, 201 bp, Homo sapiens
tgccatctcatcaaaggattaaaaatattcatagtcagatatatcttttaaaagtatttttttcctatcactggttgtcattttaccaaaaaaaaaaaaawtttttttaaataaaaagaagattttttttcccagcgtgtggcttgcctattttcttaaccctctttaaatgagcagaagttttaagtttttataaggttc

SEQ ID NO: 30329 - DNA, 201 bp, Homo sapiens
tccacccacctcagcatcccaaagtgctgggattacaggcatgagccaccccgcctgacctacttttaggatatttaaaaggaaatgaagaaaaaaaaaamaacataagaagcaggtattgtttagtggtcagcatcttatactgcagtcttcaaccgcagtcaaggtagctttctttggagagaattagtcacacatgac

SEQ ID NO: 30330 - DNA, 201 bp, Homo sapiens
tggagctatttggagtggcagagatggtgcaggaggcaggtcaaggaacttgtaatagggaggtacagttaggatataggtgttgctgcttggggtggttwtgtgtgtaagtaataaacgaaagggaaattgaggattaaggagccaggaagatgttgggaggaaatcaaaggtagtgtaagaaagcatggttggaggcca

SEQ ID NO: 30331 - DNA, 201 bp, Homo sapiens
accggagccttaccatcaaacttcggaaacggaagccagagaaaaaggtagaatggacaagtgacactgtggacaatgaacacatgggccgccgctcatcmaaatgtgagtaattgttggcccgcagtagccctggagttctggctcccttcagcatatcttgtatctactcatatccactggctttccagaagcccccag

SEQ ID NO: 30332 - DNA, 201 bp, Homo sapiens
cccctgtagtacactcttacctcttacttcctagactttgatttctccggcagcccagatgttcagttctcttggcccctctctaccccttactgggatcyggttttcattttccggtccttttgccatacacagttacagagatcagtcaaatccataccaccactgagatctcatttattgccacagatgcacaaaata

SEQ ID NO: 30333 - DNA, 201 bp, Homo sapiens
tatgggaggtgtggggttgaatatctagggctgggagaatcggaaggtattggagctatttggagtggcagagatggtgcaggaggcaggtcaaggaactkgtaatagggaggtacagttaggatataggtgttgctgcttggggtggttatgtgtgtaagtaataaacgaaagggaaattgaggattaaggagccaggaa

SEQ ID NO: 30334 - DNA, 201 bp, Homo sapiens
acagcttgctccctacagagtatttcacactcctcctgatatttctgcattatcaactgtcttgctgctgttgtatgcacaccacctagattctgtcaaartgaagtcagaaatttataatgtgatcatctttttcctttgaacacatttaaacaggagccaagcccaccctccctaatgacaccaggaaaagctacatgc

SEQ ID NO: 30335 - DNA, 201 bp, Homo sapiens
atataacaagtcctttctttcctcataggttccaggagaaggaagactcttgacctttttcctgggcaactctacagtccctccctcctttcggaaggtgmaggatactgggtttttagatgccttgtccatcctgtctggttgcaatgttttgctcccagaagagaatcagatcatcatgtggggattaccattgttcct

SEQ ID NO: 30336 - DNA, 201 bp, Homo sapiens; identical to SEQ ID NO: 7989

SEQ ID NO: 30337 - DNA, 201 bp, Homo sapiens
tttctgtgtcctaagaaatctttgctttgaggttataactcattggatatatttttaatcccagaatttttagttgtcttggaattagaattggaagtttstttaggggagccagtcctcaatgatgtcataaataaaagtccttccttgattatttgattgcatatcttatcttatactactagaaactcatcttttggt

SEQ ID NO: 30338 - DNA, 201 bp, Homo sapiens
aatctgtagttttaaaagaaacgtaaaaagcattccttcccttttagattggtctattcctcaggaagtcacatctcccattatttttgttttgccccaattttttttttatttttagagacagggtctcactatgtcacccaggctggtgggcagtggcacgatcatagctcactgcagcctcaaactcctgggctcaag

SEQ ID NO: 30339 - DNA, 201 bp, Homo sapiens
tgttaaacttggttatgtttgcaggttaaagaggaaatgatggacaacagaggcaactctagtctacctgacaaacttcctatcttccctgattctgcccrcttgccactgaccaggtccttctatctggagcccatggtcactttccacgtgcacccagaggccccggtgtcatccccttactctgaggagctgccacgg

SEQ ID NO: 30340 - DNA, 201 bp, Homo sapiens
tttcctggtgactcctctgaacccctgggctttgggaggggtggggaggagtgtgtctgctgcacttggattttatatgaggatttttcccctatctctcmtaggcccagctgtgctcttcctccactctccaggaggaaactttgtattgaaaacataaaatggggaggtgggtcctgggcttctgtgaaatgggttact

SEQ ID NO: 30341 - DNA, 201 bp, Homo sapiens; identical to SEQ ID NO: 7992
  misc_feature (1)...(201): n = A,T,C or G, or insertion/deletion polymorphism (see Tables 1-2)

SEQ ID NO: 30342 - DNA, 201 bp, Homo sapiens
aaccaccaagctggcaccaatgaagatttaaatcttgccccaagggtaaggattttattagtgttcagttccaggaagttgagaaattgtttgtaatgagmagctttcctggtgactcctctgaacccctgggctttgggaggggtggggaggagtgtgtctgctgcacttggattttatatgaggatttttcccctatct

SEQ ID NO: 30343 - DNA, 201 bp, Homo sapiens
gtcaacacagatcccatctttcttgagatgcctctgagacagagtggcctctgccagcctgagtggaggtattggaagagaaacgggcctgagccatgccytgggaagccaggtataccaggggagtgggcttgctttctaaggcaggggctggggccccgcctcccttccctcccacatgtcccttaggaatttgatgca

SEQ ID NO: 30344 - DNA, 201 bp, Homo sapiens
ttggaagagaaacgggcctgagccatgccctgggaagccaggtataccaggggagtgggcttgctttctaaggcaggggctggggccccgcctcccttccmtcccacatgtcccttaggaatttgatgcacgtgtccactctgttgggactgcagtaatccttgggagtctggtcatgctgaagaggaggctgtggcaaga

SEQ ID NO: 30345 - DNA, 201 bp, Homo sapiens; identical to SEQ ID NO: 7995

SEQ ID NO: 30346 - DNA, 201 bp, Homo sapiens
atcttccctgattctgcccgcttgccactgaccaggtccttctatctggagcccatggtcactttccacgtgcacccagaggccccggtgtcatccccttrctctgaggagctgccacggctgccttttcccagcgactctcttatcctgggaaattacagtgaaccctgccccttctctttcccgatgccttatccaaat

SEQ ID NO: 30347 - DNA, 201 bp, Homo sapiens; identical to SEQ ID NO: 8003

SEQ ID NO: 30348 - DNA, 201 bp, Homo sapiens; identical to SEQ ID NO: 7990

SEQ ID NO: 30349 - DNA, 201 bp, Homo sapiens; identical to SEQ ID NO: 7991

SEQ ID NO: 30350 - DNA, 201 bp, Homo sapiens
cacggagaggtgcatgtgaggagccacgcagccagagcagcggggccaggctgaagctctgcctttgcctgtgtgggtaggagaggctttatcccatgatyaggacgtggaagctacttcggaggctgaggcaggaggatggcttgagcctgggaggttgaggctgcagtgagctatcactgtgccactgcactccagcct

SEQ ID NO: 30351 - DNA, 201 bp, Homo sapiens; identical to SEQ ID NO: 7994

SEQ ID NO: 30352 - DNA, 201 bp, Homo sapiens
aatactgcagcgtggccacaagcctgaaggcccctggctgggacggtgctgctccaccttgggacctctccttcacctacccctttgccctccaagcaccstggctcaccgggcacaagccccttgcaaggtacctgtctctgcccctctgggggaagtggatgcccttttctttttcctttgttcttggctgttggtggt

SEQ ID NO: 30353 - DNA, 201 bp, Homo sapiens; identical to SEQ ID NO: 7999

SEQ ID NO: 30354 - DNA, 201 bp, Homo sapiens
  misc_feature (1)...(201): n = A,T,C or G, or insertion/deletion polymorphism (see Tables 1-2)
tcccctttgagaacagtaaaacctatgaccccttgtcctagaaaaatgcacataccctcaattttgcatgtaatttcagaaggcttatggaacccatgaanttaatcacaggcttcttgggggtgcaaggatccccgtttaaatgaccctctgttctatggtattgggtaggggtctgctttattaggccctctgaatatg

SEQ ID NO: 30355 - DNA, 201 bp, Homo sapiens
tgggacctctccttcacctacccctttgccctccaagcaccctggctcaccgggcacaagccccttgcaaggtacctgtctctgcccctctgggggaagtrgatgcccttttctttttcctttgttcttggctgttggtggtagaccttggtggacagacttgcttcctgagaaggtggaaaggggtcttcattgtttggc

SEQ ID NO: 30356 - DNA, 201 bp, Homo sapiens
tcaaatactgcagcgtggccacaagcctgaaggcccctggctgggacggtgctgctccaccttgggacctctccttcacctacccctttgccctccaagcrccctggctcaccgggcacaagccccttgcaaggtacctgtctctgcccctctgggggaagtggatgcccttttctttttcctttgttcttggctgttggt

SEQ ID NO: 30357 - DNA, 201 bp, Homo sapiens
tcagcttatagaggcatcgccttgatctctgcctttacctttatggggctttctccctgagtgtgtgtctgcccacatttccccctttataaggacatcartcacactggattagggacctgccatattcagtcctcatcttaattacatttgcaatgcccctatccacaaataaggtcacattctgggggctaggacttc

SEQ ID NO: 30358 - DNA, 201 bp, Homo sapiens
ggtcagtcagcaccattgtaattcagagaatgacagaatgaggcttctactgagaatgcattttggttttgacaagaaaagtgagcccctgcaggccactrtagtccaggaggcagggaggctcaggcaagtccttgggaagtggaggtaactatggtgcaggtgaaggatgttcctggcaggctctccacggagaggtgc

SEQ ID NO: 30359 - DNA, 201 bp, Homo sapiens
gggtcagtcagcaccattgtaattcagagaatgacagaatgaggcttctactgagaatgcattttggttttgacaagaaaagtgagcccctgcaggccacygtagtccaggaggcagggaggctcaggcaagtccttgggaagtggaggtaactatggtgcaggtgaaggatgttcctggcaggctctccacggagaggtg

SEQ ID NO: 30360 - DNA, 201 bp, Homo sapiens
gtgctccctattgtactttgtaatgccaggtcttattctgagtgttttctttcccacagctggagagacagggggtcctgcttgtggaattcgaggctccwcttgtcgcaggcccaaagctgccagcccagcagcagagagtggtcttagaagaggatgtcattcctctctcaccatctgtaggatactcactgagaccag

SEQ ID NO: 30361 - DNA, 201 bp, Homo sapiens
gaagggtgggttacctgagatcagaaattcgagaccagcctggccaacgtggtgacaccccgtctctactaaatatacaaaaattagctgagccaggtggkgggctcctgtagtcccagctgctcgggaacctgagacaggagaatcgcttgaacccaggaggcagaggttgcagtgaaccaagatcacgccattgcactc

SEQ ID NO: 30362 - DNA, 201 bp, Homo sapiens
ctatgtcacccaggctggtgggcagtggcacgatcatagctcactgcagcctcaaactcctgggctcaagcaatcctcccacctcagcctcccaaatagtygggactacaggtgtgcaccaatgcacccagttcaatttcttaatatttgttttctatcagcttgtaatctcttctttgtggtctgtgttatcagtgatca

SEQ ID NO: 30363 - DNA, 201 bp, Homo sapiens
ataacaaaatgttgccattttttgttatgtagcatcaaaggaaaaagaaatcactgttcatttctggaatggcaaagctgctaaagtgcccctaggtgggstccagtcggtgtccctgaccatctggaagaaggctgtggagaggctgcacaagtctttcaccagggagcaccccaggccccttcactgggccccttgctg

SEQ ID NO: 30364 - DNA, 201 bp, Homo sapiens
gaagctctgcctttgcctgtgtgggtaggagaggctttatcccatgattaggacgtggaagctacttcggaggctgaggcaggaggatggcttgagcctgrgaggttgaggctgcagtgagctatcactgtgccactgcactccagcctgagccagaccctgtctcaaaaaaaaaaaaaaaaaaagaaaagaaaaaaagaa

SEQ ID NO: 30365 - DNA, 201 bp, Homo sapiens
  misc_feature (1)...(201): n = A,T,C or G, or insertion/deletion polymorphism (see Tables 1-2)
cgcttgccactgaccaggtccttctatctggagcccatggtcactttccacgtgcacccagaggccccggtgtcatccccttactctgaggagctgccacngctgccttttcccagcgactctcttatcctgggaaattacagtgaaccctgccccttctctttcccgatgccttatccaaattacagagggtgcgagtac

SEQ ID NO: 30366 - DNA, 201 bp, Homo sapiens
ccatggtcactttccacgtgcacccagaggccccggtgtcatccccttactctgaggagctgccacggctgccttttcccagcgactctcttatcctgggmaattacagtgaaccctgccccttctctttcccgatgccttatccaaattacagagggtgcgagtactcctacgggccagccttcacccggaaaaggaatg

SEQ ID NO: 30367 - DNA, 201 bp, Homo sapiens
atccaaattacagagggtgcgagtactcctacgggccagccttcacccggaaaaggaatgagcgggaaaggcagcgggtgaaatgtgtcaatgaaggctaygcccagctccgccatcatctgccagaggagtatttggagaagcgactcagcaaagtggaaaccctcagagctgcgatcaagtacattaactacctgcagt

SEQ ID NO: 30368 - DNA, 201 bp, Homo sapiens
  misc_feature (1)...(201): n = A,T,C or G, or insertion/deletion polymorphism (see Tables 1-2)
ggcatattcaacctaagtaattgacttttgggtttaggaacaagatattccaacatctgcaaagaagaaaaggatcacaaacagcagagagcacaaactgnagtagtggggactaccaaggagctggtctcgaaagcaacccacatgaagccaccgcggaccccgccaggggaagctgaacacagaaagcggagtcagagc

SEQ ID NO: 30369 - DNA, 201 bp, Homo sapiens
ccaaggcaggtgactcaaagaggaaactgtgagagtttgtgggagcaggtagggccgtgcatggactcaactgtccccagaggcagctaactgcagagctragccctgcctcgccccggtggccactgcttgcttcaagctgcagctcaggtaatggtggtgcctattctcaggtggatcctctgaaggccatggaatcct

SEQ ID NO: 30370 - DNA, 201 bp, Homo sapiens
ctctaaactcacagcacttgctcttccaatcccttccctgtttcctgagtggaggttcccaaggcaggtgactcaaagaggaaactgtgagagtttgtggragcaggtagggccgtgcatggactcaactgtccccagaggcagctaactgcagagctgagccctgcctcgccccggtggccactgcttgcttcaagctgc

SEQ ID NO: 30371 - DNA, 201 bp, Homo sapiens
ctgaacagggctggaaaggggatggacggccctgagatctcagcttgcctgaggccagaactagccttgtaggtggccggggaggaggaaggaggaaaaawactaacataagttgagctgctgaatacgccaggtgctttccatgtattctatcctgagtgtaactggagagcagaggttaagtgagcacacagccagcag

SEQ ID NO: 30372 - DNA, 201 bp, Homo sapiens; identical to SEQ ID NO: 8000

SEQ ID NO: 30373 - DNA, 201 bp, Homo sapiens
tccttgcctacatgagcctcataggtgaacaaccatcctgttggtcttggacacatccctggttggtcttggacacaggagcgacgcttcttgggggtgcrggaaggaggagattgcattgagaaaaggtccagggaggacccaggtaactcctggcaattgcaggtcaaaaatttggtaggaggaaagaaaaccaggcaa

SEQ ID NO: 30374 - DNA, 201 bp, Homo sapiens
cgaggctggggctcccacccggatttggagcagggtcgccgcggcccagctgacccgccggcgtttgtacgttgtgtgcccactcagggagccatggacamctgtttggcggccgcagcgctgaatggggtggaccgacgttccctgcagcgttcagcaaggctggctctagaagtgctggagagggccaagaggagggcg

SEQ ID NO: 30375 - DNA, 201 bp, Homo sapiens
  misc_feature (1)...(201): n = A,T,C or G, or insertion/deletion polymorphism (see Tables 1-2)
tatacggtttgctacgagtcaggatttggagtatactagagttagtgacaattaagaatattctgcttctagtacaaatataagttgttaaggcttagacncctctcaacacttgctgacttttggtaatgctgatgttccaccgtgttggagttctacagccacatgccaaccttacctctatgtttccttgtgtgcaaa

SEQ ID NO: 30376 - DNA, 201 bp, Homo sapiens
cgtctctagaaatattattcatctgtgccagaggaaggaggggcaacccatgtctatcgttatcacagaggcgagtcgaagctgcacatgtgcttggacayagggaatggtcaggtaagtgtactcaactgtcctgcaccatgccttcagtctaccaagatatgacaccctatattcaagagcccctgctagactttgtgt

SEQ ID NO: 30377 - DNA, 201 bp, Homo sapiens
ttacatggttgacaaccaataaatagttaatgacattgtcatacacatttacgtcagttaaaggatggtagacttccaatttcgcagtaactggacaggcrtgaaagaatacaacataaaacagctttggaaaaaattggcttcaaatccatctgcaaggtaggaggaagaggggaaatttcataaaaatgtaaacatgat

SEQ ID NO: 30378 - DNA, 201 bp, Homo sapiens
gccagaaaacattcaaggaaattacctgcatggaaggcactgtcttctaggaattacagcaggctctggcctcatgcagtcttaacacttggtgagtcctmcatggttttaaggaggctgatccacaaaggagatggaagagaataccttgtttctgccctgcttttcagtttcatatgttaagatctcaaaaaactctaa

SEQ ID NO: 30379 - DNA, 201 bp, Homo sapiens
agtaacccatttcacagaagcccaggacccacctccccattttatgttttcaatacaaagtttcctcctggagagtggaggaagagcacagctgggcctakgagagataggggaaaaatcctcatataaaatccaagtgcagcagacacactcctccccacccctcccaaagcccaggggttcagaggagtcaccaggaaa

SEQ ID NO: 30380 - DNA, 201 bp, Homo sapiens
cagcctcccgagtagctgggactacaggcacatgccaccatgcctggctaatttttgtatttttagtagagacagggcttcaccatgttggccaggctgcyctggaacgcctgacctcgagggatccgcgcatcttggcctcccaaagtgctgggattacaggcttgagccaccatacccagccaagtcatctttcgatac

SEQ ID NO: 30381 - DNA, 201 bp, Homo sapiens
tgcatcaaattcctaagggacatgtgggagggaagggaggcggggccccagcccctgccttagaaagcaagcccactcccctggtatacctggcttcccarggcatggctcaggcccgtttctcttccaatacctccactcaggctggcagaggccactctgtctcagaggcatctcaagaaagatgggatctgtgttgac

SEQ ID NO: 30382 - DNA, 201 bp, Homo sapiens
gcgtttgtacgttgtgtgcccactcagggagccatggacaactgtttggcggccgcagcgctgaatggggtggaccgacgttccctgcagcgttcagcaargctggctctagaagtgctggagagggccaagaggagggcggtggactggcatgccctggagcgtcccaaaggctgcatgggggtccttgcccgggaggcg

SEQ ID NO: 30383 - DNA, 201 bp, Homo sapiens
acttaaaaatgccttaatgacttagatgacaacttagaaaaagctgacagaacaattactaactcctaataaggtagaagagaacttctctttacaatccraaagtgaaagcttgggcacaaatcagtgttctacttgtctcttcagagaaaagacagaaaaaagacatcccttggtcctggaggcagctatcaaatatca

SEQ ID NO: 30384 - DNA, 201 bp, Homo sapiens
agaaaagacagaaaaaagacatcccttggtcctggaggcagctatcaaatatcagagcatgctccagaggcatcccagcctgtgagtacggaactgcttaygcactgggtttcaccaccgttgcaactccatgaaccagttgacatggttcttagagggctatttgaattgagtctatagtatttttaagttgagatgttc

SEQ ID NO: 30385 - DNA, 201 bp, Homo sapiens; identical to SEQ ID NO: 8023

SEQ ID NO: 30386 - DNA, 201 bp, Homo sapiens; identical to SEQ ID NO: 8019

SEQ ID NO: 30387 - DNA, 201 bp, Homo sapiens
tccctcttcctaggatagcgttgcgcgcatgcgccttgacgagtgagccgggtgagggggctccctaagtagcggaaggggtagatgaaaatggaaggggygggcgcgctaggcctagtcctggctgggctcccgctggagtgtgcgttgggggcggaccaggagcggtggtctccagggaggtcgaggctggggctccca

SEQ ID NO: 30388 - DNA, 201 bp, Homo sapiens; identical to SEQ ID NO: 8020

SEQ ID NO: 30389 - DNA, 201 bp, Homo sapiens
atgaaaatggaaggggcgggcgcgctaggcctagtcctggctgggctcccgctggagtgtgcgttgggggcggaccaggagcggtggtctccagggaggtygaggctggggctcccacccggatttggagcagggtcgccgcggcccagctgacccgccggcgtttgtacgttgtgtgcccactcagggagccatggacaa

SEQ ID NO: 30390 - DNA, 201 bp, Homo sapiens
ctgcctcccaggttcagacaattctgcctcagcctcccaagtagctgggactacgtgcacacaccaccagcccagctaatttttgtatttttctttctttytttttttttttttttgtggagacacagtcttgctctgttgcccgggctggagtgcagtggcacaatctcagctcactgcaagctctgcctccctggttca

SEQ ID NO: 30391 - DNA, 201 bp, Homo sapiens
ccatgcctggctaatttttgtatttttagtagagacagggcttcaccatgttggccaggctgctctggaacgcctgacctcgagggatccgcgcatcttgrcctcccaaagtgctgggattacaggcttgagccaccatacccagccaagtcatctttcgatacttagggaatgttgagggcaggccagaaaacattcaag

SEQ ID NO: 30392 - DNA, 201 bp, Homo sapiens
aaaaaaaaaaaaaaatcttacagctatcatctgataatagaggaaagcctgcaagcctgtctcttagatcctggataaattgcatgtctatcttttagagktggaattctttctcaataacatcgttctttctgacataaacttgcagagcctttccaaaagtaaaaaggagactatttccaaaatggcttcattctccag

SEQ ID NO: 30393 - DNA, 201 bp, Homo sapiens
  misc_feature (1)...(201): n = A,T,C or G, or insertion/deletion polymorphism (see Tables 1-2)
ggaatcgacaacttctgcctatggccccttctcagcattaagcaagcttgtaatggcatcccaggtgtcactctggcccttaattacaggctctcttctgntttgtgactttgtccttttaccatttgaactgagacccatcctctgcctgcacacctgatgtaatctaccagccatgagtgaagtctacccttggaagac

SEQ ID NO: 30394 - DNA, 201 bp, Homo sapiens
  misc_feature (1)...(201): n = A,T,C or G, or insertion/deletion polymorphism (see Tables 1-2)
gagaagagagacccccaacccttagtgcttccttcagaacaatggctgaattcatggactatacttcaagtcagtgtggggtaagttggtgtgaaccaaanctatgccccatcacctgctgatggaccacatttggatctttctggaatttacggagaatctggacactacctgtttctcctgcccagccttcacggtcag

SEQ ID NO: 30395 - DNA, 201 bp, Homo sapiens
  misc_feature (1)...(201): n = A,T,C or G, or insertion/deletion polymorphism (see Tables 1-2)
cttagaaaaagctgacagaacaattactaactcctaataaggtagaagagaacttctctttacaatccaaaagtgaaagcttgggcacaaatcagtgttcnacttgtctcttcagagaaaagacagaaaaaagacatcccttggtcctggaggcagctatcaaatatcagagcatgctccagaggcatcccagcctgtgag

SEQ ID NO: 30396 - DNA, 201 bp, Homo sapiens
  misc_feature (1)...(201): n = A,T,C or G, or insertion/deletion polymorphism (see Tables 1-2)
ttttgttttaacctaccctacttgtactcaaagatagcaaactgaagtccagagtctattccagagtctaagttggattcctgacttctttggtctgtcanccattttggggtgttagagggaggaagtttaggaaaaggatgggagagtgggcacagggacatgagcaagggctgagtgcacactcgaagcacctcccac

SEQ ID NO: 30397 - DNA, 201 bp, Homo sapiens
ctagggataggatttttttttctttttttttttttttttttttttgagacagggtcttactctgtcacccaggctagagtgcagtggagcaatcatggctyactgcagccttgacttcctgggcaggtgatcctcccacctgaacctcccaagtagctgggactacaggcacatgccaccacacccagctaatttttaatg

SEQ ID NO: 30398 - DNA, 201 bp, Homo sapiens
tatttatccctcctcctttcttaaatgtgtcaatatggcatctttgtgtaacaatccaagtacttgagcaccctctcaaatccctctagactctttcctcyctacccgcttcacctccccacaaacaagctctgtctaggttttggctctggattcttatggataggctttctcttttctctctgttaattatagcctttt

SEQ ID NO: 30399 - DNA, 201 bp, Homo sapiens
cgccatccaccacatctcagatggaaagggaaagtgtcctggattggccaccctaagcaccggccatcccttcgtctgcattcaattcaccccagcctttwgttagccacaaaccaaagccttcattcagataaggggtagccgatagagatctcaaaaggagtacttaaaacccaggaaactttgtaagcaggcccttga

SEQ ID NO: 30400 - DNA, 201 bp, Homo sapiens
aatgaggctgaagaatagtgaaagtggggaggagtgcaggacagagacggagcgtacagggctttgtaggccatggtagggattctggattttattctaaytgcaataaagaagccattgaagggttttgggcaagtaaaagataggatgaaatcagatcacattcacactataaaaaggtcactctggctaaagtgtgga

SEQ ID NO: 30401 - DNA, 201 bp, Homo sapiens
tttctgataatattaaatggtgtgacatccagagagctaggagggcctgaaatttgccctgacagtctcctaaaatgtataaagccccagtacgttcacaytgaatacagcagaacaggaaccagtgtgttctttattattagctaagcaaagtccaataacccccaaagcagaacaaaacaataaatactaggacacaaa

SEQ ID NO: 30402 - DNA, 201 bp, Homo sapiens
attagtgcataccttaggagtaagctaaagaccaagggcactaattgctgatcttctaaaatgagaaactcaaacagtgagatgaaaggggagaaagaaargcagacaggctggttgttccagaggccaggtcaagaatgaggagataatagcagtgctcccaaatcagcagggaaggagacagagacagctcacacctgt

SEQ ID NO: 30403 - DNA, 201 bp, Homo sapiens
ctagatcaatcgcagcatgctcttcatcaacccagaagatcatactatttacagagcacccaaaccaccctttcccacacagcaagctctgcctttagctygctctagcagctcctgcagttcagaaaagctcctccggtgggctttctgcttcttggcttgcctgctcagcattaaaatttgccctgaagctaagctctt

SEQ ID NO: 30404 - DNA, 201 bp, Homo sapiens
cagaagcgtcctcagtgttctagtctacctagctcagcacctgccaagccaacttcaccatcctcctggccatccttttatcaccccccacatgtccatcytggggctcctcattgccctcaaggcccatgttcagagtccaatcatatatctggccaggcagggaaaggaataactatatctgtcctcacagaaggagga

SEQ ID NO: 30405 - DNA, 201 bp, Homo sapiens
ctccaggggggccttccataaaccgactctaaccacctcttcctgacacaggaggcttcactggtgatctatgatggggtcttaggtgctcagggttttcrgtgaggttgctatgttgccatccttgggtaggtgctgtcacttactctgacccaccagcgggccctgtgtcacacctgtagtgcaccggttctgccacta

SEQ ID NO: 30406 - DNA, 201 bp, Homo sapiens
tttctaacaagttgagcttaaagtccaccaaaagactcttcctccaattgcctccataaatgacatgatcccatccctgcttacatccccagcactctctytcctccatcccacccaattcttgctctgtctcctgctaaaccttcaacttctcaaaggggccgtacttttgcacaggtctggaacacccttctccaccaa

SEQ ID NO: 30407 - DNA, 201 bp, Homo sapiens
agggagtgctggcaaccaccagaacctaggtctcctagagccttcagaggaagcatggtcctggcgacaccttgatttcggacttccagacttcagaaccrtgggaggacacatgtctgttttaagccacactgtgtgtggtaatttataacagcatccacaggaagctaatgtagatggagaaaagactgcttatcccac

SEQ ID NO: 30408 - DNA, 201 bp, Homo sapiens
attcattccagccatatcttgaaatcctctttagtatctggcacagtattctgcacataagaagttattgaattaattaaaaggaagagctgggggcgacrgggggagaactggatacttgagagaagggaggcagggagaaatggaagaggctgatggaaccagaagaggagaaagggaagaggtttctgctcacttctt

SEQ ID NO: 30409 - DNA, 201 bp, Homo sapiens
gccagggagtgctggcaaccaccagaacctaggtctcctagagccttcagaggaagcatggtcctggcgacaccttgatttcggacttccagacttcagarccgtgggaggacacatgtctgttttaagccacactgtgtgtggtaatttataacagcatccacaggaagctaatgtagatggagaaaagactgcttatcc

SEQ ID NO: 30410 - DNA, 201 bp, Homo sapiens
caattagagaatagggcaagatccacagcagatcttggttctcaaaagtaaattttatgacacttgggttgagctgataactaaactgttgtaataacatscacttgtgataaattataacctgatggaagagaagcacagtaataaagcaaagacttagagcatgggcaagtaagactaggaagatgatcctatgacaag

SEQ ID NO: 30411 - DNA, 201 bp, Homo sapiens
tgtagcatggaagaaagctgctgaaaatcaaaggaaagcagcaggcacaaacctataagcaagtcccacttttccatcctctagacagaaaacctgggaasagaacacattaaattctgctctgcagttttctgggagaagatgattccattgtaaattattgaacatttcatttaagcttcataaataagaaactgggat

SEQ ID NO: 30412 - DNA, 201 bp, Homo sapiens
taggcaagtgaaaaaaatactttcaattagagaatagggcaagatccacagcagatcttggttctcaaaagtaaattttatgacacttgggttgagctgawaactaaactgttgtaataacatccacttgtgataaattataacctgatggaagagaagcacagtaataaagcaaagacttagagcatgggcaagtaagac

SEQ ID NO: 30413 - DNA, 201 bp, Homo sapiens
ggtatcatgcatgtctcagatagatcaagccaagtgtagtctaagggctgcatttgaagaactctttgaacatgcagattatggatacaattccaattttracatgaaaatattgtgcaggttgtttctttgtgataaaggacataggcaagtgaaaaaaatactttcaattagagaatagggcaagatccacagcagatc

SEQ ID NO: 30414 - DNA, 201 bp, Homo sapiens
atcagtagtgcttcagggaaattaaataacgtgtgaatctttaagaagctcagtaatacttgcataactctttaccatcagacactcaaaaagtcttcatyttttacttctctttttcttccctccccttcgtcattattcttttccatgtagcttagtgctaggcatattatgggtgctcactaaataattattttactt

SEQ ID NO: 30415 - DNA, 201 bp, Homo sapiens
cagagctattttagcaacttccaataactagattgccccagaatgtcttattttgctgttgtatgtttgttgtggttttacgttgaggtctatgatcttamaacttttggaagtgagtgctccttcagggtgtcatgtttgtctcgtggtatcatgcatgtctcagatagatcaagccaagtgtagtctaagggctgcatt

SEQ ID NO: 30416 - DNA, 201 bp, Homo sapiens
cacgagaactcactcactatctggaggacagctccaagccattcatgagggatccacccccatgacccaaacacctcccactgggccccaccaccaacatkggggatggcaattcaatatgagatttggaggggacaagcatccaaactataacaggtaccaaatcactctcgaataccaagttgcttactccactccttc

SEQ ID NO: 30417 - DNA, 201 bp, Homo sapiens
gccccattctggccactagagaattccatatttccttccctctatctttccttatcttagccagctttaagttccaactcaaatgccttctctggaaagayttatctgactattacagcccatgctgatcttctccctgctgatcgtgtcctcttagtcccatgctgatcttgtcctcttagttagcagcctctgctttgg

SEQ ID NO: 30418 - DNA, 201 bp, Homo sapiens
ataatccaaagagataagtgtggggaggctgactgctcagatctccatttaactaaaaagtagattggtgcctatctggtgtgatttcaggggctctccaragatattctccacatatctcccccatgaaacctctggtctccaaattccactgatgggaaatttctctatgagggaccctatattagtccctgggttttc

SEQ ID NO: 30419 - DNA, 201 bp, Homo sapiens
cctcagggtacactggcaggccacgtgcttgtctgcaggggaagaaatctgagactccagagggagtccagctggcaagtcagcactgaccacggcactcratgtccacctcgctatgtctgcactccctgatgggccagtgcacaaacaccaaacccagcaccagaccttcaacgccctgcagctcttctgaggaggaaa

SEQ ID NO: 30420 - DNA, 201 bp, Homo sapiens
cacacgctaggctgatgcctgcaagtacgtcctgatcatgctttgggagttgccgccttcaaggtttctggcccaaatggggatctagtggtgagaaggtyggctcctcagggtacactggcaggccacgtgcttgtctgcaggggaagaaatctgagactccagagggagtccagctggcaagtcagcactgaccacggc

SEQ ID NO: 30421 - DNA, 201 bp, Homo sapiens
tgggaggccaaggcgggtgatgacttgaggccaggagttcgagaccagcctggccaacatggagaaatcctgtatctctactaaaaatacaaaaattagcyggtcatggtggcacatgcctgtagtcccagctactctggaggctgaggcaggggaatcacttgaacctgggaggcggacgttgtagtgagacgagaccat

SEQ ID NO: 30422 - DNA, 201 bp, Homo sapiens
gctgatttgaagttggtcctgttcttttggtgagaaatgctttctactgcactctgtagtgcaaaagattcgtttgagagccaagcctatttcccctgatrtttagggcttgatatgtatcctgagtcctttctacattgcaggggtgcaaattagtgtcaacatcacactggagcctattcatcaggggcctctacactt

SEQ ID NO: 30423 - DNA, 201 bp, Homo sapiens
tgcactgagaatggtctttctaacaagttgagcttaaagtccaccaaaagactcttcctccaattgcctccataaatgacatgatcccatccctgcttacmtccccagcactctctctcctccatcccacccaattcttgctctgtctcctgctaaaccttcaacttctcaaaggggccgtacttttgcacaggtctggaa

SEQ ID NO: 30424 - DNA, 201 bp, Homo sapiens
atacttatgtgagcacacctctgaaggtcactgacaaggcagcctcactgccttcccagagagcctgcctgcaagaaggaagctctgcgtgggctggttcrtcctattgacttgggattcctaaatagtgaaattgggatttcttaatagttcaaattaggagaggattcaaggaggactaaacacaaggtatgaatagga

SEQ ID NO: 30425 - DNA, 201 bp, Homo sapiens
cctgcactttagttctctcatctaaaagacatcctatctacctcattgggttgtagcgagaattaaatgaaatcatacatatatccctattcaagaacttrggatggagcctggcacacagtaagcactcaatacccattcaattttttattggtattaatcctcacaaagctcagacctgaagccgtggcagcctggcct

SEQ ID NO: 30426 - DNA, 201 bp, Homo sapiens
tgtgctcacagacagagattttgtttaatttgtgtcttggattcctgcaaaagtatttgctgtcttgatagacaagggatacacagcaaagagtgcatacrgtaaacaagggcagtataatcaaagcagttttcctcccaagttgaaatcccagaccaccttgccaaacacagccagttaaagtaaatataataaatgcct

SEQ ID NO: 30427 - DNA, 201 bp, Homo sapiens
acaaaaaccatagtttaacatttccaaggcctgggtttttagttgtgaagagcactaggtagaagtctcaaccttaaccctaaacctaaattaattttgcyccagttcagttctagctgcacaccccaagcccagtccagtccctttgcccagcttctcctcatgcatgaaatttaggggcaacaatgcaggggcaggtgt

SEQ ID NO: 30428 - DNA, 201 bp, Homo sapiens
ttccagacctcattctcaggattgacttctttcaggatcattgacattggaggtatctggtcccttcagagacaacacttccccttaatctacagaccacracccctatgatcaaaaatacaaaacaacaacaacaacaacaaaaaccatagtttaacatttccaaggcctgggtttttagttgtgaagagcactaggtag

SEQ ID NO: 30429 - DNA, 201 bp, Homo sapiens
cttcaaggccagagggagcaaacaatttcaccttgtcctagctctaacaaccacctttccagacctcattctcaggattgacttctttcaggatcattgayattggaggtatctggtcccttcagagacaacacttccccttaatctacagaccacaacccctatgatcaaaaatacaaaacaacaacaacaacaacaaaa

SEQ ID NO: 30430 - DNA, 201 bp, Homo sapiens
gcagccctgggaaactaataggaacttccaagtcccaacagttcaagcccctagctgcttggcagtgatgccgctctaggactcttcaggaaattctttcmcaatttcaacctggatgatacttgcacctcagccaagaatctggctgcaaagagcagggtaggacttcctgctcatacaagaccagcaccctcagtcaaa

SEQ ID NO: 30431 - DNA, 201 bp, Homo sapiens
acaccccaccctgtccatcagcagtcatgctaacacctagtcaaggagcaaacaatgccacttacctgttcctcatttgccatgtttcttttcattcctcygcaagaaccacatagacagtcaggttttctgtgtagatttttacagcatttctaccaagcagaacaaccatcccatcaagcttggttgcattagtagttt

SEQ ID NO: 30432 - DNA, 201 bp, Homo sapiens
tagtttaaggggtgttcgtggaagaggagtctgggtggtggaggacggcatcataaaggcagctgcattcgactgggattcccatggtaaggaaaataaamcctggaagttacagaaggagcagatgctgtggaggaggggaggctgtgaagggactggcagagcagggcaaaatgtaaattcaggaggaatagagaagat

SEQ ID NO: 30433 - DNA, 201 bp, Homo sapiens
ggcatcataaaggcagctgcattcgactgggattcccatggtaaggaaaataaaccctggaagttacagaaggagcagatgctgtggaggaggggaggctrtgaagggactggcagagcagggcaaaatgtaaattcaggaggaatagagaagattggtgaggcaggtagagccagatccagaagctggaaaaccaagggg

SEQ ID NO: 30434 - DNA, 201 bp, Homo sapiens
ccaggatctggaagagatgggaaagagtgagttgcagatggtggggttaactctagatgggcataaaaatctgagtccctggagactggaaggggaagacraagaagacggaatgaagatcatgtcatgttgagttagggcctccccagtgagggcgtcagccttccctataaaataaaggtcaacctcctgagagttaag

SEQ ID NO: 30435 - DNA, 201 bp, Homo sapiens
gccacagaatcagaataggtctttcctcgcttaacacaagctcaaaagcacccaagacctctttcattcaataagtagcatgagcccccttcacaacatcytgagccacaaatcctgatcctgctataagttttataaactgttataatttaattacagtctgatccctcaccttaaatacacaatttacctgagccccct

SEQ ID NO: 30436 - DNA, 201 bp, Homo sapiens
cggcctggctcccgatacgaggtgtcagtcagtgccgtccgagggaccaacgagagcgattctgccaccactcagttcacaacaggtaaggctgcggtggrggagagacgcacaaggagggaaacaggggtggagccaaccggtggtgtcatcacagcaagaggagtattaggaatgaggcaaggtgtgtcagagcattgg

SEQ ID NO: 30437 - DNA, 201 bp, Homo sapiens
gtctatggggagttatttctggccccagatactcagctgtcagcatggaggaaagagacatcacccccattttaaattcacaatccacaattagtattccrcacctttatctttctctcatcagatttctctcccagtgacttttctcttttgctctctgcttctccccactgtccagaacaatgaagggggagtgattgc

SEQ ID NO: 30438 - DNA, 201 bp, Homo sapiens
attccaaaggtaacactcacctgttacactgccaaacagacttatttggaatatttgtacctttagcttggaatcaggggcagcaaggaaagtgctacccratatctctctccatgccattaaagacacaaaatggcatgttgtgggtgtctgggatatagaacatttctgtgacaaatatgtggtaatgacctgctgaca

SEQ ID NO: 30439 - DNA, 201 bp, Homo sapiens
agagaagggagagccatgaaaaagagaaagggacaaaagggagaagtttgactctggctctaaaacattgtgctttctcactcactctccaacttggagcstaaaaagttaagtttttcagcctccaatgcctgtgttcagacacagtttgatctgaatgctctgctccatgcaacatgctaagagcctagactttcaact

SEQ ID NO: 30440 - DNA, 201 bp, Homo sapiens
tcagaaggaagcagccctactgacacctgtaccttgagtctgtgagacaataatttttctttttttttttttttgagatggagtctcactctgtcacccartctggagtgcagtggcatggtctcagctcactgcaacctccgcctcccaggttcaagcgattgtcctgcctcaagcctctcaagtagctaggactacagg

SEQ ID NO: 30441 - DNA, 201 bp, Homo sapiens
actaggagtgcactaattgcacaggcaattaaagcagagatttgcttcctgcatggtgagtggatatttgcttgggtcttagagctgttctgaaaaggaamgaaccctgaacaaagtgcaccatggccggtgattggagagaagccagcctagaaaacccagaggccaatctccaaaacccctccctgccctcagcagctc

SEQ ID NO: 30442 - DNA, 201 bp, Homo sapiens
tggcttaataagagtcaggagaagaaggtatatgcccagagagctatacccctgactgataatcctggaaagaggttgattttttttttcttttttggtcctatgggaaacaggaatgaccttcttaatgaggtgagatcatgagaagcctttccatcttcttttattattctgccttgcaaaggaaaaatgacaatagcc

SEQ ID NO: 30443 - DNA, 201 bp, Homo sapiens
tctgctggaggagggtgaggggaaagaagggatgaggagatgcaaacagcactgcagacagattctccaggcctgggttggcaggtgccagttaaatgatragagggtacccagaccctcatgatgaggccctcagtcatttcagagctccgcttaaattcaaattaaccaaagtgcttttccaggtgatggctccgacac

SEQ ID NO: 30444 - DNA, 201 bp, Homo sapiens
tctcttcccttctgcttcctcatttagccaaagatgctcacgtcccttcttggttaattctaggtcagcttctcatttcccacccccacaataccacttgmtccggggtgtggtatcttctgtggacaatgagtcctgcatccttttcttaatttcaagatagttttgtttgaaaagtggtttctttgtgctctgctctga

SEQ ID NO: 30445 - DNA, 201 bp, Homo sapiens
agaattctaccttagactgtggcataagagcctgctacagaatggaatgagtccagggttttcaagaagattcaataaataaataacacccctgtgttccrctgggtttaaaatcaattgataaataagggaaaaagtgaaacagatggacaccaaaatgtcccctagattgcagcatgtaacttagtgtcatggccagat

SEQ ID NO: 30446 - DNA, 201 bp, Homo sapiens
gaaatatgcaagaacagatggagaaaaatgacccgtaagaggctgttccgaagctggggtcctttttatccttttatccagagaagcaagtttacccagarggcatgtttcatgtcctcatatgcaaatgtctgttggtttttaaatggtcttagcaactgtgttgactgtgctgttagagtggctgagcagggacatctt

SEQ ID NO: 30447 - DNA, 201 bp, Homo sapiens
gtatgaacagaacctcaagtgggtgctggagccacagctggtgggccctgcaggaaatcaaccagctttccaggtgttgccctgacctgcacagtgccagrggccagggcttatgagggaaatacactagagaacctggaagaggtgactgcaatgtccttctgctgtagaaatatgcaagaacagatggagaaaaatgac

SEQ ID NO: 30448 - DNA, 201 bp, Homo sapiens
ttgatcttaagcccaagagagctagatgctctagaagccgtgacctttcaatttctcctccaaatccaatatcagcaaccatccccgcaacatctgcccaratccatgcccagttccctgagctgtcttctccctttcctctcccattcctcaaggcccagcaccattttctgtagtgcctatgtttgtctgaccagagca

SEQ ID NO: 30449 - DNA, 201 bp, Homo sapiens
tgggaaatcagcttcattccaaaggtaacactcacctgttacactgccaaacagacttatttggaatatttgtacctttagcttggaatcaggggcagcamggaaagtgctacccaatatctctctccatgccattaaagacacaaaatggcatgttgtgggtgtctgggatatagaacatttctgtgacaaatatgtggt

SEQ ID NO: 30450 - DNA, 201 bp, Homo sapiens
aaagtgctacccaatatctctctccatgccattaaagacacaaaatggcatgttgtgggtgtctgggatatagaacatttctgtgacaaatatgtggtaaygacctgctgacaagagtagccctgagcatggcaccctggccttgcagaacagaggatgtgggaagcagccaccagctccagctctctgctgagataactc

SEQ ID NO: 30451 - DNA, 201 bp, Homo sapiens
caacatcctcagccttcccatcactgccaaggtggccacccgtacgtaccatttccctgtcctgcttcatttttcttttctcctacatgagatcatgggcwttcatgatagtagcgtcttttcttagttcttcagggatgcctggaatagttattgcccttgaggggaagggctagagatgtgacccatttagaaagggta

SEQ ID NO: 30452 - DNA, 201 bp, Homo sapiens
agttatctaaaaccaccaagtgcagcatgctgaaaagaaactggatatattctgttaaatcacattactacctcaaatatgaaaaccaggacttcattttwagtccaaaccaggtggcacccaagtggtctggtgattttcattttagctggtgctggaccaaaagccctaagcagcttaagagaggacaggactaggcta

SEQ ID NO: 30453 - DNA, 201 bp, Homo sapiens
tgtctactatgcttcagatatcatgcttacacagcaactaggaggccacttcccccatttcataattaatttaaattaaatgtgaaaggcctaagttatckaaaaccaccaagtgcagcatgctgaaaagaaactggatatattctgttaaatcacattactacctcaaatatgaaaaccaggacttcattttaagtccaa

SEQ ID NO: 30454 - DNA, 201 bp, Homo sapiens
gacacacatttactgagtgtctactatgcttcagatatcatgcttacacagcaactaggaggccacttcccccatttcataattaatttaaattaaatgtraaaggcctaagttatctaaaaccaccaagtgcagcatgctgaaaagaaactggatatattctgttaaatcacattactacctcaaatatgaaaaccagga

SEQ ID NO: 30455 - DNA, 201 bp, Homo sapiens
tttcttctccacctcctctgtgggacaagacctcactggaatgagggtcctcaagggagaagggaggagggaaaaagttacctttctaggttttatggctkgctttgaggaaaaggagttctagtttctattacctgccctgaggaagaggaattctgatttctgtgaatcacttcaaagggagaagaagggtcaggagat

SEQ ID NO: 30456 - DNA, 201 bp, Homo sapiens
tgctcacccatcatataagcatcacaacaacactgctatcacaaaagacaggttaacaagagaaagcgtaacaaatttatttaatcaaagtttcacatgamaaaggagccttcagaaatgaagacccaaagacctgggggaaattgtctgtttttacgcttaggtttgaggaataatggacagccatgtagaaacgtaatt

SEQ ID NO: 30457 - DNA, 201 bp, Homo sapiens
aatgaagctgcagaagttcactatgacttgggcatggattgcaagaattcactgataaaatgagagccgagtcatgccttatgcacccgatgaaaagtttrggtttattcttgagggcaacagagagtcattgaaagattttaaataaggtgatgtaatgactggattgtacagagaagggcaaggtcagaggcaggaaga

SEQ ID NO: 30458 - DNA, 201 bp, Homo sapiens
ttgtcctttaaaaaataagtttaccacccaaaaagctttcaaaccatggttctgctctaaatagtatgttttagaagaaaccccataaccataaaagctamagtgctctgtaggaatccctccagaaggccggtggctgaggttttccacagctccaaggttatgctgtaacctgaagagttgacattcgataacttgggg

SEQ ID NO: 30459 - DNA, 201 bp, Homo sapiens
gtaacctattaatgcaataaaaagcattaaaaattgtttatatagattgtgtttaagttaactcatgtattccatcaacatcgagcactagagccacatgrggtgggttgattctgcacctgggactcactgtgtctggagcaagattgggattgtccaccagacaccaccacgcccatggcgtggagggagttcaccaag

SEQ ID NO: 30460 - DNA, 201 bp, Homo sapiens
aaaatgatgtctgcattttaatagtaacctattaatgcaataaaaagcattaaaaattgtttatatagattgtgtttaagttaactcatgtattccatcawcatcgagcactagagccacatggggtgggttgattctgcacctgggactcactgtgtctggagcaagattgggattgtccaccagacaccaccacgccca

SEQ ID NO: 30461 - DNA, 201 bp, Homo sapiens
ggtgacagaaattctgctataattttggactccgctatgagaagagtgctgactctgttaatatgcctataattatctctgtttatatttgaccttttttwaaaaaaaaaatcctctggtgcctgagaactggttttaaatatctgcaatgattgtgcagagaggcaggtcaccatctgccgcttttcccaccttgctccg

SEQ ID NO: 30462 - DNA, 201 bp, Homo sapiens
agccaggtctcacctacaacatcagcgtctacgctgtcattagcaacatcctcagccttcccatcactgccaaggtggccacccgtacgtaccatttcccygtcctgcttcatttttcttttctcctacatgagatcatgggcattcatgatagtagcgtcttttcttagttcttcagggatgcctggaatagttattgcc

SEQ ID NO: 30463 - DNA, 201 bp, Homo sapiens
cctctggagaaaagacagaacatgcaagaacactagatacaccaagctatgggtgttgaaatagactagctggtgacctggatttgcaaataccctagggwcatgaaaacattttttctttttctttttcttttttgtaacctccacccagaatttcaggaaaggtggggccacatgcccaggatatatggtattctactg

SEQ ID NO: 30464 - DNA, 201 bp, Homo sapiens
caataaatactgccctccaggggaacacatgtaaaataggccatttatgtcaatccacagaacttgacagtccccgagacctcatggtgacagcctcctcrgagacctccatctccctcatctggaccaaggccagtggccccattgaccactaccgaattacctttaccccatcctctgggattgcctcagaagtcaccg

SEQ ID NO: 30465 - DNA, 201 bp, Homo sapiens
gactgttcggggaaggggagatgtgccaacggtacctgtttatgcgaggagggctacgttggtgaggactgcggccagcggcagtgtctgaatgcctgcartgggcgaggacaatgtgaggaggggctctgcgtctgtgaagagggctaccagggccctgactgctcagcaggtaggcaggggaactctctggggtgtttg

SEQ ID NO: 30466 - DNA, 201 bp, Homo sapiens
ccccagcaccattgacaggagaggccactgctgctctttgaccttctccttgaccattccaggacaactggactatatccctcactgcagtggccacggcmactttagctttgagtcctgtggctgcatctgcaacgaaggctggtttggcaagaattgctcggagccctactgcccgctgggttgctccagccggggggt

SEQ ID NO: 30467 - DNA, 201 bp, Homo sapiens; identical to SEQ ID NO: 8052

SEQ ID NO: 30468 - DNA, 201 bp, Homo sapiens
gttggagagagtagcatggaagtggttggccccaggggtaaggtggagtaagagttcagcacagccactctgagaaactgggtggaaatgaaaaggttccrtaagtggaagccaggtttgctggaagtgggtcaagtgtccagaaaatcctgataaagcagtgacaaatgggacagcctaatgaatgtatcttttttgcag

SEQ ID NO: 30469 - DNA, 201 bp, Homo sapiens
gattcaccagacttctgtaagccagagttactcactcctacgtggcaggcaatgttcccgcacatgtaacttcaacttaaattattttcaaaaatcaatgrtaataatgaaaagaaaaacaacaataatgcactgtgcttagggaaaaaaatttaatgttccttaattttttccatatccaattatttcatttagcctccc

SEQ ID NO: 30470 - DNA, 201 bp, Homo sapiens
taatgcactgtgcttagggaaaaaaatttaatgttccttaattttttccatatccaattatttcatttagcctcccaattttgtttactgaattgaaatayctttctaaaaatattgtcaccacaccaattatcccaaagtgaaattcaagcagaagttaagccttattgtttctgaatccaaagtcactaggcaccttct

SEQ ID NO: 30471 - DNA, 201 bp, Homo sapiens
ggaagtgggggctgaattttctcagtctagtggagagagaacttgattaggaagggtggtggagaggaaggggtcatgtacacaaaagactagatttatcyttaataactccagagacacgaatagaagttatagagaagacaatttgacctgcacataaagaacactttttttcaattatgatatgagatgagaggggaa

SEQ ID NO: 30472 - DNA, 201 bp, Homo sapiens
taagcctgttttagtttagaatttcaaaagccaggcagaataatttaggcaagagaagttctcatcaccccaagtctactgcaaaacctgcatgcacacaatgcctctgtgccttatgtggaaagtctttggagagatcatgaaaaaggggctgtatctgattaaaatctgggaagagagaagagaacattcaaaggagat

SEQ ID NO: 30473 - DNA, 201 bp, Homo sapiens
atatctggccaggcagggaaaggaataactatatctgtcctcacagaaggaggaggaaaggacagttaagcaggagagtgctggggaaaggcagtcgcggstctgttgggcccaaggatcttgcctgctgagaaatgcatctctaataaagcagtggaggtgctgggcagagtggctgattcctgtaatcccagcactttg

SEQ ID NO: 30474 - DNA, 201 bp, Homo sapiens
gacttacagccagccacacatgatgcactcacactcaccacatgcacacatgtacacacaaacacacctacagactcttgcacttacacttaagcacataygcacactcacatgcacatacacacatactcatacacacatgcacacactcatagtcatacacaccacacatgctcatgccctcatacgtacacactacac

SEQ ID NO: 30475 - DNA, 201 bp, Homo sapiens
caggggggccttccataaaccgactctaaccacctcttcctgacacaggaggcttcactggtgatctatgatggggtcttaggtgctcagggttttcggtraggttgctatgttgccatccttgggtaggtgctgtcacttactctgacccaccagcgggccctgtgtcacacctgtagtgcaccggttctgccactaggg

SEQ ID NO: 30476 - DNA, 201 bp, Homo sapiens
aatccagtggtatcagagctcatcacggctttcttcagattgttcatctatttgccaagcccctggccatcattcagagggaaggtacttagcaaaatatkagataagtgtcagcaatgacaagctagtgctcatagtcagcaggcctgctgatagcttggaaacacacaaagcaggccaataaatactgccctccagggg

SEQ ID NO: 30477 - DNA, 201 bp, Homo sapiens
ctctctagagaaccacatggacaaaagtctccaggtcctcagatctagctgcctgcctggctatggttagaacaagtcaaaatagcctcagggttggaggrtggtgcgcttctgttgccaggaatggcatatccctacttggtggtagctaccattttatccttattggctcattgagaaaggatgggagaaaatgaatat

SEQ ID NO: 30478 - DNA, 201 bp, Homo sapiens
acaaaggcttccacatacctcttcctcacggagctgggacatacagggcctattccttatttgtcttaaaggctggggataagggggctgggggaaaagcyaggtgggaatatttcagctgcagcttccacttcctcagcagggagtacttgttcacagcaacaacccagaatagggatgctcctatatgacaaggttgat

SEQ ID NO: 30479 - DNA, 201 bp, Homo sapiens
cacatcccagggccgctatgagctgcgcgtggacatgcgggatggccaggaggccgccttcgcctcctacgacaggttctctgtcgaggacagcagaaacytgtacaaactccgcataggaagctacaacggcactgcgggtacctatggctcctgagcagaccccaaggacagtgggcatgggacaagagcccccagatt

SEQ ID NO: 30480 - DNA, 201 bp, Homo sapiens
ccctgtgtttgttgagaagctaacagctcctgaattgctttcagaacctcttgctctgtttagcttcactattgatctgtttttatcttactgtggtgttwccctcttttctctgtctcttcccatcctcattaatagtctcttattctgatgggttttgacatgaggctgccacaaagggagtgagctgcctggtcggtg

SEQ ID NO: 30481 - DNA, 201 bp, Homo sapiens
ttatatcaattttacttatcacagtttattttccttagcatctctttgggttttgtttttttgtttgtttgttttttgtttttttatttccttcataggtrttccagaggcggcagaatggccaaactgattttttccggaaatgggctgattaccgtgttggcttcgggaacgtggaggatgagttctggctgggtaaag

SEQ ID NO: 30482 - DNA, 201 bp, Homo sapiens
cggatgggaattctaatttgctgatgcccctcttcccatgtggcctcaagttcagaatgcagtttcttgggtgtcatctgagcaggcctggtaagccaggkagaagccaggctgaggctgcatggtggtgccctagaatggcccaagtctgcctggctcatcaccatctcctctgaagacaggaggaaccatgagtggcct

SEQ ID NO: 30483 - DNA, 201 bp, Homo sapiens
gtgatcttggctcaccgcaacctctgcctcccgggttcaagcgattctcctgcctcagcctcccaagtagctaggattacaggcatctgccaccacgcccrgctaattttgtgtttttagtagagacagggtttctccatgttggtcaggctggtcacaaactcccgacctcaggtgatccgcccacctcggcttctcaaa

SEQ ID NO: 30484 - DNA, 201 bp, Homo sapiens
gaagtggaggttacagtgagccaagatcacgccattgcactccagcctgggagtcacagcaagactccatctaaaaaaaaaaaaaaaaaaaaaaaaaaaargaagatatccccaaactctgcaaactgtatcaaatctaggagctgagaaagctgaatctgaaaggtacaagaaaggcatgtaaccaagggcaagtacaaa

SEQ ID NO: 30485 - DNA, 201 bp, Homo sapiens
cttgacctcgagtgggataacagtgaagccgaagttcaggagtacaaggttgtgtacagcaccctggcgggtgagcaatatcatgaggtactggtccccargggcattggtccaaccaccagggccaccctgacaggtgagtaagacctatctcttggggttatgctggttgctgagtctataccctcacagctgtctccc

SEQ ID NO: 30486 - DNA, 201 bp, Homo sapiens
aggccaaggcaggcggatcacttgaggtaaggagttcaagaccagcctggcctacatggtgaaaccccatctcttctaaaaatacaaaaattagccggaastggtggtgcaaacctgtagtcccagctacttgggaggctgaggcaggagaatcacttgaacccaggaagtggaggttacagtgagccaagatcacgccat

SEQ ID NO: 30487 - DNA, 201 bp, Homo sapiens
ggaagctggagagaactgctccaggggaataatgaagacaaattctagatgacagagggagacgcagggagtgagaagataggatgtgggtggagaccgcrtaatcaaggaactgatagtgaaagaaataatcattaaggagtaggattaatctaagaatttttaagacaaaggatataaatgtaacttaaggtgagagga

SEQ ID NO: 30488 - DNA, 201 bp, Homo sapiens
tcgtcaagttactctttctcattccctctccctcttgtctccttcttctcttctttgtattatctttttccaagcttcctttttcctttctttgtacttcrtatgtggttgtgtcactgagtcctaattcatctgggtgaaggggaaacaagacatcgacagattcacaccgaatgtagcaccatgagaaactccagatat

SEQ ID NO: 30489 - DNA, 201 bp, Homo sapiens
ggcagtgccctccaaaagaggccctcttgtctcctccatttctaaggacactcatagaaagtatatggagggaaagagagagagggaacgataagatagawagatagataataaatcctagattcaatttcgtcaagttactctttctcattccctctccctcttgtctccttcttctcttctttgtattatctttttcca

SEQ ID NO: 30490 - DNA, 201 bp, Homo sapiens
cccaagtctactgcaaaacctgcatgcacacaatgcctctgtgccttatgtggaaagtctttggagagatcatgaaaaaggggctgtatctgattaaaatstgggaagagagaagagaacattcaaaggagatgaggtatgagtgatacagagatttttagcaataccaagaaagtggaacaagaagtaaccatgaaaaca

SEQ ID NO: 30491 - DNA, 201 bp, Homo sapiens
tgtcaccttccaggggcgggaagctggggagtgggctgcagagacccaagttgaagaggaggaaagaaaggacaaaggcttccacatacctcttcctcacrgagctgggacatacagggcctattccttatttgtcttaaaggctggggataagggggctgggggaaaagccaggtgggaatatttcagctgcagcttcca

SEQ ID NO: 30492 - DNA, 201 bp, Homo sapiens
tcctaaaggcacagcaaggagatgagaagatatgctgaccaagcagattaacgggggtgaattaagcagagaaaggatagaccagctggcatagggcctcrcagagagctagaaacagtcacaaaaattaagctaaatccaaaaaaaaaaaaaaaaaaccctgaaatgatacaggagggaactgattctaagcgcagccca

SEQ ID NO: 30493 - DNA, 201 bp, Homo sapiens
ggaattcccactgctcttaggataagcccagacccttagtgtggacaccaggccctgcctggtttcccctgccctctccaggctcacctcccacccatgtyccctgatgttttctgggctccaggcccacaagtctgcttctttccatttctcaaatacgttttccctcctgctatataggactggcaaatgctgttccct

SEQ ID NO: 30494 - DNA, 201 bp, Homo sapiens
cttaagaagtctttctttgcttttcagccaaaaggttttcttcaatatgttccgctattaactttctagatttatttctctatatttagcctattttataytggtattagttgaggatacagtttcatttttctttctatagtgaaccagttctcctaacatcatttattaaataatccatctgttctgtattggtttgtg

SEQ ID NO: 30495 - DNA, 201 bp, Homo sapiens
catctttgtcattgcagatataaaacccagttatatcaattttacttatcacagtttattttccttagcatctctttgggttttgtttttttgtttgtttsttttttgtttttttatttccttcataggtattccagaggcggcagaatggccaaactgattttttccggaaatgggctgattaccgtgttggcttcggga

SEQ ID NO: 30496 - DNA, 201 bp, Homo sapiens
gagagaaagaatcctttctggacattgtctattttccttgcaggaggccgggtgttccctcatccccaagactgtgcccagcatttgatgaatggagacaytttgagtggggtttaccccatcttcctcaatggggagctgagccagaaattacaagtgtactgtgatatgaccaccgacgggggcggctggattgtaagt

SEQ ID NO: 30497 - DNA, 201 bp, Homo sapiens
tatttgttgaattagtaagagtataaacaggtaaatatactggaagacgctgtgagaaagccaagtggctcaccccatgtgggctgagcaggtaaccttgycctgttggcagacttaggctgcccctgacagtctagccagctactctgcagatgtgcgccattgattctaacaagggagagtcaaccacaaacaagcttc

SEQ ID NO: 30498 - DNA, 201 bp, Homo sapiens
cccttccaccacccttcctttggctcattatacaggagctgattgtggatgcagaagacacctggattcgactggagggcctgttggagaacacagactayacggtgctcctgcaggcagcacaggacaccacgtggagcagcatcacctccaccgctttcaccacaggtgagggagcatggccactttgatgccttcttc

SEQ ID NO: 30499 - DNA, 201 bp, Homo sapiens
gtgcccaacactgtgacagaattcaccatcaccagactgaacccagctaccgaatacgaaatcagcctcaacagcgtgcggggcagggaggaaagcgagcscatctgtactcttgtgcacacaggtgggaatgtctccctgctgtgtcaagtcagaaccctggctgaagatctgggtgaagttgttcgggcttgtagaaag

SEQ ID NO: 30500 - DNA, 201 bp, Homo sapiens; identical to SEQ ID NO: 8059

SEQ ID NO: 30501 - DNA, 201 bp, Homo sapiens
agaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacacacacgaa

SEQ ID NO: 30502 - DNA, 201 bp, Homo sapiens
tagaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacacacacga

SEQ ID NO: 30503 - DNA, 201 bp, Homo sapiens
gtagaaattggcatggtgggacagcacaattaggtaatgaaaattcactagactccctgtttaatgaggaaagaaggaaagaaggaaggaaggaaggaaggaaagaaggaaggggagggagggagggaaagaaaagagagagattgattcaggagtcataagtaaaacacacacacacacacacacacacacacacacacg

SEQ ID NO: 30504 - DNA, 201 bp, Homo sapiens
catcctctccagcacctgctgtttcctgactttttaatgatcgccattctaactggtgtgagatggtatctcattgtggttttgatttgcatttctctgayggccagtgatgatgagcattttttatgtgtctgttggctgcataaatgtcttcatctccacctactaatcctcatacttccccacagaatttatttaatt

SEQ ID NO: 30505 - DNA, 201 bp, Homo sapiens
tcctttgagtatatacccagtaatgggatggctgggtcaaatggtatttctagttctagatccttgaggaatcgccacactgtcttccacaatggttgaamtagtttttagtcccaccaacagtataaaagtgtttctatttctccacatcctctccagcacctgctgtttcctgactttttaatgatcgccattctaact

SEQ ID NO: 30506 - DNA, 201 bp, Homo sapiens
taggtatatctcctaatgctatccctcccccctacccccaccccacaacaggccctggtgtgtgatgttccccaccctgtgtccaagtgttctcattgttyaattcccacctatgagtgagaacatgctgtgtttggttttctgtccttgagatagtttgctgagaatgatggtttccagcttcatccatgtccctgcaaa

SEQ ID NO: 30507 - DNA, 201 bp, Homo sapiens
ataaaaccctgtctctactgaaaatacaaaaattagttgggcatggtggtgtgtgcctgtaatcccagctactcaggaggctgaggcaagagaatcacttkaacctaggaagcagaggttgcagtgagctgagatcgtgccactgtactccagcctgggtgaaaaagtgagactccgtctcaaaaaaaaaaaaataaataa

SEQ ID NO: 30508 - DNA, 201 bp, Homo sapiens
atccttgtatatttagcctaaatatgcctctctttttttattacactctaagttctagggtacatgtgcacaatgtgcaggtttgttacatatgtatacaygtgccatgttggtgtgctgcacccattaacttgtcatttacattaggtatatctcctaatgctatccctcccccctacccccaccccacaacaggccctg

SEQ ID NO: 30509 - DNA, 201 bp, Homo sapiens
gaggacctatccccatcttctccagtgagatggaagctttagcacctgccccctcaaaaagcacacagaagcgtatgcacacacacacacacacacacacwcacacactctcacacacacatactctctctctcacgcatgcacacacgcatgctctcacacacaacacactcacacaacttagtgcaccctccaaaaggc

SEQ ID NO: 30510 - DNA, 201 bp, Homo sapiens
gaggaaggcaccttacacttcaaaaccttgaaatcaacagtcttctttttgtttagtggtcaaatttgatattgttctattccatctccatcactcgggarctggctctgattttctcctcctggggtttcccttgttttgtttttaagcttatgatgttgactggttccttttaaagtttctagaatgccactggaactc

SEQ ID NO: 30511 - DNA, 201 bp, Homo sapiens
tgggccctaagccaatatgactgtgtccttatagaaaggggaaatttgggcacagagacagacatgcccacaagaagaacaccatagtgaagatgaaggcygagatcggaatgattcttgattcttccagaagccaagaaacgccaaagatcaccagcaaatcactagcagctaggagaggcatgcaacagattctcactc

SEQ ID NO: 30512 - DNA, 201 bp, Homo sapiens
ctggagaggcaggcatgccctggcactttctcctctttgcagtcctggaccctccggcaaacctgacagccagtgaagtcaccagacaaagtgccctgatytcctggcagcctcccagggcagagattgaaaattatgtcttgacctacaaatccaccgacggaagccgcaaggtgagattttgctggaaagggaaaagac

SEQ ID NO: 30513 - DNA, 201 bp, Homo sapiens
gtgaaacctcgtctctactgaaaatacaaaaattagctaggtgtggtggtgcatgcctgtaatcccagctacttgggaggctgaggcaggagaatcgcttraacctgggaggcagagattgcagtgaaccaagattgtgccattgcactccagcctgggcaacagagcgagactgtctcacaccaaaaaaataaataaata

SEQ ID NO: 30514 - DNA, 201 bp, Homo sapiens
caaattaggagaggattcaaggaggactaaacacaaggtatgaataggagtctaagatcattttcttcccactttcagccttcctagccctgccccatacrcagaataatgtttgtttctccatccactgatagatctggtacctggcactgagtatggagttggaatatctgccgtcatgaactcacagcaaagcgtgcc

SEQ ID NO: 30515 - DNA, 201 bp, Homo sapiens
cagtgaaacctcgtctctactgaaaatacaaaaattagctaggtgtggtggtgcatgcctgtaatcccagctacttgggaggctgaggcaggagaatcgcrtgaacctgggaggcagagattgcagtgaaccaagattgtgccattgcactccagcctgggcaacagagcgagactgtctcacaccaaaaaaataaataaa

SEQ ID NO: 30516 - DNA, 201 bp, Homo sapiens
tgggctggttcgtcctattgacttgggattcctaaatagtgaaattgggatttcttaatagttcaaattaggagaggattcaaggaggactaaacacaagrtatgaataggagtctaagatcattttcttcccactttcagccttcctagccctgccccatacacagaataatgtttgtttctccatccactgatagatct

SEQ ID NO: 30517 - DNA, 201 bp, Homo sapiens
aggagatcgagaccatcctggctaacacagtgaaacctcgtctctactgaaaatacaaaaattagctaggtgtggtggtgcatgcctgtaatcccagctayttgggaggctgaggcaggagaatcgcttgaacctgggaggcagagattgcagtgaaccaagattgtgccattgcactccagcctgggcaacagagcgaga

SEQ ID NO: 30518 - DNA, 201 bp, Homo sapiens
aaacttaaaaaaaaaaaatagaagtaaaagggctgggctcacacctgtaatcccagcactttgggaggccgaggcgggcagatcatgaggtcaggagatcragaccatcctggctaacacagtgaaacctcgtctctactgaaaatacaaaaattagctaggtgtggtggtgcatgcctgtaatcccagctacttgggagg

SEQ ID NO: 30519 - DNA, 201 bp, Homo sapiens
ggtgagaggaggtgaaaacttaaaaaaaaaaaatagaagtaaaagggctgggctcacacctgtaatcccagcactttgggaggccgaggcgggcagatcaygaggtcaggagatcgagaccatcctggctaacacagtgaaacctcgtctctactgaaaatacaaaaattagctaggtgtggtggtgcatgcctgtaatcc

SEQ ID NO: 30520 - DNA, 201 bp, Homo sapiens
aaagaaagaaagaaagaaagaaagaaagaaagaaagaaagagaaggaaagaaagaaagaaagaaagaaagaaagaaagaaagaaagaaagaaagaaagaamgaaagaaagaaagaaagaaagaatcaccaagagggatctggactctgcctaacctggggacttacaaaggtttgcaccttaaaagaatatattagaccaa

SEQ ID NO: 30521 - DNA, 201 bp, Homo sapiens
aatgggaagtacggggagtccaggcacagtcaggtaagcgatgctccacctctgctatgaatgagccagagctgtggaatccgtgctcccttagctttatrttttaaaagcacatgtgagtccttcatttccctttaaaaagaaatattttgagtcttgagaaaaataatgcagacaatgggataagatcaggacagagta

SEQ ID NO: 30522 - DNA, 201 bp, Homo sapiens
taagaaaatatcggccaggcacagtggctcacgcctgtaatcccagcactttgagaggctgaggcgggcagatcacgaggtcaggagatcaagaccatccyggctaacacggtgaaaccccatctttactaaaaatacaaaaaatgagctgggcatggtggcgtgtgcctgtagtcccaactacttgggaggttgaggcag

SEQ ID NO: 30523 - DNA, 201 bp, Homo sapiens
agggcatggctaatcatgacaagcaggcaagaaaatgtatataagaaaatatcggccaggcacagtggctcacgcctgtaatcccagcactttgagaggcygaggcgggcagatcacgaggtcaggagatcaagaccatcctggctaacacggtgaaaccccatctttactaaaaatacaaaaaatgagctgggcatggtg

SEQ ID NO: 30524 - DNA, 201 bp, Homo sapiens
gtagatcaaaattggagagtcccagggcatggctaatcatgacaagcaggcaagaaaatgtatataagaaaatatcggccaggcacagtggctcacgcctrtaatcccagcactttgagaggctgaggcgggcagatcacgaggtcaggagatcaagaccatcctggctaacacggtgaaaccccatctttactaaaaata

SEQ ID NO: 30525 - DNA, 201 bp, Homo sapiens
tcagtcagtgccgtccgagggaccaacgagagcgattctgccaccactcagttcacaacaggtaaggctgcggtgggggagagacgcacaaggagggaaasaggggtggagccaaccggtggtgtcatcacagcaagaggagtattaggaatgaggcaaggtgtgtcagagcattggccttgtcatagacaccgcgagaag

SEQ ID NO: 30526 - DNA, 201 bp, Homo sapiens
ccaaggcttatttctcattcaaactttttgttctgtttgatccttctcactcagtcattgacggccccacgcagatcctggttcgcgatgtctcggacacygtggcttttgtggagtggattccccctcgagccaaagtcgatttcattcttttgaaatatggcctggtgggcggggaaggtgggaggaccaccttccggc

SEQ ID NO: 30527 - DNA, 201 bp, Homo sapiens
cctgtcctgtggtgatccacctgcctcggcctgccaaagtgctgggattacaggtgtgagccactgcatctggcatctcatttctagtttaaggggtgttygtggaagaggagtctgggtggtggaggacggcatcataaaggcagctgcattcgactgggattcccatggtaaggaaaataaaccctggaagttacagaa

SEQ ID NO: 30528 - DNA, 201 bp, Homo sapiens
taagttatcaatcagaggttgttgagcagctcctaaaagtttattgtgcaagttgtggggactcaaaagaagcataaaacatggcctttacaaaaactaawcgtctagttttaaaaagaaacaggaagtaactcatcacacaatcaatggtactcacttctagttttttctgtttttgtttttgtgtttttgagatagagt

SEQ ID NO: 30529 - DNA, 201 bp, Homo sapiens
agtgcccttcccctgcccagactgggaagtgccatcacctggaaactacagcctggtaaaagagcagttagaccaaaattcaggggaatcaaggcaaactrcatgtcctcaggaaagatattcatcttactgtgtctcattttcctcatctgtaaaatgcagtaacaatacccatcctctctctgactcaccagacttcca

SEQ ID NO: 30530 - DNA, 201 bp, Homo sapiens
tctcagtgcattttctgctcttctccacagggctggacaatatacacaggatcacatcccagggccgctatgagctgcgcgtggacatgcgggatggccargaggccgccttcgcctcctacgacaggttctctgtcgaggacagcagaaacctgtacaaactccgcataggaagctacaacggcactgcgggtacctatg

SEQ ID NO: 30531 - DNA, 201 bp, Homo sapiens
attaacacaaggccaccaagtggaaggactggagttattactcaaatcaatctctccaaaaactcagaagctagggtttttatggataatttggtgggcarggggctagggaatgggtgctgccaattggttggggataaaatcataggagtgtggaaaatggtcctcgtgccctgagtctgcatctgggtgggggctgca

SEQ ID NO: 30532 - DNA, 201 bp, Homo sapiens
cctgccactatctcatctcatcttcttctcctgggtgcctagataacaagcttcttaccggcctctctgcctctaggaccaccccattgtccacatggctrtaatcacccaacaggttcttcttgtcttttgcacagataaacccaattctctgagacagcattattgcaataaagaaagagtttaattaacacaaggcca

SEQ ID NO: 30533 - DNA, 201 bp, Homo sapiens
atatgaggatgggattagataaagcacacaaagcaatcagctctgtgctgatgagagtgagtgctcaatacttggtatacgcacatatactcagaacataytcagaagtgaaagtggtaggaaacaagtcattcaaaaataagtaggtatgggttgggtcactgttcaaggtgatggcttaagtctattattatttcatcc

SEQ ID NO: 30534 - DNA, 201 bp, Homo sapiens
gaaggcgagtagagctttggatgagaggcggctttaggagcttacagttaggagggcaatttgattccaacatgtcactctacctatccccaaggtttatytaccttgtctggaagtgaccaacagatcatcatttcccacattgctccaaggatctcacccatctttggataaggctgtgttaaggattgggcttttctg

SEQ ID NO: 30535 - DNA, 201 bp, Homo sapiens
ttggttttgtggggtttttttgttgttgttttgttttgttttgtttgtttttttgacagagtctcactctgtcacctgggctggagtgcagtggcttgatytcggctcactgcaacctccgtctcccgggttcaagagattctcctgcctcagcctcccggatagctgggattacaggcacccgccactacgcccagctaa

SEQ ID NO: 30536 - DNA, 201 bp, Homo sapiens
ttactccatggcaatatgaaagacaagcaaaacagactttttcaaaactttcttccaagccttcctctctctttttttggtgctgtttggttttgtggggkttttttgttgttgttttgttttgttttgtttgtttttttgacagagtctcactctgtcacctgggctggagtgcagtggcttgatctcggctcactgcaa

SEQ ID NO: 30537 - DNA, 201 bp, Homo sapiens
aaaattttaacttgaatttagattgaaatgacaatgaatttataaattaatttggggagaactgacatctttgtaatactacagtcatcccttctgaaggsctataatgcatcttcctttgttcaaatcatccttattttttaatagagttgtaagtttttcctttatattcataacaaacattctatatgttcttggcta

SEQ ID NO: 30538 - DNA, 201 bp, Homo sapiens
gtcaggagatcaagaccatcctggctaacacggtgaaaccccatctttactaaaaatacaaaaaatgagctgggcatggtggcgtgtgcctgtagtcccarctacttgggaggttgaggcaggagaatggtgtgaacctgggaggtggagcttgcagtgagccgagattgtgccactccactccagcctgggcaacagaga

SEQ ID NO: 30539 - DNA, 201 bp, Homo sapiens
atcggccaggcacagtggctcacgcctgtaatcccagcactttgagaggctgaggcgggcagatcacgaggtcaggagatcaagaccatcctggctaacayggtgaaaccccatctttactaaaaatacaaaaaatgagctgggcatggtggcgtgtgcctgtagtcccaactacttgggaggttgaggcaggagaatggt

SEQ ID NO: 30540 - DNA, 201 bp, Homo sapiens
atcacttgaacctaggaagcagaggttgcagtgagctgagatcgtgccactgtactccagcctgggtgaaaaagtgagactccgtctcaaaaaaaaaaaaataaataaaaatttaaaaaatcaggttccttccagttcaggttttctgcaagtggttttccagcaaagtttatctttctcttcctccttcctctgctacct

SEQ ID NO: 30541 - DNA, 201 bp, Homo sapiens
aaaatgtatataagaaaatatcggccaggcacagtggctcacgcctgtaatcccagcactttgagaggctgaggcgggcagatcacgaggtcaggagatcragaccatcctggctaacacggtgaaaccccatctttactaaaaatacaaaaaatgagctgggcatggtggcgtgtgcctgtagtcccaactacttgggag

SEQ ID NO: 30542 - DNA, 201 bp, Homo sapiens
cctgaggtcaggagtttgagaccagcctgtccaacatgataaaaccctgtctctactgaaaatacaaaaattagttgggcatggtggtgtgtgcctgtaawcccagctactcaggaggctgaggcaagagaatcacttgaacctaggaagcagaggttgcagtgagctgagatcgtgccactgtactccagcctgggtgaa

SEQ ID NO: 30543 - DNA, 201 bp, Homo sapiens
gccagtgaggccagaagcaaggaatcagccatgttagatttctctcactgtcatgatctttgcaaaggttggttcatgaccactataatgatcttcctcayaccccaaatatgggcgatggctaatcccctttgtaaaacttttcaatgactccacattaccaccaggagaaggcccaatgccttagccaaagtacaggcc

SEQ ID NO: 30544 - DNA, 201 bp, Homo sapiens
aatatgaggatgggattagataaagcacacaaagcaatcagctctgtgctgatgagagtgagtgctcaatacttggtatacgcacatatactcagaacatwctcagaagtgaaagtggtaggaaacaagtcattcaaaaataagtaggtatgggttgggtcactgttcaaggtgatggcttaagtctattattatttcatc

SEQ ID NO: 30545 - DNA, 201 bp, Homo sapiens
ctagggtcgtcagaacaggtgtctctttacctgagacctgtgagccaagacttgaataatgagagtgaatccacaaagaagagcattccaggcctagggaygagtaattactacaccctgagggaggagtaagtttggccttttccatctgttacaagaaagctaatgaggctgaagaatagtgaaagtggggaggagtgc

SEQ ID NO: 30546 - DNA, 201 bp, Homo sapiens
tattagctctggctcataaacaattatctcatagcaatgtcttagtttgaaatgtgttgtgtgtgtatataaagatgtttacacacaaacacacatgactrtcctctcctaaatagccgggggcatgttcattacgataaatgccaaaaacctctgatgaatgttaaccgcaaccatcaaacatttgatctttggcaagag

SEQ ID NO: 30547 - DNA, 201 bp, Homo sapiens
gtgaaactaagctgcaacttttggccagcagagacatgtctgttttctgctctcaccctgggtgacagcagaagaaccaggtcaagagaggtctgtactcrgaatgcatctgccccagaaaagtctgatggatattaaaaggctagatatctaggaaagagctgctgagtagagtgatgaataggagaaagtagacatagg

SEQ ID NO: 30548 - DNA, 201 bp, Homo sapiens
ggctggcagcaagtaccccctcttgacctccctctttacaaatgttgccctctgccacacagagtccaggctggtgcccaaaattcaaacactccccccccattattctctgtaggcaatgtccagagaattccttctgggatatgaatttgtttctgaacaacagactcaatgtctgcaatgactttttctctctgctct

SEQ ID NO: 30549 - DNA, 201 bp, Homo sapiens
caacagctaacatgctaacaattagtacagaatattaagagtatgactcactttgttccagatgactatctagcaaattagaaccaaccctatgtatagtytacactgtcaaagctgatagaaggatgatgtactaaaatggggatctaaacccaacagtgagaaaaaaaaaaaaaagtatctcattggggctgattccct

SEQ ID NO: 30550 - DNA, 201 bp, Homo sapiens
cttcgggggcctagatgggcagattacctgaggtcaggagtttgagaccagcctgtccaacatgataaaaccctgtctctactgaaaatacaaaaattagytgggcatggtggtgtgtgcctgtaatcccagctactcaggaggctgaggcaagagaatcacttgaacctaggaagcagaggttgcagtgagctgagatcg

SEQ ID NO: 30551 - DNA, 201 bp, Homo sapiens
tcaggttctggctgggtgcggtgactcacacctataatcccagcacttcgggggcctagatgggcagattacctgaggtcaggagtttgagaccagcctgkccaacatgataaaaccctgtctctactgaaaatacaaaaattagttgggcatggtggtgtgtgcctgtaatcccagctactcaggaggctgaggcaagag

SEQ ID NO: 30552 - DNA, 201 bp, Homo sapiens
cctacatggtgaaaccccatctcttctaaaaatacaaaaattagccggaagtggtggtgcaaacctgtagtcccagctacttgggaggctgaggcaggagratcacttgaacccaggaagtggaggttacagtgagccaagatcacgccattgcactccagcctgggagtcacagcaagactccatctaaaaaaaaaaaaa

SEQ ID NO: 30553 - DNA, 201 bp, Homo sapiens
ataaaggagatgctgtgcagaacagtcatggaccaggagctgccaatgtgctcacagacagagattttgtttaatttgtgtcttggattcctgcaaaagtrtttgctgtcttgatagacaagggatacacagcaaagagtgcatacggtaaacaagggcagtataatcaaagcagttttcctcccaagttgaaatcccaga

SEQ ID NO: 30554 - DNA, 201 bp, Homo sapiens
tggcctacatggtgaaaccccatctcttctaaaaatacaaaaattagccggaagtggtggtgcaaacctgtagtcccagctacttgggaggctgaggcagragaatcacttgaacccaggaagtggaggttacagtgagccaagatcacgccattgcactccagcctgggagtcacagcaagactccatctaaaaaaaaaa

SEQ ID NO: 30555 - DNA, 201 bp, Homo sapiens
aagaccagcctggcctacatggtgaaaccccatctcttctaaaaatacaaaaattagccggaagtggtggtgcaaacctgtagtcccagctacttgggagrctgaggcaggagaatcacttgaacccaggaagtggaggttacagtgagccaagatcacgccattgcactccagcctgggagtcacagcaagactccatct

SEQ ID NO: 30556 - DNA, 201 bp, Homo sapiens
tgaaaaacatctcaaaagaccaatctgcaatagtgctgttatctataggagcaactaggaaagtcacaaatctctggccacatgaccctgagcagtaaggrattatagaaactatgcctacattttagcagaactcaaatccctccgtaatcctaatctcttggcctttcgttagtcttgcaaaggtagtttcagtccctg

SEQ ID NO: 30557 - DNA, 201 bp, Homo sapiens
aatctgaaggacagattagaaaagttcctacttcaggtatactatgaagccctcaagatatccccaaactctatgctgggcatcgtggctcacacttgtamtcccaacactttgggaggccaaggcaggcggatcacttgaggtaaggagttcaagaccagcctggcctacatggtgaaaccccatctcttctaaaaatac

SEQ ID NO: 30558 - DNA, 201 bp, Homo sapiens
ttgttgtaattttagtagagatgggtttcaccatattggtcaggctggtctcgaactcctgacctcagatgatccacccgccttggcctcccaaagtgttrggattacaggcatgagccaccgtgccctgcctttgttaggtttttctacaaccccagtcctaatagataaaaatgagtttgatgccagttgtaatagatg

SEQ ID NO: 30559 - DNA, 201 bp, Homo sapiens
gactacaggtgcacaccaccacacccggctaattgttgtaattttagtagagatgggtttcaccatattggtcaggctggtctcgaactcctgacctcagrtgatccacccgccttggcctcccaaagtgttgggattacaggcatgagccaccgtgccctgcctttgttaggtttttctacaaccccagtcctaatagat

SEQ ID NO: 30560 - DNA, 201 bp, Homo sapiens
tagatcaatcgcagcatgctcttcatcaacccagaagatcatactatttacagagcacccaaaccaccctttcccacacagcaagctctgcctttagcttrctctagcagctcctgcagttcagaaaagctcctccggtgggctttctgcttcttggcttgcctgctcagcattaaaatttgccctgaagctaagctcttc

SEQ ID NO: 30561 - DNA, 201 bp, Homo sapiens
tgatcacttgattttgttgggtttttttgttttgtttttgtttacttgtttgtttgtttttgtttttttgatacagagtctcactctgtcacccaggctgragtgcagtggcatgatcttggctcactgcaacctcagcctcccaggttcaagcgattctcctgcctcagcctcacaaatagctgggactacaggtgcaca

SEQ ID NO: 30562 - DNA, 201 bp, Homo sapiens
tgtgttgaatcacaggagacaggcactagagaacctgtttaaaaagaattttcttacctgtaggatgagcaccagtctagagatcacacctattaagatcrtctgaattattcctaatatagtttactttgggacaccatgtataaatgaaaggaggcatctcgcgcaatctgtaacctgctgtctaaattgtaggggaaa

SEQ ID NO: 30563 - DNA, 201 bp, Homo sapiens
attctgctataattttggactccgctatgagaagagtgctgactctgttaatatgcctataattatctctgtttatatttgacctttttttaaaaaaaaaatcctctggtgcctgagaactggttttaaatatctgcaatgattgtgcagagaggcaggtcaccatctgccgcttttcccaccttgctccgggatgagtca

SEQ ID NO: 30564 - DNA, 201 bp, Homo sapiens
ctcctgcctcagcctcccgagtagctgggactacaggcgcccaccaccgcgcccggctaattttttgtatttttagtagagacggggtttcaccttgttasccaggatggtctcgatctcctgacctcatgatccgcccgcctcggcctcccaaagtgctgggattacaggcgtgagccaccgcgcccggcctgattccct

SEQ ID NO: 30565 - DNA, 201 bp, Homo sapiens; identical to SEQ ID NO: 8051

SEQ ID NO: 30566 - DNA, 201 bp, Homo sapiens
agatgaggtatgagtgatacagagatttttagcaataccaagaaagtggaacaagaagtaaccatgaaaacataagccctctagaattcagaaagcccccrggccagtaaataggacttaccaccagataaggggtaagagatctgagcccattttgtgtaggtagatggtattcaggtaacaaatgccacgaaagttcag

SEQ ID NO: 30567 - DNA, 201 bp, Homo sapiens
accagataaggggtaagagatctgagcccattttgtgtaggtagatggtattcaggtaacaaatgccacgaaagttcagaaaaggaaaaggtcaaggtagraagatttagccttgaaatcttcatggaagctccaggactgaattgacctttgaaggatgcaaggatagagacaggcagaggggaaggaatttaagaagtc

SEQ ID NO: 30568 - DNA, 201 bp, Homo sapiens
cctgtggcatttattatgccaattcagggcattccctcaggcaagctcccaggtgacaaggacaaaatcatgtaaaccacctgacacaacttcaagtgggyttgcagtcagccctgccttccaaccaagaagcatgagaactcttccaaacaggaaggatgagaaaatctgtcctttttccaatgggaatagcccatgaga

SEQ ID NO: 30569 - DNA, 201 bp, Homo sapiens
caggcttcctggagaactgagaaaagtcatgctgtcatatttcagggctgataattgaaactccattaggacaagcacacttccatctcacaaaacctgtrcatgtgtatgtgactgtgtggttgggggagaaggggtggtgggaggaaaagagggagatacatgaaatgaaaaattcagaccatcctagacttagtgatt

SEQ ID NO: 30570 - DNA, 201 bp, Homo sapiens
tatgtgactgtgtggttgggggagaaggggtggtgggaggaaaagagggagatacatgaaatgaaaaattcagaccatcctagacttagtgatttgagctwaacaaaatactctcaatgtgcatcagatgatcaaggaaatcactctagtattaattctgaaactggtttgctccacaactttagccagctttctctgtgc

SEQ ID NO: 30571 - DNA, 201 bp, Homo sapiens
tgactgtgtggttgggggagaaggggtggtgggaggaaaagagggagatacatgaaatgaaaaattcagaccatcctagacttagtgatttgagctaaacraaatactctcaatgtgcatcagatgatcaaggaaatcactctagtattaattctgaaactggtttgctccacaactttagccagctttctctgtgcctct

SEQ ID NO: 30572 - DNA, 201 bp, Homo sapiens
cagggtgatcacttgattttgttgggtttttttgttttgtttttgtttacttgtttgtttgtttttgtttttttgatacagagtctcactctgtcacccakgctggagtgcagtggcatgatcttggctcactgcaacctcagcctcccaggttcaagcgattctcctgcctcagcctcacaaatagctgggactacaggt

SEQ ID NO: 30573 - DNA, 201 bp, Homo sapiens
cattgatagagagcaatggggtctttaaaaagtgagaaatccctaggagtactcagagtgctgatatctaagtgcactggctatgcctcggatacatgtgkttttttttttttttccagcagaactgtgtctaacctgctggcaaagagcaacaattcacttgtagcatggaagaaagctgctgaaaatcaaaggaaagca

SEQ ID NO: 30574 - DNA, 201 bp, Homo sapiens
tttcaagaagattcaataaataaataacacccctgtgttccactgggtttaaaatcaattgataaataagggaaaaagtgaaacagatggacaccaaaatrtcccctagattgcagcatgtaacttagtgtcatggccagatgggtttgcaaactggatggccactgtggacctaggcaagtctctccatatggcagaaat

SEQ ID NO: 30575 - DNA, 201 bp, Homo sapiens
aggaagcaagaggtttccagcatacaggaaaagcagcgctccctcactaggagaggaaaactagcttctcatcctacctctactggcaaccagatctgtgyttgatataaatccttccccactatgggcctcaggtttcccgtttgtaaaatgacaagtttgccttgaacacatgtaagcatccatatcgctagtccaaat

SEQ ID NO: 30576 - DNA, 201 bp, Homo sapiens
acttaagcacatatgcacactcacatgcacatacacacatactcatacacacatgcacacactcatagtcatacacaccacacatgctcatgccctcataygtacacactacactttcacataccctcacacgtacacacactcacacacgctaggctgatgcctgcaagtacgtcctgatcatgctttgggagttgccgc

SEQ ID NO: 30577 - DNA, 201 bp, Homo sapiens
aaattattattgagtagggggcttaaataggttgattttttgttacagtcagatttaaaacatttcaaatatatgtgtatatatatatatatatatataayattacatttatatattacacataattatctcagggagttcactgctgaggagatttatgaggcaaatagcttaacataatttaagaagggattattggca

SEQ ID NO: 30578 - DNA, 201 bp, Homo sapiens
gaaaattattattgagtagggggcttaaataggttgattttttgttacagtcagatttaaaacatttcaaatatatgtgtatatatatatatatatatatwacattacatttatatattacacataattatctcagggagttcactgctgaggagatttatgaggcaaatagcttaacataatttaagaagggattattgg

SEQ ID NO: 30579 - DNA, 201 bp, Homo sapiens
atcctagacttagtgatttgagctaaacaaaatactctcaatgtgcatcagatgatcaaggaaatcactctagtattaattctgaaactggtttgctccamaactttagccagctttctctgtgcctctcttttcctgtgtgcaaaatgagaacactgatagaagccatcatagtacctcccgggagtcctgtaaagcttc

SEQ ID NO: 30580 - DNA, 201 bp, Homo sapiens
tttgccaaatcctcatagggtggtgtcattcttatggagtctatggggagttatttctggccccagatactcagctgtcagcatggaggaaagagacatcrcccccattttaaattcacaatccacaattagtattccacacctttatctttctctcatcagatttctctcccagtgacttttctcttttgctctctgctt

SEQ ID NO: 30581 - DNA, 201 bp, Homo sapiens
ataccctcacagctgtctccccaacctacacatcttacaaacccatggccaattcctattgatctcatctcttaagtgcctagcacatatgtctagtactrtccattgtactgccatcacctgttctaagctactaacatctcctttttttgagacggaatctctctgtcacccaggctggcgtgcagtggcacaatttca

SEQ ID NO: 30582 - DNA, 201 bp, Homo sapiens
agcacatatgtctagtactgtccattgtactgccatcacctgttctaagctactaacatctcctttttttgagacggaatctctctgtcacccaggctggmgtgcagtggcacaatttcagctcactgcaacctctgtctcccaggttctcatctattatcttaaccattgcaataaccccctcacattgtctcctggccc

SEQ ID NO: 30583 - DNA, 201 bp, Homo sapiens
tgatgtgcttctctggctttttgtccatctctctcctttttgtgtccatctgagattatcagaaaccctgtgtttgttgagaagctaacagctcctgaatygctttcagaacctcttgctctgtttagcttcactattgatctgtttttatcttactgtggtgtttccctcttttctctgtctcttcccatcctcattaat

SEQ ID NO: 30584 - DNA, 201 bp, Homo sapiens
gctggtcacaaactcccgacctcaggtgatccgcccacctcggcttctcaaagtgctgggattacaggtgtgagccactgcacctggccttccagtgactytttcaaagtacatttttgattatgccattgcactgtgcagatattccagggaattcccactgctcttaggataagcccagacccttagtgtggacaccag

SEQ ID NO: 30585 - DNA, 201 bp, Homo sapiens
tgctgggattacaggtgtgagccactgcacctggccttccagtgactttttcaaagtacatttttgattatgccattgcactgtgcagatattccagggamttcccactgctcttaggataagcccagacccttagtgtggacaccaggccctgcctggtttcccctgccctctccaggctcacctcccacccatgtcccc

SEQ ID NO: 30586 - DNA, 201 bp, Homo sapiens
ggaaaattattattgagtagggggcttaaataggttgattttttgttacagtcagatttaaaacatttcaaatatatgtgtatatatatatatatatatataacattacatttatatattacacataattatctcagggagttcactgctgaggagatttatgaggcaaatagcttaacataatttaagaagggattattg

SEQ ID NO: 30587 - DNA, 201 bp, Homo sapiens
gccacagacctagaagcgatgggaaaattattattgagtagggggcttaaataggttgattttttgttacagtcagatttaaaacatttcaaatatatgtktatatatatatatatatatataacattacatttatatattacacataattatctcagggagttcactgctgaggagatttatgaggcaaatagcttaaca

SEQ ID NO: 30588 - DNA, 201 bp, Homo sapiens
tgaattaagcagagaaaggatagaccagctggcatagggcctcgcagagagctagaaacagtcacaaaaattaagctaaatccaaaaaaaaaaaaaaaaaaccctgaaatgatacaggagggaactgattctaagcgcagcccatccctgcctagagccgcaggctaatttggtaattagcagttatataaaatcgatggc

SEQ ID NO: 30589 - DNA, 201 bp, Homo sapiens
gtgaattaagcagagaaaggatagaccagctggcatagggcctcgcagagagctagaaacagtcacaaaaattaagctaaatccaaaaaaaaaaaaaaaaaaccctgaaatgatacaggagggaactgattctaagcgcagcccatccctgcctagagccgcaggctaatttggtaattagcagttatataaaatcgatgg

SEQ ID NO: 30590 - DNA, 201 bp, Homo sapiens
acacctaaatctctgtgaacattgcaccatatttggttttgctcatcattgaatctcagggttcaccatttcctgaatgaatgaatgaatgaatgaatgaatgaagctgcagaagttcactatgacttgggcatggattgcaagaattcactgataaaatgagagccgagtcatgccttatgcacccgatgaaaagtttgg

SEQ ID NO: 30591 - DNA, 201 bp, Homo sapiens
tacacctaaatctctgtgaacattgcaccatatttggttttgctcatcattgaatctcagggttcaccatttcctgaatgaatgaatgaatgaatgaatgaatgaagctgcagaagttcactatgacttgggcatggattgcaagaattcactgataaaatgagagccgagtcatgccttatgcacccgatgaaaagtttg

SEQ ID NO: 30592 - DNA, 201 bp, Homo sapiens
ctacacctaaatctctgtgaacattgcaccatatttggttttgctcatcattgaatctcagggttcaccatttcctgaatgaatgaatgaatgaatgaatgaatgaagctgcagaagttcactatgacttgggcatggattgcaagaattcactgataaaatgagagccgagtcatgccttatgcacccgatgaaaagttt

SEQ ID NO: 30593 - DNA, 201 bp, Homo sapiens
cctacacctaaatctctgtgaacattgcaccatatttggttttgctcatcattgaatctcagggttcaccatttcctgaatgaatgaatgaatgaatgaatgaatgaagctgcagaagttcactatgacttgggcatggattgcaagaattcactgataaaatgagagccgagtcatgccttatgcacccgatgaaaagtt

SEQ ID NO: 30594 - DNA, 201 bp, Homo sapiens
ccctacacctaaatctctgtgaacattgcaccatatttggttttgctcatcattgaatctcagggttcaccatttcctgaatgaatgaatgaatgaatgadtgaatgaagctgcagaagttcactatgacttgggcatggattgcaagaattcactgataaaatgagagccgagtcatgccttatgcacccgatgaaaagt

SEQ ID NO: 30595 - DNA, 201 bp, Homo sapiens
actttttttttttttttttgagacggagtttcactcttgttgcccaggctggagtgcagtggtgtgatcttggctcaccgcaacctctgcctcccgggttsaagcgattctcctgcctcagcctcccaagtagctaggattacaggcatctgccaccacgcccggctaattttgtgtttttagtagagacagggtttctcc

SEQ ID NO: 30596 - DNA, 201 bp, Homo sapiens
ccagtgactttttttttttttttttgagacggagtttcactcttgttgcccaggctggagtgcagtggtgtgatcttggctcaccgcaacctctgcctccygggttcaagcgattctcctgcctcagcctcccaagtagctaggattacaggcatctgccaccacgcccggctaattttgtgtttttagtagagacagggt

SEQ ID NO: 30597 - DNA, 201 bp, Homo sapiens
actcttcacacctcctccagtgactttttttttttttttttgagacggagtttcactcttgttgcccaggctggagtgcagtggtgtgatcttggctcacygcaacctctgcctcccgggttcaagcgattctcctgcctcagcctcccaagtagctaggattacaggcatctgccaccacgcccggctaattttgtgttt

SEQ ID NO: 30598 - DNA, 201 bp, Homo sapiens
aaccccctcacattgtctcctggcccactcttcacacctcctccagtgactttttttttttttttttgagacggagtttcactcttgttgcccaggctggrgtgcagtggtgtgatcttggctcaccgcaacctctgcctcccgggttcaagcgattctcctgcctcagcctcccaagtagctaggattacaggcatctgc

SEQ ID NO: 30599 - DNA, 201 bp, Homo sapiens
taaccattgcaataaccccctcacattgtctcctggcccactcttcacacctcctccagtgactttttttttttttttttgagacggagtttcactcttgytgcccaggctggagtgcagtggtgtgatcttggctcaccgcaacctctgcctcccgggttcaagcgattctcctgcctcagcctcccaagtagctaggat

SEQ ID NO: 30600 - DNA, 201 bp, Homo sapiens
ttaaccattgcaataaccccctcacattgtctcctggcccactcttcacacctcctccagtgactttttttttttttttttgagacggagtttcactcttrttgcccaggctggagtgcagtggtgtgatcttggctcaccgcaacctctgcctcccgggttcaagcgattctcctgcctcagcctcccaagtagctagga

SEQ ID NO: 30601 - DNA, 201 bp, Homo sapiens
aatttgacaatcagcatttacaagccagtaggagctggctccagtgcatgttcatgaccttatagagattggggtactaagcaccaaaaagacaagagcckgctcacaaaggaagttacaaatcacttaaagccattgagcccagcaggacatatagacatggcatggggggtgagatgtgaggaagaaagttgagtccag

SEQ ID NO: 30602 - DNA, 201 bp, Homo sapiens
ccaggttctcatctattatcttaaccattgcaataaccccctcacattgtctcctggcccactcttcacacctcctccagtgactttttttttttttttttgagacggagtttcactcttgttgcccaggctggagtgcagtggtgtgatcttggctcaccgcaacctctgcctcccgggttcaagcgattctcctgcctc

SEQ ID NO: 30603 - DNA, 201 bp, Homo sapiens
acaggcgctgggcacctatttttgtacagatgcccatggattgcctaatccatgcaacaacctgaaaatgttggtatgatttgccccttttacagaggtggccatcaaggccaagcagggttaaaagacttgctcatggttccattaccaaagatgtcagagctggggatcaaacggaagcctgactccaaagcctatatt

SEQ ID NO: 30604 - DNA, 201 bp, Homo sapiens
tgactgtgtggcccaatttcgtcatctataaaatggtagtaataatgataccttaatcccatggtgttggtgagagggtgaattgaaataatctatgtaamagtggttagcattgtacttggtacataataagtgctcagtataatcatgcaaaatcctgacaggttctaaatatcaactcttcttctcatggcctaggag

SEQ ID NO: 30605 - DNA, 201 bp, Homo sapiens
ttttttttcctttggagacagagtctcactctgtggcccaggctggagtgcagtggtgtgatctcggctcgctgcaagctccgcctcccgggttcacaccrttctcctgcctcagcctcccaagtagctgagactacaggcgctgggcacctatttttgtacagatgcccatggattgcctaatccatgcaacaacctgaa

SEQ ID NO: 30606 - DNA, 201 bp, Homo sapiens
tttagtagagacgaggtttcaccatgttagccaggatggtctcgatctcctgacctcatgatctgcccgcctcggcctccctgtgtgctgggattacaggmgtgagccaccgtgcccagagagacaataatttatattatttaagacacccagttggtggtaccttgttatggcagccctgggaaactaataggaacttcc

SEQ ID NO: 30607 - DNA, 201 bp, Homo sapiens
acttaaaacaggccttagaaagaagcttctcattttacagatttaaaaagcagcagtcagtgagacagattttcccagagccagacagctaattaatggcsgagtaagaaaaagaatcctggtctcctaccagcttctagcactcttttatcttctctggaatgcaaagtagaatagaattgaaaaataaaaattttaaag

SEQ ID NO: 30608 - DNA, 201 bp, Homo sapiens
ctctcaagtagctaggactacaggcacctgccaccatgcccagctaatttttggatttttagtagagacgaggtttcaccatgttagccaggatggtctcratctcctgacctcatgatctgcccgcctcggcctccctgtgtgctgggattacaggcgtgagccaccgtgcccagagagacaataatttatattatttaa

SEQ ID NO: 30609 - DNA, 201 bp, Homo sapiens
tacctgtcatattcttgaccctgcctttctacagggataggttcatttgcaaacaaaatcttgatctaatccaggacttacactgaaccctcctggctacytcagggaagactcagcagctgctagcatagctacaactgggttgagtccaaactatgagcacgttacctctgacatggtacctctgtgctgcttgaggaa

SEQ ID NO: 30610 - DNA, 201 bp, Homo sapiens
cttgaggtgggggagggtagacagtgaagtcatgggaccaccttaggcaaggccattctctaactctgagggatcccaagcgttccacctgctcaaaattrtctccctcaccagttgccatattccaggaatgccttccacaatgctactgcaagagatggtggttggtctgtgaggctctctgattatcttggagcttac

SEQ ID NO: 30611 - DNA, 201 bp, Homo sapiens
gacctgcactgcccagagcaccctgcagaactgaacccaagtgactcttctggaacttggcttgataatgcacctgggcttgagcacgttcccttcccaaytttccactcttccctaccagttttttctgggaacaccttccaataaatcacttttacatgaatctttagcaaagacctacttctaaggaatccatcctaa

SEQ ID NO: 30612 - DNA, 201 bp, Homo sapiens
tgggggattcgcatgccctcagggacatagaccttaacccacaatgagatgtgacctgcactgcccagagcaccctgcagaactgaacccaagtgactctyctggaacttggcttgataatgcacctgggcttgagcacgttcccttcccaactttccactcttccctaccagttttttctgggaacaccttccaataaat

SEQ ID NO: 30613 - DNA, 201 bp, Homo sapiens
acctgacagccagtgaagtcaccagacaaagtgccctgatctcctggcagcctcccagggcagagattgaaaattatgtcttgacctacaaatccaccgayggaagccgcaaggtgagattttgctggaaagggaaaagaccatttcttccaagtgaggccatgtggaaactgactagtggagtgaccacaggacattgga

SEQ ID NO: 30614 - DNA, 201 bp, Homo sapiens
gttcaagactaggatccagagggatggctaaagacccagcaaagccagatggagccttggagggaagcacagtgatgtggtcccatttcagccactccagwcaagttatgagtcagaggaaactggcccagacctcacctgcatcctgccagttcttgctggtacatgtggcatttttaaggaagtggagggcacactcac

SEQ ID NO: 30615 - DNA, 201 bp, Homo sapiens
gatgagaaaatttcacctcgagaagaaaagggttgttattccagtaatggaatggggtcatgaaattcatcatcagatatagccagaaaccaccaagaagstgcctttgctcttgctttgtgctccagggagaaagaaggcaccaaagtggccataactccctcacccgggaccaaagcagtgaaggtgatgtggctccgt

SEQ ID NO: 30616 - DNA, 201 bp, Homo sapiens
tatttaattttttctaaaataaagaaaatatataattggctaatcttgaataaacacaaatagtgtttgtttagatttgaggtttaaaacatttatcaagrtatagaattttcttctaagttaagagtttttgtaataagctttgttgttaaactttatcaaatggtttttataatacctatttaatttattatatgactt

SEQ ID NO: 30617 - DNA, 201 bp, Homo sapiens
tcccaggttcaagcgattgtcctgcctcaagcctctcaagtagctaggactacaggcacctgccaccatgcccagctaatttttggatttttagtagagaygaggtttcaccatgttagccaggatggtctcgatctcctgacctcatgatctgcccgcctcggcctccctgtgtgctgggattacaggcgtgagccaccg

SEQ ID NO: 30618 - DNA, 201 bp, Homo sapiens
tcagctcactgcaacctccgcctcccaggttcaagcgattgtcctgcctcaagcctctcaagtagctaggactacaggcacctgccaccatgcccagctamtttttggatttttagtagagacgaggtttcaccatgttagccaggatggtctcgatctcctgacctcatgatctgcccgcctcggcctccctgtgtgctg

SEQ ID NO: 30619 - DNA, 201 bp, Homo sapiens
agaaggtttatagtcattctgcctgcattctaatcctagcttctatgtttgctgactgtgtggcccaatttcgtcatctataaaatggtagtaataatgayaccttaatcccatggtgttggtgagagggtgaattgaaataatctatgtaaaagtggttagcattgtacttggtacataataagtgctcagtataatcat

SEQ ID NO: 30620 - DNA, 201 bp, Homo sapiens
gagtctcactctgtcacccagtctggagtgcagtggcatggtctcagctcactgcaacctccgcctcccaggttcaagcgattgtcctgcctcaagcctcycaagtagctaggactacaggcacctgccaccatgcccagctaatttttggatttttagtagagacgaggtttcaccatgttagccaggatggtctcgatc

SEQ ID NO: 30621 - DNA, 201 bp, Homo sapiens
agatcacacctattaagatcgtctgaattattcctaatatagtttactttgggacaccatgtataaatgaaaggaggcatctcgcgcaatctgtaacctgmtgtctaaattgtaggggaaagaatgaaaactgtagaacatcagggtttgacagtcagttctgctatgacccactctgacttttggcacatcccttaacct

SEQ ID NO: 30622 - DNA, 201 bp, Homo sapiens
gccttcctttcctcatctacaaatggtgctagactagagcaacaagaagttattaacaataaaagcacctattcagatgtcagcctggcttctgtaagtamcgtataagcaacagctattatcggctgacgccaatgagtgggaactgtatctgtacccctttgtgcacaggttttctctcccaaaaggtaccttagaccc

SEQ ID NO: 30623 - DNA, 201 bp, Homo sapiens
caccagacagagcacacataaattatcttaaaggtacacataatagtaaaatgtagtcaaataatttgagagtgataaattttgaatatctattacctttrtttttaatataatttacttaagtattaggttataaaattgaatctttaataatggctgtattcaacgacagtcttgaaacagtcctgaaaatttgacaat

SEQ ID NO: 30624 - DNA, 201 bp, Homo sapiens
tgtgggccatcgctgtgttaatgctattctgtagcgcacatgcttcttagtagacttactctttggcggtctggacatacctgtcatattcttgaccctgsctttctacagggataggttcatttgcaaacaaaatcttgatctaatccaggacttacactgaaccctcctggctacttcagggaagactcagcagctgct

SEQ ID NO: 30625 - DNA, 201 bp, Homo sapiens
ccggatcgagatgctggagagggaggtgtcggtgctgcgagaccagtgcaacgccaactgctgccaagaaagtgctgccacaggtagagtccgggagctcrcagcgtggtctcaggaggggaaggagagggctgagcagagagggagagtgaacaagaaggaccaatgcacttccagcgaaaacgcactcccagcaaaacc

SEQ ID NO: 30626 - DNA, 201 bp, Homo sapiens
aatctcggctcactgcaagctccgcttcccgggttcacgccattctcctgcctcagcctcccgagtagctgggactacaggcgcccaccaccgcgcccggstaattttttgtatttttagtagagacggggtttcaccttgttagccaggatggtctcgatctcctgacctcatgatccgcccgcctcggcctcccaaagt

SEQ ID NO: 30627 - DNA, 201 bp, Homo sapiens; identical to SEQ ID NO: 8047

SEQ ID NO: 30628 - DNA, 201 bp, Homo sapiens
gactgcagtggcgcaatctcggctcactgcaagctccgcttcccgggttcacgccattctcctgcctcagcctcccgagtagctgggactacaggcgcccrccaccgcgcccggctaattttttgtatttttagtagagacggggtttcaccttgttagccaggatggtctcgatctcctgacctcatgatccgcccgcct

SEQ ID NO: 30629 - DNA, 201 bp, Homo sapiens; identical to SEQ ID NO: 8049

SEQ ID NO: 30630 - DNA, 201 bp, Homo sapiens
tgcggactgcagtggcgcaatctcggctcactgcaagctccgcttcccgggttcacgccattctcctgcctcagcctcccgagtagctgggactacaggcrcccaccaccgcgcccggctaattttttgtatttttagtagagacggggtttcaccttgttagccaggatggtctcgatctcctgacctcatgatccgccc

SEQ ID NO: 30631 - DNA, 201 bp, Homo sapiens
gatttgcatcccagtgagtttattgtactctatggttcttggtgactaggtaaccagcagaggagctaattcattattttaccaatttaaacaggaacttrgaagaaaagcacctggtggtcacagagcatgaggactatactgacaagaagattaaaagaaagttcagctcacacagccctagataatcacaaatgtacc

SEQ ID NO: 30632 - DNA, 201 bp, Homo sapiens
actaacacgaaatcttgaagttcactgtcttctgtatcatgcttgttcaccttacaccatttgaagttgaacagaacagagaagcccaaagcaaaatagarttgagtcctccaagtctctaggcttagggaagttatttccctgccttcatcaaacatgtgatcacagaattgttttgggttatattcaggaatccagaga

SEQ ID NO: 30633 - DNA, 201 bp, Homo sapiens
ctttctcaagcctccatgcatttgcacatgctatttctttcaccaggaaactcccccatttgcctgcctagaaaacccatccttcaagtcgtggtttcaamcctatctcttctgtcaaagcttccctgaaggcagtcagacacatctgctcacagacactaaacacacagctctaacagagcaatgaacttccattcattc

SEQ ID NO: 30634 - DNA, 201 bp, Homo sapiens
gaaacaaaaattgagctctcatctttatggaactcacttctaatgatgttgcagagaagtaaatagttacaacttgatgtgagcagtgtatgctatagacrtgcacagaacaccatgggccatgtccagtgggctactatgaatagggtcaaggtgtggagggaaagaaagaagaaaagtcttagataaagtgaaagaaga

SEQ ID NO: 30635 - DNA, 201 bp, Homo sapiens
catgcttaccaaatttgtgtataaaacaaaattgtgatcaatagaatccaagttcaaaaatattttaatcaactgaaacagtggcccaaaactcaatcaaygaggcaaaatgcaatagaaataaatgcaaagctctgtccatgggtataaaaaatcaactaacaaaattggattgagaggtagggggagtggttacaaaga

SEQ ID NO: 30636 - DNA, 201 bp, Homo sapiens
aactccctgatccacccggaccaattaaatgcaccaagtaaagacatcaggttctggctgggtgcggtgactcacacctataatcccagcacttcgggggyctagatgggcagattacctgaggtcaggagtttgagaccagcctgtccaacatgataaaaccctgtctctactgaaaatacaaaaattagttgggcatgg

SEQ ID NO: 30637 - DNA, 201 bp, Homo sapiens
aatgagccagagctgtggaatccgtgctcccttagctttatgttttaaaagcacatgtgagtccttcatttccctttaaaaagaaatattttgagtcttgrgaaaaataatgcagacaatgggataagatcaggacagagtagaagccagaggaaggaaaggaaaggacccaggagccagaacttacccagagaagccctt

SEQ ID NO: 30638 - DNA, 201 bp, Homo sapiens
acctaatgtaatcctcacaacagcctatgtggtatgcactatcatctctattttttacaaatgaggaaattgggccacagagaggtgaggtaactcacccragatcccatagctcttaagtaagggagctggaatttgacgccagatgtttcagctctggggtctgtgttactaatgtttctctctaccacctcccactgt

SEQ ID NO: 30639 - DNA, 201 bp, Homo sapiens
aggttgtttgtttgtgtttacaagactccagttgacaccaggctcttggggcatgaccaataccagctcagaaaggggaaaacagaagagcccaatttccyatgcggtgagtgtagctactgactgaggtgttccatgtagagtttgtattattacttctgtggtacatggtaaagatatgtctgtgtttggaagctttcg

SEQ ID NO: 30640 - DNA, 201 bp, Homo sapiens
cagttgacaccaggctcttggggcatgaccaataccagctcagaaaggggaaaacagaagagcccaatttcctatgcggtgagtgtagctactgactgagstgttccatgtagagtttgtattattacttctgtggtacatggtaaagatatgtctgtgtttggaagctttcgcagttttactggaaagctcaaatttaaa

SEQ ID NO: 30641 - DNA, 201 bp, Homo sapiens
cccctttcactttattgggaactcggccttgaagcttcatgttagctgaaaatagctaaccccacattgtggattccctgttcccataattaccccttttwtgaagtggggcgttccatggtgggggatgacctgacatgcttatctttctcacgcccagggcatcaactggtaccattggaaaggccatgagttctccat

SEQ ID NO: 30642 - DNA, 201 bp, Homo sapiens
gcccaggccggattgcggactgcagtggcgcaatctcggctcactgcaagctccgcttcccgggttcacgccattctcctgcctcagcctcccgagtagckgggactacaggcgcccaccaccgcgcccggctaattttttgtatttttagtagagacggggtttcaccttgttagccaggatggtctcgatctcctgacc

SEQ ID NO: 30643 - DNA, 201 bp, Homo sapiens
aagtatctcattggggctgattccctttttttttttttttttttttttttgagacggagtctcgctctgtcgcccaggccggattgcggactgcagtggcrcaatctcggctcactgcaagctccgcttcccgggttcacgccattctcctgcctcagcctcccgagtagctgggactacaggcgcccaccaccgcgcccg

SEQ ID NO: 30644 - DNA, 201 bp, Homo sapiens
gtgagaaaaaaaaaaaaaagtatctcattggggctgattccctttttttttttttttttttttttttgagacggagtctcgctctgtcgcccaggccggaytgcggactgcagtggcgcaatctcggctcactgcaagctccgcttcccgggttcacgccattctcctgcctcagcctcccgagtagctgggactacaggc

SEQ ID NO: 30645 - DNA, 201 bp, Homo sapiens
ggatgatgtactaaaatggggatctaaacccaacagtgagaaaaaaaaaaaaaagtatctcattggggctgattccctttttttttttttttttttttttktgagacggagtctcgctctgtcgcccaggccggattgcggactgcagtggcgcaatctcggctcactgcaagctccgcttcccgggttcacgccattctc

SEQ ID NO: 30646 - DNA, 201 bp, Homo sapiens
tatccccatcttctccagtgagatggaagctttagcacctgccccctcaaaaagcacacagaagcgtatgcacacacacacacacacacacacacacacactctcacacacacatactctctctctcacgcatgcacacacgcatgctctcacacacaacacactcacacaacttagtgcaccctccaaaaggctgaaatc

SEQ ID NO: 30647 - DNA, 201 bp, Homo sapiens
cctatccccatcttctccagtgagatggaagctttagcacctgccccctcaaaaagcacacagaagcgtatgcacacacacacacacacacacacacacacactctcacacacacatactctctctctcacgcatgcacacacgcatgctctcacacacaacacactcacacaacttagtgcaccctccaaaaggctgaaa

SEQ ID NO: 30648 - DNA, 201 bp, Homo sapiens
atgaagttaagatgagatcatactggagtagagtggttcctctaatccattgtgactgctgtacttttaagaagacaactatatgaagaaacaaggagaayacagtgcacagacagaggcacagacgggagtgatgcacctacaagcagaggaatggcatgggatgctagcagccaccagcagctgggagaggggcatggg

SEQ ID NO: 30649 - DNA, 201 bp, Homo sapiens
acctatccccatcttctccagtgagatggaagctttagcacctgccccctcaaaaagcacacagaagcgtatgcacacacacacacacacacacacacacacactctcacacacacatactctctctctcacgcatgcacacacgcatgctctcacacacaacacactcacacaacttagtgcaccctccaaaaggctgaa

SEQ ID NO: 30650 - DNA, 201 bp, Homo sapiens
ggacctatccccatcttctccagtgagatggaagctttagcacctgccccctcaaaaagcacacagaagcgtatgcacacacacacacacacacacacacwcacactctcacacacacatactctctctctcacgcatgcacacacgcatgctctcacacacaacacactcacacaacttagtgcaccctccaaaaggctg

SEQ ID NO: 30651 - DNA, 201 bp, Homo sapiens
cagaggacctatccccatcttctccagtgagatggaagctttagcacctgccccctcaaaaagcacacagaagcgtatgcacacacacacacacacacacwcacacacactctcacacacacatactctctctctcacgcatgcacacacgcatgctctcacacacaacacactcacacaacttagtgcaccctccaaaag

SEQ ID NO: 30652 - DNA, 201 bp, Homo sapiens
gactacactgtctctggactgtggggactgctccttgcatcggtgccctctacactgccttaatgtcattgtcttagagaagaccagcttgttagaaaacsacttaataggtaggtcatttttctttgctccaaggagcccataaaatgaaggagtgagaccagtgtgcaaagcctcttcacactccaacattcccagccc

SEQ ID NO: 30653 - DNA, 201 bp, Homo sapiens
gatcccctagcagtaaaaaaaaaaaaaaagcccatagcataaatgaaatacaatttaggaaaatggatttgttctggacttgtgctctgaaatccctgtayagtcaataggcagtttttcaaaactgaaaccaaaggtggctgctaaagaataagagatacaggcaaaatttggtttatcttaaaaaattacctcagagaa

SEQ ID NO: 30654 - DNA, 201 bp, Homo sapiens
gtcatgaactcacagcaaagcgtgccagccaccatgaatgccaggactggtgagtaggaggactgctgaggaagaagaccaggttagcctataagcctaakgagtcatggaggctcgtcccagcaaaaattaatcagaaagcaatgtcttccagtgaacagggctctggtgacaactgtcagcctagaaacaacatccacc

SEQ ID NO: 30655 - DNA, 201 bp, Homo sapiens
tggaatatctgccgtcatgaactcacagcaaagcgtgccagccaccatgaatgccaggactggtgagtaggaggactgctgaggaagaagaccaggttagsctataagcctaaggagtcatggaggctcgtcccagcaaaaattaatcagaaagcaatgtcttccagtgaacagggctctggtgacaactgtcagcctaga

SEQ ID NO: 30656 - DNA, 201 bp, Homo sapiens
aggaatgcttttcaggtctatgtccacactgtctctcttgattacatactcccgaaattcacaatttaagcaagaaatcctctcgctggttcaagccaacytgagacgctaagcatacaaggagtccttgtatacttatgtgagcacacctctgaaggtcactgacaaggcagcctcactgccttcccagagagcctgcct

SEQ ID NO: 30657 - DNA, 201 bp, Homo sapiens
aaaggggaaaacagaagagcccaatttcctatgcggtgagtgtagctactgactgaggtgttccatgtagagtttgtattattacttctgtggtacatggyaaagatatgtctgtgtttggaagctttcgcagttttactggaaagctcaaatttaaatgtaagtcactcatgtataccaaactctgctggctttgtcttg

SEQ ID NO: 30658 - DNA, 201 bp, Homo sapiens
gctggctttgtcttggagatttatcagaacccactgaaatgactggttgcagaatgaaagattcttgggcagaaataatgcatgtgaaagtatcttgcacraagcctggcacataccagacataatagacactggttaaattgaatagtcaaatctcagctgcagagcacagaagaggggtctctgataaaataaagccta

SEQ ID NO: 30659 - DNA, 201 bp, Homo sapiens
ggagttggagattccctcctgagaggctcctgctccctcaaggggcccagccccttggggaggtcccctccctactgtagtttcatgatcccctagttcayagggacaccgcattccaggcaccatgctggacatctcataagcagggctttcttccatcttcacacacaacccagagaggatgaggacttgatccccatt

SEQ ID NO: 30660 - DNA, 201 bp, Homo sapiens
ggcggcccctgctttaggtgacctcgaatgcatactctcagtttcagacaatgagtgcggttgagggggccgggacgaggcagcccagtggggcgagcagrctcctcccacatgacatcctcgcacaagaatgcgggggtgggggtgaggggcagctgaaaactttccacaggctggtgaggcaggccccgcagagataag

SEQ ID NO: 30661 - DNA, 201 bp, Homo sapiens
atggaatcttggtaagctcatccctgctttgacacacattagttctgttagtggaaattatagatccttcccagacatcagtttccttattaaggctggaytaactcattcattaagaatgaatgaattgtggctgggcacggtggctcatgcctgtaatcccagcactttgggaggctgaggtgggtggatcacttgagc

SEQ ID NO: 30662 - DNA, 201 bp, Homo sapiens
gaggctgcagagggtttcagtggctttctgcaacagcgcccctgaccttcgtgccccgccaggtgatgaaagccatcaatgatggcttccggctccccacrcccatggactgcccctccgccatctaccagctcatgatgcagtgctggcagcaggagcgtgcccgccgccccaagttcgctgacatcgtcagcatcctgg

SEQ ID NO: 30663 - DNA, 201 bp, Homo sapiens
cggtggtgacacagtgtgggagccctcatgccggggctgaccagggcactcccctgaccctgtctgcccacaggagagtttggggaggtgtacaagggcaygctgaagacatcctcggggaagaaggaggtgccggtggccatcaagacgctgaaagccggctacacagagaagcagcgagtggacttcctcggcgaggcc

SEQ ID NO: 30664 - DNA, 201 bp, Homo sapiens
ccggcatcatgggccagttcagccaccacaacatcatccgcctagagggcgtcatctccaaatgtgaggcttggggcctgcccacactgggtggagagggrccacttagcaggggctctgtctgtgactgtgcccacctcccctatacctgtgcccaccttccccccacacctgcacccacctcctctacaactgtgccca

SEQ ID NO: 30665 - DNA, 201 bp, Homo sapiens
tgagctgggggcactgggaacagactaggggtgaggggagggaaggcatttgttcatagctggtttgattcccagctcttccacctcctagctgtgtgacytcaggcaagtcactttacctctctgacctcagttctctaatctgcaaaatggggatgaaaaagagcacctgcctcacagataattcagaagatttgattt

SEQ ID NO: 30666 - DNA, 201 bp, Homo sapiens
acagatgctgagcgctcccaacgtgccaggaggtctcattgaaccctacttgactgggcttccctgttgcccagataaggagacggaggcacggggcagcrgagtcaatcatccaggttagggagcagcaggtgcagggcccagggtggactgggtgctgcagcccctcacctgcagtgcttcctgttgcagcgtgtctat

SEQ ID NO: 30667 - DNA, 201 bp, Homo sapiens
gtcccaggaagggggagaccctatcctcttagccttttgtgcctctaaaaatagtggccagtttcaacaacccagcttgtgcatggtcaaagatcatggcrggaacagaccgggaggctgggaggttttgggaaccgtatggaggggatgacctgggcctcccatggttctaggtcacagaagttctgggatttgagcctg

SEQ ID NO: 30668 - DNA, 201 bp, Homo sapiens
ggattcaaccaaatgcagactccttgccccacctgcggaactgcaaatcgagtgaatctggggtcaggccgggggtcctgtctccttcaccgtggtctgarcgcttttccagggaccacaatttgagaccttcaagtgtgtgggaaactgctgctttttcagcacctccaactgtataggttagaaacgtcctgtgcaggt

SEQ ID NO: 30669 - DNA, 201 bp, Homo sapiens
tgtcaagctgccccttggcagctcttctccccttcccaactccagcattgagacttttcccggcatggccttggcacagacacctcctcctgtcccaggargggggagaccctatcctcttagccttttgtgcctctaaaaatagtggccagtttcaacaacccagcttgtgcatggtcaaagatcatggcgggaacagac

SEQ ID NO: 30670 - DNA, 201 bp, Homo sapiens
agcaaacattaactgagcaccgctgggccatgggacacagataaattggtctccattcctgctcctcaggagctgctggtctcacggaagctcctgatacwtgcaggaataatttcaaatggagcataaaagccaagttttgaattcccctggagctgaaacagtgtttatctgtctcaccatcgcatcctagcacccagc

SEQ ID NO: 30671 - DNA, 201 bp, Homo sapiens
tcaagacgctgaaagccggctacacagagaagcagcgagtggacttcctcggcgaggccggcatcatgggccagttcagccaccacaacatcatccgcctrgagggcgtcatctccaaatgtgaggcttggggcctgcccacactgggtggagaggggccacttagcaggggctctgtctgtgactgtgcccacctcccct

SEQ ID NO: 30672 - DNA, 201 bp, Homo sapiens
  misc_feature (1)...(201): n = A,T,C or G, or insertion/deletion polymorphism (see Tables 1-2)
gcatttggttccccgtggggctctttcaggaggaagaaccagcgtgcccgccagtccccggaggacgtttacttctccaagtcaggtgagacgcagccccngctccaggcccagccctgcccgcaccgtccccagctctgtgggggaggtgggggcagccagggtgttcccagggcactggggtggggccacaggcttccg

SEQ ID NO: 30673 - DNA, 201 bp, Homo sapiens; identical to SEQ ID NO: 8080

SEQ ID NO: 30674 - DNA, 201 bp, Homo sapiens
  misc_feature (1)...(201): n = A,T,C or G, or insertion/deletion polymorphism (see Tables 1-2)
tcctatctccttaccctctagggagggtagcacttattggcagctacctggactttacttggaaatagagtggggacagtacctagggtcttaggttttgnctatggcctctgagcctggcagagaacctggggtggatcagtgggaggtgcccaatggcaggactaggtctagggaagaccccgggagtgtatccctccg

SEQ ID NO: 30675 - DNA, 201 bp, Homo sapiens
agggtgaggacaggggcagaattttgggaccccacacactcagtttgagtcctggctcatgcatttagtggttctgaccttgagtgagtcacttaattccragcctcagtttcctcctctgtaagaagagcctcaagtttgctaacaaaggcaagccaccttgctagcttggggtggtctccagcgggctgagccgaggcc

SEQ ID NO: 30676 - DNA, 201 bp, Homo sapiens
tgcatttgtggaagaagctgtggagcaatgtggacccacaaagatggcacttacggtggaactcatggcaaagaaggaggtgttttttgctttttttttttccccccagaaatgggaaggtaaggggatagagagctcatggataagccctgcttagcctaagcctctccaggaagccgtctgggtcagccgaggggctcc

SEQ ID NO: 30677 - DNA, 201 bp, Homo sapiens
cttaaaacattatgatattatttttgcaatatttttcccttttttttgagacagagtctcgctctgttgcccaggctggagtgcagtggcttgatctcggytcactgcaacctctgccttccgggttcaagcaattctcctgcctcagcctctggagtagctgggattacaggcacgtgccaccacacacagctaattttt

SEQ ID NO: 30678 - DNA, 201 bp, Homo sapiens
cggccacccacccacagggagactccaacagctacaatgtgcgccgcaccgagggtttctccgtgaccctggacgacctggccccagacaccacctacctkgtccaggtgcaggcactgacgcaggagggccagggggccggcagcaaggtgcacgaattccagacgctgtgtgagttgggggaccctgggcatggaccag

SEQ ID NO: 30679 - DNA, 201 bp, Homo sapiens; identical to SEQ ID NO: 8075

SEQ ID NO: 30680 - DNA, 201 bp, Homo sapiens
  misc_feature (1)...(201): n = A,T,C or G, or insertion/deletion polymorphism (see Tables 1-2)
tccacagcaatgtggattttcaatgggtgactttttctggaaatggccatgaggcagagcatttgtggaatgcaggccaacctttggagggctggctcatnccctctctctggcagcttctttgctgagataagcgggacgttaaggaattggaggtttagtggctgcgttgcacacaccttggctaactcccccctcatc

SEQ ID NO: 30681 - DNA, 201 bp, Homo sapiens
aaattcgtaaattatcttaaaacattatgatattatttttgcaatatttttcccttttttttgagacagagtctcgctctgttgcccaggctggagtgcastggcttgatctcggctcactgcaacctctgccttccgggttcaagcaattctcctgcctcagcctctggagtagctgggattacaggcacgtgccaccac

SEQ ID NO: 30682 - DNA, 201 bp, Homo sapiens
actgagtacatggagaatggggccctggacaagttccttcgggtaaggatgtgggttgtagggggcggggatgcctggccattgagcccggggctggcctrgcgggttcagggctggcctgcagctgagcgcctgtgctccggcaggagaaggatggcgagttcagcgtgctgcagctggtgggcatgctgcggggcatcg

SEQ ID NO: 30683 - DNA, 201 bp, Homo sapiens
tactgacctgcttgcagggcaggggtccctggtgagggaatgagacagtcacgtggggtggaagcagattgaactgatgtccttgtgctctgtctgtcctrtgtccaccagcctgctcgcctggattttttaagtttgaggcatctgagagcccctgcttggagtgccctgagcacacgctgccatcccctgagggtgcca

SEQ ID NO: 30684 - DNA, 201 bp, Homo sapiens
ctcctgcgagtgtgaggaaggcttcttccgggcacctcaggacccagcgtcgatgccttgcacacgtgagtcttgcagtgggtcagggtggcgtgactgarggtgacgtgtccgcctgggtccagcacagcactgactcctcctgtctgtgcaggacccccttccgccccacactacctcacagccgtgggcatgggtgcc

SEQ ID NO: 30685 - DNA, 201 bp, Homo sapiens
cttcctgcccgcccctttcccacctctagctgttgcttccccttcctgtggggggctgcatttctctgcctcattctcacccaggtcttcccctctatgcsgtcctgatgtgaccaggaatgggggcaggggctgggggttcttcccctggctgtgtgtgtctgctgtgtgatcttggggaagatgtggctctcggggcct

SEQ ID NO: 30686 - DNA, 201 bp, Homo sapiens
cccctcccctgctccagcccctaactctccctctctccctcccggcccacagcgacatcaagaggattggggtgcggctgcccggccaccagaagcgcatygcctacagcctgctgggactcaaggaccaggtgaacactgtggggatccccatctgagcctcgacagggcctggagccccatcggccaagaatacttgaa

SEQ ID NO: 30687 - DNA, 201 bp, Homo sapiens
  misc_feature (1)...(201): n = A,T,C or G, or insertion/deletion polymorphism (see Tables 1-2)
ccctgctcccagcctgcctggagctctgtccaccctttgagtccttctccggtcctggccttgaggaatggggcttctgaggcagatccctcatgctccanggcccaaaggaagcattgacttggtttctttacccccaccttagggctttaccctctgaatccatcttgcataggttctatgccccggtttctcctatct

SEQ ID NO: 30688 - DNA, 201 bp, Homo sapiens
cattgggactccaggctctgtgcagagcaggagtcgggtcccgggcctcctctgtcctgctgcatgacctgggacaagcccccttccctgccctatgtgcytgagctcttgcagggccaatgctgagggtctgcagaagcaggatggaccaagggggtgagagcggctgtttgtgtggtccctgggccagggttgggaggg

SEQ ID NO: 30689 - DNA, 201 bp, Homo sapiens
agtggctggtgcccattgggcagtgcctgtgccaggcaggctacgagaaggtggaggatgcctgccagggtgagtgacggttctgggttgcagggaaggggttctgcattcccaggttctggtctttagctttggaatcatggaatcttggtaagctcatccctgctttgacacacattagttctgttagtggaaattata

SEQ ID NO: 30690 - DNA, 201 bp, Homo sapiens
cttgttgcccagactggagtgcaatggcgcaatctcggctcactgcaacctctgcctcccgggttcaagctattctcctgtctcaagcctccctagtagcygggattacaggtgcccgccaccaggcgcgtctaatttttgcatcttttagtggagacgaggtttcaccatgttggccaggctgattctgaactcctgacc

SEQ ID NO: 30691 - DNA, 201 bp, Homo sapiens; identical to SEQ ID NO: 8091

SEQ ID NO: 30692 - DNA, 201 bp, Homo sapiens
atcctggagagggagtcctggctcgctcacttcctccctgttcctccacccgccttctccgcaccctcggccctgagagtggagcttgggcagcaaaagcrgggactgggccgcattctgagcaccccaggtcctcctaggaccaaagtagggccaggaggcttccctggccggagcagacctcactgacctccctgcatt

SEQ ID NO: 30693 - DNA, 201 bp, Homo sapiens
catttggttccccgtggggctctttcaggaggaagaaccagcgtgcccgccagtccccggaggacgtttacttctccaagtcaggtgagacgcagcccccrctccaggcccagccctgcccgcaccgtccccagctctgtgggggaggtgggggcagccagggtgttcccagggcactggggtggggccacaggcttccgt

SEQ ID NO: 30694 - DNA, 201 bp, Homo sapiens
  misc_feature (1)...(201): n = A,T,C or G, or insertion/deletion polymorphism (see Tables 1-2)
gcctagatcctggagagggagtcctggctcgctcacttcctccctgttcctccacccgccttctccgcaccctcggccctgagagtggagcttgggcagcnaaagcggggactgggccgcattctgagcaccccaggtcctcctaggaccaaagtagggccaggaggcttccctggccggagcagacctcactgacctccc

SEQ ID NO: 30695 - DNA, 201 bp, Homo sapiens
gcttacaacccactggtttttaaaccggatgtcaggtttcttctgggattcaaccaaatgcagactccttgccccacctgcggaactgcaaatcgagtgawtctggggtcaggccgggggtcctgtctccttcaccgtggtctgagcgcttttccagggaccacaatttgagaccttcaagtgtgtgggaaactgctgctt

SEQ ID NO: 30696 - DNA, 201 bp, Homo sapiens; identical to SEQ ID NO: 8083
  misc_feature (1)...(201): n = A,T,C or G, or insertion/deletion polymorphism (see Tables 1-2)

SEQ ID NO: 30697 - DNA, 201 bp, Homo sapiens
ccgcttgaccgtctatgaaatgggactaagtaccctctggagccttcccaagtgcaagcacccagcacacagtaggggcccaggtgtcttgggtgcagcgygggtgttgctgtaatttgtgggggaactcccttgtcatcagctgatttcttccaccagccccggagggatctggcaacttggcggtgattggcggcgtgg

SEQ ID NO: 30698 - DNA, 201 bp, Homo sapiens
gcgcgggtgttgctgtaatttgtgggggaactcccttgtcatcagctgatttcttccaccagccccggagggatctggcaacttggcggtgattggcggcrtggctgtcggtgtggtcctgcttctggtgctggcaggagttggcttctttatccaccgcaggttcgtcagagcccataccctggctccacatgggcttgg

SEQ ID NO: 30699 - DNA, 201 bp, Homo sapiens
agctttggcattgtcatgtgggaggtgatgacctatggcgagcggccctactgggagttgtccaaccacgaggtgggtgcccttgccctccccaggcctgyccggacctgaactcaagccctttactcatctcaaactgcaggggctgggcagaggacagtttagatgaaccttcttaggcttgctccataaatgtttatt

SEQ ID NO: 30700 - DNA, 201 bp, Homo sapiens
gtataggttagaaacgtcctgtgcaggtagcgtaggaagttctcccaaatgtcccaaatgtctcggccttcctgctgctgtgggagcaccagcctctgcgygaggtcctggagtccccccaactcacctgggtctgcccttccctgctctgcgcctgtgccggggctcccggagcctgtgggaaagtcatgtctgcagaac

SEQ ID NO: 30701 - DNA, 201 bp, Homo sapiens; identical to SEQ ID NO: 8071
  misc_feature (1)...(201): n = A,T,C or G, or insertion/deletion polymorphism (see Tables 1-2)

SEQ ID NO: 30702 - DNA, 201 bp, Homo sapiens
ggctggaaagggagggccctccatgccaggttaacccttcagaagcctggtagcggtgagccctctcacttgggcacagacctcagcctcctgtcaatctragggggggctgcaggactgtgaggaacctttgtccttctacccacccagctgaaatcaggagcctccagattccttcctgtgtagctggaacattccatt

SEQ ID NO: 30703 - DNA, 201 bp, Homo sapiens
ggacacaggacacaggtgaattagatgcagactctggctgaggagctcagaatctcatgtgggagcccagatgtgggtgtccccatgtgccgtgccaagtrcactttggtaaatggcaaggggtacagggtaaagggaacatggcaactttgggagttgggtggcggggggcacctggcccaactgtagcctaacctggga

SEQ ID NO: 30704 - DNA, 201 bp, Homo sapiens
gtgtgagaatggggctgctggtcccctgtagagatggagaaactgaggcccagggagcgtggggcctggcttcaattcagcagctcagccaggtctcaggytcagggtccagcttctcacaccaggctcagagtcagccggcccaggccagggctggatgggcgtgggaaggtacgagggtgtgggtgtaagcctgagagg

SEQ ID NO: 30705 - DNA, 201 bp, Homo sapiens
gaggatcatagcgtctatctcgtagggtggctgtgataatcaaatgacttaatagtaaagtgcttaggtcagtgcctgccacatgagtacttttaaatgtsgctgttatttttgattcatcccacgaatgtatactgagtagctctggtacagcggcactgtggtcccacggtggagtaccaggagcaagttccatgtctg

SEQ ID NO: 30706 - DNA, 201 bp, Homo sapiens
gctgaactcgccatccttctcctgccggagcacaggcgctcagctgcaggccagccctgaacccgccaggccagccccgggctcaatggccaggcatcccygccccctacaacccacatccttacccgaaggaacttgtccagggccccattctccatgtactcagtgatgatcatcatgggcttgtctgtaggggggtgg

SEQ ID NO: 30707 - DNA, 201 bp, Homo sapiens; identical to SEQ ID NO: 8076

SEQ ID NO: 30708 - DNA, 201 bp, Homo sapiens
  misc_feature (1)...(201): n = A,T,C or G, or insertion/deletion polymorphism (see Tables 1-2)
gctccacatgggcttgggtgggaaaatggggcaggaacctccatttcctcatctgaacgatggggcccacaggatgctagtcgagtctaatccctgcctcnggatggtgcgaggatatacgagttagagtgtgtagcgaagtgcctggcacgcggcggggccgggacacgggggtcattacctctgctcttgttattaatg

SEQ ID NO: 30709 - DNA, 201 bp, Homo sapiens
aaaaagtcccttccagtgaactctggacacagacccttaggcatttgccctttgggcagctctgaaggttgggtggcagctcaagaaaggcccttcctgtytgtttctgggatgttcctgttcccctcccctcccctgcccacctccataggctggaggctgcagagggtttcagtggctttctgcaacagcgcccctgac

SEQ ID NO: 30710 - DNA, 201 bp, Homo sapiens
ccctccgccatctaccagctcatgatgcagtgctggcagcaggagcgtgcccgccgccccaagttcgctgacatcgtcagcatcctggacaagctcattcrtgcccctgactccctcaagaccctggctgactttgacccccggtgagttctatgccctctgcccatgatgacctcaattttccttctgcagactcttgaa

SEQ ID NO: 30711 - DNA, 201 bp, Homo sapiens
cacagacacaaaagtgcccagtttgagaagatctgtggtggggaataccctcccctcctccacaacacatagacccacagctgctctgaaattcgtcaggmgtttctggcttttgaagtgggtcaggccttatctcctctctcttcaggcttgtttcagaatgttgatttatctttgctccaaattgaagtgttcctaaga

SEQ ID NO: 30712 - DNA, 201 bp, Homo sapiens
atcttaaaacattatgatattatttttgcaatatttttcccttttttttgagacagagtctcgctctgttgcccaggctggagtgcagtggcttgatctcrgctcactgcaacctctgccttccgggttcaagcaattctcctgcctcagcctctggagtagctgggattacaggcacgtgccaccacacacagctaattt

SEQ ID NO: 30713 - DNA, 201 bp, Homo sapiens
  misc_feature (1)...(201): n = A,T,C or G, or insertion/deletion polymorphism (see Tables 1-2)
actgagccaggtgaagtctcctccacagacaagtcagggcatttgggggaactgaccccaggataaacatggcccagctttctggagtctcagttttactnacagatctggtggaggagagagctatttttgtatcatgcagatatgttatggggagggatgcaatatactcatgggtttccaaatacaataggagacttg

SEQ ID NO: 30714 - DNA, 201 bp, Homo sapiens
ccggaagttcacctctgccagcgacgtgtggagctttggcattgtcatgtgggaggtgatgacctatggcgagcggccctactgggagttgtccaaccacraggtgggtgcccttgccctccccaggcctgtccggacctgaactcaagccctttactcatctcaaactgcaggggctgggcagaggacagtttagatgaa

SEQ ID NO: 30715 - DNA, 201 bp, Homo sapiens
cgtaaattatcttaaaacattatgatattatttttgcaatatttttcccttttttttgagacagagtctcgctctgttgcccaggctggagtgcagtggcwtgatctcggctcactgcaacctctgccttccgggttcaagcaattctcctgcctcagcctctggagtagctgggattacaggcacgtgccaccacacaca

SEQ ID NO: 30716 - DNA, 201 bp, Homo sapiens
cacaaattcgtaaattatcttaaaacattatgatattatttttgcaatatttttcccttttttttgagacagagtctcgctctgttgcccaggctggagtkcagtggcttgatctcggctcactgcaacctctgccttccgggttcaagcaattctcctgcctcagcctctggagtagctgggattacaggcacgtgccac

SEQ ID NO: 30717 - DNA, 201 bp, Homo sapiens
tgttggccaggctgattctgaactcctgacctcaggtgatccacccgccgcggcctcccaaagtgctgcgattacaggcatgagccaccacccccggcctgtttccttctttttctgcctcccaaactgggtttggaggttttgctgttctgtgttgggaggaaaagaggccggatctggagccgttgggcagtggcaggt

SEQ ID NO: 30718 - DNA, 201 bp, Homo sapiens
acacgtgagtcttgcagtgggtcagggtggcgtgactgagggtgacgtgtccgcctgggtccagcacagcactgactcctcctgtctgtgcaggacccccytccgccccacactacctcacagccgtgggcatgggtgccaaggtggagctgcgctggacgccccctcaggacagcgggggccgcgaggacattgtctaca

SEQ ID NO: 30719 - DNA, 201 bp, Homo sapiens
tgcccacctcccctatacctgtgcccaccttccccccacacctgcacccacctcctctacaactgtgcccacttctccccaatacctgtacccacctcctwacacctgtgcccaccttccccccatacctgcacccacctccttacacccgtgcccacctctccccatacttgtacccacctcctctacacctgtgcccac

SEQ ID NO: 30720 - DNA, 201 bp, Homo sapiens
acaagggcatgctgaagacatcctcggggaagaaggaggtgccggtggccatcaagacgctgaaagccggctacacagagaagcagcgagtggacttcctyggcgaggccggcatcatgggccagttcagccaccacaacatcatccgcctagagggcgtcatctccaaatgtgaggcttggggcctgcccacactgggtg

SEQ ID NO: 30721 - DNA, 201 bp, Homo sapiens
caaatatcctaactatatcatatatatttcatatgcatttaattaccataactttagatttcattttaatgtgtagcaagggtagtttcactcaatccatktctctttataatatttcctttgccttttcatgaatgtattcttccttatgaactttaagaataaaatacaacattcattgaatatatttgcaaaattgat

SEQ ID NO: 30722 - DNA, 201 bp, Homo sapiens
tgaaaaggaggtttcttttgtcttttctaatgttacagtccctcacatggcctgaatcttggtcctggaagccaagattggaatccatcctttctagccttttttttttttttttttgcctccctatccacttactccttctggtttatcttgaagcctgttaatttctcccatcttaaaatgtctgtctttgacccggat

SEQ ID NO: 30723 - DNA, 201 bp, Homo sapiens
tgacaagttgatgggtacagcaaaaaccaccatagcacgtgtatacctgtgtaacaaacctgcacgttctgcacgtgtaccccagaacttaaagtataataaaaaaaggacatacattcaagtacccagtctaatacctgatgcatagtcagtgctttataaataattataaagctattaatagtatcattgttgaatacc

SEQ ID NO: 30724 - DNA, 201 bp, Homo sapiens
acgtgtatacctgtgtaacaaacctgcacgttctgcacgtgtaccccagaacttaaagtataataaaaaaaggacatacattcaagtacccagtctaatamctgatgcatagtcagtgctttataaataattataaagctattaatagtatcattgttgaatacctactatctgcccagcacatgtattaactaattttac

SEQ ID NO: 30725 - DNA, 201 bp, Homo sapiens
taatagtatcattgttgaatacctactatctgcccagcacatgtattaactaattttaccatttcaccaaccttatgagaatggtgctcttattttatgcrtgaagtaactgagccacaataagtctaaggaacttggccaaagtgcacagctaaacagggctggaatccatctatacccaggcaatctgcatccagaccc

SEQ ID NO: 30726 - DNA, 201 bp, Homo sapiens
ctgtattgacccactagctcttccttttacttccgggcaacttggagtgtggtgtttttctctctcagaaaagtcatgttatcttttccgcttaacacatktatcctggcttgaattaaatgtctgtaaatgtgacaatctcttttaagttccacagacatcaaatgacactattttttagtcaaataccatggacaagct

SEQ ID NO: 30727 - DNA, 201 bp, Homo sapiens
tccacccgcctcggcctcccaaagtgctgggattacaggcatgagccactgcacctggtctataatttggtatcttgttgtcatgaagagtctgttctgtyagtcttctgagatctattttaacatgaatgccggccagtcattgtgtctagactccaaaaggaagggagataatgaaatgtgtctaacctcttgtctcat

SEQ ID NO: 30728 - DNA, 201 bp, Homo sapiens
ccagctacttgggaggctgaggcacaagaatcccttaaacccaggaagcgaagattgcagtgagccaagatcgcaccactgcactccagcctgggtgacaragcaagattctgtcaaaaagaaaagaaaaagaaagagaactaagaggaagcaaaggaaccatggcatagtgaggtgagacgtttctggagtaaccttggc

SEQ ID NO: 30729 - DNA, 201 bp, Homo sapiens
tatctaaaatacataaagaatcaacagtaaaatacaaacaattcaattagaaaataggcaaaaaccatgacagctatttgtcaaagatgacatacagattktaaataagcacatagaaatatgttcagcattatgacccattatagaaatgcaaattaagaccacaatgagataacactgtatgcttatcagaatgactca

SEQ ID NO: 30730 - DNA, 201 bp, Homo sapiens
gtgaaaccctgtctctattaaaaatacaaaaattagctgggtgtggtaatgcacacctgtaatcccagctacttgggaggctgaggcacaagaatcccttraacccaggaagcgaagattgcagtgagccaagatcgcaccactgcactccagcctgggtgacagagcaagattctgtcaaaaagaaaagaaaaagaaaga

SEQ ID NO: 30731 - DNA, 201 bp, Homo sapiens
gaatgctacgcaaccagtaaaataataagacttacaaagtagcaaattgggctgagtgtggtggctcacacctgtaatcgtagcacttttgggaggctgargccggcacatcacttgaggtcaggaatttgaaagcagcctggccaacagggatgaaaccccatccctactaaaaatataaaaattagctggatgtggtgg

SEQ ID NO: 30732 - DNA, 201 bp, Homo sapiens
ataaagaatcaacagtaaaatacaaacaattcaattagaaaataggcaaaaaccatgacagctatttgtcaaagatgacatacagattgtaaataagcacrtagaaatatgttcagcattatgacccattatagaaatgcaaattaagaccacaatgagataacactgtatgcttatcagaatgactcaaacaaaaatatt

SEQ ID NO: 30733 - DNA, 201 bp, Homo sapiens
ccacggaggcagaggttgcagtgagccgagatcacaccactgcactccagccttgacaacagagcaagactccacccccccgcaaccccgccccccccccsccccccaaaaatgatgatgtatcatttgaaaaaaaaatccattggtttcaaaggagaaatactgctttgggttgtgcattagttgctatttgactaagtc

SEQ ID NO: 30734 - DNA, 201 bp, Homo sapiens
tgctacgcaaccagtaaaataataagacttacaaagtagcaaattgggctgagtgtggtggctcacacctgtaatcgtagcacttttgggaggctgaagcyggcacatcacttgaggtcaggaatttgaaagcagcctggccaacagggatgaaaccccatccctactaaaaatataaaaattagctggatgtggtgggca

SEQ ID NO: 30735 - DNA, 201 bp, Homo sapiens
caaacaattcaattagaaaataggcaaaaaccatgacagctatttgtcaaagatgacatacagattgtaaataagcacatagaaatatgttcagcattatracccattatagaaatgcaaattaagaccacaatgagataacactgtatgcttatcagaatgactcaaacaaaaatattgacagccacgtgctggtgagaa

SEQ ID NO: 30736 - DNA, 201 bp, Homo sapiens
gcaaaactctagggtgttgtcatagaacacagatttctatgtgaatgtttaaaggatattggataaagtcacatggcttattgtgcttggttcaataagamccaaaaaaaaaaaaaaaaaaaacagaagtaacaagtaacttctcttattacttattttttatatgacattttaaaataacaatcgtatctgaaatatgta

SEQ ID NO: 30737 - DNA, 201 bp, Homo sapiens
tgattagggcttgatttcctcactatcctgatgggagggagactcaaagttggaaatagttatattttaaagataatttttaaatgttatattcataatamtagtagacattatttataataattgttgacattatttcacaccaacctccccactcccactgagaaaaactaataaaggtagacactctcctttcccccg

SEQ ID NO: 30738 - DNA, 201 bp, Homo sapiens
ggagactcaaagttggaaatagttatattttaaagataatttttaaatgttatattcataatactagtagacattatttataataattgttgacattattkcacaccaacctccccactcccactgagaaaaactaataaaggtagacactctcctttcccccgaaagtagagagtgaacaaagcagtgaagatgtagtat

SEQ ID NO: 30739 - DNA, 201 bp, Homo sapiens
gtctgataatcaaaattaaacaggctattttgtttcagcaccaactagcatactgcggtatatttctgacactaaccacctggagttagcacagactgcamaagttatgggctcagttttctccaaaactgcctctatctcagataccaatcacaaatgggatccccagaccacttgcggttctgaccaactggctataca

SEQ ID NO: 30740 - DNA, 201 bp, Homo sapiens
tcgtgtggtttatctttccagcatggccagctcccatcttgaagctatttaggggcccaccatgaaccacatcattagcataaactgaggtgtgatgtaaygggctcatgaataacaaagccacttctattcacttggaaaattccaagggtgtactgtcttccaggaatgaaggacaaagatcagcctacttacttatta

SEQ ID NO: 30741 - DNA, 201 bp, Homo sapiens
tttctataatctcaacactttgggaagccaaggcaagaagatcacttgggcccaggagttcgagacctgcctgggcaacataaagaggccttgtctctacaaaaaaaaaaaaagttttttaattagctgggtatggcaagtggagagctgagtatagcaagtatggaggagagcttgagcccaggaattcaaagctgcagt

SEQ ID NO: 30742 - DNA, 201 bp, Homo sapiens
tttaataattgtatatagttaaggtgtccaacaggatgtttcaatatacataagcatagtcacatgattagtgtagtcagacaaattagcatatctatctmctcgcatagttaccttttgcctgtatgtgctaagagctcctggaatctactcagcaaatttccagtatgaattgcagcattattaactgtaatcaccatg

SEQ ID NO: 30743 - DNA, 201 bp, Homo sapiens
tggtttgaggccaggacatcgaggctgcagtgagccatgatttcaccgctgtactccagcctgcccaatagagtaagactctgtctccaccctccttcccyccaaaaaagattgggaaatatagaaaagaacaaaaaagatggtaaatgatattatagatggtctatcctacatgcatgtaattggagtcccaaaatgaaa

SEQ ID NO: 30744 - DNA, 201 bp, Homo sapiens
ttttaacactacatcctaccttcttcacttggtataagatgaatttcttggataaactcgatgcttaagtaaagagttgcatcacctagcctggacagcakaggaaaaccctgtctctaaataataataaaaactggctggatgcattggctcatgtgtgtagtcccagctgcgtggggggctgaactggtaggattgctt

SEQ ID NO: 30745 - DNA, 201 bp, Homo sapiens
aagagttgcatcacctagcctggacagcagaggaaaaccctgtctctaaataataataaaaactggctggatgcattggctcatgtgtgtagtcccagctrcgtggggggctgaactggtaggattgcttgaggctggaagtttgaggccagcctgggcaaccacctctaaattttaaaaaagaagaatttcatgtatgaa

SEQ ID NO: 30746 - DNA, 201 bp, Homo sapiens
tagtcccagctgcgtggggggctgaactggtaggattgcttgaggctggaagtttgaggccagcctgggcaaccacctctaaattttaaaaaagaagaatwtcatgtatgaatgtttgagggtagaaagtgttacgtgcagaaagaacattgttttttaggtaaatctagaaaatatgcatcttttattttcatatcaact

SEQ ID NO: 30747 - DNA, 201 bp, Homo sapiens
taaatttgatttataaatactaaatttatattgctaaatttgatttattaatttcattaatatataaacttatataatatttttggatttataagagttcytcttgttttgtgatgtgtgctttgatatcaatgtcactgatactgcttttgtaaaatcagggaagtttccttagttttttggctttggaatacggtcatg

SEQ ID NO: 30748 - DNA, 201 bp, Homo sapiens
taaggattttttgtttgttttagtttgtaaagtttttattcttttgaaaaatgtgttttttggttatattttttatattaaaatgtcttctttattttaartttcacattttttcttccaaaggtcccgtttaaaaaaaaaaccttcttatattttgtcttttcctctcaattcttaatttctgtcagcctttctgtgttt

SEQ ID NO: 30749 - DNA, 201 bp, Homo sapiens
ggccttagatatgttcctattttatcttttaatttttgacttgaaatatacaaccactccggtcaaacctctctactggttgctgattttgggaatccacmgtgatctctaagatacctgcaaccccattcctacatgcagtgttaaccagcagttctcccttttactgtccacctaaggaacatgccataccacattccc

SEQ ID NO: 30750 - DNA, 201 bp, Homo sapiens
gtgccatgttggtgtgctgcacccattaactcgtcatttaacattagctatatctcctaatgctatccctccccgctccccctaccccacaacaggccccrgggtgtgatgtggaatgctgttttctatgcctggctctcatcctttggatcaggactgtccaatcttctggcttccctgggccatagcagaaaaagaatt

SEQ ID NO: 30751 - DNA, 201 bp, Homo sapiens
ggttaaatatgtatacatgtgccatgttggtgtgctgcacccattaactcgtcatttaacattagctatatctcctaatgctatccctccccgctcccccyaccccacaacaggccccggggtgtgatgtggaatgctgttttctatgcctggctctcatcctttggatcaggactgtccaatcttctggcttccctgggc

SEQ ID NO: 30752 - DNA, 201 bp, Homo sapiens
ataaaacaaagtaatcgctactttgtggataaggagaaacctgtgtttgggaatattttatactaattcagttttatatttgcttatctttaatattaatytgagacaactattatttttctgttctttaatttttttatcagcaaactgaatggtaagttagaaatgaatgtatgagagtcagagaaatctggattttaa

SEQ ID NO: 30753 - DNA, 201 bp, Homo sapiens
tactttaagttttagggtacatgtgtacaacgtgcaggttaaatatgtatacatgtgccatgttggtgtgctgcacccattaactcgtcatttaacattarctatatctcctaatgctatccctccccgctccccctaccccacaacaggccccggggtgtgatgtggaatgctgttttctatgcctggctctcatccttt

SEQ ID NO: 30754 - DNA, 201 bp, Homo sapiens
ctgtctcaaaaaaaaaaaaaaaaatgttaatactgaatgtaggaaagggaaaggtgaaaaagaaaggactatttttaaataacataagacgaaggtgatgrtgttttgttttccaagatcctctaagaacacatcatgaaactctaggatacagtgtcagagttggctctcagctcctcccttggcatctgggatagaact

SEQ ID NO: 30755 - DNA, 201 bp, Homo sapiens
tacaactgctacttcagtagaaacaggagtccatcagaaactccatctgcttatccagtgctatttgatattatagttattatgtactctttatggactasagacggagaggttgaacaatagcacacactggccttagatatgttcctattttatcttttaatttttgacttgaaatatacaaccactccggtcaaacct

SEQ ID NO: 30756 - DNA, 201 bp, Homo sapiens
tgttttgttttccaagatcctctaagaacacatcatgaaactctaggatacagtgtcagagttggctctcagctcctcccttggcatctgggatagaactmgtttcccaagaaggtgtccaagtcttgtcccattgaatgtgaaggccgtcaggctctcgcaagcctatgagtctttggttaatgtgcataactacgcatt

SEQ ID NO: 30757 - DNA, 201 bp, Homo sapiens
tttccaagatcctctaagaacacatcatgaaactctaggatacagtgtcagagttggctctcagctcctcccttggcatctgggatagaactcgtttcccragaaggtgtccaagtcttgtcccattgaatgtgaaggccgtcaggctctcgcaagcctatgagtctttggttaatgtgcataactacgcatttttttttt

SEQ ID NO: 30758 - DNA, 201 bp, Homo sapiens
cggtttgataaatagggtcaaatttagtgacattagaaaggctcctcattcagaaaagaagtccgaaagacgacaagtgatggcatcttaatatttagacrctaggattcaggccagactaaggacaagaagtcaaatgacatatggagcatgacctgagagaaagggctacctttgaacttagaatagtggacaagttca

SEQ ID NO: 30759 - DNA, 201 bp, Homo sapiens
ttagatatatttttaaatacaataacttttaaaaagtgtgtcaaatttttcatgagtgtttttaatctcttaattattttttgagatgcagtcgagctctktcgcccaggctggagtgcagtggcgcgatctcagcccactgcaacctccgcctctagggttcaagcattctcctgtctcagcctctcaagtagctgggac

SEQ ID NO: 30760 - DNA, 201 bp, Homo sapiens
cagctaatgtgttttttaaaaatatataatatacatatatacttattgcatattcactctagggcaaagactttacatttattctattattcaatcctcayaagatgcttaaatttatagatgtttaccagtccattttccaggaggataaatggaggatgagcaaggtttcataactagtgccgggtcacagagctagca

SEQ ID NO: 30761 - DNA, 201 bp, Homo sapiens
tccattttccaggaggataaatggaggatgagcaaggtttcataactagtgccgggtcacagagctagcaaatggatgctcaaattttctctcttgactcrgaaacccatggtcttccaactgtacttccaaccacactgtgctggaaaaatggaaattgttaggaaatggatacagctggtttttttctttcgctccttt

SEQ ID NO: 30762 - DNA, 201 bp, Homo sapiens
gaggatgagcaaggtttcataactagtgccgggtcacagagctagcaaatggatgctcaaattttctctcttgactcggaaacccatggtcttccaactgyacttccaaccacactgtgctggaaaaatggaaattgttaggaaatggatacagctggtttttttctttcgctccttttgaggagctcctttttaaaataa

SEQ ID NO: 30763 - DNA, 201 bp, Homo sapiens
agttggctctcagctcctcccttggcatctgggatagaactcgtttcccaagaaggtgtccaagtcttgtcccattgaatgtgaaggccgtcaggctctckcaagcctatgagtctttggttaatgtgcataactacgcatttttttttttttgtcattgcagactgaactccattgatgtgaagtatcagatgtggaaac

SEQ ID NO: 30764 - DNA, 201 bp, Homo sapiens
aactcgtttcccaagaaggtgtccaagtcttgtcccattgaatgtgaaggccgtcaggctctcgcaagcctatgagtctttggttaatgtgcataactacrcatttttttttttttgtcattgcagactgaactccattgatgtgaagtatcagatgtggaaactaggagtcgttttcactgacaacgtaagcctacttca

SEQ ID NO: 30765 - DNA, 201 bp, Homo sapiens
tcgtttcccaagaaggtgtccaagtcttgtcccattgaatgtgaaggccgtcaggctctcgcaagcctatgagtctttggttaatgtgcataactacgcatttttttttttttgtcattgcagactgaactccattgatgtgaagtatcagatgtggaaactaggagtcgttttcactgacaacgtaagcctacttcatta

SEQ ID NO: 30766 - DNA, 201 bp, Homo sapiens
ttattttttttattctccttttaccaaagagcctttggagactaaatatagggccgtaatatatatccaaatagaaaaaaattacctattactaaaaaccrctaggtgtctcaagatttcactctttaattttagcactgacttttatagttcacgttagttccattctcctatttagaagcatttgatagcccccaaatt

SEQ ID NO: 30767 - DNA, 201 bp, Homo sapiens
attttttttattctccttttaccaaagagcctttggagactaaatatagggccgtaatatatatccaaatagaaaaaaattacctattactaaaaaccgcyaggtgtctcaagatttcactctttaattttagcactgacttttatagttcacgttagttccattctcctatttagaagcatttgatagcccccaaattct

SEQ ID NO: 30768 - DNA, 201 bp, Homo sapiens
gcagtatttctcggaacaaggattgggctcataagcaaaagtttttagctatgtcttcatttcttctcttcaatttaaactttgcggtgttgctacacttyctctctgtcaatgcagaactggattttgggaatccaggtcccaggtgtttgagaggaccaaaagtataaaaaaatcttggtgctttgagagaatttaaat

SEQ ID NO: 30769 - DNA, 201 bp, Homo sapiens
cactctttaattttagcactgacttttatagttcacgttagttccattctcctatttagaagcatttgatagcccccaaattctcctgcctctatccttaycccttccctcatccagccatgggcccagaactctgggtgtcttaggagcattctctaagagttcaaaatcaggtcttccaagtatctttcagaaccataa

SEQ ID NO: 30770 - DNA, 201 bp, Homo sapiens
atccataatattcatcttgctttgtagtttttttgtcctcttgataacttgggcatggatagatccaggatggagtctttccttagacagcgttctgctaycttagtaggcttttatccacctgcagtttcatggcttctgtttggccaatcacctctcaacatgcattcattcttcactattactgtgtctctctgaaac

SEQ ID NO: 30771 - DNA, 201 bp, Homo sapiens
tccataatattcatcttgctttgtagtttttttgtcctcttgataacttgggcatggatagatccaggatggagtctttccttagacagcgttctgctacyttagtaggcttttatccacctgcagtttcatggcttctgtttggccaatcacctctcaacatgcattcattcttcactattactgtgtctctctgaaaca

SEQ ID NO: 30772 - DNA, 201 bp, Homo sapiens
tagataagcagaaaataatatttagcataagtatgtcccaaattacttcatgggatatacctaaactaaaaatcatttattctttctctctcattcaaatkttactgtgcagcaagcacatgtgtagaccacacatgcacctttggcccagcttgtcacttaggtcgttactcatcttatgcccataaattttccttttcc

SEQ ID NO: 30773 - DNA, 201 bp, Homo sapiens
aggatgagcaaggtttcataactagtgccgggtcacagagctagcaaatggatgctcaaattttctctcttgactcggaaacccatggtcttccaactgtrcttccaaccacactgtgctggaaaaatggaaattgttaggaaatggatacagctggtttttttctttcgctccttttgaggagctcctttttaaaataaa

SEQ ID NO: 30774 - DNA, 201 bp, Homo sapiens
aaatacacaagtgaaattgtgagatgtaaatgaaaacaatgaaaggtttttttggactttccttacatgtgattcccgtctctttaaagcatgagacccartatttttctgggcgtcagtgaaggttctgctcagtataagaaatggtactatgaattgatggtggaccacacagagccctttgtgacagctgaagcaact

SEQ ID NO: 30775 - DNA, 201 bp, Homo sapiens
aagattctagatatgtataaaattttagcttttccttatagcttcttgtaacttaagattttaatgtatagttagatcttgactgccctctagtggcgtayattttcttagctatattgtttggagagcagagtgtatggttactttaggcctttttaggccctagttaggtgattggtggtgtgtcatgcctgggaggta

SEQ ID NO: 30776 - DNA, 201 bp, Homo sapiens
agattttaatgtatagttagatcttgactgccctctagtggcgtatattttcttagctatattgtttggagagcagagtgtatggttactttaggcctttytaggccctagttaggtgattggtggtgtgtcatgcctgggaggtacggggagcacagtctttgctcagtccttggccttaatcttgaggtagttcattaa

SEQ ID NO: 30777 - DNA, 201 bp, Homo sapiens
gcacagtctttgctcagtccttggccttaatcttgaggtagttcattaataatataattcctgaattgtttctgctttgaataccaacagacttgataatrtatgacaggaatatgtctcccaactattcatttttaaatgtccattattattatattcattataacagtataaaaatcacttatataacatacttacatg

SEQ ID NO: 30778 - DNA, 201 bp, Homo sapiens
  misc_feature (1)...(201): n = A,T,C or G, or insertion/deletion polymorphism (see Tables 1-2)
taaatgtccattattattatattcattataacagtataaaaatcacttatataacatacttacatgagttataattgcctatcaaacacataaatatatcntgtttaaaatcgagcaaagcataaggatgttcgggggagagttctgtgcctttgacaggatgctacccattagctatttgtctgggctgctatatccgga

SEQ ID NO: 30779 - DNA, 201 bp, Homo sapiens
cataagaaagactttatgaacttgaagacaggtcttttgaaataacccatccagagggagaaaaagaaataaaaataagaaagaaggaaaaaagcctatakaacttatgggatgccactgagcaatggagaaaggcacagaaaacgtttaacaaaataatgactaataactttccacatctttggaaagatatggacatcc

SEQ ID NO: 30780 - DNA, 201 bp, Homo sapiens
tcttcctcaaatagggactgcagcagccctcaggaaactcatctgttaactggataaaaaccaaatgacagaaacactggtctctggtagaaggagcaagrctctcattccctcaactcctcctcaaaaccacgcttacatggtcaagatcaagagcattgttgaactagagtgaaattccactagaatttcagggtttaa

SEQ ID NO: 30781 - DNA, 201 bp, Homo sapiens
ggaaactcatctgttaactggataaaaaccaaatgacagaaacactggtctctggtagaaggagcaaggctctcattccctcaactcctcctcaaaaccaygcttacatggtcaagatcaagagcattgttgaactagagtgaaattccactagaatttcagggtttaaaggccgcattgtctatgtggcagatcctctgt

SEQ ID NO: 30782 - DNA, 201 bp, Homo sapiens
tcttatgcccataaattttccttttcctcagtctttgcatttttcttttttttttgagacagagtcttgcactgtcacccaggctggagtgcagtggcacrctctccgctcactgcaagctccgcctcctgggttcacaccattctgcctcagcctcctgagtagctgggactacaggcgcccgccaccacgcccggctaa

SEQ ID NO: 30783 - DNA, 201 bp, Homo sapiens
gacattaagaaccatcttgtcctcagtaactcacaatggcaaacaggtaaacagtttatctttttcctcccttgcagaaaataaaaaagcaacaaataaarcaaagaaaaataaaactacccctcaaatgacaatgtacagttttaaagatttttttgaagggagggtctgcacctgttctaaactgcagggattagtagt

SEQ ID NO: 30784 - DNA, 201 bp, Homo sapiens
agaaaaataaaactacccctcaaatgacaatgtacagttttaaagatttttttgaagggagggtctgcacctgttctaaactgcagggattagtagtttgwgggtctcctaggcctatactcaagccttggcttgactttggataaattaactgaaaataataaaagtacataccttaccagatttttgcgaaaatgaaat

SEQ ID NO: 30785 - DNA, 201 bp, Homo sapiens
gaaactcatctgttaactggataaaaaccaaatgacagaaacactggtctctggtagaaggagcaaggctctcattccctcaactcctcctcaaaaccacrcttacatggtcaagatcaagagcattgttgaactagagtgaaattccactagaatttcagggtttaaaggccgcattgtctatgtggcagatcctctgtt

SEQ ID NO: 30786 - DNA, 201 bp, Homo sapiens
taatgtcatcacttaagcctgttgttcacatatcccaggacaacgggtaaaactatttcccagagaacatttggaagccttagttttttgttcaccttaawgactttaactgaaattactaaatttcaaaaatatatctcttcctagaactactggtttttgcttttatattgagtatcttggcttaaatgtcttttttgg

SEQ ID NO: 30787 - DNA, 201 bp, Homo sapiens
gagaggtaatcatacatgagatcttagatcaggaaggggaacatgagacaaaatatatatcactagctggaaagagatgtatccttcagtaagctcctcaygaaaatacctacatcatttgtgttggggatgtaggtatagaggctgatataatgatacataaattactctagaaaaaatagcccaaaagattgatgagaa

SEQ ID NO: 30788 - DNA, 201 bp, Homo sapiens
atatcactagctggaaagagatgtatccttcagtaagctcctcacgaaaatacctacatcatttgtgttggggatgtaggtatagaggctgatataatgayacataaattactctagaaaaaatagcccaaaagattgatgagaatgaccagtattacaaagactaacaattaagataattttatactaaagaatgacaac

SEQ ID NO: 30789 - DNA, 201 bp, Homo sapiens
tttttttatttttaaaagcctaagacagttttttccccaccatgttatagaagataatctgccttcagttattcccacaattagtataactacatgcagtractgttccctggcagggaggagagaacagaacatacaggtggctgacctgagggaattaaaggacagaggttgagggaagctctgctgaaactcgatgtt

SEQ ID NO: 30790 - DNA, 201 bp, Homo sapiens
tgatccactgcctgttcttgagccatttatttatagcccaaatctcttatttgtgtaaagaagtttttctgtatttaaaactttatcataaatgatcattmatatagaattgcccatccttcctctcctttaaacaagtattcttttatttactaatttagagagcttcagacaagattgtcattctttagcttttcaata

SEQ ID NO: 30791 - DNA, 201 bp, Homo sapiens
gccatttatttatagcccaaatctcttatttgtgtaaagaagtttttctgtatttaaaactttatcataaatgatcattaatatagaattgcccatccttyctctcctttaaacaagtattcttttatttactaatttagagagcttcagacaagattgtcattctttagcttttcaatattaagcattttgttctcttcc

SEQ ID NO: 30792 - DNA, 201 bp, Homo sapiens
gtagaacagtaacttagaaaagggattgccaaactaaggcccaaatccagctcaccacctgtttttttttttttttttttttttttttgagacagggtctygccttgctctgtcacctagtctagagtagtgtggagtgatcatagttcattgcagtcttcaactcctgggctcaggtgatcctcccatctcggcttccca

SEQ ID NO: 30793 - DNA, 201 bp, Homo sapiens
gtgtgcccagagtcaacctaatttgttaatttttttttttcttgtagaatcagggtctcgccatgttgcccaggctggtctcaaattcctgggctcaagcsagcctcctgcctcagcctctcagatacagatacaggcatgaaccactgccttggccctgctgttttaagtaaacttttattggaacaccaccacgcttgt

SEQ ID NO: 30794 - DNA, 201 bp, Homo sapiens
gcctcagcctctcagatacagatacaggcatgaaccactgccttggccctgctgttttaagtaaacttttattggaacaccaccacgcttgtttgtttacmtactgtctatggctgcttttgcactatagctcagagttgagtcgttgcaacagaggccatatgatccatgaaacctaaaatgtcttctctgtagtcattt

SEQ ID NO: 30795 - DNA, 201 bp, Homo sapiens
gtcattcttagcaacatggttgagcctagaggacgtatgttaagtgagataagcaatctgggtcttaacaaaccctcaaagggagaggattctacctcacygaagacttgagagccgcttacctatgtcagtggctctacactgagggtgattttgtccccaaagggacatctgacaatgttggagaactcttagaactct

SEQ ID NO: 30796 - DNA, 201 bp, Homo sapiens
atgtcttctctgtagtcatttatagagtttgctgagccccaggataaagcatgggcattgggatccaccagacttggatttattttctggtcacttagtarctgtgagggcaagtgatttaaactaagattttggtttcctcatgtggaaaatggtaataacgattcctatctcattggatggttgtaagggttcaccaag

SEQ ID NO: 30797 - DNA, 201 bp, Homo sapiens
tggttgagcctagaggacgtatgttaagtgagataagcaatctgggtcttaacaaaccctcaaagggagaggattctacctcaccgaagacttgagagccrcttacctatgtcagtggctctacactgagggtgattttgtccccaaagggacatctgacaatgttggagaactcttagaactcttttggttgtcacagct

SEQ ID NO: 30798 - DNA, 201 bp, Homo sapiens
acattcccactacacagagaaaaaattgacttttaatacatctctcctacttaaagaactgagatgatagtgtaaaaataattttccatcacctccttttkaacttaatattacatatttgtccaaaggcttagaaacattttaaacatacttttttggtttttttaaaatcaactttttattttgaggaatatctgccct

SEQ ID NO: 30799 - DNA, 201 bp, Homo sapiens
gggcagtagaattgcttgaacccgggaggcggaggttgcagtgagccgagattgcaccattgcactccagcctgggtgacaagagcaaaactcctcaaaawaataataataataataataaatataatgatttcttttcctttgggtacgtatccagttgtgggattgcagggctgaatggtagttctatttttagttttt

SEQ ID NO: 30800 - DNA, 201 bp, Homo sapiens
ggactacaggtgcccaccaccacgcccggctaatttttatatttttagtaaagaagggtttcaccatattggccaggctggtcttgaacttctggcctcargtgatccacctgcctcagcctcccaaagtgctgggattacaagtgtcactgggcccagccagtataacttctttacttttctttgtatgttattagacca

SEQ ID NO: 30801 - DNA, 201 bp, Homo sapiens
tagaattgcttgaacccgggaggcggaggttgcagtgagccgagattgcaccattgcactccagcctgggtgacaagagcaaaactcctcaaaaaaataataataataataataaatataatgatttcttttcctttgggtacgtatccagttgtgggattgcagggctgaatggtagttctatttttagtttttggagaa

SEQ ID NO: 30802 - DNA, 201 bp, Homo sapiens
tctgacacatggtagttgcttagtgagtaattatcgaataagtaaatgaatggttgaaagcttcttaacacatattaccaaattgctctacataaatcttrtactagtttaagttgatttggaggatttctgttactgaattcaccacctgccaacattgagtgttaggactcaaacagtatgttgtttgggccattttat

SEQ ID NO: 30803 - DNA, 201 bp, Homo sapiens
agattgcaccattgcactccagcctgggtgacaagagcaaaactcctcaaaaaaataataataataataataaatataatgatttcttttcctttgggtasgtatccagttgtgggattgcagggctgaatggtagttctatttttagtttttggagaaatattcatgctgtttcccaaaggggttgaactaatttatgtt

SEQ ID NO: 30804 - DNA, 201 bp, Homo sapiens
ctccagatcccacactcttaacaccacggtgcttactgcttctccgattgactctgtggacctctgaccagcgacctttcttctcctgcctgtctttatgwtatatagcacgttctgttcaatgaataaaagcattctgtgatcctgtagttcaggaatctgccattttctaacaactatacacactgactcatgaagaaa

SEQ ID NO: 30805 - DNA, 201 bp, Homo sapiens
gttgcttagtgagtaattatcgaataagtaaatgaatggttgaaagcttcttaacacatattaccaaattgctctacataaatcttatactagtttaagtygatttggaggatttctgttactgaattcaccacctgccaacattgagtgttaggactcaaacagtatgttgtttgggccattttatgtccacaccactct

SEQ ID NO: 30806 - DNA, 201 bp, Homo sapiens
ccaatactgacgtttttagtgtgctgcctacttgaacattcatgtaaaacattacaggaagaaatgaaggctgggcacagtggcccacacctgtaatcccrgcacttcgggaggccaaggcaggcagatcacctgaggtcaggagtttgagaccagcctggccaacatggtgaaaccctatctctactaaaaatacaaaaa

SEQ ID NO: 30807 - DNA, 201 bp, Homo sapiens
agaaatgaaggctgggcacagtggcccacacctgtaatcccagcacttcgggaggccaaggcaggcagatcacctgaggtcaggagtttgagaccagcctrgccaacatggtgaaaccctatctctactaaaaatacaaaaattagccggacgcagtggcgtgcacctgtagtctcagctactcgggaggctgtggctgga

SEQ ID NO: 30808 - DNA, 201 bp, Homo sapiens
caccatgcctgattaaactttgaattatgtgtagagacagagtctccctatgttacccagactggtcttgaactcctgggctcaagcagtcctcctgcctyggcctcccaaagtactggaattataggcatgaaccaccatgcctgaccctttggccggtttttaatacagttgtttgtttttttcctgttgagttgttta

SEQ ID NO: 30809 - DNA, 201 bp, Homo sapiens
ttcctcaagagcctagtggaggtgatcctcatcacattagttgggggacaagaacaagggtaatagaggcctgagatctctcttctttccccccacccccrgcgtacctatataaatttccatccatcttaccacataattattttcattactagccaatgtaacaataagaaggaattatgaagatggcaaaacatgcca

SEQ ID NO: 30810 - DNA, 201 bp, Homo sapiens
tatataccaagactgattttagggaagttgatgtgcaggtttttttcttagcagcctcagtgctaccagatgcagattaaattctgatgatgaggctggaraggaataccagtgaatgaagaatataatcactcatttgagaaatttacagtttaatatgtgggctgtgggaagcaagaaaagggctttaagcagagcagc

SEQ ID NO: 30811 - DNA, 201 bp, Homo sapiens
tgctcaatgtgacctatcagctgtcagcagttgttgatcagtaaggcaggaagaattttatacactattataatcatcttgattgtagttcctaaaatacrgggtctcataaacatgcttcagatggcataaaacagcttacaactggcagggaaggatgagcaccagagtcacatgggacaattattgaatacattgctt

SEQ ID NO: 30812 - DNA, 201 bp, Homo sapiens
tgtgacctatcagctgtcagcagttgttgatcagtaaggcaggaagaattttatacactattataatcatcttgattgtagttcctaaaatacagggtctyataaacatgcttcagatggcataaaacagcttacaactggcagggaaggatgagcaccagagtcacatgggacaattattgaatacattgcttctccttg

SEQ ID NO: 30813 - DNA, 201 bp, Homo sapiens
cataaaacagcttacaactggcagggaaggatgagcaccagagtcacatgggacaattattgaatacattgcttctccttgggttttgtggaccaggcctrtctgcaaggggcagacctaagcaggtgcccctctacagggtgcttaggagaggcgtggtccagagaaggtggaaccaagaggaccaggaatctggtccct

SEQ ID NO: 30814 - DNA, 201 bp, Homo sapiens
tggaagacccttgctaaactgtagatgggatgtctcatagcttggtatttgatttggccttttctaaaggaaagtaatctgtacctattcccccttggtcrtccgactttgtttgggtgggtactaagtttgtagtttcagttgaagacacagttaatcctgcttagataactttagtcaatgtcatgaacaagagttgat

SEQ ID NO: 30815 - DNA, 201 bp, Homo sapiens
gtcatgtttctcattttagataggaattcttaggctgcttcctagggagatgcgagtctccgtttttcttcttacagatcttaagaggactttcagatctygtcaggcactgttggataccaacttaaaagctgcatttaaaaaaatattaatacatagaaatctttccattactcgagattagccaaaagtatagtttgg

SEQ ID NO: 30816 - DNA, 201 bp, Homo sapiens
gctgcttcctagggagatgcgagtctccgtttttcttcttacagatcttaagaggactttcagatctcgtcaggcactgttggataccaacttaaaagctkcatttaaaaaaatattaatacatagaaatctttccattactcgagattagccaaaagtatagtttggtaaaatgctattcttactcattttccgacccaa

SEQ ID NO: 30817 - DNA, 201 bp, Homo sapiens
tttccaatgaacttcaaagtattatgtacaatgcatgttaaatgcctaaggtgtttaagctatttgaaattcctcttccactgtgcagattgttagtagtytgaatttgaaggatacgatattttaagagaaccctcagaagcataaatgtatatatatacacacacacatatattttttgagacaaggtcttgctgtttt

SEQ ID NO: 30818 - DNA, 201 bp, Homo sapiens
gagaatcacttgaacctgggagacggaggttgcagtgagccacggccgtgccactgcactccagcttgggcagcagagcaagactctgtctcaaaaaaaawtttttttttttactgctttccttttgtggagaatgtagacagaaacctgtaggtttttatgtcaccatagctgtgcatttaactttatgtggctgtgcat

SEQ ID NO: 30819 - DNA, 201 bp, Homo sapiens
aagtattatgtacaatgcatgttaaatgcctaaggtgtttaagctatttgaaattcctcttccactgtgcagattgttagtagtttgaatttgaaggataygatattttaagagaaccctcagaagcataaatgtatatatatacacacacacatatattttttgagacaaggtcttgctgttttgccaagttcaagtggc

SEQ ID NO: 30820 - DNA, 201 bp, Homo sapiens
attcctcttccactgtgcagattgttagtagtttgaatttgaaggatacgatattttaagagaaccctcagaagcataaatgtatatatatacacacacayatatattttttgagacaaggtcttgctgttttgccaagttcaagtggcatgatcaggacctactacagccttgacttcctgggctcaataaatcctcctg

SEQ ID NO: 30821 - DNA, 201 bp, Homo sapiens
cttaaagcccttagtcggtggcaacagtagccactttataccctttaaacacaggatccatttttccatgcatggccccgattcgaattttgggttaaatrctaacaaacagcaacaataataactgcagtagcagcaaccacagcagtgacttaaaaccagcctcataacgtgccagatactgaattaagtacttattta

SEQ ID NO: 30822 - DNA, 201 bp, Homo sapiens
tctactaaaaatacaaaaattagccggacgcagtggcgtgcacctgtagtctcagctactcgggaggctgtggctggagaatcacttgaacttgggaggcrgaggttgcagtgagccaagatcacagcattgtactccagcctgggtgacagaacgagactccgtctcaaaaaaaaaaagagtacataaacacccatccct

SEQ ID NO: 30823 - DNA, 201 bp, Homo sapiens
attagccatcacacataatgagaaatatttatgaagcatatagtgcaccccaaacttaccccagtatttctttttacccttaacctatagtacacggtcaratcttaatactccagtcaacccttctctgcccctcccacacagacccacgatctcctgcttctgtaggttgtctgtcttattcacctacctgaaatattt

SEQ ID NO: 30824 - DNA, 201 bp, Homo sapiens
ataagttttagattgcatgccattttgagcagtgtgatgaaatctcacgccctgctactttgtcctgcccaggatgcgaatcatcgctttgtccccctggyccatgctgtataggctgtctacctgttagtcacttagcaaccatcttggttatcagcttgattgtcatgacactgtagtgcttttgttcaagtaaccctt

SEQ ID NO: 30825 - DNA, 201 bp, Homo sapiens
aaacacccatccctgaagaatatcatctcatccccttgtgaaaaaaaaaatctcatctcctttccaaaaaataccatctcattgtcttgccaatcaattcsaaagagctcaaaaaaacaattaacaaagttagtatagttcccctttttgttcaaaagaggaaagatttgctaactctgacacacatgggaagagcttatg

SEQ ID NO: 30826 - DNA, 201 bp, Homo sapiens
tatggctcaggcttacttttgatgtcagtacaccatgtgactttctctctcggtctggactcacattaactacattcctggcatgtcacactgaggtactratttgcagtgataataactgtcttataatccaaaatattcatttttacagatcagcttgggaagacacattatcatcagaagatttcttggtgggcatgt

SEQ ID NO: 30827 - DNA, 201 bp, Homo sapiens
atgggaagagcttatgaaatattttattggtttttgctctattgttcattgctattgcatataaacataagattatatatataatttgtgcattataaatrtacctcattcatgcataaatacatgcttcatacattaaacatgtatttttcccccatgcttagatccagtttattccagaaaaaaagcaaaattttcttc

SEQ ID NO: 30828 - DNA, 201 bp, Homo sapiens
gtttaattgcctgagtttatggtaaatcctaatattatgatcaatcttgagttctctcagagctgggttggacatccctctttgatacttttacagccttrtgattacctcattgccctgaagatactatcataattgcctgttgtctgtagcacagggccttgcacatgatagcactcagtagatatttactgaatgaat

SEQ ID NO: 30829 - DNA, 201 bp, Homo sapiens
ataatatcatacacacacacacacacacacacacacacacacacacacaccacgtatatctgctttagtaggtacatagactccccagcaggatatcgaakaattggtaacaattgatgcctttagaggaaggaaacagaactagaagaagttggagggagacttacttttcagtgtattcctttttgtgccatttcagtt

SEQ ID NO: 30830 - DNA, 201 bp, Homo sapiens
atgacttgatatagatttcgggaactggctatgtggtggggagaaaactgtgaagacaatgtgggctggtagtttagaccaggtggacgcatttgaactcrgactgaggagaagtgggttctttcctcagctttgccattgactcgctgtgtggctttgggtaagtcagttacactttctgtgccatctttttttcatttg

SEQ ID NO: 30831 - DNA, 201 bp, Homo sapiens
aattggtaacaattgatgcctttagaggaaggaaacagaactagaagaagttggagggagacttacttttcagtgtattcctttttgtgccatttcagttygcagtgtcttatcccttactcagaaatgaataattagcaaatcagtaaatgttcctttcaccttaaaaacaagacttctgactgggcgcggtggctcaca

SEQ ID NO: 30832 - DNA, 201 bp, Homo sapiens
tggctttgggtaagtcagttacactttctgtgccatctttttttcatttgtaaaacaaaccaaactcaaaccaaaccttcaaaaaagtgaagaaggctatsttccttgcagaataagacaagagaagatctgaccattggcttctaccttttgtgcccatgcatcctctctgatctgctgtgacaggtctccgaaagagtc

SEQ ID NO: 30833 - DNA, 201 bp, Homo sapiens
gccatttcagttcgcagtgtcttatcccttactcagaaatgaataattagcaaatcagtaaatgttcctttcaccttaaaaacaagacttctgactgggcrcggtggctcacacctgtaatcccagcactttgggaggccgagatgggtggatcacgaggtcaggagatcgagaccatcctggctaacacagtgaaacccc

SEQ ID NO: 30834 - DNA, 201 bp, Homo sapiens
atacatcttttctgacatccacacgattaatctgtgggatgcttacaagacagaatgattttctaaagatgtctgagaaatggccgctgggcaaactttcstatgaatactcattttctgaagattcaaagtatgaaaccaacaaggatagattgctgctctttgagtatggccaaaatgaatgtttgaagacttggaaag

SEQ ID NO: 30835 - DNA, 201 bp, Homo sapiens
cgagcctagagttttatcctataggaaaggtattttgttatgaattcaatgtatttgatagcttgagagctatttagattttctatttatttgtgtgtcarctttgataaattatgtttttctgtaaattagttcatttaatttaggttgccatatataggcataaaattgcactaatgtgctcttattattcttttaatg

SEQ ID NO: 30836 - DNA, 201 bp, Homo sapiens
ccagagacctctagaaatgacaggaaagtcaggaagtgggttcactgcagggcctccagaaggaactcagccctgttgagcaataggttggtagatacttaagagtatttttaaaagaaccaactaaataaataaaaacaggtgatgatgagagtgtgtcacaaacaaaagtttatcagtaatccacggtccacttctgtg

SEQ ID NO: 30837 - DNA, 201 bp, Homo sapiens
ggatctttaatgatatctctcttttcattcctggtaatgatagttgctgttttctctctttttatcttgatcacttctctaagggattaattgattttatraatcttttcaaaggttaattgaacttaaatgtacttttgttttggttaaactttcagacatttatttatttctccatatcaccaatcgtggattattatg

SEQ ID NO: 30838 - DNA, 201 bp, Homo sapiens
aagagttcttgagcttccctctaactttataattctttaacatttgtgcatccctagaggatgtaggtagcagtgatgacagtcaatatatttttaggttrgaaagatacttatataatgataaagataaaattttggggaaaaaactcacacctggttttatagtctgacacatcaaccatttgatttccccaggttttc

SEQ ID NO: 30839 - DNA, 201 bp, Homo sapiens
tattttttgagacaaggtcttgctgttttgccaagttcaagtggcatgatcaggacctactacagccttgacttcctgggctcaataaatcctcctgtttyagccccacaagtacctgaaactacaggcatgcaccaccacacctggcttttttttgtgtttttttttttttaattttagtacagacaagatctcttatgt

SEQ ID NO: 30840 - DNA, 201 bp, Homo sapiens
tgaatgcctgaactcaagcgatcctcccacctcagcctcccaaaatgctgggattataggcttgagccagtgtgcccagccaacatatttttatcattatratggtcaggatgaagattattatgagacgttaaggtctggtatagttagttaggaaccatctaaattaatgtggacttctctattccgtgcgatataggt

SEQ ID NO: 30841 - DNA, 201 bp, Homo sapiens; identical to SEQ ID NO: 8107

SEQ ID NO: 30842 - DNA, 201 bp, Homo sapiens
ggcatgtttgcatttgtggattggcaacccttggtacgtgtgccaaacgcagatggttagtgaggtcctggccatctccacgctcctgtgaccaccactcrtgaatctcaggagagataaagagagataggatgcaagggcttggctacctgtgcttttctttcctttttctactttccttgcaagactaaaccatattta

SEQ ID NO: 30843 - DNA, 201 bp, Homo sapiens
tccagtacttacaaagccaaaataaccctttcttgcctgagtttccactgtaacaggagaagccttttctattcccgaataacaaaccaaacccacatggktcccatagatctggacctctcattcttagattaaaaatagctccaaattcatggaaaggcaccctctggttttttgccctttgcacctgctgagtctcac

SEQ ID NO: 30844 - DNA, 201 bp, Homo sapiens
tgaggcaggagaatggcgtgaatccgggaggcggagcttgcagtgagccgagatcgcgccactgcactccagcctgggcgacagagcgagactccgtctcaaaaaaaaaaaaaaaattgtgctttcaaggttgtatctcattgctactgctgctgtcttgggttattctggacatagagaagaaatgatcacacttatctc

SEQ ID NO: 30845 - DNA, 201 bp, Homo sapiens
cggcctcccaaagtgctgggattacagacatgagccaccatgcctggccagtccagagtatttttatgcaaccaaatgtatcagcttaagatggtctattrtaactacaatattgtttgtcttagtttcatagtaaccacaaagaaaaaattgcagcagtcacactaatgagaaagggaaaggtatcaaagcttagcacca

SEQ ID NO: 30846 - DNA, 201 bp, Homo sapiens
ggattacagacatgagccaccatgcctggccagtccagagtatttttatgcaaccaaatgtatcagcttaagatggtctattataactacaatattgtttrtcttagtttcatagtaaccacaaagaaaaaattgcagcagtcacactaatgagaaagggaaaggtatcaaagcttagcaccacaaaaaggtatcaaacca

SEQ ID NO: 30847 - DNA, 201 bp, Homo sapiens
ggtggctcacaccttaatcccagcactttgggaggccaaggcaggtggatcacctgaggtcaggagttcaagaccagcctggccaacatggtgaaaccctrtctccattaaaaatacaaaaattagctgggcgtggtggcaagtgcctgtaatcccagctactcgggaggctgagacaggagaatcgcttgaacttgggag

SEQ ID NO: 30848 - DNA, 201 bp, Homo sapiens
gggaagttttaggtattaaagaaatattcaataaatgatagctgtttcatattactttcttatttatttaaacttaagtattcaagctgcttttctgatgygcaggacttgtaagtagcaggcctgtagatgtattaaataatagcatcgagatataatcaaagtagccaccccataatctctatcagtcacctcaggcct

SEQ ID NO: 30849 - DNA, 201 bp, Homo sapiens
caagcttctagatttctagatctcactaccaatttagaggtatgtgttaaaaaacaccataggaaggctgttggccaaatctagaatgtagaaagtcctcyaggacatatggtacagactgattatcaccaaataaatggcaagaagggaagacaagagaggaatggggactattctagaataaaagaaacttaagacccc

SEQ ID NO: 30850 - DNA, 201 bp, Homo sapiens
ggtatgtgttaaaaaacaccataggaaggctgttggccaaatctagaatgtagaaagtcctccaggacatatggtacagactgattatcaccaaataaatrgcaagaagggaagacaagagaggaatggggactattctagaataaaagaaacttaagacccctaactgataagtgtatctcttttggaactggatttgaa

SEQ ID NO: 30851 - DNA, 201 bp, Homo sapiens
gctaggtgtatgcggatttattttaatattctctttacgtatatttgaaacattccacaataaagatagaatgagaaggattatctaaacaggtagggaamggcaggtgagaatggtgttagaaaaactttcaagacaataggagtttccacagtgttaaaaagaaagtaagtctattggatttggtaacatgaaggtcac

SEQ ID NO: 30852 - DNA, 201 bp, Homo sapiens
gcctaagtgcccatcaatggattagtaagtgaagaaaatgtggtatatatacacagtggaatactatttggtcataaaaaaaatgagaacctgtcatttgyaccaatatgggtgagcctggaggatattgtgtttagtgaaataagccagacatagaaagaaaaatactgcattgcccactcatatgtagaatcgaaaaaa

SEQ ID NO: 30853 - DNA, 201 bp, Homo sapiens
cagcctaagtgcccatcaatggattagtaagtgaagaaaatgtggtatatatacacagtggaatactatttggtcataaaaaaaatgagaacctgtcattygcaccaatatgggtgagcctggaggatattgtgtttagtgaaataagccagacatagaaagaaaaatactgcattgcccactcatatgtagaatcgaaaa

SEQ ID NO: 30854 - DNA, 201 bp, Homo sapiens
ccattagaatagtaacatcttaaggactgagaatcagatatcagcttagaggggaaaaaaaagaaacaaaacacaactaagaaggccaaccagtgcctttyattctaagtctctggagaaacagaagcaaatcttctagttcatttatgatctaagcccagctcaccaatttaaaaaatcagaacttgagtcccaaatacc

SEQ ID NO: 30855 - DNA, 201 bp, Homo sapiens
gtatatgtaaaggcttagagacacaaggaggattgcaaatgggaatttcagagagctttgtacgaccagatgtagagtggagtttgaaaagtggcagtagrtcaaatagaggaggcaggagttgaaacagtttttttttttttttaaattaaagaatgattctagtggctctttaggaaaaaggctgaatgtaaacaaaac

SEQ ID NO: 30856 - DNA, 201 bp, Homo sapiens
acaaggcattctgtaaagagaaatagtgtcttggagtcgtccattggagggataaagaatgagaatgaatctgctacttgtctttcatctcttgtttcttrttggtcaaaggtcaccctaaggcacagcaagtccccatccaatggctagatggaatcatctgacctctaggagttcattctggatactggatccataccc

SEQ ID NO: 30857 - DNA, 201 bp, Homo sapiens
actggatccataccctgtggtaggcagttatagccaaggctggtagtagcagaagagccagaaaccctgggtgcagctggtcaacctagctatataagggratccaaagggcccaacatgccaaggacaagagactgggcagccccaggcggaagaaccatgaaaaatgtctggtgcaggaagcagaggtggaaccagtgg

SEQ ID NO: 30858 - DNA, 201 bp, Homo sapiens
ccattgcagatgaagctttggtgggcagaaagccagccagccccaccatcaccttacccttgtgctaacactgtgcagagaacagcagatcctcccagctscctgaatgaccactcctgtttacagggcgcagaggggccacccagacttgggtccaccagcgccctccccctgagccaagaccacctctactgccactgc

SEQ ID NO: 30859 - DNA, 201 bp, Homo sapiens
tcccaggttcaagggattctcctgcttcaacctcctgagtagctgggattacaggcacacaccacgacgcctggctaattttttgtattttttgtagagayggggttttaccatgttggccaggctggtctcaaactcctgacctcagatgatccgcctgcctcagcctccaaaggtgttgggattacaggcgtgagccac

SEQ ID NO: 30860 - DNA, 201 bp, Homo sapiens
tggggatcagtcagtacagtcagaaaactactgattgccttgaatggccgtagctcccctcttttcccctactcagttgcctttttgcaaataaaaagtaygtgagggattgattccgtaggggtttcttttggttgtttttttgacagtagtttttacattcggcacagatttttaaaatgcactaaaataatgttcttc

SEQ ID NO: 30861 - DNA, 201 bp, Homo sapiens
cctagaaatgtgtcagacaatttcttgttaattttgatgactaaaatagtgacgataatatgaaaatcctgtattttacttttatttgttcaggttgcctytggggatcagtcagtacagtcagaaaactactgattgccttgaatggccgtagctcccctcttttcccctactcagttgcctttttgcaaataaaaagta

SEQ ID NO: 30862 - DNA, 201 bp, Homo sapiens
ccctgccaattacatccatttcatctgcctccaacttaacccattctcagtgtgggggtaactgtattacataacggagttcagattaatttttcttacayataaatgaagaaagctaatatctaggtaggcctgtttgagaataagcagagccttttcttcccattcctttaattgttagattttaaaatgcatttccaa

SEQ ID NO: 30863 - DNA, 201 bp, Homo sapiens
cctgccaattacatccatttcatctgcctccaacttaacccattctcagtgtgggggtaactgtattacataacggagttcagattaatttttcttacacrtaaatgaagaaagctaatatctaggtaggcctgtttgagaataagcagagccttttcttcccattcctttaattgttagattttaaaatgcatttccaac

SEQ ID NO: 30864 - DNA, 201 bp, Homo sapiens
gctgtgaagctactacatgtgacaggaaacaaggtgatatctctgaggcatagtagggcagataaaaggctgagaatgatatggttgatgcatgtgtgtgygtatatatatatatatatatgtatgcacacacacacacacatttaaaatgactttctgaaatgaatgtattagatactgaatgtgtacccgtatgtatac

SEQ ID NO: 30865 - DNA, 201 bp, Homo sapiens
tgtgaagctactacatgtgacaggaaacaaggtgatatctctgaggcatagtagggcagataaaaggctgagaatgatatggttgatgcatgtgtgtgtgtatatatatatatatatatgtatgcacacacacacacacatttaaaatgactttctgaaatgaatgtattagatactgaatgtgtacccgtatgtatactg

SEQ ID NO: 30866 - DNA, 201 bp, Homo sapiens
gtgaagctactacatgtgacaggaaacaaggtgatatctctgaggcatagtagggcagataaaaggctgagaatgatatggttgatgcatgtgtgtgtgtatatatatatatatatatgtatgcacacacacacacacatttaaaatgactttctgaaatgaatgtattagatactgaatgtgtacccgtatgtatactgt

SEQ ID NO: 30867 - DNA, 201 bp, Homo sapiens
atcagcttgtcaaagtctgtaagatacacagtcagtattttaattggaatggcattgaatttatgtatcaatttgggagcagttcataactttataatatygagcctttctatccataaacatggtatagctctacatttattttgttcctgtttaaagtaactgataaagttttataattatattaaaaaattcttatgc

SEQ ID NO: 30868 - DNA, 201 bp, Homo sapiens
tgaagctactacatgtgacaggaaacaaggtgatatctctgaggcatagtagggcagataaaaggctgagaatgatatggttgatgcatgtgtgtgtgtatatatatatatatatatgtatgcacacacacacacacatttaaaatgactttctgaaatgaatgtattagatactgaatgtgtacccgtatgtatactgtt

SEQ ID NO: 30869 - DNA, 201 bp, Homo sapiens
ttttgggaatccaggtcccaggtgtttgagaggaccaaaagtataaaaaaatcttggtgctttgagagaatttaaatatagaagtagtgtggaggaatgtrcaggaaagatgggtacaggtttctaatagagggtctataaagctatcgtatccctccaagtgaaaaatatatttgattataatagatatcgtgtaaataa

SEQ ID NO: 30870 - DNA, 201 bp, Homo sapiens
gaagctactacatgtgacaggaaacaaggtgatatctctgaggcatagtagggcagataaaaggctgagaatgatatggttgatgcatgtgtgtgtgtatatatatatatatatatgtatgcacacacacacacacatttaaaatgactttctgaaatgaatgtattagatactgaatgtgtacccgtatgtatactgttt

SEQ ID NO: 30871 - DNA, 201 bp, Homo sapiens
tatttagaaacttagaaacataaaaattactctatgtgttaatttattttaaaattttgaattataattcagttctcatcacgttaccagtccatggcacaagcatgttcttcagactccaccatcctccatgacacagacattggttggtttcacttaatttccaatccagattgagatttgatgataatactcttggat

SEQ ID NO: 30872 - DNA, 201 bp, Homo sapiens
tcctgagtagctgggattacaggcacacaccacgacgcctggctaattttttgtattttttgtagagatggggttttaccatgttggccaggctggtctcraactcctgacctcagatgatccgcctgcctcagcctccaaaggtgttgggattacaggcgtgagccactgcgccaggccccaacaatgctttaaaaaaaa

SEQ ID NO: 30873 - DNA, 201 bp, Homo sapiens
taagcatagtcacatgattagtgtagtcagacaaattagcatatctatctcctcgcatagttaccttttgcctgtatgtgctaagagctcctggaatctaytcagcaaatttccagtatgaattgcagcattattaactgtaatcaccatgctgtacattagatctccagacctgttcatcctacataactgcagctgcgc

SEQ ID NO: 30874 - DNA, 201 bp, Homo sapiens
atgaatttcccataaagtagaattcaaattcttctaatgagggatgatttccgggttccttggggctccacacacatggctttggaggacatgtgtctgcyggcagatacagcgttctgaatacaaaccgtgtctccattctacctgttatggactgagttgcatagctctaaccctcaatgtggctgtatttagagatgg

SEQ ID NO: 30875 - DNA, 201 bp, Homo sapiens
aatttctttgagtttatccccaaagtttactgtacttcttagatgtgtaaatgaatgtttttcatcaaatttgggaagcttctggccattatttattcatkctttcttctcttttctgtctctccttacagtctgtgatttccattatgtgtatgttggtatggttgagtgtatcccccaggcctctgaagctctgcttgt

SEQ ID NO: 30876 - DNA, 201 bp, Homo sapiens
aaagtagaattcaaattcttctaatgagggatgatttccgggttccttggggctccacacacatggctttggaggacatgtgtctgctggcagatacagcrttctgaatacaaaccgtgtctccattctacctgttatggactgagttgcatagctctaaccctcaatgtggctgtatttagagatggggcctttaaaggg

SEQ ID NO: 30877 - DNA, 201 bp, Homo sapiens
agtacttgctgtatacctgtactaagttctttacaagtgatagctcatgtcacctgtcttaggaactgtatgagataggtctgttactatcatcactcttytaaacataaggaaaccagacaggttaagtaatttacccaaaatcacatacccaatatgtggaggagctaggatttgaattctgccagtctaccttcacca

SEQ ID NO: 30878 - DNA, 201 bp, Homo sapiens
ggggatttgttctctggtgggcaggagtgggggtcacaaggtgttcagtgggggagctttttgagccaggatgagccaggaaaaggactttcacaagatartgtcatcacttaagacaaggaccggccattttcacttcttttgtggtggaatgtcatcagttaaggcggggcagggcattttcacttcttttgtgattct

SEQ ID NO: 30879 - DNA, 201 bp, Homo sapiens
tatttatatacatatgttgaaataatgatatattaaactatacctaaacttatcacagagtactttcatggacctaagttagatgagtaaggtgaaatctwttcactgggagggagggatgggaagaaacacacacacagagagagagagagagagagagagagaatgaatgagattagagggagaaaatggcaagagaga

SEQ ID NO: 30880 - DNA, 201 bp, Homo sapiens
aatgaagtctctgtccaaagcctgacttccctgtcttggaattagaaatcaatttcattttcccctgtagttattacctaatgttccaggggctcctaccrcaaatccatagtcattcttagtcgctgttcatatcagctcccaaaaggaatagcagccacttaggttattttcctcagcctcctttccttcgtcaggcgg

SEQ ID NO: 30881 - DNA, 201 bp, Homo sapiens
tcgactgaattgtcttcattcatctctgctggcattttacaggatgtttgtgttctgcactgatttgatattgggttcacattgggtgccctcctcccctstgtgagtcactgttccttctcgtgcctcatccgggcctctttaggagtgctggaaagctaagaatgctctctctggccgcttggagattgcagcctattg

SEQ ID NO: 30882 - DNA, 201 bp, Homo sapiens
ctgaaaactacagcaagcaagcgaacaaaggaaacaccgagaaagtggtggacagtttctcttttgtctatttccttccacctacctttatcattccttakcctcacttcaccagctagcaaacctgagaaataagcaataattttgtacagtctgcttttgtctttagcctcatttgtttttctaacatcatctcatccc

SEQ ID NO: 30883 - DNA, 201 bp, Homo sapiens
cgtgtagaaagacaaaaaccacatgatctcactttcatgtggactctaaaatcaaagtcgaactcatagaaacagagagtagaatgaggttaccaggtgtrggggggagtggttggggagatgttcaaggatacaaaatttcagttagatagaaggaataagttcaaaagctctattatacagcatggtgactatagttaa

SEQ ID NO: 30884 - DNA, 201 bp, Homo sapiens
tgcaaataaaacagcaactggttctagtccgtgagtcttgagccctgggcagatatgtttgtggcatttattaaaaagaatgtctgcttagagagagctgaaaaaaaaaaagcttatagtaggatcataaatatttttattatgatgccattttatgacgatatttaaatatttctaaagtctaaggttttactaaaggga

SEQ ID NO: 30885 - DNA, 201 bp, Homo sapiens
taaagtttcgtggaataatacttttactctgtaatacattctgatattttgttctttattttattgtagttgattctgtgttattctattatattcatttaaaaaaaaatcctggcccagggcccaaaacattcatttccagatcttttaatgggaaacaaacccagagtttgagagtttgaaacacattgattggtgctg

SEQ ID NO: 30886 - DNA, 201 bp, Homo sapiens
cgcttttcagatgccaacaatagccaaaggtaaggccaacttcaatttgtcctaattcagtaggatgttggatgacatcatgttctaaagaatgttttccrtactcaacatcccaacctctccacttcctaaattatgtgtatactacttaaattagtttttttaaaaaagctgtaaagtatatattttataattttttcc

SEQ ID NO: 30887 - DNA, 201 bp, Homo sapiens
gaatagtcctttgcttttggccaggcatttcttgaatgtgctagtccctttttaattctctaaaaggagaattaaattaaaagctgacttgggtcccgacmtaatgtggagttaactgctaatttcaccctctgtgcccatgcaggaagcatgaaagtgcctgattgaagggccggggccggccctcttgtatacataccc

SEQ ID NO: 30888 - DNA, 201 bp, Homo sapiens
aaattaaaagctgacttgggtcccgacataatgtggagttaactgctaatttcaccctctgtgcccatgcaggaagcatgaaagtgcctgattgaagggcyggggccggccctcttgtatacataccctggtctcagagagcctggaataaccttgccgacagagctgtattcccccaaatgctgaataatgataggaaag

SEQ ID NO: 30889 - DNA, 201 bp, Homo sapiens
acataacatttacattgtgtattaagtatttattataagggatctagagattatttaaagtagacaggaggatgtacgtaggttaagtgcaaacactatarcattttatataagggacagatgttaatatctgtaggatgtcctggaaccagtcccccacagatactaggagacaaacatgtattgaagcagcatatattt

SEQ ID NO: 30890 - DNA, 201 bp, Homo sapiens
gcagaacaactacttacataacatttacattgtgtattaagtatttattataagggatctagagattatttaaagtagacaggaggatgtacgtaggttawgtgcaaacactataacattttatataagggacagatgttaatatctgtaggatgtcctggaaccagtcccccacagatactaggagacaaacatgtattg

SEQ ID NO: 30891 - DNA, 201 bp, Homo sapiens
actacagcaagcaagcgaacaaaggaaacaccgagaaagtggtggacagtttctcttttgtctatttccttccacctacctttatcattccttatcctcasttcaccagctagcaaacctgagaaataagcaataattttgtacagtctgcttttgtctttagcctcatttgtttttctaacatcatctcatcccagacca

SEQ ID NO: 30892 - DNA, 201 bp, Homo sapiens
cgaaaaaatatttgcttctgtagccaacaagtacagacttttttcccttgtcactgttccctaaacaatacagcagaacaactacttacataacatttacrttgtgtattaagtatttattataagggatctagagattatttaaagtagacaggaggatgtacgtaggttaagtgcaaacactataacattttatataag

SEQ ID NO: 30893 - DNA, 201 bp, Homo sapiens
gtactcagaagttatatgttctctaagtttgtcctttgccatgtgaacgtggcagatggaagtggttagagatcactgaagttgttttttgttattgttgyttttccttctcatggagagggtctgctttccatagatgcgcttattcatttgattgaatcctgtatattgatagtgttttggtaactttgcagcctggga

SEQ ID NO: 30894 - DNA, 201 bp, Homo sapiens
ttcaaaggttaattgaacttaaatgtacttttgttttggttaaactttcagacatttatttatttctccatatcaccaatcgtggattattatgagtgatmtgctgtggttatgtgtgactatgtcttacattaccttaggaaagcatggcattattgagtaggactatggcatcctatggagaacgttaatgttcaatca

SEQ ID NO: 30895 - DNA, 201 bp, Homo sapiens
gtgactatgtcttacattaccttaggaaagcatggcattattgagtaggactatggcatcctatggagaacgttaatgttcaatcacagtatcaagagatmctggtttcacagctttgaaatgacctattaaatgtactttctaatcaacaaatgtatatatcaggcatacaaatattcactaacattgccttatgataat

SEQ ID NO: 30896 - DNA, 201 bp, Homo sapiens
ctgcaagatttaagttcctctgcaagatttaagttctcaagattttacaatgtcctctgagtttctgttcttcatagctatgcaaatgaggatgcaatatwttgtacattggaatttctattttatatttatgtaaattggaggacatattctccattccacattgaatcactgaagctcgtcactgaacatgcatcgttt

SEQ ID NO: 30897 - DNA, 201 bp, Homo sapiens
atttcagagagctttgtacgaccagatgtagagtggagtttgaaaagtggcagtaggtcaaatagaggaggcaggagttgaaacagttttttttttttttwaaattaaagaatgattctagtggctctttaggaaaaaggctgaatgtaaacaaaactggagatgaggacagcagtttggtgacaaaaaagaagtatagat

SEQ ID NO: 30898 - DNA, 201 bp, Homo sapiens
gctgggactacaggcacctgccaccacgcccagctaatttgttgtatttttagtagagacagggtttaaccgtgttagccaggatggtctcgatctcctgrcctcctgatccaccagcctcggcctcccaaagtgctgggatcacaggtgtgagccaccacgctcggcctagtataactacctttatagacattttatttt

SEQ ID NO: 30899 - DNA, 201 bp, Homo sapiens
ttaaagatatgtggaacctattgagtcagccattctcaaacatttttcttttttgagatagagtctcattctgtcacccaggctggagtgcaatggtgcartatcctccccaaaaaacaaacacaaaagcaaaaacaacaattaacactccttcctgcatttttttggtgtgttttcttcaaagcactgaacaccttctga

SEQ ID NO: 30900 - DNA, 201 bp, Homo sapiens
tgcatgtcaaggagcaaaatgaacaccgagcaaaccatatgggatgctacgaattcactagggattttcataattagctgctaagttggcacagctgtggstctttgtagccgcaatgtactgctaattaccactcatttaaacgtgctgctatatcctctctcacctggacctttctattggcaagaatgccaagggaat

SEQ ID NO: 30901 - DNA, 201 bp, Homo sapiens
ttcctaaattatgtgtatactacttaaattagtttttttaaaaaagctgtaaagtatatattttataattttttcctttttttttttgaattagagccttrctctgtagcccaggctggagtgcagtggcacaatcttggctcactgcaagctccgcctcccgggttcaagcaattctcctgcctcagcctcccaagtagc

SEQ ID NO: 30902 - DNA, 201 bp, Homo sapiens
ataatgacagttatctgggaactgggctttggaggaactccagctctgttctgcccactacaagggcttatgggtggctgattttcactatgattgagggkcctttggttttcaatatgctgtggaattagagagagggtgatgcagcaggagcaaattaaaacatcactagtttgctgttcttaccaacatttggacatt

SEQ ID NO: 30903 - DNA, 201 bp, Homo sapiens
atcgctactagaaagaaagtacatctgatgtgattaagtgtagaaagagttgaggaagggtagatggtccacttaggataaaatatagggtacagatgggsagagagaacagacatagatgaaggtagaaagattagggcaaaatatggaatatcttgcaaactcagctaagaaatgtggataaatttgtataaggagtac

SEQ ID NO: 30904 - DNA, 201 bp, Homo sapiens
tgtagaaagagttgaggaagggtagatggtccacttaggataaaatatagggtacagatgggcagagagaacagacatagatgaaggtagaaagattaggrcaaaatatggaatatcttgcaaactcagctaagaaatgtggataaatttgtataaggagtaccagccccaggaagttttaaagcaagagcttgatgtgtg

SEQ ID NO: 30905 - DNA, 201 bp, Homo sapiens
ttttttactgtagagtgataaaaaaaaaacctgccatatctactgcttattgaacattctctagttttggtcctgactagtacattttctgcagaaatttktttttgaatttcacatgtctagcagaacgagaaatctggcatacattacaaccaaccaaaacattgctctggacaggcctaaaacaaggacctgaacgtc

SEQ ID NO: 30906 - DNA, 201 bp, Homo sapiens
tttaactgtaaagctcctatcattttagaagcaaattataatgatttagtattcccatgaatgaaacaaatgccacagtaagcaatttttagcaaatggtyttttttttttattcatttcttggaacgcatgtggcttttacaagcagatgaatttgaattttccttcccttcattccatgtatcccagagcaatgacttt

SEQ ID NO: 30907 - DNA, 201 bp, Homo sapiens
agctcctatcattttagaagcaaattataatgatttagtattcccatgaatgaaacaaatgccacagtaagcaatttttagcaaatggtcttttttttttattcatttcttggaacgcatgtggcttttacaagcagatgaatttgaattttccttcccttcattccatgtatcccagagcaatgactttaggcttttttt

SEQ ID NO: 30908 - DNA, 201 bp, Homo sapiens
ctcctatcattttagaagcaaattataatgatttagtattcccatgaatgaaacaaatgccacagtaagcaatttttagcaaatggtcttttttttttatwcatttcttggaacgcatgtggcttttacaagcagatgaatttgaattttccttcccttcattccatgtatcccagagcaatgactttaggctttttttaa

SEQ ID NO: 30909 - DNA, 201 bp, Homo sapiens
caaatgccacagtaagcaatttttagcaaatggtcttttttttttattcatttcttggaacgcatgtggcttttacaagcagatgaatttgaattttcctkcccttcattccatgtatcccagagcaatgactttaggctttttttaaaaaaaaatgccttttacagtttaatctcgagtgtacttcagattattcaaggc

SEQ ID NO: 30910 - DNA, 201 bp, Homo sapiens
ttcatttcttggaacgcatgtggcttttacaagcagatgaatttgaattttccttcccttcattccatgtatcccagagcaatgactttaggctttttttwaaaaaaaatgccttttacagtttaatctcgagtgtacttcagattattcaaggcatttaatatatcttaaatatatatgcatctcataatatttcaaatg

SEQ ID NO: 30911 - DNA, 201 bp, Homo sapiens
aacatttggttggatggacctgattttcaaaatgtcatcatcttaaaagttttatttctgctttatggtggcataattgtcaaaaattatatatattcaasgtatacaatgtgatgttttgatatacacgtacattgtgaaatgacgaccaaaaccaagctaatgaacgtatttatgacctcacagagttaccttttttct

SEQ ID NO: 30912 - DNA, 201 bp, Homo sapiens
cccttcctttgacacaagtttattcttcttgcaatttaaatgactcataatttgaaattttatcctccagctaactttgagctgcatactgtgctgggatmaaggagtccagccctttggatgacaaactttttaagccagggacttctcattttcggtgcaatgttctgaccttatccctcttgatgtttttcaacacca

SEQ ID NO: 30913 - DNA, 201 bp, Homo sapiens
gcccataacttggttatgtataccagtctactatgctcaaaactttgccttgacttttcttttaccttttatgaaacaagagaaagaaggattttaggtcytattgattttattgctaaattttttctctattagacttgtttctcttgctgatgtcaattttaagggtgcaccttcctgtttactgtgatttgagggttc

SEQ ID NO: 30914 - DNA, 201 bp, Homo sapiens
agagttaccttttttctgtgtgtgtgatggaaacacgtcagttctactctcttagcaaatttcaagtgtccaatacagtgttattaactacagggacccaycctactgtacattaggtctccagaacttatttgttttataactttaagtttataccctttgaccaacatctttgtatttcccctcgctatgacccctggt

SEQ ID NO: 30915 - DNA, 201 bp, Homo sapiens
tttaggctttttttaaaaaaaaatgccttttacagtttaatctcgagtgtacttcagattattcaaggcatttaatatatcttaaatatatatgcatctcmtaatatttcaaatgagctccgaatcataacttgtagggacagaaacagaatcaataacaacaatatgttttcaattgggaacttctgaatgtactagcaa

SEQ ID NO: 30916 - DNA, 201 bp, Homo sapiens
tcgaactcctgacctcaggtgatccacctgcctcggcctcccaaagtgctaggattacaggcatgagacgctgtgcccagcctcatacttttatttagttmattacacatggttttatttagttctttgaacagatttaaaatacctaacttaaagtctttgtctaataagcccaacatctcggcctcctgaggaataatt

SEQ ID NO: 30917 - DNA, 201 bp, Homo sapiens
aggaatatgttggagcttctcacatcccactatggatatttcactccccagcttttcctttcaaactttttggtcagttgctgtttgcctcagctgttatygctgcctcacaaagctgcaaggctaacaaattgcctcagatgattttcaacaaatgtccttggagaaacaactatttgcactgggcaagctctaagtcaa

SEQ ID NO: 30918 - DNA, 201 bp, Homo sapiens
ttattcaaggcatttaatatatcttaaatatatatgcatctcataatatttcaaatgagctccgaatcataacttgtagggacagaaacagaatcaataayaacaatatgttttcaattgggaacttctgaatgtactagcaaagctactctaagactgggcataaatatattcagttgggaatggaaagaaaattcttat

SEQ ID NO: 30919 - DNA, 201 bp, Homo sapiens
ttgacaaggtttgattttaccgaagttatgtgaacagtgagcaatgagaatagagtggcatattctacagtagaagctgagattatgtttagtgtttactrtgtgccaggatataacagcatgcttcatagtagggatgcaagtgatctgtatggaaaagacataagaagaaagattaattttccaatgggaggaatcagt

SEQ ID NO: 30920 - DNA, 201 bp, Homo sapiens
atctcataatatttcaaatgagctccgaatcataacttgtagggacagaaacagaatcaataacaacaatatgttttcaattgggaacttctgaatgtacyagcaaagctactctaagactgggcataaatatattcagttgggaatggaaagaaaattcttattatctggtgagtcgaagtggtatagggggatttgatt

SEQ ID NO: 30921 - DNA, 201 bp, Homo sapiens
ttgggaatggaaagaaaattcttattatctggtgagtcgaagtggtatagggggatttgattctcctgactcagtcttctctgggaagggaagggatggasattttttatgcccacttccaaattcttcgaaattctgctcaagtcctaacttgagctttctgtaatcatggttagtgtctttccaattagggctgtctct

SEQ ID NO: 30922 - DNA, 201 bp, Homo sapiens
gaggaatcagtaaagggagaaatatcttcagagttagatgttgaaaggatcaggaatcagtaaagggagaaaatgtcttcagaattagatgttgaaaggaycaaaatttcaacaagtagagattagtgtcagaaaggccatcgctactagaaagaaagtacatctgatgtgattaagtgtagaaagagttgaggaagggta

SEQ ID NO: 30923 - DNA, 201 bp, Homo sapiens
gttacatcacccttttcaaagtatccaattgactgtaagtaatgctgtggtttaatacctttgtttattgaaaatggtcttctttaacaataaaaatatawattattcagtttttccttttcactacatcctactcctctgcaacaaaaatatttatataaattaatttcttatatttcttatgttagtctgtaactttaa

SEQ ID NO: 30924 - DNA, 201 bp, Homo sapiens
cttttcaaagtatccaattgactgtaagtaatgctgtggtttaatacctttgtttattgaaaatggtcttctttaacaataaaaatatatattattcagtytttccttttcactacatcctactcctctgcaacaaaaatatttatataaattaatttcttatatttcttatgttagtctgtaactttaaaaagctcttct

SEQ ID NO: 30925 - DNA, 201 bp, Homo sapiens
ttattgaaaatggtcttctttaacaataaaaatatatattattcagtttttccttttcactacatcctactcctctgcaacaaaaatatttatataaattwatttcttatatttcttatgttagtctgtaactttaaaaagctcttctatattgtcattaataactaattgaaaacattaaatgtctttgatataaatgca

SEQ ID NO: 30926 - DNA, 201 bp, Homo sapiens
ctccagcctgggcaacaagagcaaaactccatctcaaaaaaaaaaaaaacacaaacaaataggaaaatccacagagattaaaaaagaaaaagaagagtcctttttttttgtgaagtcccttgcatgatagtatctgtgaaccacatgtttgtttcaaattcaggttaagtatcatcaatgagcataagaatagcatagcat

SEQ ID NO: 30927 - DNA, 201 bp, Homo sapiens
tatgcataaagtctttcccaaatcttaaggagaaacaaataggaacttccttcttctcttttcttttctttctttctttctttttctttctttctttcttyttctttctttctttctctttctttctttctttcttcctttctttctttctttctttctttctttcttttgtctttctttctttctctctctctctttctt

SEQ ID NO: 30928 - DNA, 201 bp, Homo sapiens
acaaataggaacttccttcttctcttttcttttctttctttctttctttttctttctttctttctttttctttctttctttctctttctttctttctttcttcctttctttctttctttctttctttctttcttttgtctttctttctttctctctctctctttctttctctttgtttgtttgttttgttttgagacagga

SEQ ID NO: 30929 - DNA, 201 bp, Homo sapiens
tagcagccttcaagagttttcaagttgctttctttccttttgtagttagttgtgctctaatatgttatttttcttcaaatatatgcagtatattgtctacrtcgggagtcacagtggtttgtgtgtgtgtttgtgaattttgtatcagtcacaatgaaagttaacttttaacaacacaatccattggtatttgttagatct

SEQ ID NO: 30930 - DNA, 201 bp, Homo sapiens
ctcccaaagtgctgggaatataggcgtgagccactgcaccaggcctatttctaatagtctatataaatttgtcactgatcttcaaaatgttagccagttcrttgcttgtatgaagttttatattcattcatttagctagcttttgagcaggtatgaacatcatttccctaacacagatttgcaaagataataggaatttta

SEQ ID NO: 30931 - DNA, 201 bp, Homo sapiens
ataattgtctatatgaggtacagtgtgatatttgcatacatgtatacaatgtgtaatgatcaaatcagggtaattagccaacccatcacctcaaacatttrtatttctttgtgttgggagcattcaaaaactgctcttgtagctatttgaaaatatataataaattgttgttaattatagtatccttataaagtgtcctgt

SEQ ID NO: 30932 - DNA, 201 bp, Homo sapiens
actaacttaataaatatatactatggggcagggcacagtggctcacacctgtaatcccagcactttgggaggctgaggctggtggatcacctgaggctcgragttcgagaccagcctgacaatggtgaaaccccgtctctactgaaaatacaaaaaaattagctgggcttggatggtggcacatgcctgtaaccccagcta

SEQ ID NO: 30933 - DNA, 201 bp, Homo sapiens
atttgcaagtgttaaaaaaccataattttcttttacttgttcatggggagagcattctgatattgcaaaataattgcataagtttcctataaattatattktatttttgtctaaaatttgataaactattatctcaagttattattattatattattttgcaaaataacttcttcaagcaaaagtcagcttggctcttgaa

SEQ ID NO: 30934 - DNA, 201 bp, Homo sapiens
cagatggttagtgaggtcctggccatctccacgctcctgtgaccaccactcatgaatctcaggagagataaagagagataggatgcaagggcttggctacytgtgcttttctttcctttttctactttccttgcaagactaaaccatatttacaagttccttcaacaaatgtgtaaatgtgtattggatgcctcctggaag

SEQ ID NO: 30935 - DNA, 201 bp, Homo sapiens
tggtatagggggatttgattctcctgactcagtcttctctgggaagggaagggatggagattttttatgcccacttccaaattcttcgaaattctgctcawgtcctaacttgagctttctgtaatcatggttagtgtctttccaattagggctgtctctggatattacaaatttggaatttaaaaaatgacttttgtttac

SEQ ID NO: 30936 - DNA, 201 bp, Homo sapiens
agtagagcagtggtgtctttttcttacatctgtttttctgtcatcactatcattatcatcagcatcattttcttaaagcaaattaatgcttctggataacytacttcctttagaatgcacaatactctttttgttgtttttttttttttaccactgtattttaaattttctaattcttagatccctgattttcagaagttt

SEQ ID NO: 30937 - DNA, 201 bp, Homo sapiens
aacattcagagggagccaaaaaggctgggcacattgatgttaagaaagaagggagttttaggaaaagggaatttggtcctgggtatgaaatgccactgaamggttggaaagatgagttgtaaaagtgcaattttgctgcacagtgaaaagcagctttgttcctgaggacggagagtgcctggatagctaagtaatccagga

SEQ ID NO: 30938 - DNA, 201 bp, Homo sapiens
ccaggcaagagtgcaatggtgagatcttggctcactgcaacctccgcctcccgggttcaagtgattctcctgcctcagcctcccgggtagctaggattacrggcatctgccaccatgcccagctaatttttttttttttttttttttagtagagatggggtttcaccatgttcgccaggctggtctcgaactcctgacctc

SEQ ID NO: 30939 - DNA, 201 bp, Homo sapiens
gttacaaagcacaaataggtatctcaggaaaaaataaatggcacagaaacacatatctaaaactacactcacatatacagacgtgaaaaattagagtaatygatagtgctgattatatttataatagaatcttgttttgattggaagcccaatgacataaaaatccattcatgctgaaaagtattttctgcaattatataa

SEQ ID NO: 30940 - DNA, 201 bp, Homo sapiens
ataggtatctcaggaaaaaataaatggcacagaaacacatatctaaaactacactcacatatacagacgtgaaaaattagagtaattgatagtgctgattwtatttataatagaatcttgttttgattggaagcccaatgacataaaaatccattcatgctgaaaagtattttctgcaattatataataaagcagcattga

SEQ ID NO: 30941 - DNA, 201 bp, Homo sapiens
ttctttctttctttctttctttcttttgtctttctttctttctctctctctctttctttctctttgtttgtttgttttgttttgagacaggatctcactctatcacccaggctggaatgcagtagaacgaccatagctcactgcaacctcgaccttctaggctcaagtgatccttctgtatcagcctcttgagaagcttgg

SEQ ID NO: 30942 - DNA, 201 bp, Homo sapiens
ttcaaaattgcttttgaactttttatggttacaaatgttcctaacctggtattgagatgccatgaggaactgtgtgtttctttgaggtttgtatctacagmtttcagatgaattatttatactgttttttttctgctgccattattgtcatgcaagtttgacctctgtctcctttttatactaagtttctctcatttctgt

SEQ ID NO: 30943 - DNA, 201 bp, Homo sapiens
acactttttaaaaaatgacgtaacatatatcttagaccttagatcttagacatgtatcttctaccatatttcccatgaagagtacttacattatgaaaggyaaacacttaaaaaaaatgatgtaacatatatcttagacctgaggtatactttgagtatgcaatagtgaactgactgctggttgacataattactgtgttg

SEQ ID NO: 30944 - DNA, 201 bp, Homo sapiens
cttctcatcgtcgttctggctctgggttcctcattctgagacttccccctctcgtctctctcaatctcacctgcatctcatttcctagggatacttttccyccttttgcatcacactggtcctaatgttggatgctgacctttttatttttcccccagatcttttaaatacagcatttgtatgtatagcagatcacagtga

SEQ ID NO: 30945 - DNA, 201 bp, Homo sapiens
gttgtacctgaatcttctacatccttgcccactgtttttattaagctaagtctcttcctaatgacgacaatatgaccataaattatatagccatggaaaaygtataagctcaaatgcatgaacttttgatacccgcaaccctccaatgaggtagctattaccttgattttatagataaggaaacagaggaacagaaaggtt

SEQ ID NO: 30946 - DNA, 201 bp, Homo sapiens
gaggctgaggcagagcattacttgaacccaggagatggagactgcagtgagccgagatcacaccactgcactccagcctggtgacagagcgagactccatyttaaaaaaaaaaaaaaaaaaaaaaaaaaaaagggctcaggtgattgatttaagaaagggctcaggttagtccacttcccttcttaaatatgcccacatat

SEQ ID NO: 30947 - DNA, 201 bp, Homo sapiens
ttatttcaaaaaataattttttctcccatctgccatttgtagtctatgtttatttctctgaaatattttaggattaactaatttatctatgtatttttttsttctcacaaataggaaaaacaacatttcttattgtattttaaagtttattattaatacccattctgacattgctaccactatgtggctcccgtgtttatt

SEQ ID NO: 30948 - DNA, 201 bp, Homo sapiens
tcacataactcaggtgtgcctatgaatcaacggaatatacttgtagatgcaaaagtcacatttatcaaaactatgtttcaaatgtacttacaatatgagayttcactttacgtatatatataaaaaggttggcatctatattcaatttttggcttgttacttcagcagatatcctaaggatatttttaggtttgatttgaa

SEQ ID NO: 30949 - DNA, 201 bp, Homo sapiens
cagacagcatttgactaaggaatctgacacacatttaatgtaacaagctattccaactgcaaaaacataattattagaattttatttctgcacatctgctrgctttgtaatgtactccccatgttgaaacctaagaatgctttcatgtttgacttccacatggatcatttcagtgtaggcccaggggagacactagtctgc

SEQ ID NO: 30950 - DNA, 201 bp, Homo sapiens
cgatactattgatgagctgtgactacataaatctagattattcttcaaacttctgaattaagtagtcttgatcctgtctctctactgttgcttatgtttgyattttgaaatagaagtttggagtttattttcactttgattacagataatcaatatatagaaaggagatgatcttatggtcagccactggggaaagggaat

SEQ ID NO: 30951 - DNA, 201 bp, Homo sapiens
aaagctctgtggaagcaccatgcagggagcacgtgctgctgcctgtggggccccgagatggcctttgagcagagttgtaaagatggagggtgggccgggtkcagtggctcaagcctgtaatcccagcactttgggaggccgaggtggatggatcacaaggtcaggagttcgagaccagcctgaccaacatagtgaaacccc

SEQ ID NO: 30952 - DNA, 201 bp, Homo sapiens
tggatttgcatataaaaatgtatatatatttgcatatatatagtcttggattttaagatacatacctacctcaaccagtatttctttttcttttcttttctttttttttttttttaagacagagtttcactcttgttgcccaggctggagtgcaatggcgcgatcttgactcactgcaacttccgcctcccaggttcaagc

SEQ ID NO: 30953 - DNA, 201 bp, Homo sapiens
tgaatatcttgcaatgtttccagtgcagcatttacctaaaaactcttcaaatctacagatggtggcagcagaggcaaaggagaacatttcccttatgaacragaaatcaagttctttgcaaaagtacagtatacaatctatcttgtttttgcttcaatatgtttgtttacataccctactcattagatcgttgcccttttc

SEQ ID NO: 30954 - DNA, 201 bp, Homo sapiens
tatgggcccgtcacagtccttagcactagggattcagtgacaaacagaagagaccagttaatagttctggaggccaggaaagggctataatgggaaacaawcccagaaatgtttcttgtttttgtgtaactcataggctcctggaaagagagactttaatccaaagtcccacgcatacaatgtaaaattgcaaatgatgtt

SEQ ID NO: 30955 - DNA, 201 bp, Homo sapiens
gaggtggagtttgcagtgagccgagatcatgccagtgcactccagcctgggcgacacggcgagactccctctcaaaaaaaaaaaaaaaaagaaaaattacktaaagtactcagaatcactgcagatagaagcatatttgaggattcagtgtgccattaagttgagaatgtaatggttcaatcatgcgcaatctgtaactat

SEQ ID NO: 30956 - DNA, 201 bp, Homo sapiens
cattgtctatactgcatctttcttatcttctctgcctccaaacactggaggccctaggccttttttcttcttacttatattcatgctggctagtttcattkagacccacgatgtttagaattaaatgtatgtttacaatgcccaagtgtatagctctggcttagatctcttccctgcactgcagacttttttttttttttc

SEQ ID NO: 30957 - DNA, 201 bp, Homo sapiens
ggttattattaaataagagagcagtgttccatataatctaactcttccattgtgccaaggatggggatagttaaaatgagataactgtatatagtctcatrtagtaattatgtagcagagcttgtccctattctaagggttaggggaaccttttccatttgggaattttatttcttgtgtgaaaatgatttccaaaatgag

SEQ ID NO: 30958 - DNA, 201 bp, Homo sapiens
ggatgcctcctggaagttgtgtactggaatcaatgcttttcgcaatttattatctcaaactcctgtgccctatgagacaaaacaaaataaaaaacaaaagycaggggcattggtgttgtacgtttctttttctaagtttgctaatctatgatttatcattcttccatgtttttgagttcattacttggcttaggattaaac

SEQ ID NO: 30959 - DNA, 201 bp, Homo sapiens
atgtatacctatgtaacaaacctgcacattctgcacatgtatcccagaacttaaagtaatgaaagcaaaaaaaaagaatattaactttgaattcacattatcatttctttttggttactcctatactgtcattgcccagatttcatcagtttccctttgaactacttcacattcccatccttccctccatcaccacctctt

SEQ ID NO: 30960 - DNA, 201 bp, Homo sapiens
attacaattcgatataagattttggtggggatacagagccaaaccatgtcaagaaactcttaggagtattgggaacaggtcccatggcatagtagtgaggyctgcttaaggaagtctttggctgttgaaccatgagttggccatgcaaaaatagtacagcttagtatttactgagtgtttatgtcatttactcctcttgac

SEQ ID NO: 30961 - DNA, 201 bp, Homo sapiens
ggctgaggcagagcattacttgaacccaggagatggagactgcagtgagccgagatcacaccactgcactccagcctggtgacagagcgagactccatttyaaaaaaaaaaaaaaaaaaaaaaaaaaaaagggctcaggtgattgatttaagaaagggctcaggttagtccacttcccttcttaaatatgcccacatatgg

SEQ ID NO: 30962 - DNA, 201 bp, Homo sapiens
atactttgagtatgcaatagtgaactgactgctggttgacataattactgtgttgcaaatcaagatttattactgatggaaaatcaaacttttctaggtcrgttgcaaatctcagctttcatctgggtttaggagttttggttttgaaattctgaaaagaaaatcaattcttgtgaacccttgcatttacctgagcagtcc

SEQ ID NO: 30963 - DNA, 201 bp, Homo sapiens
gcccttgagtaacatggcagtattcagttgtaaactggttatccagatcgtcctgaatatttatgaaactccaatgagtatattacttctatttctactaracggggactgaggctctaggaagacaagtttgcagactgtataaaagaaaaatgcattttataattgttctgatatattagaccacacacacacacacac

SEQ ID NO: 30964 - DNA, 201 bp, Homo sapiens
gactaaatgatcactaactcatttgcggtaatcgttttccattttttttcaagatttaaaatcattcagacagcatttgactaaggaatctgacacacatktaatgtaacaagctattccaactgcaaaaacataattattagaattttatttctgcacatctgctggctttgtaatgtactccccatgttgaaacctaag

SEQ ID NO: 30965 - DNA, 201 bp, Homo sapiens
catcacacccagcaaatttttgtagttttagtagagacggggtttcgccatgttgcccaggctggtcttgaactcctgagctcaagtgatctgcctgcctyggcctcccaaaatgctggggttacccaggcatgtgctacgatgccagactaaaacattttaaagacatttttactatattatttttatctggatttttta

SEQ ID NO: 30966 - DNA, 201 bp, Homo sapiens
caggcatgtgctacgatgccagactaaaacattttaaagacatttttactatattatttttatctggattttttatttttcattcagaatatgtttcagaygttttaaaatgtacactttcacacagtgaaaataaaggtagaggtgaataacttactatgtgtcaaacaatgtgctgagcacctttcatgcattatctta

SEQ ID NO: 30967 - DNA, 201 bp, Homo sapiens
ttcaaaagaaatttttgcagtagtcttttctcaaggggcattgatacactgataaaatagtgccaattatggttttacagaagatagagaaattcagttayagttgtatgctggtcttttttaacgactgtaagaacgagaatgaacccattgaagccttctgtgattaacatatcataatttgatagtttagttttattt

SEQ ID NO: 30968 - DNA, 201 bp, Homo sapiens
tattacatatttacacttacatgcaacacatatacatacaagcttttatatacacatacacacatatatacatatatagcatgtataatgcatataaaatmcacacacacacacacacacacacacacacacaccccacaacagggaaggaggaacgttcgcattccttttattcttcattgctgtccttcacagtgcttt

SEQ ID NO: 30969 - DNA, 201 bp, Homo sapiens
atcatggaaaatggggtatccatcccctcaagcattaatcctttgtgttacaaacaatccaattatacttctagttattttaaaatgtatgattgaattaytactgaccatagtcaccctgttgtgctatcaaatattaggtcttattcattttttctaactatttttatacccttaatatctattttgaacacttatctc

SEQ ID NO: 30970 - DNA, 201 bp, Homo sapiens
atacatacaagcttttatatacacatacacacatatatacatatatagcatgtataatgcatataaaatacacacacacacacacacacacacacacacacaccccacaacagggaaggaggaacgttcgcattccttttattcttcattgctgtccttcacagtgcttttggatttgagtgaacatttttttttaatgtg

SEQ ID NO: 30971 - DNA, 201 bp, Homo sapiens
catgatacacatagatttgcagaatgctcatccgtactatttaagcacgtaacaaatgttcatggtaccacacagtcacatagaccaatcaccattgcaawaatgagatagactctgaagtgtgtcaccgtggcacatggttttgaacaattttggcttttgactttgtatttcataggatttttaaaatttaaaaactga

SEQ ID NO: 30972 - DNA, 201 bp, Homo sapiens
taagtaagcctgacacctgccgtgcaagtggtctggccaggatgattatgatcaggctggaatccttaggcatgggctgatgctgttggccacaggtggtraggaagagagaaccaagagcagggtagagtcccatggaaactagctgtagtttatgtgctcagggaaagcctgaaccctttgaaagagctcacctggtta

SEQ ID NO: 30973 - DNA, 201 bp, Homo sapiens
aattgcttgaacctgggaggtggaggttgcagtgagctgagatcacgccacctcactccagcctggtgacagaggagtgagactccgtctgaaaaaaaatraaaataaaaagatgctgttaggtctcttctaaggggctgcagacctcttcctcaaatagggactgcagcagccctcaggaaactcatctgttaactggat

SEQ ID NO: 30974 - DNA, 201 bp, Homo sapiens
gggaggtggaggttgcagtgagctgagatcacgccacctcactccagcctggtgacagaggagtgagactccgtctgaaaaaaaatgaaaataaaaagatkctgttaggtctcttctaaggggctgcagacctcttcctcaaatagggactgcagcagccctcaggaaactcatctgttaactggataaaaaccaaatgac

SEQ ID NO: 30975 - DNA, 201 bp, Homo sapiens
ttaaggggtaatgaaatgaatttcccataaagtagaattcaaattcttctaatgagggatgatttccgggttccttggggctccacacacatggctttggwggacatgtgtctgctggcagatacagcgttctgaatacaaaccgtgtctccattctacctgttatggactgagttgcatagctctaaccctcaatgtggc

SEQ ID NO: 30976 - DNA, 201 bp, Homo sapiens
gcagtttattaatttggaccatgactttgagtaagtcaagccatcagaagttttgagcagaagagtgacatgatctcagttacattttagtaaggccaccrtggctgccagaatagactgaatggcagggattgggaggtcgggatgggaaggaccaaaatacaatcacagagaactgctgcagctgcagagagctgttgc

SEQ ID NO: 30977 - DNA, 201 bp, Homo sapiens
tcttaagcctcttataacaatgaaaccaaagggatgtccttcacaatatgtaccttgagccctcaagcagcaattacaaatcataatttaccagtgtaagmgcactttcaactacatgttactccattccgttatttgttattgatcttagtttccatcttacaatggaatttcttttgcacacatcacaaaatagactgc

SEQ ID NO: 30978 - DNA, 201 bp, Homo sapiens
aaaaatgataaattaaaaatcctacactgtactaggagattgttccataccacatgccgcatggcagatcaatagaaccttcttttgctatgaaaaactayattttgaaacaaaagttttagtgtttatttggggcagtggaaaaagaaggaagaggtgagtattgagtgctaggcactaatcaagtacttactcatttaa

SEQ ID NO: 30979 - DNA, 201 bp, Homo sapiens
cctcattttatttataagctaaaccaggcacagtatttttaaaactataaatgcagactttcagctttttccttaatctttgagtgtgtaaaatcacaactttttttttttctaactgaaagcttaatgtggtgggggaaggtgcattttgaagtcagtacaccaagaagtgttgctgaaaacacatttgtcattttaaaa

SEQ ID NO: 30980 - DNA, 201 bp, Homo sapiens
gctagtaatacagttgtctttttcatagaaaatagactataagggttttttttttttaagtaattaacaccacattagatttttctcaaaactaaggactrttttattcaggtggacaaatacggttgctgtataatttttcaatcaattcgtatcaaactctgtggggttaaaactagctgggacattttggtaggcttc

SEQ ID NO: 30981 - DNA, 201 bp, Homo sapiens
ctagctgtagtttatgtgctcagggaaagcctgaaccctttgaaagagctcacctggttaagtatcatccaccttggataatctctcgtttgatttactcrtagtcaattgataaggaaccttaattacctctacaagatcccttgacctttgccatctaaggtaacctcattgcaggagtgatatcctgttctattcatt

SEQ ID NO: 30982 - DNA, 201 bp, Homo sapiens
tacaagatcccttgacctttgccatctaaggtaacctcattgcaggagtgatatcctgttctattcattggtcccacgcacactctaggggagggtattgtacggggtgttagagggctgttatttaggcagtgtgaccttaagctttgtggctacggctgtggaagcccctcatagaccccttcagcatgagaaacttta

SEQ ID NO: 30983 - DNA, 201 bp, Homo sapiens
taacctcattgcaggagtgatatcctgttctattcattggtcccacgcacactctaggggagggtattgtacggggtgttagagggctgttatttaggcastgtgaccttaagctttgtggctacggctgtggaagcccctcatagaccccttcagcatgagaaactttaaaaatcctttctttccacaaactcacttacc

SEQ ID NO: 30984 - DNA, 201 bp, Homo sapiens
gtcgtttctcttaccacgtaacatttttagactttcttttcacagtgaccaactattctgggctgcagtgcggcaccataaaggagcaaataaaaaaattmttttgactttttaatttttttctaactttaatcattatttgtcttaaagagacctggctattaagaaatcaataaaaactccatcatctgaggatctatt

SEQ ID NO: 30985 - DNA, 201 bp, Homo sapiens
gtctcagcaagagacaggcttttaaagtgctgggaattgccacacatttataggtgtaatgcaggacaccagatttggggatttgcgcttcctaatgagatttttttttttttagtgatctccatctgatttgggactataatttataattcacacctaatttatgtaacatgctactcttaacaaaatactgtgtatgtg

SEQ ID NO: 30986 - DNA, 201 bp, Homo sapiens
gcactggcgcaatctcggctcactgcaagctctgcctcctgggttcacgccattctcctgcctcagcctcccaagtagctgggactacaggcacccgccaycacgctcagctaattttttattttattttatttttagtagagatggggtttcaccgtgttagccaggatggtcttgatctcctgacctcatgatccgccc

SEQ ID NO: 30987 - DNA, 201 bp, Homo sapiens
gcgcaatctcggctcactgcaagctctgcctcctgggttcacgccattctcctgcctcagcctcccaagtagctgggactacaggcacccgccaccacgcycagctaattttttattttattttatttttagtagagatggggtttcaccgtgttagccaggatggtcttgatctcctgacctcatgatccgcccacctcg

SEQ ID NO: 30988 - DNA, 201 bp, Homo sapiens
ttgagtcccaaataccagctaataataaattgtactttttctttgccttgtgctctcttccttgccacgtgaggataatttacttcttcttcttctttttytttttttttttttttttgagacagagtttcactcttgttgcccaggctggactgcagtggcgtgatcttggctcactgcaacccccgcctcctgagttca

SEQ ID NO: 30989 - DNA, 201 bp, Homo sapiens
gaaatctgaagggatttccagaaattcatcaaggatctgacatttgcaggctgttctggtcctgaggttatgtggggtcaggctggaggaatcagacataygattcctgctgtcaaaaaggtgaatgatagtcaagtggaaagaagacaattgaggaacagttttaacaaagtgccaacatttccctgatagtgaaagtac

SEQ ID NO: 30990 - DNA, 201 bp, Homo sapiens
ccaagacacataatcgtcagattcaccaaggttgaaatgaaggaaaaaatgttaattaagggcagccagagagaaaggtcgggttaccgacaaagggaagsacatcagactaacagcagatctcgctgtagaaactctacaagccagaagagagtgggggcaaatattcaacattcttaaaggaaagaatattcaactcag

SEQ ID NO: 30991 - DNA, 201 bp, Homo sapiens
atgtattcccttcttcacttgttcttcagtttggttgttaacctgttctaccaaagcttgttcttaactatcacatagtataaactccagattcccttacrgaatatatcataccgaatatgtacataattcaaacttcagtgtaaggaaagcaaaacaaaaccagcaacaataaagttggaaaaaaacaataaagacaaa

SEQ ID NO: 30992 - DNA, 201 bp, Homo sapiens
gagaactctctggtaacagcataaatgtctgtgttggttgcttttgatttaaaggtttcttttttcatttgtttgagcccatttcttttccccctcctttwagttcactttatttttcatattctgtaactagcaagccttcattttttaaacctcttccatcttccagtgtctattttctgtattttggatggaaagttt

SEQ ID NO: 30993 - DNA, 201 bp, Homo sapiens
ctttcccacagtattccccatttcggtacatggtaccaccatttatccagttgttcagacctaaacccttctaattattctttttcctatcgttatcccamatcagcaaatcctgtcaattccatttttaaaaaaaatatatctggattctgaccttttcccggcacttccacaggtcacaccctaatagaagccaccatc

SEQ ID NO: 30994 - DNA, 201 bp, Homo sapiens
ctaccaaagcttgttcttaactatcacatagtataaactccagattcccttacagaatatatcataccgaatatgtacataattcaaacttcagtgtaagraaagcaaaacaaaaccagcaacaataaagttggaaaaaaacaataaagacaaaggaatgtcagtgaagaaacgcagatgatatctgatttacccagcata

SEQ ID NO: 30995 - DNA, 201 bp, Homo sapiens
aggaggcataggaattaaattttatatagtcttttgagggaggtttccatttaatagcaaaatacttaagctagagtgttttaatggcaatctgatctacaagattgaaaaatttctactgattaacttttaatttcattaactcttttttatacaattccaatctgatgctaagctgacccagttaattttgtatttaaa

SEQ ID NO: 30996 - DNA, 201 bp, Homo sapiens
ataaagttggaaaaaaacaataaagacaaaggaatgtcagtgaagaaacgcagatgatatctgatttacccagcatattgacggcatagggaaaaccatgcacagagtcttctctgatgtgaagcgtgtgcttgtctgctgaaagaacttaggcgctatgggctaattcttacgactgtgaggaagactgcacgtctcact

SEQ ID NO: 30997 - DNA, 201 bp, Homo sapiens
ctaaattaactgaattctttttgtttggtgagattaaatgttgttaatgaaaaacttgaatacaattttttatgctttagaattggaagtagattgtggtkcaaggaccaaattgatatcaattcatttaaatgacagtaattgaaacattgctaggtatttgtttgtttgttatttattttggctttttctttccacagc

SEQ ID NO: 30998 - DNA, 201 bp, Homo sapiens
taaagttggaaaaaaacaataaagacaaaggaatgtcagtgaagaaacgcagatgatatctgatttacccagcatattgacggcatagggaaaaccatgcacagagtcttctctgatgtgaagcgtgtgcttgtctgctgaaagaacttaggcgctatgggctaattcttacgactgtgaggaagactgcacgtctcactc

SEQ ID NO: 30999 - DNA, 201 bp, Homo sapiens
agcctaatgtctttttgagttctgattgctaaattaactgaattctttttgtttggtgagattaaatgttgttaatgaaaaacttgaatacaattttttawgctttagaattggaagtagattgtggtgcaaggaccaaattgatatcaattcatttaaatgacagtaattgaaacattgctaggtatttgtttgtttgtt

SEQ ID NO: 31000 - DNA, 201 bp, Homo sapiens
agatgatgctgctgactgctcttcctctttctgtgcagaatgtgcccccagacctctccatctgcacctttgtgctggagcagtccctctctgtccgggcrctgcaggagatgctggctaacaccgtggagaaatcagaaggggcaagtacccaatttatgtagacttgtagtattttaatgagctcagctactataggaa

SEQ ID NO: 31001 - DNA, 201 bp, Homo sapiens
ttacgactgtgaggaagactgcacgtctcactctgcttctgcttggctcctccagagccacgtgaaatcacaacaattctttttttttttttttttgagayggagttttgctctcgttgcccaggcttgagtgcaatggtgtgatcgcagctcactggaacctccacctcccaggttcaagggattctcctgcttcaacct

SEQ ID NO: 31002 - DNA, 201 bp, Homo sapiens
tgaacccaggagctggaggctgtagtaacctgtgactgtgtcactgcacccctgcctgaacaacagagtgagaccttgacacacacaaaaaaagaattacraggaaaatgaaaaatttaaatttatttttgtaaacccgagggccccaggaaatatatatcatttaactgtttcaaaaagtgtttttcaatggaactcaga

SEQ ID NO: 31003 - DNA, 201 bp, Homo sapiens
tggtctcaaactcctgacctcagatgatccgcctgcctcagcctccaaaggtgttgggattacaggcgtgagccactgcgccaggccccaacaatgctttaaaaaaaaaaaaatgaagaaatgccttaaggggtaatgaaatgaatttcccataaagtagaattcaaattcttctaatgagggatgatttccgggttcctt

SEQ ID NO: 31004 - DNA, 201 bp, Homo sapiens
ggtctcaaactcctgacctcagatgatccgcctgcctcagcctccaaaggtgttgggattacaggcgtgagccactgcgccaggccccaacaatgctttaaaaaaaaaaaaatgaagaaatgccttaaggggtaatgaaatgaatttcccataaagtagaattcaaattcttctaatgagggatgatttccgggttccttg

SEQ ID NO: 31005 - DNA, 201 bp, Homo sapiens
tatattccaaatgaaacataaccgccatttcagctaagagtaggcatttcttggttcctaaaataattgagattcctgaatgtatcgaaatctagaagcayccattgagctcttactatatgcaaaactctagggtgttgtcatagaacacagatttctatgtgaatgtttaaaggatattggataaagtcacatggctta

SEQ ID NO: 31006 - DNA, 201 bp, Homo sapiens
gtctcaaactcctgacctcagatgatccgcctgcctcagcctccaaaggtgttgggattacaggcgtgagccactgcgccaggccccaacaatgctttaaaaaaaaaaaaatgaagaaatgccttaaggggtaatgaaatgaatttcccataaagtagaattcaaattcttctaatgagggatgatttccgggttccttgg

SEQ ID NO: 31007 - DNA, 201 bp, Homo sapiens
gaattttccttccccttacagataattgaaataggttttataatctgttacaagggagacaattttgttacagggtcttaaacaagcagatgttctcagtrgggcgatgcttacccctaaccagtgtatttaattttgtgacagagaaaaagtagctattatatggataagcaaatgaagaataaacagattttctaccat

SEQ ID NO: 31008 - DNA, 201 bp, Homo sapiens
tcaggtagaagaatgtcagattaaaagacagaatgctgtcattctaattcctgagctgccatgacttgttccacccgtgtgggccaggtctctcttccctsaggccttgtttctctgcagtaaagtgaagaacctatccctcaggcctgcaaatgacaatatgcaggatatattgtcaaagatcagcagggctggatgcta

SEQ ID NO: 31009 - DNA, 201 bp, Homo sapiens
gtgctacctagcacttgttcatggtttataaagtttccataacagctatttagaaagaaaacgtctcatcttcccaacactgtatagcttcatatgtaccaaaaatgccttgtacaaattttttaaagaatagtttaaaaaatggatgagatgtaaagttgtgcagatgtaagtatgatccgtatttccagggactatagc

SEQ ID NO: 31010 - DNA, 201 bp, Homo sapiens
catgaagaaatgtagaaaggtgcttttcattatgaatcagaaaaagcgtacagtttgctctcaggatctggtctgaagacctggcactaacctttaataaktaagtcacaatgggcccattaatttagtcttgttgaacttcaatttcctcatcggtaaaattagggttaacaaaaagtacctgccttacatatgaacatt

SEQ ID NO: 31011 - DNA, 201 bp, Homo sapiens
atggtaccaccatttatccagttgttcagacctaaacccttctaattattctttttcctatcgttatcccacatcagcaaatcctgtcaattccatttttwaaaaaaatatatctggattctgaccttttcccggcacttccacaggtcacaccctaatagaagccaccatcgtcttttgcttggctacggtaacaacctc

SEQ ID NO: 31012 - DNA, 201 bp, Homo sapiens
tgtaatagtttatatttactattcgagtgaaatctttttaaaattgtgattagttttgctaattaaaaagtcatttgctaatgggttccgagttgtcaaayggagattatttatacatgatacatgtttatcctaaatgctaaatgttttgtttagcaattctaccattaacactaatttctaagcaagtcagtcccttta

SEQ ID NO: 31013 - DNA, 201 bp, Homo sapiens
ggctttgaatgaatcaaatcattaaaattgagaaaaaaaaatccatgctgataaaccagtaccaaaaacatatcaagaaaactataaagggggaaaaaaamcaatagttgaatatgttaataatatctgttgaagaacatcgttggtgttgaaatggtccataatgttgtcatagagcccatacatgaagagatgactaaa

SEQ ID NO: 31014 - DNA, 201 bp, Homo sapiens
tcttttatattctggtaattgtttcctgggtactttgttaaaattatattttgattaatcccttgtgacaatcctctaaggtggagatttcagagaggaaraacattgcaatcccagtgactagtaaaaggaaagctagagagctgggatgcaaaccctgggtgtgtctattgcaaaagcaaatctctttccacttaatcc

SEQ ID NO: 31015 - DNA, 201 bp, Homo sapiens
ttttttagtagagacggggtttcactatgttggtcaggctggtctcaaactcctgacctcatgatttgcccacctcagcctcccaaagtgctgggattacrggtgtgaaccaccacgcccagcctgtaatgctgtttaatgacatcaccttggtatggaaacctgtgaataacatctataggaattttcttcccagttaac

SEQ ID NO: 31016 - DNA, 201 bp, Homo sapiens
agtcatgtaggtaaggactcacttccttcttgggggttctactcagtggttgtattttttcgaagcatttgtttcttactctgacgataattgcacatagragaatagttaatgattaacaacactttaaagtgggataatcggcagtgtcttgttttctatcttgttttaaggggttggtaatatcataattaataactt

SEQ ID NO: 31017 - DNA, 201 bp, Homo sapiens
tttcttgtgcagtatttggagcttatgcaataaaccagtcttttcagtatctctctttaaaatgtgatattttcagtgtccttacttaacatggaataatygtacacagtggttttcttttcagaattttaacatggtttgtacaatctgagtctggtataggtctttgagaatgtctaccacttgtttattgtggtctca

SEQ ID NO: 31018 - DNA, 201 bp, Homo sapiens
atttttgacagtatattggatattgggaatgatatgtagtagaggctctgaatttcaagtttttttctgaagagtgattttggttttgcaggcagttaacyttgttgggttgaaacttcagttttctctcttttacatgaggagttgcttatatttttactcaaatctttcagcttccatctgttgccattatactggact

SEQ ID NO: 31019 - DNA, 201 bp, Homo sapiens
gttgaaacctaagaatgctttcatgtttgacttccacatggatcatttcagtgtaggcccaggggagacactagtctgccactaagaaaatacggttggtacgcaatgaatggagacatgttttcagtgtacgttaacatttgcttcatcttccaagatatatggtgtttagatgtttgctctcctgagcaaagaaaatgt

SEQ ID NO: 31020 - DNA, 201 bp, Homo sapiens
attgacatagtaaaagtcctagacatttacaaatttgtcctgatattttattttgtagatgaggaaatttaggtttaggaaaattaaatgattgatacaasgttgtgcagatagttattggtagagaaagtctaaagctcttttcaatattaaaaataaataacaaaaaacatggaagtgagcaggcagcaaactgctgca

SEQ ID NO: 31021 - DNA, 201 bp, Homo sapiens
aaacctaagaatgctttcatgtttgacttccacatggatcatttcagtgtaggcccaggggagacactagtctgccactaagaaaatacggttggtacgcdatgaatggagacatgttttcagtgtacgttaacatttgcttcatcttccaagatatatggtgtttagatgtttgctctcctgagcaaagaaaatgttcta

SEQ ID NO: 31022 - DNA, 201 bp, Homo sapiens
tgtttaatttacagatcccacgagtgaagtcacttccctcccatctgttcatattcttcaggggcttacttcatgtctaccattgccttaggtagcatttttttttttttttttttttttttttgccccttgacttactgtttgtttatttaattctttttgagatggagtgtcgctctgtcgcccaggctggagtgcagt

SEQ ID NO: 31023 - DNA, 201 bp, Homo sapiens
aacatcaacaaaaaggacgtccactcagagactccatccgaaggtcaccaatatcaaagactaaaggtagataaatccatgaagatggggagaaaccagcrcaaaaagactgaaaattccaaaaactggaacacctcctctcctccaaagtatcacaactcctcgccagcaagggaacaaaactggacggaaaatgagttt

SEQ ID NO: 31024 - DNA, 201 bp, Homo sapiens
ttttttttttttttttttttgccccttgacttactgtttgtttatttaattctttttgagatggagtgtcgctctgtcgcccaggctggagtgcagtggtrcagtctcatctcactgcaacctccacttcccgggttcaagcgattctcctgcctcagcctctcaagtagctgggattacaggcctgccaccacaattggc

SEQ ID NO: 31025 - DNA, 201 bp, Homo sapiens
aaggatatggcagatgttaatacattcattcttcctaaaatagcccaaaaaagtaggcttaactctagtatttttccatctctaaaatgcaaagtgagaamggtcgctttctcatcttctgtgctgatctccctcttccactctacttttttctcctttaccaaaaatttgagtgactttacttgaggctgcccttcctta

SEQ ID NO: 31026 - DNA, 201 bp, Homo sapiens
aattcttcttggaatatagcagaagatactgaattttttttttttgatcatgaggtagtcctggacttcataaaagcaagacaaagttttgaagttgatcygatttcttaaaaatagtttgattttttaaaatcctcactacaacattaactaccaattaaccttccccacctttctatctgtatctgataatttgtttca

SEQ ID NO: 31027 - DNA, 201 bp, Homo sapiens
tctttcattcagcaagtgttctcacttattttttctaatgtaacttcagcattttttacctcactcaagggtcatagtaattattaaaacagtcatcggcygggagcggtggctcacacctgtaatccctgccctttgggaggccgaggtgggtggatcacctgagttcaggcgtttaagactagcctcaccaacatggtg

SEQ ID NO: 31028 - DNA, 201 bp, Homo sapiens
gaggaggcgcggaaccatggccgatgggggcgagggcgaagacgagatccagttcctgcgaactgtaagcgccgtgcgtcgcgtgtgctgtcaggggaagrgggcgtcagggcatccactagcggggtccgggcagagtgacagcgggcagcggggactcgcgggcggggcgagggggtgccccctgaggatgcgggagga

SEQ ID NO: 31029 - DNA, 201 bp, Homo sapiens
cctcttcaaggagaactacaaactaccacttgaggaaataagagagaacacaaacaaatggaaaaacattccatgctcatggataggaagaatcaatattrtgaaaatggccatactgcccaaagtaatttatagattcaatgctatccccatcaagctaccattgactttcttcacagaattggaaaaaactactttaaa

SEQ ID NO: 31030 - DNA, 201 bp, Homo sapiens
atgtgtagaccacacatgcacctttggcccagcttgtcacttaggtcgttactcatcttatgcccataaattttccttttcctcagtctttgcatttttcttttttttttgagacagagtcttgcactgtcacccaggctggagtgcagtggcacactctccgctcactgcaagctccgcctcctgggttcacaccattct

SEQ ID NO: 31031 - DNA, 201 bp, Homo sapiens
tcaccccctgatttggcccacctgcccacttcttaaaaccatctcctatccttccttttgctgcttttctcgcaccacaaagcagagaaaaatgtataagttttttttttttttttaacttacagcaactgtaagaaaactggattcaatgcaataagactgacccgttactagtgacgactctccatcagagtcactaac

SEQ ID NO: 31032 - DNA, 201 bp, Homo sapiens
ttgctaaattttatttcattcattcatgttgagagatatatgtaaacaaaatgattttgcataatcatcttttcatctttgaagtttaaaaatgatttcaytagtgtaattatctataagaccctatgtgtttaaaaacatatgcatatatgtaatatctattctatcttctgtttttccaaaaccttctagatgcttctt

SEQ ID NO: 31033 - DNA, 201 bp, Homo sapiens
acagggacatatccttgattcagatgttattaaagatctacattgttatcttctgtatgatcactgattttgttagtttattttaaacaaatgcaactgcyttaccaccaggtaatgttgttaatggaacgattggcaaacagatggtggatatgcttgtggaatcttccaacaacgtggagatgattctcaaattttttg

SEQ ID NO: 31034 - DNA, 201 bp, Homo sapiens
ttttaattacctattcatgatatagccaaccttctctttctcacctcaccattgcatcccactcctccattcaaaccaatttgcttggcattttctgtaartttgtttttcatgtggttttgttgtcattgacactattcagggtgcatacgataagtctagagtctattcactttagctgtagcctactatctaaagata

SEQ ID NO: 31035 - DNA, 201 bp, Homo sapiens
tcccctagccaagggaaactgtgagagactgtaccaggaggaattgtgcactccagcccagataccatgcttttcccatggtcttcgcaaccagcagaccrggacattccctccactgcctatgccaccagggccctgggtttcaagcacaaaactgggtggctgtttgggaaggcagcaagctagctgcacaagtttttt

SEQ ID NO: 31036 - DNA, 201 bp, Homo sapiens
acattcgtggatacaggaactttggtgttttatatttctttttcctaaaatatatacctatgtgtctagaatatgaatggtaaacaattagtgtttgtttytggctaaatacaattatatttctatatactgttgtttttacgaaagaatagaaagataatagttcttcatattatttacttttgcaacatttacacatac

SEQ ID NO: 31037 - DNA, 201 bp, Homo sapiens
tgtagggtaaccataataatagtaatagtaattaactcatagagctcttcatttcttagccattgaccgtcgcttctgtgccagatgctgtgctatatgayaggtataagttgataaataaaactaacatgaacctccctttgctatttcattgagataatgcatagtacctgggagtagatgcttaatgatacacctagg

SEQ ID NO: 31038 - DNA, 201 bp, Homo sapiens
ggccctgggtttcaagcacaaaactgggtggctgtttgggaaggcagcaagctagctgcacaagtttttttcatataccagtggcacctgggatgccagcragacagaaccatttactcgcctggaaagggggctgaaaccagggagccaagtggtctggcttggcaggtcccacccccacggagcccagcacgcgaagat

SEQ ID NO: 31039 - DNA, 201 bp, Homo sapiens
gagcggtggctcacacctgtaatccctgccctttgggaggccgaggtgggtggatcacctgagttcaggcgtttaagactagcctcaccaacatggtgcartctgtctctactaaaaatacaaaaattagcagggtgtggtggtgggcgcctgtcgtcccagctactcgggaggctgagacagcagaattgcttggaacca

SEQ ID NO: 31040 - DNA, 201 bp, Homo sapiens
taaaagtccaggtcactaaagattgctgatggcttgtgaggacagccctgagtgagactgaatcagttggttgacaacagactgtgacagaatgctaaggsgttaatttagagtttattggtgcagtatacctgctcagcactgatggatttcctgatttagtgtattaaagatgaaaaagtaaagttcctttctgataga

SEQ ID NO: 31041 - DNA, 201 bp, Homo sapiens
tttttcatataccagtggcacctgggatgccagcgagacagaaccatttactcgcctggaaagggggctgaaaccagggagccaagtggtctggcttggcrggtcccacccccacggagcccagcacgcgaagatccactggcttgaaattctcgctgccagcacagcggtctgaggttgacctgggatgctccagcttgg

SEQ ID NO: 31042 - DNA, 201 bp, Homo sapiens
gagttcaggcgtttaagactagcctcaccaacatggtgcaatctgtctctactaaaaatacaaaaattagcagggtgtggtggtgggcgcctgtcgtcccrgctactcgggaggctgagacagcagaattgcttggaaccaggaggctgaggttacagtgagctgagactgtgccactgcattccagcctgggtgacagag

SEQ ID NO: 31043 - DNA, 201 bp, Homo sapiens
taaatagttaagcctactaatgaaatatcctgtcatttcctctacttaatagaaggctacagataggcttatacagtaaacatgtgaaaggtacagttgayttctctgcttgaatttgcacatggggggaattcgttctcttcttttgcccttttcacagaaccgtaaaatgtgaggactgaaggcaccttggaggatgcc

SEQ ID NO: 31044 - DNA, 201 bp, Homo sapiens
aagcataatttcacaattaatgtttacgtgacttcttaatatataatccatgcacccataaatagtctagacacaaaccaatttgcttgaagaaaagaccaaaaaaaaaaatgttagaggctcactgttctattctgaagagataattacagtgttctatttttatcacagaatttaatttttctattgacagggttggta

SEQ ID NO: 31045 - DNA, 201 bp, Homo sapiens
gctaagagtaggcatttcttggttcctaaaataattgagattcctgaatgtatcgaaatctagaagcatccattgagctcttactatatgcaaaactctakggtgttgtcatagaacacagatttctatgtgaatgtttaaaggatattggataaagtcacatggcttattgtgcttggttcaataagaaccaaaaaaaaa

SEQ ID NO: 31046 - DNA, 201 bp, Homo sapiens
attaacttattacaaattttgggcattgtttgttcttatccattcattcaactactattgattgaggcccttttatatacctgacattatgctagatactrgggctataattctaggtaaaaacagactcagtttattttttattattattattatttttttttttttgagacggagtcttgctcttgtcacccaggatgg

SEQ ID NO: 31047 - DNA, 201 bp, Homo sapiens
tgcaaaactctagggtgttgtcatagaacacagatttctatgtgaatgtttaaaggatattggataaagtcacatggcttattgtgcttggttcaataagaaccaaaaaaaaaaaaaaaaaaaacagaagtaacaagtaacttctcttattacttattttttatatgacattttaaaataacaatcgtatctgaaatatgt

SEQ ID NO: 31048 - DNA, 201 bp, Homo sapiens
attcggaagaggccttatgacccaggaagacatactttaattaatatctttattgtcctgtcaggtaggttaaccctctggatcccatcagtatttggcartgttgatctttattcttggaatagaaactagattgtgtgtgtgtgtgtgtgtgtgtgtacatgtatgtgtgagcatgtgtgcatgtacacaatatcctca

SEQ ID NO: 31049 - DNA, 201 bp, Homo sapiens
aaactctagggtgttgtcatagaacacagatttctatgtgaatgtttaaaggatattggataaagtcacatggcttattgtgcttggttcaataagaaccaaaaaaaaaaaaaaaaaaaacagaagtaacaagtaacttctcttattacttattttttatatgacattttaaaataacaatcgtatctgaaatatgtattt

SEQ ID NO: 31050 - DNA, 201 bp, Homo sapiens
aagaggccttatgacccaggaagacatactttaattaatatctttattgtcctgtcaggtaggttaaccctctggatcccatcagtatttggcaatgttgrtctttattcttggaatagaaactagattgtgtgtgtgtgtgtgtgtgtgtgtacatgtatgtgtgagcatgtgtgcatgtacacaatatcctcatgtgca

SEQ ID NO: 31051 - DNA, 201 bp, Homo sapiens
aactctagggtgttgtcatagaacacagatttctatgtgaatgtttaaaggatattggataaagtcacatggcttattgtgcttggttcaataagaaccamaaaaaaaaaaaaaaaaaacagaagtaacaagtaacttctcttattacttattttttatatgacattttaaaataacaatcgtatctgaaatatgtatttt

SEQ ID NO: 31052 - DNA, 201 bp, Homo sapiens
acctagagtgagggtgcaggcaagaactcccatctggatgttgttcattctggaaggagtccaatctaggctttttttactctcccccctgaaggttcttytctctctctctctctctctttccctttcccctcctgattaaccccaggcttcctctgggttgttgctgtgggagagaggaggtatggggaaggaaaggtc

SEQ ID NO: 31053 - DNA, 201 bp, Homo sapiens
atatttctatatactgttgtttttacgaaagaatagaaagataatagttcttcatattatttacttttgcaacatttacacatacacatttgtagctctcyatccttctcttttaaagagaataatccaagtttatttgagatagcctggtgttattttgtatattctggagaaaaaatgccctaaaaactacctcctttt

SEQ ID NO: 31054 - DNA, 201 bp, Homo sapiens
ataaaatggtggctactccataggcagagcagctccaagggctactggttggctagttttatggttatttcttgatcatatgctaaacaaggggtggattrttcatgagttttccaggaagggagtgaggaatttccagaactgagggttccttccctttttagactatataggataacttccagacactgtcatggcctt

SEQ ID NO: 31055 - DNA, 201 bp, Homo sapiens
acatttttctattttattcatagggatattaacaaggaagattaaatgctggctgaaagctctcatatttgtatccacagaaatacaaattatatataaarttatatgattactaccattatcatgattatgttcttagcctttccgaattcctgttatacgcaaagcattctacttaactccatgggtataatgggatat

SEQ ID NO: 31056 - DNA, 201 bp, Homo sapiens
accagtagactgtatgttaggtatgtatataaaataatactcagagcaagcactagaaaagctgtacaaagagatacactgagaagtaccacagataaatcaaaataggattctaaatattgttcaagtaatgcatagcatagcaagtcagtaaaaataaatcagaacaaacggaaccacaggtgaaatgacagactgaag

SEQ ID NO: 31057 - DNA, 201 bp, Homo sapiens
atttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaat

SEQ ID NO: 31058 - DNA, 201 bp, Homo sapiens
gcattgtactatacacagtttgtggtataattaatcatgccctacacttaaatcactagcagattcaacattgcataccttgatttatccagaactttgattttttttttttttttttgctaagaactgtacctatttttagactctttcactttctcatcatgtcaatctcagaatagatagcactagtacttggctttc

SEQ ID NO: 31059 - DNA, 201 bp, Homo sapiens
tatggttctagggggattgtgtcctgtgtaaaattcagagggtccaaaaggtgaagagatgatggatgtggtcatgatattgggctccaaaactcacggartaaatggccaatggtgaagtaaatggtggtaaaagcagagattctatttcattataaaatatgaaaaaaacatgaaaggcagaatccagactatagaaca

SEQ ID NO: 31060 - DNA, 201 bp, Homo sapiens
cccctgatttggcccacctgcccacttcttaaaaccatctcctatccttccttttgctgcttttctcgcaccacaaagcagagaaaaatgtataagttttktttttttttttaacttacagcaactgtaagaaaactggattcaatgcaataagactgacccgttactagtgacgactctccatcagagtcactaacatgc

SEQ ID NO: 31061 - DNA, 201 bp, Homo sapiens
aaatatttcctttttgcttttggagttagttccgcaagggtccctcttaattccttacattcccatctaatcaatgatctgctccagtcttctctctattytttatatgatctctgtttggcaacttctaagtacacctgacattgattaagcgacagttgctgtggtttaccctgcattcctgtgggctctctgcaaaca

SEQ ID NO: 31062 - DNA, 201 bp, Homo sapiens
cttattagctttatttatggatgagaaaactgaggcttaaaaggtttaattaacttgctaacatcttagaggtaatgagtggcagaggctggactcaaaaytaaatctctctgtcccccaaatctatgctcttaatcactaataatgaaaaaaaaaatccacaaaaacccaggaagtatgtttagcttaactactgatttt

SEQ ID NO: 31063 - DNA, 201 bp, Homo sapiens
aattaacttgctaacatcttagaggtaatgagtggcagaggctggactcaaaactaaatctctctgtcccccaaatctatgctcttaatcactaataatgaaaaaaaaaatccacaaaaacccaggaagtatgtttagcttaactactgattttaagatctctggtttggagttggccattatgcaacataaaatttaaaa

SEQ ID NO: 31064 - DNA, 201 bp, Homo sapiens
aatttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaa

SEQ ID NO: 31065 - DNA, 201 bp, Homo sapiens
atttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaa

SEQ ID NO: 31066 - DNA, 201 bp, Homo sapiens
tttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaat

SEQ ID NO: 31067 - DNA, 201 bp, Homo sapiens
ttaatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaatc

SEQ ID NO: 31068 - DNA, 201 bp, Homo sapiens
taatgaaggactgatattttgcacctaaaggatatcaaatgtcaattcttctaattccattattgttggaattaatatatcattactataattcactttattttatttaataaaattaattacaattaatatatgtcagagtataatgatacactttatacatgtgaacaattaagtgtgtaggcctctgattttaaatct

SEQ ID NO: 31069 - DNA, 201 bp, Homo sapiens
gaaggggattgttaagaattattctaatgattgatagacatggaatcaatactagatgctaattaaaatgaggatggtgacaaggttgcaggtcctggtgttttactgaagaattgctggggtcaggatactcaggggagtgggttagaaagatgggcattgtggccagagagttgaagggttgaaattgagaccatggaa

SEQ ID NO: 31070 - DNA, 201 bp, Homo sapiens
aaggggattgttaagaattattctaatgattgatagacatggaatcaatactagatgctaattaaaatgaggatggtgacaaggttgcaggtcctggtgttttactgaagaattgctggggtcaggatactcaggggagtgggttagaaagatgggcattgtggccagagagttgaagggttgaaattgagaccatggaag

SEQ ID NO: 31071 - DNA, 201 bp, Homo sapiens
ctggaggctggtttgacatacctgttggtgttttaacttttttttttttttttttggagacacaatcttactgtgttgcccaggttggagtgcagtggcatgatcatggctcactgcagccttgacctcccaggctcaagtgatcctcccacctaggcctctcaaagtgctgggactacaggtgtgagccaccatgcctgg

SEQ ID NO: 31072 - DNA, 201 bp, Homo sapiens
gttgcttcctggacccatctcttgctgagtttagcaaacttaggcacattacatgaagttttctaaggtacagtttctttatctgcagaatatcaataacrtgaaacctacatattgtgacagtcacatggaatgaagcataatttctggcacaaagtattaatttagtaaaggtcgttctcattccatttccctccattt

SEQ ID NO: 31073 - DNA, 201 bp, Homo sapiens
aacaaagcaaagtgccctttaactgtgctcctctatttctctgccccaaaatgctagacacagcagtggtttatttacccactgcttcttatattactggmcttaccactcactgaaatggcgctgaaagatgaccagggagctctcaaatgctttccctcagtattcatccccttaaacttccctggaggatgtgggact

SEQ ID NO: 31074 - DNA, 201 bp, Homo sapiens
aaaaagtttagtatttaattttagaatcagagggtacatgtgcgtgtttgtaacataggtatattgctatgtacagagatacataggaatttacctatgtrcgttgttacataggtataatggtgggaatttagattctaatgaacccattacctaaatagtcaacattgtacttgacaggtaatttttcaacactagctc

SEQ ID NO: 31075 - DNA, 201 bp, Homo sapiens
ctgatgacttctaactttgctattctgcagaataacctttagcagctcctagtccattcacataagtgtaattccctcagcatagcatatgaggccctcayttaatatcttaatcagggttcttgagataaacagaaccaacagggtgtatgtatgtgtgtgtgtgtatatatacatatatatatagacatatatgtatat

SEQ ID NO: 31076 - DNA, 201 bp, Homo sapiens
taatttgccttttccgtctttaaatgatccttaaatctaagtaaaacacatgcaaaaactcaacatatggctgttttctggtaattcctgtttgaaaaaaygttaattttcttatgttttggaaaagggaactatgtagcccttgtatttaaaatgttcagaggaactcatattactttactataagtattgtattgtttt

SEQ ID NO: 31077 - DNA, 201 bp, Homo sapiens
gcttgtcacttaggtcgttactcatcttatgcccataaattttccttttcctcagtctttgcatttttcttttttttttgagacagagtcttgcactgtcrcccaggctggagtgcagtggcacactctccgctcactgcaagctccgcctcctgggttcacaccattctgcctcagcctcctgagtagctgggactacag

SEQ ID NO: 31078 - DNA, 201 bp, Homo sapiens
taaattaaaattaaagacttctgaatatcagcaaataccatagtatgtaaagcaaacaaataaaacagagcaacataaaaacagcactaccaccaacaacraaaatacaaacctcagattgggagaagatattttcaacatgtaaatataagtggataaaattttactatcaaaaattataaagatttcctagcaatcaat

SEQ ID NO: 31079 - DNA, 201 bp, Homo sapiens
agggatcaaattttctttgtttgtttgtttttaagacagagtcttgctctgtcacccaggctggaatgcggcggcgcgatctcggctcactgcaacctccrcctccctaggttcaagtgattctcctgcctcagcctcccgcatagctgggattataggcgcgtgccaccatgcccggctaatttttgtatttttagtaga

SEQ ID NO: 31080 - DNA, 201 bp, Homo sapiens
caccccctgatttggcccacctgcccacttcttaaaaccatctcctatccttccttttgctgcttttctcgcaccacaaagcagagaaaaatgtataagttttttttttttttttaacttacagcaactgtaagaaaactggattcaatgcaataagactgacccgttactagtgacgactctccatcagagtcactaaca

SEQ ID NO: 31081 - DNA, 201 bp, Homo sapiens
gtcctccttcccgaaggatgttcccttgcaggattccccagacttccccaacctagaactgcagcttctgctggtacttctttcctcagcagtacaaaaamaaaacaaaacaaaacaaacaaacaaacaaaaccacttcccggttacagttacctataatcacagaaaatcgtagatacggtggaattttggaatattaac

SEQ ID NO: 31082 - DNA, 201 bp, Homo sapiens
gggagatgaggaagatttggcaaaggagactggaaagcaatggccagaaatgaagcgaagcagaggagtgtggtgtttctgtgttaaggcttttgtccccwtcattctggtcagcagcaactaactaggttttgaattgatgggtgacacatccattaagtcagggtatctggaacagtctaagaaaatctcagaggaagg

SEQ ID NO: 31083 - DNA, 201 bp, Homo sapiens
agaccgggcttggaagagcctcttcactaataccttggtcacggtgtataaacctgctagtaatacagttgtctttttcatagaaaatagactataagggttttttttttttaagtaattaacaccacattagatttttctcaaaactaaggactgttttattcaggtggacaaatacggttgctgtataatttttcaatc

SEQ ID NO: 31084 - DNA, 201 bp, Homo sapiens
ggaatgtgtgttttattttaaagattttattaacttaccaatgtagcatcaaactgtcatttggcatttaaaaacacgcatctttttcgttatggtcctcttttttttttttttccaacaatcatacagaatgttatagaagatattcctctgactttaggaaaaccatggtgtaaaatgaccttggtcaaggtttttttt

SEQ ID NO: 31085 - DNA, 201 bp, Homo sapiens
aacacgcatctttttcgttatggtcctcttttttttttttttccaacaatcatacagaatgttatagaagatattcctctgactttaggaaaaccatggtrtaaaatgaccttggtcaaggtttttttttttttttttttttttttgagtactttgtctttctttcatttgtctaagcacagttgagttacccttgtggtg

SEQ ID NO: 31086 - DNA, 201 bp, Homo sapiens
gtgaaaaggaggtttcttttgtcttttctaatgttacagtccctcacatggcctgaatcttggtcctggaagccaagattggaatccatcctttctagccttttttttttttttttttgcctccctatccacttactccttctggtttatcttgaagcctgttaatttctcccatcttaaaatgtctgtctttgacccgga

SEQ ID NO: 31087 - DNA, 201 bp, Homo sapiens
caaatgcagaaagaaggaacctgctatgaaggaagtaggcaaagatagtgggggtggaagaatagaggtaagatctcttctggaagcagaagagtaggagkgttggtgggtgaaattctgagatgaggacaccggaggtgtgtagggtgagagaggccaggtgatgattgctgctttgggaggccgcagtggctcccaggt

SEQ ID NO: 31088 - DNA, 201 bp, Homo sapiens
atcgaacttcctagcgggtagtttttggaagctgtctttcctcattttaaaaattagcatcccagttgtctggaactttcacttggccttcatggtttctyggtttaccaacagtcattctgcatccacggatgttacttttgctttgagtcttgatacttgagacttgaactcactttaagagactgttgtatgtgtctt

SEQ ID NO: 31089 - DNA, 201 bp, Homo sapiens
atatcttacttaggtttttgtttttcagttttaattgttttttaaacttaggaacacagagttgggttaatgataactctgaattcatgatacacagtcaytgttagtccactagtgtctacttttaaagttacttagtcatttctaataatgtagtaactacccataaacccacttctgacaagaaacaacctagagaat

SEQ ID NO: 31090 - DNA, 201 bp, Homo sapiens
  misc_feature (1)...(201): n = A,T,C or G, or insertion/deletion polymorphism (see Tables 1-2)
tgctgttggagttcatttttttttattgttgtgttatttccctttgggcagatataccagagcttatccatttacctttttcgttgatagacttttgtatnacctctgtgtttttgctaatgtgaacagggattgaatgcctattcttatccatttcacctatcttacaagagctacagggtgtacccattttcaaataaa

SEQ ID NO: 31091 - DNA, 201 bp, Homo sapiens
ttgctggagtcatgattttcatttctcttggctaggtacttttctgtattacaaacatcacttctttctgaaacaaaagagctgatgagtggttctgcacrtcctctctattatgatgagtacagcatctgctctaaatcatgtgcttactgctccttgttgaccatactttggtgataatttgaaaaatcattttacatc

SEQ ID NO: 31092 - DNA, 201 bp, Homo sapiens
attagtagaagtttaaagtagtttttataggtttggtgaatttgtcagatacagtctgtacaccaagtaaattcaggtttaatagtttttaaaaatcacarattttaacttcattaggagcaaatctcattaaattttcctaggaagatttttttaaaacagttaaaatattttatttcaaaatacttttttattaaaaat

SEQ ID NO: 31093 - DNA, 201 bp, Homo sapiens
aaattttaacttcattaggagcaaatctcattaaattttcctaggaagatttttttaaaacagttaaaatattttatttcaaaatacttttttattaaaawtttttttcagctagtgctttaaatggattatccctttgtacaaaagcaaacatggcttatgaattttatggcttaaaaacatatcattataatcccaaat

SEQ ID NO: 31094 - DNA, 201 bp, Homo sapiens
atgagctgtagggttcttcctactatagctattggttaatgaccaatttcttttggtcactattatactacagaccataataataatagcagctgagatgyattaaaagcatgtatttttcagactcttttttctttattttatttttttgagatggaggctcattctgtcacccaggctggaatgcaatggcacaatctt

SEQ ID NO: 31095 - DNA, 201 bp, Homo sapiens
tcaaaggacaatgtgaaggggacagatgacacctgcacatgcagctagttgagttacagaaaaggaatcctgagctcagggagtgtgagttagttacactrgacagaaagcctgcctggcctttgctgtggatggagacatctctctcttgcatggcctcttgctgcaaacatcttggaaaagatttcctgaaacaaagcc

SEQ ID NO: 31096 - DNA, 201 bp, Homo sapiens
cctgccttgagtagttttctcatgacattctcatcagtgttctgctgaatatttgagggggaccttctgtaggtctccagggttccctcttgtgagccctytcctctctgtgtcctgtgaattctagcaaccttggtctcctggacgctcagcaatatctcttcaactcatggagactgtcaggccacacctgggttccct

SEQ ID NO: 31097 - DNA, 201 bp, Homo sapiens
taacaaaggatgccttccagaatgtggctggagattaagatggataaaaggtagaacaagtccaagttgaaaaggtcttgtgtgccatgtgaaaaggttarcatctattacatagacaagggaaatccattggaaatttgaagaaggggattgagcataatgaaacttgttttggaaaaatatgttgttattaatgtggag

SEQ ID NO: 31098 - DNA, 201 bp, Homo sapiens
ttagcagtgggccaggctggtcttgtactcctgacctcaagtgatccacctgcctcggcctcccaaagtgctgggattacaggcgtgagccatggtgcctrgcccagtctttctttaaatgttgctttctcaatgatgcccattctgacaaccccatttaaaattgctgcccttgattctggttcccccattctagctttc

SEQ ID NO: 31099 - DNA, 201 bp, Homo sapiens
attcagaccatagcagccagatagttactattacaggccgcgtggaccatgaggtctgttagaatcactcaaccctgcctttgtagtgtgaaagcagccakagacagtatgtaaatgcaggtgcatagaatacacaataaaattttatttataaaaataggcagtatgcgtctgacaagggtctcatatccagaatctata

SEQ ID NO: 31100 - DNA, 201 bp, Homo sapiens
gggaactctctgtgccttcctacttttgctgtgaacataaaattgctgtaaaaaaataaattctatttgaagcacaaaacagcctaccaaccaacaagagwtccctaaatgttcggcagtagagaaattgataaagtatagtggattcaagcaatgttatactgtatatacagtgaaactgtaaacacacatatcaacaag

SEQ ID NO: 31101 - DNA, 201 bp, Homo sapiens
aagttcttgtaactcctcactactaaggtaaatcatgcatgttaaatggccagtaccctgagaccaaccctagtttattgctgtacaatacttaattctartataaactctcagtactgtaatttgtgtgttctctgtgtagcaactggtagcttttgtttatgcttattccaaacttatggaatgaaaataagtttatat

SEQ ID NO: 31102 - DNA, 201 bp, Homo sapiens
tcaaattttgagtttataaatcttttctagtactttatttgacttctagtttagtaatttcacttaatcttcattagttccacttttcaactctctttgcygttctatttttaggacatgaaaaccgcaagttctttcattttagtcattcttttctttattaatcagggcacttaaggctataatattttgcctttgaat

SEQ ID NO: 31103 - DNA, 201 bp, Homo sapiens
gaggcagaagaatcacttgaacccaggaggaggaggttgcagtgagcagagattgcaccattgcactctagcctgggtgacaagagcaaaactccatctcaaaaaaaaaaaaaaaaaaaaggtgggggagggagggtagctggcaagatggccaaataggaacagctccagtctgcagctcccagtgagattgacgcagaa

SEQ ID NO: 31104 - DNA, 201 bp, Homo sapiens
aggcagaagaatcacttgaacccaggaggaggaggttgcagtgagcagagattgcaccattgcactctagcctgggtgacaagagcaaaactccatctcaaaaaaaaaaaaaaaaaaaaggtgggggagggagggtagctggcaagatggccaaataggaacagctccagtctgcagctcccagtgagattgacgcagaag

SEQ ID NO: 31105 - DNA, 201 bp, Homo sapiens
ggcagaagaatcacttgaacccaggaggaggaggttgcagtgagcagagattgcaccattgcactctagcctgggtgacaagagcaaaactccatctcaaaaaaaaaaaaaaaaaaaaggtgggggagggagggtagctggcaagatggccaaataggaacagctccagtctgcagctcccagtgagattgacgcagaagg

SEQ ID NO: 31106 - DNA, 201 bp, Homo sapiens
aaacactattacatatttaagtaaaatattttatttgattaatcagatacattttaaaattatacttgcaattgcaaatatgtgtgtgtgtatgcacacaygcatatacattttcaaaatatataaattattcagtatatagataatgcttctggagtgtatggtggtttcattgattgtttcttataacccccaaccccc

SEQ ID NO: 31107 - DNA, 201 bp, Homo sapiens
gggaactgaagactagacagttacacggtagttcaaatgcaatcatatcactgcaattaaaactatgagaagactagattattctgtaatatcaccacatkaggaatatgaatcactgtcaaatagcagatgcacatcatatggatatgattgatgtgatcacatcacttcttttagagtctgtggatgactggtcactgt

SEQ ID NO: 31108 - DNA, 201 bp, Homo sapiens
agcacaaaactgggtggctgtttgggaaggcagcaagctagctgcacaagtttttttcatataccagtggcacctgggatgccagcgagacagaaccattyactcgcctggaaagggggctgaaaccagggagccaagtggtctggcttggcaggtcccacccccacggagcccagcacgcgaagatccactggcttgaaa

SEQ ID NO: 31109 - DNA, 201 bp, Homo sapiens
aaagaccaaatatacgtttgattggtgtacctgaaagtgacgggagaatggaaccaagttggaaaacactcttcaggatatcatccaggagaacttccccracctagcaaggcagaccaacattcaaattcagggaatccagagaacaccacaaagatactcctagagaagagcaaccccaagacacataatcgtcagatt

SEQ ID NO: 31110 - DNA, 201 bp, Homo sapiens
gggacacatttaaagtagtgtgtagagggaaacttatagcactaaatgcccacaagagaaagcaggaaagatctaaaattgacaccctaacatcacaattwaaaaaactaaagaagcaagagcaaacaaattcaaaagctagcagaagacaagaaataactaagatcagtgcagaactgaatgagatagagaaacgaaaaa

SEQ ID NO: 31111 - DNA, 201 bp, Homo sapiens
taagatcagtgcagaactgaatgagatagagaaacgaaaaacccttcaaaaaaatcagtgaatccaggagctggtgttttgaaaagatcaacaaaatagayagactgctagccagactaataaagaagaaaagagaagaatcaaatagatgcaataaaaaattataaaggggatatcaccaccgatcccacagatatacaa

SEQ ID NO: 31112 - DNA, 201 bp, Homo sapiens
tctgctggagatggacatattttaaaatgagagggaaacttggtgccctgcttctacctgcaggaagttactttataatatcaaatgtgaatttcttacaytaccagagccttgcaggctgtgtgccacatcataggtcctgtgtttaatgtttgtggaattgcatcgaactgattccatgagatagtattttacataata

SEQ ID NO: 31113 - DNA, 201 bp, Homo sapiens
gaagaatcaaatagatgcaataaaaaattataaaggggatatcaccaccgatcccacagatatacaaactaccatcagagaatactgtagacacctttacmcaaataaactagaaaatctagaagaaatggataaactcctggacacatacaccctcccaagactaaaccaggaagaagttgaatccctgaatagatcaat

SEQ ID NO: 31114 - DNA, 201 bp, Homo sapiens
agacacaacaaaaaaagaaaatttcaggccaatatccctgatgaacatcgatgcgaaaatcctcaataaattactggcaaaccaaatccagcagcacctcraaaagcttatccaccatgatcaagtaggcttcatccctgggatgcaaggctggttcaacatacgcaaatcaataaatgtaatccatcacataaacagaac

SEQ ID NO: 31115 - DNA, 201 bp, Homo sapiens
tcaagaactgtacttcaggagcatgtcacagttatgagcctgtaggcaagaacagggttttttttttcctctccttttagggaagaacaacatattgaagkatgattaagacacttgaaaaatgtaacagaaacatacacacacacgcattgcatacacaggatccaatccctgatgccctttgcctctcttcttgtttta

SEQ ID NO: 31116 - DNA, 201 bp, Homo sapiens
ataggtaattatgtatactattaagcaaatagtcagtctagggatatattggagggattttctgaaagctcaggtcaggggaaaatgttgaaatatcttargaaacagaatgattctgctggtagtgactgccctcagctctcccactatgataggatctggctaagaaaattccagtaatttttcagaaaattagcaatt

SEQ ID NO: 31117 - DNA, 201 bp, Homo sapiens
gggcccaagcgatcctcccaccttggcctcccgaagtgctgggtttacagatgtgagccactgtacccagcctctcaatagcctctttgacagctctttgmcattggttgcaagatgaatccaaggggagggcataatgtacaaggaaaaatgataaattaaaaatcctacactgtactaggagattgttccataccacat

SEQ ID NO: 31118 - DNA, 201 bp, Homo sapiens
atcatctttcagcagtgagaaggtagtgtgaacggaaaaaaaaacccaggaaattcaatatcagcatacatataacatttaagttaattcagcccagctgstcagcagaggttgctgttctcggtgtgttccaagaccacagatggcaagccagtcttgatggctttttaaaaaaaatatttgagacagggtcttgttctg

SEQ ID NO: 31119 - DNA, 201 bp, Homo sapiens
tgcttttcccccctctgttactgatgttgttagtgtcgaagagcagtttttcactttaatgaagtccagattatcagtttttttaaatcatggtttgtggttttttttttgtatcttctttgcctacccaaaggctgttctcccatgttatcttctacagcctttactattttaaggctgatatttaggtctgtgctctta

SEQ ID NO: 31120 - DNA, 201 bp, Homo sapiens
gcatgtcaaaggtatctaagacaaactttctttattgaatcaactttgtcttggcttcaactgtgaaacttggatgatgtaatctagggttgggtaccgtwcatttctagtctctgggtcttccactgaacactgctgtaccacacgcttcaatggtagagggtttcatggcagggccgtgcagcactgttgtgacataga

SEQ ID NO: 31121 - DNA, 201 bp, Homo sapiens
tatttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaa

SEQ ID NO: 31122 - DNA, 201 bp, Homo sapiens
tgtggtctggaatttccaacagacgtgaggaaaatatttattgaagaacaacatgatgtcaagtttttcagtaaacccttggtttgatattttttcctgamtagaagtcttaaagatttggccttaaagacttctgcccaattagatcactcattccatgtacatatgcagatagtggcacacaacgcagtttgcttgcat

SEQ ID NO: 31123 - DNA, 201 bp, Homo sapiens
cggtagagacggggtttcaccgtgttagacaggatggtctcaatctcctgacctcgtgatcctcctgccttggcctcccaaagtgctgggattacaggtgwgagccaccgcacccggccttgtcttcctaaatattattaacaaacaacccaagccttcatatatcaattgcttcctggatgccttgccctgtgctaaaca

SEQ ID NO: 31124 - DNA, 201 bp, Homo sapiens
aggactgtattgtagtttacaactattttctcaaatgctctcagcttttaaatgtcctacgtaatttgaaatgctgcttaatgttacttagcccaaaggaragttaatagtattttccccctttgcttatactgtactttcgttttttatgaggaaaagctagttgttgctaactaccgctttttttgtttattggctctt

SEQ ID NO: 31125 - DNA, 201 bp, Homo sapiens
tcctgccttagccttccgagtagctgggactacaggcgcccaccaccatgcccagccaattttttgtattttcggtagagacggggtttcaccgtgttagmcaggatggtctcaatctcctgacctcgtgatcctcctgccttggcctcccaaagtgctgggattacaggtgtgagccaccgcacccggccttgtcttcct

SEQ ID NO: 31126 - DNA, 201 bp, Homo sapiens
caaaggaaagttaatagtattttccccctttgcttatactgtactttcgttttttatgaggaaaagctagttgttgctaactaccgctttttttgtttatyggctctttttttgttttgttttgtttttttagaattttcataaagaaattaagtgcagggaaatagaaattagattctttttcttttccttttaatttac

SEQ ID NO: 31127 - DNA, 201 bp, Homo sapiens
cggcccactgcaaactccgcctcactgcaagctccacctcctgggttcacgccattctcctgccttagccttccgagtagctgggactacaggcgcccacmaccatgcccagccaattttttgtattttcggtagagacggggtttcaccgtgttagacaggatggtctcaatctcctgacctcgtgatcctcctgccttg

SEQ ID NO: 31128 - DNA, 201 bp, Homo sapiens
tttaattaaagtggacccacaaaaacgtattagccaatgaataagctcagagcagtgaccttccaggatgcatttgttatgaacctctctgcagcattgargtcaatgtgtcaaaaatataaaaacaatctaatttgaggaacccatgactattgctggctgagaaaaatgccataagattaatttctgtatgatttctat

SEQ ID NO: 31129 - DNA, 201 bp, Homo sapiens
caaagccagtaactttactcttgtcctccttccatccttgatgtcctacagaactggatttgctccaataggtcacttatcctaatatgtttttatattaygtacaaaactctagtcctttttgtttgtttcagttttgttaagagtagtaaggagttatttccactgaaattattttaccagggacccggaacataaaat

SEQ ID NO: 31130 - DNA, 201 bp, Homo sapiens
gcaattctcctgcctcagcctcccgagtagctgggactacaggcacatgctaccacgcccagctgatttttgtattttttagtagagacggggtttcactmtgttggtcaggctggtctcaaactcctgacctcatgatttgcccacctcagcctcccaaagtgctgggattacaggtgtgaaccaccacgcccagcctgt

SEQ ID NO: 31131 - DNA, 201 bp, Homo sapiens
attgattaaatgtgtgtttcagcataaccacctacagtttggaggatgggttggggagggaggagaaactggaggagaggatatagtaagaggctattcastgaaaggagaggatgagtttaggagataaatttggacacaggattaatgaattttaacaattagatttaggaaaatgagaaagtgaaagaggattcaaaa

SEQ ID NO: 31132 - DNA, 201 bp, Homo sapiens
acctcttcaaggagaactacaaactaccacttgaggaaataagagagaacacaaacaaatggaaaaacattccatgctcatggataggaagaatcaatatygtgaaaatggccatactgcccaaagtaatttatagattcaatgctatccccatcaagctaccattgactttcttcacagaattggaaaaaactactttaa

SEQ ID NO: 31133 - DNA, 201 bp, Homo sapiens
ttgcattgtgtcacttgctttccgtcaagtttaagtgtctgttacctacctaaggtacattgtcatggcttaaagcctctgtgtgggtctgagttcagagrtgcttctctgcattgtgagtaacttagttcaatcttctcaagccaacttgcctcttgatggcccttttagtcctaagcttttaaagtgggagcatatgaa

SEQ ID NO: 31134 - DNA, 201 bp, Homo sapiens
actactttaaatttcatgtggaaccaaaaaagagcccgcatagcccagacaatcctaagcagaaagaacaaagctggaggcatcacactacctgacttcaractatactacaaggctacagtaacaaaaagagtatggtattggtatgaaaacagatatatagaccaatggaacaaaacagaggcctcagaaataacacca

SEQ ID NO: 31135 - DNA, 201 bp, Homo sapiens
ttataaagttcttttcagatacattcaaagctatgagtttaaaaactgagaatctcagtaagctcaacaaatgaacacatttacatgccagtaatatatcyttcttccaaggctagaaaatacttcatgatatttttgttagtataacttttaaatgcatttctttcagataatagaaaagcattttaatatatatttacc

SEQ ID NO: 31136 - DNA, 201 bp, Homo sapiens
cataggcatgggcaaagacttcatgactaaaacaccaaaagcaatggcaacaaaagccaaaactgacaaatgggatctaattaaactaaagagcttctgcmcagcaaaagaaactatcatcagagtgaacaggcaacctacagaatgggagaaaattttttgctgtctatccatctgatatacagctaatatccagaatct

SEQ ID NO: 31137 - DNA, 201 bp, Homo sapiens
ataggcatgggcaaagacttcatgactaaaacaccaaaagcaatggcaacaaaagccaaaactgacaaatgggatctaattaaactaaagagcttctgcayagcaaaagaaactatcatcagagtgaacaggcaacctacagaatgggagaaaattttttgctgtctatccatctgatatacagctaatatccagaatcta

SEQ ID NO: 31138 - DNA, 201 bp, Homo sapiens
tcaaaagacgacatttatgcagccaacaaacatatgaaaaataggtcatcactggtcattgaagaaatgcaaatcaaaaccacagtgagataccatctcaygccaattagaatggcgatcattaaaaagtcaggaaagaacagatgctggagaggatatggagaaataggaacacttttacagtgtttgtgggagtgtaaa

SEQ ID NO: 31139 - DNA, 201 bp, Homo sapiens
gagtttgagaccagcctggtcaacaagacgaaaccctgtctgtacaaacagaaattatcagggtgtggtggtgtgcgcctgtaatcccagctacttgggaygctgaggcaggaggatcgcttgagcccaggaggttgaggctgcagtgagctgtgattgcaccaccgcactccagcctgggtgacagagcaagactgtctc

SEQ ID NO: 31140 - DNA, 201 bp, Homo sapiens
tcgaattttgatatagaaaagtaaagagaatatttttgcaaagccagtaactttactcttgtcctccttccatccttgatgtcctacagaactggatttgytccaataggtcacttatcctaatatgtttttatattatgtacaaaactctagtcctttttgtttgtttcagttttgttaagagtagtaaggagttatttc

SEQ ID NO: 31141 - DNA, 201 bp, Homo sapiens
cttcctgggctcaataaatcctcctgtttcagccccacaagtacctgaaactacaggcatgcaccaccacacctggcttttttttgtgttttttttttttwaattttagtacagacaagatctcttatgttgctcaggctggtcttgaatgcctgaactcaagcgatcctcccacctcagcctcccaaaatgctgggatta

SEQ ID NO: 31142 - DNA, 201 bp, Homo sapiens
tgtctgtaatcagtttggttctatacaggaaaatcactatgaattaaaactaagtcattgccacacccttcttacacaggatttatttcaatttataaaaygtgtcaagtgcctaggacataccaggcatgtttaaggtgtttgggacacatcaaagaacaaaagagaccaaaatctttgcatttttgatcttctaattca

SEQ ID NO: 31143 - DNA, 201 bp, Homo sapiens
tttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaatt

SEQ ID NO: 31144 - DNA, 201 bp, Homo sapiens
ggtgatgacctagcggagagttcttgcagttgctaaatgccttggcaggcatcacatagctagtgagtagcagctccaagactggaatcaaggttttctamgacagaatttagaaagtgactgcaagtcactgtaaggcttgctgaagcatgaccagaaaatgggatgcttttattaactaaatgatagttagacatttgt

SEQ ID NO: 31145 - DNA, 201 bp, Homo sapiens
ttattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaattt

SEQ ID NO: 31146 - DNA, 201 bp, Homo sapiens
agatattcatttcctgtcatcataagttgcaaacctttttaccagtttattggtttgggaaagaatttgaaaggatttttgtagtagttgaattggtaaattttttttttggctttacagcataaaacaaatctcccctactcaagattatattattttctacttcttttataaaccatctcttttataaaccatacacac

SEQ ID NO: 31147 - DNA, 201 bp, Homo sapiens
tattttttcattttttgcctttctttagattaatatttattaacaagcttctattagcttgtgagttattcattcttttattactccttcagtgtttacactagagattataatatcgttaatttattagtatctaccttaaatgaatacttttatatttttctggaaatgcgagtctgtttatataatactttaaattta

SEQ ID NO: 31148 - DNA, 201 bp, Homo sapiens
ttaaatgtattggacataatgtaagaaaagatatagaggttctagatgatgttatcttcttccacaaaacattaattttattctggtaggtaggtagcatmcaggcacatcattgtcatctcattgaggcttatttgtctccatattgcccttcctagtaggtataactcttctgaggtctcatgtgaatacctgcagttt

SEQ ID NO: 31149 - DNA, 201 bp, Homo sapiens
acatttttacctaaataaattactataataatgatacatgtatatatataagaatattaagaaggacccagtgtctggattttattctttggatttgtaayaaagtctttagtgtaggtgaagagaaaaactttttaaaattaatacagtggcagcttatgtctatgatcatatatagattattatttaatgtcaggtaat

SEQ ID NO: 31150 - DNA, 201 bp, Homo sapiens
cagtatattgcatgcaagcccatcacatcctatgatttggttgctcttcagcgacttcaaataatcttctacttaaactagtttttatagttattctcagygaaagtttagttcagtaccagcgtctctatcataacctggaactgaagtcccccatgagaaactaacttttggtggcacgtaacatcgtattgtgtgttc

SEQ ID NO: 31151 - DNA, 201 bp, Homo sapiens
actaggtaatgaaatccttataagcaaaaaccatagtatcgtttctgtttttttgggacgggcagggaggatactgtttctccatgcaatctttgaatgcsaacatgcttaataaatattgatggacagaagtgacttaatttttatcaaactcttcacagttttatgaatgcatcatttgttttgtctttataaatatta

SEQ ID NO: 31152 - DNA, 201 bp, Homo sapiens
gtgtatcactcacccactaggtaatgaaatccttataagcaaaaaccatagtatcgtttctgtttttttgggacgggcagggaggatactgtttctccatscaatctttgaatgcgaacatgcttaataaatattgatggacagaagtgacttaatttttatcaaactcttcacagttttatgaatgcatcatttgttttg

SEQ ID NO: 31153 - DNA, 201 bp, Homo sapiens
tgttttaccatttcctttgtctttctatataaatgttaaaatattcttgtctatatctacaaaaaatttcaccggggtttcgataagaattgtagcaaaayttgtgtatcaatttgggttgaattggcatctttattattttgtcttccaatgcgtgaacactgtagcaggtgtttttgatttggcttactgtaacattgt

SEQ ID NO: 31154 - DNA, 201 bp, Homo sapiens
tgtgtatcactcacccactaggtaatgaaatccttataagcaaaaaccatagtatcgtttctgtttttttgggacgggcagggaggatactgtttctccawgcaatctttgaatgcgaacatgcttaataaatattgatggacagaagtgacttaatttttatcaaactcttcacagttttatgaatgcatcatttgtttt

SEQ ID NO: 31155 - DNA, 201 bp, Homo sapiens
atggatgcctgaaccctaggcagtggcgacaggaagagagaaggcaggcagctgggagagcaggcccggagcctctgtttggaagggccagtggggcaggygagctggcctgactcccttcttcgagtcctccatttcgacctctgtgcctttgcacagatacatctggctttacagatagaggtgttcctggaaaaggaa

SEQ ID NO: 31156 - DNA, 201 bp, Homo sapiens
taatcccagctacttgggaggctgaggcaggagaatcgcttgaacctgggaggcaaaagttgcagcgagcagagatcatgccactacactccagcacgggygacagagcgagactccatctcaaaaaaaaaaaaaaaaaacaaaaactcatctgttagtataactaatgctccaggaagctgccacatatttacctcagga

SEQ ID NO: 31157 - DNA, 201 bp, Homo sapiens
aatcgcttgaacctgggaggcaaaagttgcagcgagcagagatcatgccactacactccagcacgggtgacagagcgagactccatctcaaaaaaaaaaamaaaaaacaaaaactcatctgttagtataactaatgctccaggaagctgccacatatttacctcaggacctatttctatcttcgccccaccgcacgctgaa

SEQ ID NO: 31158 - DNA, 201 bp, Homo sapiens
gcctttaactgacatttttcttccaacctgctcctaggtaagccagttgagaaaaaaatacatgtaatggtaacattgcactggagcaaaaatcttcctgyatctcttaatatttggcataattgcagcaactctagtagaattccctttttcagaaaagaagttatcaatgtaagaaaagttcaatgatgggtggaggaa

SEQ ID NO: 31159 - DNA, 201 bp, Homo sapiens
tacatttgccctgacttttgcaaaaatgggttggttatgagaatttcctcaaaaaagtctttactgtgttatgattgaagcaaatatgtaaattaattctkcttcaccatcatttatttttactttgagctttaagtggttttgctgactccattttctggcttttggtgtataaaatgaacttccctttactgtttttag

SEQ ID NO: 31160 - DNA, 201 bp, Homo sapiens
agaagaatcaaatagatgcaataaaaaatgacaaaggggatatcaccatcaatcccacagaaatacaaactaccatcagagaatactataaacacctctayccaaataaactagaaaatctagaagaaatggataaattcctcgacacatacaccctcccaagactaaaccaggaagaagttgaatccctgaatagaccaa

SEQ ID NO: 31161 - DNA, 201 bp, Homo sapiens
ctcccaaagtgctgggattacaggcgtgagccaccgtgcctggcctgctatccttttatagtcacacacttcctccttagtgccaccatccctagcccacrggagccactgttttgttctccatctctgtaattttgtcattttgacaatgtaattgtattagtccgttcttgcactgctgtaaagaaatacctgagactg

SEQ ID NO: 31162 - DNA, 201 bp, Homo sapiens
tcagctgaatcacagtgattgttgtctgtctgctggatctagccacctggtgagtctacccagatccaggctggtactgggggttgtctgcacagagtccyatgatgtgaaccttctatgagtctctcagctgtggatacaagtgtctgtcctggtgcaggtggtgcgagtgtgcaatggactccataagggttctttgct

SEQ ID NO: 31163 - DNA, 201 bp, Homo sapiens
aaagactatattttctccattgtattaggtctgtgatccattttgagttaatttttatgaagggcgtggtctgtgtctagattctttatatatatatatawatggatatccagtcttttcagtactatttggggagaatgtccattgacttactgattctttgttagagatcaatgtgctatatttgtgtgggtctatttc

SEQ ID NO: 31164 - DNA, 201 bp, Homo sapiens
ttgctcacgtgcacaaggaaacatacataagagtatttgttgcagtattgatgggagaaagaattggaaatagcagcagactgcagaagaaattgagctayagtcatgcagcggatgactctgagcaataaaaatgaatgggccacaggagtccacatccacatggattaatctcaaaaatataatattgcatcaccaaaa

SEQ ID NO: 31165 - DNA, 201 bp, Homo sapiens
ggatgtatttttcacaatactgaaataagcccatatttcatatgatcagtctgtttaccagttagacaggcttagaaggatatcataatatactgtacttyattacagaagaactccagagagtatctggggtaaactatgataatatttggtctcaaggaagatgtgtttggtggggtcaaacatgcaggccttccagtc

SEQ ID NO: 31166 - DNA, 201 bp, Homo sapiens
caggtgatccaccagccttggcctcccagaatgctggcattacaggcatgagccactgtgcccagccaacaaatttaaataacatactgtgtaggtctacrtaaatttgtggtaaaattataaagaaaaacaggagaatgttgtggagagacacagaaagctccaaaattactcataatattgtattcttcaacctggttg

SEQ ID NO: 31167 - DNA, 201 bp, Homo sapiens
ctcagcctctcaagtagctgggactacaggcgcgtgccaccacacccggctaatttttgtatttttagtagagatagggttttgccatgttggccaggctrgtctcgaactcctggcctcaagtgatccgcccaccttggccttccaaagttctgagattacaggtgtgagccaccgcacccggcctgcccctacttcaga

SEQ ID NO: 31168 - DNA, 201 bp, Homo sapiens
tagttttagttcagcaacctagttttaattctgactcttatctttttgggtttttaaggaggctccattttgtaggcatggttgattccatcattggccaytggtaatcaagtcaaccttcagcccctctatcctccatggaggtcaagggtggaatgtgttgggggaaggcttaaagttctgaccccccagttgcattgt

SEQ ID NO: 31169 - DNA, 201 bp, Homo sapiens
gagagactgactgtgcttggcattccttttctaattttcctagacacagccactcagtattttaaaaatgcatttttccaggtagctactaccaatcagtrgtacctgaaataaaattgatttgctatcctgatctattcaggataggctaagttatgctttgataagaaaaaaaaaaacccaaatctcaatggctttcaa

SEQ ID NO: 31170 - DNA, 201 bp, Homo sapiens
aactagatcacaaagtctttgtaaggggagttattgaaataatattaatgggtacagtttttttaggggaggggaataagggagtgatataaataaaatgrtgtttgagaaattgtacttataggccaggcatggtggcttacgcctataatcccagcagtttgggagactgagatggaaggattgcttgaggctaggagt

SEQ ID NO: 31171 - DNA, 201 bp, Homo sapiens
tggctccactgcacttcagcctgggtgaaagagaaagaccctgtctccaaaaaaagtaaaataaaaataacaaaagaagaaaccgtacttcagtgtttggaaaaaaaaaaatgagtcaggaaagtcagaaggaggaaggattactttttgcagtaattttgatcataatgcagtgaaaaatctgatctagattggtacaaa

SEQ ID NO: 31172 - DNA, 201 bp, Homo sapiens
gaacgggcagactgcctcctcaagtgggtccctgacccctgacccccgagcagcctaactgggaggcacccctccagcaggggcacactgacacctcacayggcagggtattccaacagacctgcagctgagggtcctgtctgttagaaggaaaactaacaaacagaaaggacatccacaccaaaaacccatctgtacatc

SEQ ID NO: 31173 - DNA, 201 bp, Homo sapiens
aaatatatttgttatattcacacagtaaacacgctatttagagtgttgatgacgtgctaagcaatgtccaaagtcatggggacagagcagagatcgagacagagtgcaccatctcatggatatttcattctagtagataaagacaggaaataaaccatttagctaataattagtgatgcatgtcatggagataattaaaat

SEQ ID NO: 31174 - DNA, 201 bp, Homo sapiens
tgatgcatgtcatggagataattaaaataagtaaggtgatgggtctgttggattggattggtttattgtagaaggcctctttgctggatagccagaaggamccagtcattggatgcttagagagagaagcattgaatctatgtagaagagatagtgcaaagaccctaaggtgagaatgagtgtggactgttcaaagacaga

SEQ ID NO: 31175 - DNA, 201 bp, Homo sapiens
ggggagaagagagctattcagacagggataggaagatcagtgaggcacctgcttctgactttttttttgagaggaggtgtccctctgtcacccaggctggwtggagtacagtgttatgatcacagctcactgcaacctccgcctcccaggctcaagtgatcctcccacttcagcctcccaagaagctgggaccacaggcgt

SEQ ID NO: 31176 - DNA, 201 bp, Homo sapiens
tccatgaagaggggattggagaagacaagagaatgaagtaactcaatagggatggtagtaaagaaatactttgattcagaagtttcgtcagattggatttragaggtaagagagaaagaggaattaaagagttttggatttgaggacattgttgagatgaggaaggcagaagtcatagagaaaggcagacttattaagagt

SEQ ID NO: 31177 - DNA, 201 bp, Homo sapiens
gtgtgccgctacgcctggctaattttttgtatttttggtggagatggggtttcaccatgttgcccaggctgatcttgaactcctgagctcaagcgacctgmctgccttggcctctcaaagtgctgggattataggcgtgagccactgcacccagcctgcttctgacattttagcctaaggcatgctctgttaatgcctgca

SEQ ID NO: 31178 - DNA, 201 bp, Homo sapiens
ggagatggggtttcaccatgttgcccaggctgatcttgaactcctgagctcaagcgacctgactgccttggcctctcaaagtgctgggattataggcgtgrgccactgcacccagcctgcttctgacattttagcctaaggcatgctctgttaatgcctgcattagtttgcctgagctgtcataacaaagtaccacagact

SEQ ID NO: 31179 - DNA, 201 bp, Homo sapiens
taatacatgtatcacatttacgtttgtttctctttccttttcttcctcttggttttcagatatttggtcttattttctggcaaaaatggtatttttaaatktattggacataatgtaagaaaagatatagaggttctagatgatgttatcttcttccacaaaacattaattttattctggtaggtaggtagcatacaggca

SEQ ID NO: 31180 - DNA, 201 bp, Homo sapiens
gtatgttgatcaatgaaggttaaaaaacactgttaactaaggttttctatttgcagtgttttctgacaaatatttttcctccagattttaagcgtgttatkatgagtcaacctttatgtttgtaaagccttagtcttgttaataatgtataacttccaaatgaatcatatacttatgcatagcacttgaatatgcagattt

SEQ ID NO: 31181 - DNA, 201 bp, Homo sapiens
ggctcctttcatttcagtttaaattttagaattagcttataaatctccacaagatgagctgctggaatttttaatgaaatagcatcaaatctgtagacccrtttgagaagaattaacatcttttcgatattaagactcccaatctatgaacatggtatatctttcttttatatatttagatattttaaaatttctctcagt

SEQ ID NO: 31182 - DNA, 201 bp, Homo sapiens
gtgtaaagcatgcatgtctggcatgtttgcatttgtggattggcaacccttggtacgtgtgccaaacgcagatggttagtgaggtcctggccatctccacrctcctgtgaccaccactcatgaatctcaggagagataaagagagataggatgcaagggcttggctacctgtgcttttctttcctttttctactttccttg

SEQ ID NO: 31183 - DNA, 201 bp, Homo sapiens
aatagctccaaattcatggaaaggcaccctctggttttttgccctttgcacctgctgagtctcaccttttaaaaacctcagacctctcaggaaattccctkccaattacatccatttcatctgcctccaacttaacccattctcagtgtgggggtaactgtattacataacggagttcagattaatttttcttacacataa

SEQ ID NO: 31184 - DNA, 201 bp, Homo sapiens
acttttactctgtaatacattctgatattttgttctttattttattgtagttgattctgtgttattctattatattcatttaaaaaaaaatcctggcccarggcccaaaacattcatttccagatcttttaatgggaaacaaacccagagtttgagagtttgaaacacattgattggtgctggggtagttaagaactgtaa

SEQ ID NO: 31185 - DNA, 201 bp, Homo sapiens
aataggggaccaaccttggcatttctgaaatttatgcatcttcacaactattatttgaggcctcctgtgtgccagaaattgtgcttgagtttcacgccctrtaatgaggtaaacagatgcccatcccggctcttcagacctagtctgtcctgaagacttgctgagattcttgaccgtatgttcatccacagtcatcctggg

SEQ ID NO: 31186 - DNA, 201 bp, Homo sapiens
gtaatgaggtaaacagatgcccatcccggctcttcagacctagtctgtcctgaagacttgctgagattcttgaccgtatgttcatccacagtcatcctggrtacttcatgtcagtctaaaagaactgttaggatttatgttcgtcatttcctccacattatatatccagccttgggagaaatcagggtcgaagacagatgg

SEQ ID NO: 31187 - DNA, 201 bp, Homo sapiens
caattgggagtataatgtgatggtttgatgcagaataagcttgaacaatatttaggcactgaagtcttctcagtttctaaaaagtactctgcaactcacaytgagagtttcactgtaaaagagtattcctaatatattgggagcgttcacatataagttcagtgattgacttctttgaaaaggccatggtttgtgttgaca

SEQ ID NO: 31188 - DNA, 201 bp, Homo sapiens
tgcagcctcaacttcccaagcacaggtgattctcccacctgagcctcccaagtagctgggactacaagcacgtgctaccatatctggctaattttttgtattttttttttttttgtagaggtgtggttttgccatgttgcctaggctggtcctgaacacctgagctcaagcaatcaggccacctcccctcccaaagtgctg

SEQ ID NO: 31189 - DNA, 201 bp, Homo sapiens
aagaactagtttcttaatagcacaaactacctttaaatatcataaaatctgatagaatttttttctctcaaaacaacgtttacgatcctatttttcaaaayatatttacttaccaagtaataggcatgagaatttacccttaaccatagaaatgtttctctgattcagagacttaagctagtttctgaagggttagccagc

SEQ ID NO: 31190 - DNA, 201 bp, Homo sapiens
atgcaggcattgtgcttggtgctggcataggaagattaagatgcagttcctgaactcaggagggcggagtttcatgcatggactctagtaatccaaggatrgcctgcaagactccattctttgatgttatatccaaaattatttatcagcatatagatttttaaaatcagattatcaatgagatgtgtgtccaggaagatg

SEQ ID NO: 31191 - DNA, 201 bp, Homo sapiens
tcatatgcatgcctctgttaaattattcaacacatatctaaatgtgctcaatgttatttttcctgatcaaattatgaacagtgcaattcctagagtcttttttttttttttcatttcatttcatagttctacataggttttggcctaaatgagaaactgagagtaaatctccgcttaaatccttaaaatgctattgccttt

SEQ ID NO: 31192 - DNA, 201 bp, Homo sapiens
agttcaaagttacaaaatagtaggggctggatctaagtatattatccctgagtggtgggttatactgccggctaataaaaagttttatactttgacatgtkctgctaagttttattgtgggttgtaaatgtttaatatcctcctaggggcttttaggagaatatgttttcacagcacatgtggtgctgttatactccgaac

SEQ ID NO: 31193 - DNA, 201 bp, Homo sapiens
ctaagttttattgtgggttgtaaatgtttaatatcctcctaggggcttttaggagaatatgttttcacagcacatgtggtgctgttatactccgaaccaawctaatgggctttaattatgccaaggtctgtggatcccggagatgctgacaaattcataatgtgttttaaattgctaggatggaaagtacaaatcaaaagt

SEQ ID NO: 31194 - DNA, 201 bp, Homo sapiens
ccagactggagtgcagtggtgcaatgtcagctcactgcaacctctgcctctcgggttcaagtgattctcctgcctcagcctcccaagtagctgggattacrggtgcacgccaccactcctggctaatttttgtatttttagtagagacggggtttcaccatgttggccaggctggtcttgaactccttaccttaggtgatc

SEQ ID NO: 31195 - DNA, 201 bp, Homo sapiens
ggtttcaccatgttggccaggctggtcttgaactccttaccttaggtgatctgcctgccttggcctcccaaagtgctgggattacaggcatgagccactgygcccagctggttatcctttaaaatttaatattttaaaatagttatgtttatactacctgaaaaccttgtgaattcattatattaaatatacatatgtacc

SEQ ID NO: 31196 - DNA, 201 bp, Homo sapiens
agatcaggagccctagacttgcctgtaagctcatcccatttttggcaagtcccttcagcttcttttgttttctgagttctgaagtgacaataataattctrtttcctcatccattataactgaacatcatataaaatatgcaaattacactgaaaatacagaaagagctacacaaatgtaaattgctcttaaagaggaaaa

SEQ ID NO: 31197 - DNA, 201 bp, Homo sapiens
gattgccaccctatgctaacctagtctaagctaccattgtttcccacctgaaattataatatcctcccaacagatccaattgaaatacaccctagatactytcttttctattgtttttttttgcctttttaaaaattgtacaaatttacagggtacatgtgcaattttgttacatgcataaagtaacaaaagtcaagactt

SEQ ID NO: 31198 - DNA, 201 bp, Homo sapiens
tcaaggagttcctgatctgggatgggtggactcaatctcgcttctcgattctctcttctctcttcttcttcctcttcctcttcttctttttttttctttcctctctctctctctctctctcagagtctcactctttcacccaagctggagtgcagtggtgtgatctcggctcaatgcaacctccacttcccagattcaagt

SEQ ID NO: 31199 - DNA, 201 bp, Homo sapiens
tatactgtttctgaataaacttaggggtataaaagtagaaaatatttaccatgcttgctttgaaagaatttaatgattttgaaaaattaaaagtttaaaaktgagtgtataaactaggctgaaagaaaccagaaaagtcacataggagttttatttaaaatgggttgttcaatcaaagaagtgtagaaaacagtagtctaa

SEQ ID NO: 31200 - DNA, 201 bp, Homo sapiens
caaggagttcctgatctgggatgggtggactcaatctcgcttctcgattctctcttctctcttcttcttcctcttcctcttcttctttttttttctttcctctctctctctctctctctcagagtctcactctttcacccaagctggagtgcagtggtgtgatctcggctcaatgcaacctccacttcccagattcaagtg

SEQ ID NO: 31201 - DNA, 201 bp, Homo sapiens
tctcagattcatcctgtatgtcacaactgttacatcacttccctgtttagacattgttcacatttctatatcattctagaagataaagttcaccttgttgycccggtatatgaggccccagttaacccttccagccttctattttcccagttcccttatccctacccccttacttgagccacatcacagtttcctgaactt

SEQ ID NO: 31202 - DNA, 201 bp, Homo sapiens
aggctggagtgcaatgccatgatctcggctcactgcaacatccacctgccagattcaagtgattctcctgcctcagcctcccgagtagctgggattacagrcgtgtgccaccacatctggctaattttagtatttttagtagagacagggttttaccatgttggccaggctggtctcgaactcctgacttcaggtggtcca

SEQ ID NO: 31203 - DNA, 201 bp, Homo sapiens
gtcccagggaaaaataataatccaactggtataagtttatatcaaaccatatggaagtgattttttctggttagtcattttcacggggattagagagtagrgaaaagtcaaagaaccagggattcccaaggacacacttggcctggtcaatattactaggattggcccagatgccaccaaatccttttttcttcctactta

SEQ ID NO: 31204 - DNA, 201 bp, Homo sapiens
ccttctcagaataacagtggattcaaatattctccatttgtcttcagcaagtgctatctaattatacatatcagctgcccttttgcggtcttattaatgakcataataatactttctatggtgctatttctaacttcctgcttattgtatatccttcttttcctgttatacctcatataatttcctttaaaatttttttga

SEQ ID NO: 31205 - DNA, 201 bp, Homo sapiens
tgcctataaaatataaacttcaacatggctttattaatcaaacatctagtacagatttgccaaattattagaatctttaagtctttttttttttttttgamagagtttcactcttgttgcccaccaagctggagtgcaatggtgagatctcatctcactgcaacctccgcctcccaggttcaagcaattttcctgcctcag

SEQ ID NO: 31206 - DNA, 201 bp, Homo sapiens
ttcctcatcggaaaatggcaggaacaaagtttgctttatcactatccccagactgcaaattttatattctattattctacccatttttgaacacagtatcrcacatctgcatctttaccatctggtatacagctaaatacttcagatctcaatgacattcatatatggtaaaatttgtggttaatctctttacctccactc

SEQ ID NO: 31207 - DNA, 201 bp, Homo sapiens
gtctgtggccgaaggcccgtgagcccctggcaaagcactagtgtaaatccaagagtccagaagctgaaggacttggagtctgatgtttgagggcaggaagmacccagcacgggacaaagataaaggccagaagataaaggcaagtcaggttcttctgcctgcctttatcctagccgtgctggcagctgattagatggtgcc

SEQ ID NO: 31208 - DNA, 201 bp, Homo sapiens
agaccctttcccccatcccccagtatttggcttatatgattgatcttttgtatctcttccgaagtaagtaaaccaaactatcacatattcacattcctacmtgggtaagtttgtggtttgctaacatatgatctcatctgagatttttaaatatcagaacaatatcatggttttggtgttggttgattaaatccaattaat

SEQ ID NO: 31209 - DNA, 201 bp, Homo sapiens
tctaggctctctattctgttccactgacctgtttgtctgttctttcaccaataccacactgtgttgaatactgtagctttatagtaagtcctgaaatcagrtagtgtcagtctcccaacttcgttcttctccttcaatattgtgttggctcttctatgtctttcacttctcatataaactttagaatcagtttgttaatat

SEQ ID NO: 31210 - DNA, 201 bp, Homo sapiens
ggggctaggggagggatagcattaagagaaatacctaatgtagatgacgggttgatgggtgcagcaaaccattgtggcacgtgtatacctatgtaacaaayctgcacgttctgcacatgtaccccagaacttaaagtataataaaaaatttaaaagaagaagaagaagtaaccagttgtaaggtcctgaagttttcctaat

SEQ ID NO: 31211 - DNA, 201 bp, Homo sapiens
cccagtgaatccctgacattctgattgggacgcttgggattagcctgctgcccggggcttccggtagtggtgcggggcaggggtggttctaaagaaacaaratgaaatttacaaagatctaaattctttaggcaatggagtcattattctgcgtattctaagtttaagtttatttctcaaccattctgttactgaaaaaaa

SEQ ID NO: 31212 - DNA, 201 bp, Homo sapiens
catagactctgtgaccttgtttacacccctcttttaagaagaagggcctggtctgtctcttcctttcaccagcaaccagatgttgctggtctgtctctaamctctctgtattgcgttcttttaattcttggtccggtctgtcccttcttttcacctctgatgtcgctgattctgtctagttagcgggctacaacttgggag

SEQ ID NO: 31213 - DNA, 201 bp, Homo sapiens
atttgaccatgctaatcaaaaagtagaagagcttttcgaaattcaggaaaaaaggttgaacttaattttgcaattgtaaagttgaggttccaggcacacawtggagtgaatagagtagatagttttattaggctggcttggtgaccttggacatctttcttaaattatttgagctcagtttctgcatctataaaatggggt

SEQ ID NO: 31214 - DNA, 201 bp, Homo sapiens
atgtcgctgattctgtctagttagcgggctacaacttgggagagagatcttgatattatatttttcattattctgaatctattaacatgcattacttttawaattgaaaaaagtagttaacatatatctctaatgccagataattgatagcaaaagtaaaaactgaatgtactaattacagttgagtaaaaaaaaaaaaaa

SEQ ID NO: 31215 - DNA, 201 bp, Homo sapiens
ctaatagaatttgtagatgaatggaattcaggatctcaaggagactgagaatgaatgattgatttaaaattttagtttggacaatttgaccatgctaatcraaaagtagaagagcttttcgaaattcaggaaaaaaggttgaacttaattttgcaattgtaaagttgaggttccaggcacacattggagtgaatagagtag

SEQ ID NO: 31216 - DNA, 201 bp, Homo sapiens
aaaggtggtgaaggttttctcttggcatttatttatatatgtattaatcttacatatagatagaaaggagaatcatttcatccattcaagagccatgaactttatatgaatgtcatttcaacaataaagcaaaaactacagactgtctaaggaaaactccgttttattatttggtttgttacttaccaaaacatacaattt

SEQ ID NO: 31217 - DNA, 201 bp, Homo sapiens
aaggtggtgaaggttttctcttggcatttatttatatatgtattaatcttacatatagatagaaaggagaatcatttcatccattcaagagccatgaactttatatgaatgtcatttcaacaataaagcaaaaactacagactgtctaaggaaaactccgttttattatttggtttgttacttaccaaaacatacaattta

SEQ ID NO: 31218 - DNA, 201 bp, Homo sapiens
gcagtgactcaccattgccagaacgagtacgtgttaaattgaattgcagtctggttggaggcagctgtggtgtggctcagcaaatgtggtcttacatttcyttttaaactataagacatttgctacatacaaaagaatgtatgttatgcatatgtagattatgtgagatgaaactccctggggtttatttatttatttatt

SEQ ID NO: 31219 - DNA, 201 bp, Homo sapiens
acatttatatattagtgcaaatgaagagaatctcttcccataatctacaaggtaattttagtgggagatggggtgtttccactggatagaattatgagagtttttttaatgtttttgagttcttatgattttctttttgtgttatagtgagcatcaatttcatgaccagaaaagggtaacaaatacaactttatattgaat

SEQ ID NO: 31220 - DNA, 201 bp, Homo sapiens
ttctttacatacatattttggaatatatgatacaaaggtatttcaataaaactatgagggcctagaagatgttggtttggactcagtctgcaaactctgamcatagcctacagaaatgttggcaatacatgaaaaattatgtcttaactacaattttactaatgctgcattaataagcagaagagtttgtatatagataag

SEQ ID NO: 31221 - DNA, 201 bp, Homo sapiens
ttatcatgaataggctaacatgtaggatatttcctacatacgtaataaacacacacacgtgtgtgtgtgtgtgtgtgtgtgtgtggtgttaattttttttwaaaaaaaaaaaccttttttgaggaaagagtgaaaatgtgctccaaagtaattcgtggctagaggaactgcaacagtgtttcaaatatttccatttatatg

SEQ ID NO: 31222 - DNA, 201 bp, Homo sapiens
tacagaaatgttggcaatacatgaaaaattatgtcttaactacaattttactaatgctgcattaataagcagaagagtttgtatatagataaggaaatgaytgacaaactgagaagagaaagaaaatacttactaggactagattattaaataatcatataggtagctgataggattaataccatttaataattttctatc

SEQ ID NO: 31223 - DNA, 201 bp, Homo sapiens
caattttactaatgctgcattaataagcagaagagtttgtatatagataaggaaatgattgacaaactgagaagagaaagaaaatacttactaggactagrttattaaataatcatataggtagctgataggattaataccatttaataattttctatctgtttaccatcctaaaaattaatccaaagaagtcttgtgttc

SEQ ID NO: 31224 - DNA, 201 bp, Homo sapiens
attgtatgcacatcaacaatggctccctctcaagatatatgtgagctgatgtgatgtaagccaacattagaattagagaggtatgatggaatggttcatcmaatgagtgtaccttctagttttgcactgacacgtctgagtcatttgaattttaaaataattgtaaaaatcagatgaattggcctatctacttaatattaa

SEQ ID NO: 31225 - DNA, 201 bp, Homo sapiens
attaaataatcatataggtagctgataggattaataccatttaataattttctatctgtttaccatcctaaaaattaatccaaagaagtcttgtgttcagycacaaaatgtaaattttactgtggcctaaaggtaatctatgtgcctgttaaacatcaaatacatgagttcatgtatttttatccttggattggtcaatga

SEQ ID NO: 31226 - DNA, 201 bp, Homo sapiens
ctcctgatatcagctttgacttttttcgtgtgggttttagttttcatgatttaagttgtctttgtggcattaaaaaaccacagaagtagatttgttaaggrtgtaaccaaaaagagctagaaggaactttagaaataattttacgtcgtctgctgttttcatcttgaagaatttggggcatgaaaggttagataacctaac

SEQ ID NO: 31227 - DNA, 201 bp, Homo sapiens
ttgtctttgtggcattaaaaaaccacagaagtagatttgttaagggtgtaaccaaaaagagctagaaggaactttagaaataattttacgtcgtctgctgktttcatcttgaagaatttggggcatgaaaggttagataacctaacaagaattagtccttttaatggtagaatcaagccttatttgggccttctgagtttc

SEQ ID NO: 31228 - DNA, 201 bp, Homo sapiens
ttaactaacttccttttagttaggtactccagggtactactttttgtgatggcagacacacttaagctatttgtaaatgtgtcaccaccttttcaaataattttcattgaaggttaacatgttttctctgagaaaaatttatttaattaaaaaccttatgtatataagggctacaataaaattttcatggactctgagatg

SEQ ID NO: 31229 - DNA, 201 bp, Homo sapiens
ctcacatcccagacaatgggcggccgggcagagacgctcctcacttcctagataggatggcggctgggcagaggtgctcctcacttcctaggtgggatggyggccgggcggagacgctcctcactttccagactgggcagccaggcagaggggctcctcacatcccagacgatgggcggccaggcagagatgctcctcact

SEQ ID NO: 31230 - DNA, 201 bp, Homo sapiens
tagccacattagtgtttcaccgtccattccccatgggccactccgtcctcgtgtcccagcccagtctctcctcctccctatgcttcttcagcttccttggmcttctctctgcctcttgaatgtgttagattcctttctgcccagggtttttgcacatgctgtaattatcgcctgagtaaaggaccctcacacataattact

SEQ ID NO: 31231 - DNA, 201 bp, Homo sapiens
attcacacctgtaatcccagtactttgggaggctgaggtaggtggatcatgaggtcaggagttcgagaccagcctgaccatcatggcataaccccatcttyactaaaaatacaaaaattagccaggcgtggtggtgtgcacctgtaatcccagttactcaggaggctgaggcaggagaattgcttgaacccagtgagctga

SEQ ID NO: 31232 - DNA, 201 bp, Homo sapiens
cttcagttattcccacaattagtataactacatgcagtgactgttccctggcagggaggagagaacagaacatacaggtggctgacctgagggaattaaargacagaggttgagggaagctctgctgaaactcgatgttacattttgatccactgcctgttcttgagccatttatttatagcccaaatctcttatttgtgt

SEQ ID NO: 31233 - DNA, 201 bp, Homo sapiens
ataatctgccttcagttattcccacaattagtataactacatgcagtgactgttccctggcagggaggagagaacagaacatacaggtggctgacctgagrgaattaaaggacagaggttgagggaagctctgctgaaactcgatgttacattttgatccactgcctgttcttgagccatttatttatagcccaaatctct

SEQ ID NO: 31234 - DNA, 201 bp, Homo sapiens
tgcaaatccttacaattctctgggattcacattctaaagaagagtgtttgatatcttttaaatgtatcatagcactaatactgtatgagttattcctttamggtatctaatattatatattagaaagcaatattatccttttttacttattgaaacgataaatatttttgttcatttaaggctatggcagaaatgatggct

SEQ ID NO: 31235 - DNA, 201 bp, Homo sapiens
ggccacaagtctatttataacttgccattattttcacccaaaggttctttaagcataaaccaatattatttgaaatattaacatagattgtcgtttctccrttacttgccttatagcattttcttttttgactgtcatcttgttaaacctcttcgtctttttttatgttactgatttcctatgtgattataaagcaatttt

SEQ ID NO: 31236 - DNA, 201 bp, Homo sapiens
gtacttgatctctgtttgcctcattaaatgtgaattcttattgttactattgttatgtcaatatttctgtggagggcatttattgagagcatctcattagyggtaaatgaaagagtatatttgtgtttgtagcactttggcctgtaggtgggaaagaaagaatatttctataagcctcagaaatggggagcaatatacacc

SEQ ID NO: 31237 - DNA, 201 bp, Homo sapiens
tctaaagatgtacctttgtgtacttgatctctgtttgcctcattaaatgtgaattcttattgttactattgttatgtcaatatttctgtggagggcatttrttgagagcatctcattagcggtaaatgaaagagtatatttgtgtttgtagcactttggcctgtaggtgggaaagaaagaatatttctataagcctcagaa

SEQ ID NO: 31238 - DNA, 201 bp, Homo sapiens
gaggaagggctatggaatttcaccacttgggcttaaatcctggtagtgctactttctaaagatgtacctttgtgtacttgatctctgtttgcctcattaartgtgaattcttattgttactattgttatgtcaatatttctgtggagggcatttattgagagcatctcattagcggtaaatgaaagagtatatttgtgttt

SEQ ID NO: 31239 - DNA, 201 bp, Homo sapiens
acttatactactttcagtaacttgttcctaagaaaactgtaatacctcgatgagtcatatttagcttattttctccattatatgtcctctgtcacaagatsccatttcgtgggctgtatttcagcttgtattttcttttctacgtaaaagctctaggatgataatgtcattaccactttttacatgcacctctggtgtatc

SEQ ID NO: 31240 - DNA, 201 bp, Homo sapiens
gttttcctaatgaaaacagtacatcatgttcgtttgctacagctagtttgtctatagggctttcttctcatttccagtgggatctgagggttgattcttasgaaagagtagggtgttcagacagtcatgatccagatttagaaggcacaagggcgctcctgtctgcagagggaaggtatacagccacacaggcagagcaag

SEQ ID NO: 31241 - DNA, 201 bp, Homo sapiens
gagtctgttccattccttatgatatttatgtagatcctgaaaattatggctctcaggcctaaacccagtttattgtgactttacatatatgtaagttaatytgggctattaatagatgcctttcaagtatgagccttcggtttgctgtacttaatatttttttaaagtatacaataacaacattgtgcaataaagtttgca

SEQ ID NO: 31242 - DNA, 201 bp, Homo sapiens
acaaaatgaaactcgaaaagcaaaaagatatagtacctttaaaggggcaagagtaagatttgcagttgatttcaactcagaaacaatgggagacatgggaygtaagcttaaaagtgcttaaagaaaatatctggcaatctaaaattttatatccggtaacacagtgatactttatttaatttactttgggacagggccttg

SEQ ID NO: 31243 - DNA, 201 bp, Homo sapiens
acttaatatttttttaaagtatacaataacaacattgtgcaataaagtttgcataatattatcagaggcattcgagccagagcgactccattttgagtgarggctaggaaaatgaggccgggacttgctgagactccatcttgactgagggctaggaaaatgaggccgggacttgctgagactccatcttgactgagggct

SEQ ID NO: 31244 - DNA, 201 bp, Homo sapiens
ttgagtgaaggctaggaaaatgaggccgggacttgctgagactccatcttgactgagggctaggaaaatgaggccgggacttgctgagactccatcttgastgagggctaggaaaatgaggccggaacttgctgcgctgcattctcataaagtcaggcattcctaccctctagatgtttattatggttaagggaaaaaatt

SEQ ID NO: 31245 - DNA, 201 bp, Homo sapiens
aggccgggacttgctgagactccatcttgactgagggctaggaaaatgaggccgggacttgctgagactccatcttgactgagggctaggaaaatgaggcyggaacttgctgcgctgcattctcataaagtcaggcattcctaccctctagatgtttattatggttaagggaaaaaattaataatgtttaaacagacccag

SEQ ID NO: 31246 - DNA, 201 bp, Homo sapiens
gacttgctgagactccatcttgactgagggctaggaaaatgaggccgggacttgctgagactccatcttgactgagggctaggaaaatgaggccggaactygctgcgctgcattctcataaagtcaggcattcctaccctctagatgtttattatggttaagggaaaaaattaataatgtttaaacagacccagacttagg

SEQ ID NO: 31247 - DNA, 201 bp, Homo sapiens
ctagggtcttcctcagacatttttatcatatttatttccaagctagagtatgcctcagaataataatgaaagaaggaggggttcagaaaacttgaggaacragcacataatcttgcagctcttggcccagactgatttggccgccctgtctgaggcagtaattgtgggtggatgaatacagcaggcactgctggtaattgc

SEQ ID NO: 31248 - DNA, 201 bp, Homo sapiens
caggcgccatggagcagggggcggcgcttgtcggggaggctcggacacgcaggagcccatggccggggggaggctcgggcatggcaggctgcaggtcccgwgccctgccctgcggggaggcagctgaggcccggcgagaatttgagcacagcaccggtgggctggcactgctgggggacctggtgcaccctctgcagctgc

SEQ ID NO: 31249 - DNA, 201 bp, Homo sapiens
aggtcccgtgccctgccctgcggggaggcagctgaggcccggcgagaatttgagcacagcaccggtgggctggcactgctgggggacctggtgcaccctcygcagctgctgccgcaggtgctaagcccctcactgcccggggccggcagtgccagccagccactccgagtgcgggacccgccgagcccacgctcaccagca

SEQ ID NO: 31250 - DNA, 201 bp, Homo sapiens
attctgcacatgtatcccagaacttcaagtaaaaaaaaaaaaatatatatatatatatatatatatacacacacacacatatatatatatatacacacacwtatatatatatgtgcatgtggtatggttattgtaaacacaagtttattgaaaaaggcagcatgggagaatagaaagattttgggttttgaagccagctag

SEQ ID NO: 31251 - DNA, 201 bp, Homo sapiens
tgccctgcggggaggcagctgaggcccggcgagaatttgagcacagcaccggtgggctggcactgctgggggacctggtgcaccctctgcagctgctgccscaggtgctaagcccctcactgcccggggccggcagtgccagccagccactccgagtgcgggacccgccgagcccacgctcaccagcacaagcgccacgcg

SEQ ID NO: 31252 - DNA, 201 bp, Homo sapiens
cagttatagatagtctgggggatgtgtatgtgtagcattttttttttgcagggatagttgttgaaggttataaactataatcaataaatcttttttttttaattttcccaataattttgcagacaatctgcaaaaccgttattttaggccacaggtagaaaatgagcaacataaatttagatgatgcttctctgaattgtt

SEQ ID NO: 31253 - DNA, 201 bp, Homo sapiens
gttaatgggtacaaaaatacagtttcatagaaggaataaattctggtattcaatagcacaatagggtgactataactaacaataatttattatatatttcmtaatagccagaagagaagatttggaatgtgcccaatgcaaagacatgataaatgtttgagataatgtacatcccaactaccctgatttcatcattataca

SEQ ID NO: 31254 - DNA, 201 bp, Homo sapiens
atactcatttttacatggagaacggtctgagtatgacataaaactcaggatctatgaaagcataaacattatttgaaaaaagagcaactataaataaagtygtaaaggcaaatggtaaactgggaaagatatatttaacaccataacaaagggccattttccttaatctaccaagtccttatcacatcaataagaaataag

SEQ ID NO: 31255 - DNA, 201 bp, Homo sapiens
aggcaggagaatctcttgaacccaggaggcagaggttccagtgagccgagatcatgccgttgcactccagcctgggcaacaagagtgaaactccatctcaraaaataataataataataatgagtaaaagcaaatatagaaattggaactaattaatagttattttggtacaggatgaagtatagtctatggggcgtttat

SEQ ID NO: 31256 - DNA, 201 bp, Homo sapiens
gaatgaccagtattacaaagactaacaattaagataattttatactaaagaatgacaactcagtgggacagagtagttcagaaacagatgcaaatactcayggaaattaaaagatgataaagatcttttgaagtaatgaaatgaaaaataatttaataaatgacattagtaccatggacaagctatttggggggaaatgat

SEQ ID NO: 31257 - DNA, 201 bp, Homo sapiens
aggatatttattcttttaggctgatctttgcctaaaagagaatggttcataatatcagcatagattttcttgcagaaatataaacacttaattctgttgakatgttttgattaattattcctgattcctaattgtggatatttactgtatgttctgtatatgaatgaattttcatctgtgtctctatatttcagaaattag

SEQ ID NO: 31258 - DNA, 201 bp, Homo sapiens
agagaaaaaagctatatatatattttttttagtttcaaaggaggttaaatgatgattaagttactggactttatgtacaagccttccttttcctggctagyatagaagaagtaaccagttgtaggacatggatgaagctggaaaccatcattctcagcaaactaacacaggaacagaaaaccaaacaccgcatgttctcac

SEQ ID NO: 31259 - DNA, 201 bp, Homo sapiens
ttctcagacaagccaggtaagaattcatcacggtgatgaatcaactgtttatgttatggattaaataattttttaaatttaattattgagtttttctaaaraataatctgaaaattctgaagagtcacaaaatttagaagggagagaaaaaagctatatatatattttttttagtttcaaaggaggttaaatgatgattaa

SEQ ID NO: 31260 - DNA, 201 bp, Homo sapiens
gttgctaaaggaaattgaccttggtgctatataatgaacaaagcgaggatccctcttactaacattagtaaaactagatctctgctcacactctgcttttyagaattttactttcctttttatatttttaaataagctatgctcatcaaatttttaaaaagtgaaggcagtctattttagagcaaagcgttacttaacatt

SEQ ID NO: 31261 - DNA, 201 bp, Homo sapiens
aaatcttcttatcatgcttaagagtttcttgatgagtgatgacaaagtaataatgtgcttattatgtatagattttcatatattttacttctttgggaaaraaatgagtatcttgacaaatgaagtgaaaaggatttcacttcattgtgagtcacatgtatattacataagctgtcccttttttctgtgtaaggtcctagg

SEQ ID NO: 31262 - DNA, 201 bp, Homo sapiens
gttatgttagcacataaaatatgaatcaatataagatgagcagatagaacattatctgcttgacttttcttatattgttgtgaaaatagaaaaatgtaatwctaaaaaaagaagtcgtgtttaacagttaaaattgaatgagatataagcattcataagctgtgagtaaattattaatatgatttcctgtaaattctgtga

SEQ ID NO: 31263 - DNA, 201 bp, Homo sapiens
tcagttatatttttagttgaaaaattaccctaaatgtttattaataacgacaatcaacctctatataacatcttttacttaggatgtacccagcatgcacygcaaagctgtttctgcgagtagcaagggaatcccttcacccatcactacatctcagcaaggcccagggttaacagctgatgttcagcatgataaaacgca

SEQ ID NO: 31264 - DNA, 201 bp, Homo sapiens
cacaatcaagactctgtacatggaatatctataatagaattaagaaagtatgtcagttatatttttagttgaaaaattaccctaaatgtttattaataackacaatcaacctctatataacatcttttacttaggatgtacccagcatgcactgcaaagctgtttctgcgagtagcaagggaatcccttcacccatcacta

SEQ ID NO: 31265 - DNA, 201 bp, Homo sapiens
taactttattgtactatttggtattaaaattaatacattttagataaggaaagaaataagaaaaattaagaaggcagaaactactcttaaacttaaccacrcattttgatctataacctttacaaatgttcctttaaatatttatcacgtaatacatgcagaaaacattttgcacacctgcatgcgtgcttgcagaataac

SEQ ID NO: 31266 - DNA, 201 bp, Homo sapiens
tgaagtctgaaattgaataaggtactaaagtgaactttctctaatacatgccccctttgaattggtatccttttaataggggtccctttaatttataaaaygatagtaataataataatgattatactaatatcagaaatagataagatgtaccttctaggatactcttaacacaatcaagactctgtacatggaatatct

SEQ ID NO: 31267 - DNA, 201 bp, Homo sapiens
ctaagcccctcactgcccggggccggcagtgccagccagccactccgagtgcgggacccgccgagcccacgctcaccagcacaagcgccacgcgcagctcyggttcctgcccacacctctccctccacacctccctgcaagcagagggagccagctccagcctcggccagcacagagaagggctcccacagtgcagcagca

SEQ ID NO: 31268 - DNA, 201 bp, Homo sapiens
ctggggcatttttgatgccctgtctcaaaaggtaatttaatggtttgtgggtttgtttgtatcaataaaatggtatagagccacacattcttagtaagatrgtattcctagttgaatactatctttgctaaccaagacacgtatggcttgattttttctcttttctcaacttcataacaaatgttgaaaatgcaacttata

SEQ ID NO: 31269 - DNA, 201 bp, Homo sapiens
ttaaatgtgaattcttattgttactattgttatgtcaatatttctgtggagggcatttattgagagcatctcattagcggtaaatgaaagagtatatttgygtttgtagcactttggcctgtaggtgggaaagaaagaatatttctataagcctcagaaatggggagcaatatacaccaaaggccacaagtctatttataa

SEQ ID NO: 31270 - DNA, 201 bp, Homo sapiens
ctctggttcctgcccacacctctccctccacacctccctgcaagcagagggagccagctccagcctcggccagcacagagaagggctcccacagtgcagcrgcaggctgaaacgctcctaaagcatggccagagtgggtgccgaggccgaggaggtgctgagagtgagcgagggctgccagcacgctgtcacctctcagat

SEQ ID NO: 31271 - DNA, 201 bp, Homo sapiens
gtgaaagtgtagccacagaacatctcttcacatcctaacttcacatcctaacttccattctcttcacatcctaacttccattcttattgagcatttgtgatttttttttttgacagaatttattgctggttcaaagggtcactgtgaaagatcatattacaggacatggcccttttttttcctctcctgggtccattcttc

SEQ ID NO: 31272 - DNA, 201 bp, Homo sapiens
ttcctgcccacacctctccctccacacctccctgcaagcagagggagccagctccagcctcggccagcacagagaagggctcccacagtgcagcagcaggmtgaaacgctcctaaagcatggccagagtgggtgccgaggccgaggaggtgctgagagtgagcgagggctgccagcacgctgtcacctctcagattgggag

SEQ ID NO: 31273 - DNA, 201 bp, Homo sapiens
cccacacctctccctccacacctccctgcaagcagagggagccagctccagcctcggccagcacagagaagggctcccacagtgcagcagcaggctgaaasgctcctaaagcatggccagagtgggtgccgaggccgaggaggtgctgagagtgagcgagggctgccagcacgctgtcacctctcagattgggagcgcttt

SEQ ID NO: 31274 - DNA, 201 bp, Homo sapiens
ttcttttgcaacttgtggattaccataccctacctctttcccctccagcccactttacccctttaaatattgaagcccttgaattcaactttggagaaagrcacacaccacagactgtttctgtgattctgtgtcattttcttctgggtgtgtctttaaccttggcaaaataaacttctaaattgattgagtcctgtctca

SEQ ID NO: 31275 - DNA, 201 bp, Homo sapiens
ggaactcctggggtgaagtaacccacctgcctctgcttcccaaagtgttgggattacaggcgcgaaccaccattgtcgggactgaaaaaatctttagaacygtcttttgtgtcttccttaatagtggaagataaaaagtcatagtcatttgggaaaacacttactcttatcatagaagtggctgaaataatactgagaaac

SEQ ID NO: 31276 - DNA, 201 bp, Homo sapiens
cgtaatggcagaatcaaatttagaaactcagcaaaaaaaaaaaaaaagctttgtgtttcaacatgaatttctttttttttttttttttttgagatggagtsttgctctgttgcccaggctggagtgcagtggcacaatctcagctcactgcaagctccacctccagggttcacaccattctcctgcctcagcctcccgagt

SEQ ID NO: 31277 - DNA, 201 bp, Homo sapiens
tataatttgtaatggaatggaaaagtaatggtggtacattctgttattaggtacccttgtccttgaatagaagattatttatatttctaggataaatagargtgaacaatgaaaaatgaaatatgttacactaaataaaattttgttattatccgaattacttaaaattgagaatagtctgcctaataaaccagacgtcaa

SEQ ID NO: 31278 - DNA, 201 bp, Homo sapiens
agctttttgaggagataggtgtcatttcattcatttttatctatttatgaacaatggatagttgattgtttttagtggtaaaaatcatatgaacccgacayttaaagatgtaactaaagaatacatttccatgtgtcatagtgctatcatcttccggatagtgaaattgtatgtccccatgttaatccctttgaaggttat

SEQ ID NO: 31279 - DNA, 201 bp, Homo sapiens
attttttcattgactatacgtggaaacagaaaagttgtcattttattcatcagtttattcaggatgattgtggtcatgtgtcttctttctctgagttcttrtttctttgatgttgtatccatatgaaaatttctgtgatagtatttgtagaagagtacagtgtgtggtcagcaccagtttggcgtaattatcatgtggtca

SEQ ID NO: 31280 - DNA, 201 bp, Homo sapiens
attttgtttgactttttaaatcagaattttgtagttgtctttatttagattttgtacatattttgttagatttgtatttcagcatttaattttttggtatyaagataaataatatttttactttaaatacgtgttgttcattgctggtatagaagaaattgatttttgtgtattaatgtcctgaaactttcctataattgt

SEQ ID NO: 31281 - DNA, 201 bp, Homo sapiens
ttttgtttgactttttaaatcagaattttgtagttgtctttatttagattttgtacatattttgttagatttgtatttcagcatttaattttttggtattwagataaataatatttttactttaaatacgtgttgttcattgctggtatagaagaaattgatttttgtgtattaatgtcctgaaactttcctataattgtc

SEQ ID NO: 31282 - DNA, 201 bp, Homo sapiens
tgtattcagtggagacagctgtctgctgagttaccaaggagggaggatgtgagcctctagggccatccagatttggctctcatcagcaagagaacatgtarttatattttccctgcagagatggggagggagatatgttgagatatgttggattctttggcaggggttgcaggaggttgagtagttggtacagaggtaggt

SEQ ID NO: 31283 - DNA, 201 bp, Homo sapiens
tttgtttgactttttaaatcagaattttgtagttgtctttatttagattttgtacatattttgttagatttgtatttcagcatttaattttttggtattaagataaataatatttttactttaaatacgtgttgttcattgctggtatagaagaaattgatttttgtgtattaatgtcctgaaactttcctataattgtct

SEQ ID NO: 31284 - DNA, 201 bp, Homo sapiens
cattctcaaatgacaggaagttgtaagaatttgactacagcagacctaccctaaaagaatgctaaaggaagttctttaaatataaggaaaatgaaaaatgwaggaaatttggaaaattcagaaaggaagaaattaacactgggtaatgttgtaatatggtgaatgcagtgcatttttattctctggagttttctaatttat

SEQ ID NO: 31285 - DNA, 201 bp, Homo sapiens
accagggagctcttaggttctctcagtagtagaaaatgtatccagagacctctggcccaggaccacactagcaagggtacacctgagggcctcacggacasccttgcatgcccaggaatgaggctgtcattcaaagcctcactgtcactctgcagactgctgtattcagtggagacagctgtctgctgagttaccaaggag

SEQ ID NO: 31286 - DNA, 201 bp, Homo sapiens
ttgtttgactttttaaatcagaattttgtagttgtctttatttagattttgtacatattttgttagatttgtatttcagcatttaattttttggtattaagataaataatatttttactttaaatacgtgttgttcattgctggtatagaagaaattgatttttgtgtattaatgtcctgaaactttcctataattgtcta

SEQ ID NO: 31287 - DNA, 201 bp, Homo sapiens
tcagagcaagcactagaaaagctgtacaaagagatacactgagaagtaccacagataaatcaaaataggattctaaatattgttcaagtaatgcatagcayagcaagtcagtaaaaataaatcagaacaaacggaaccacaggtgaaatgacagactgaagtcatagcatatcaataatctaaatataccaattacaagaa

SEQ ID NO: 31288 - DNA, 201 bp, Homo sapiens
tccagtaaaacactgtaggtctaatatacacaccctcacgagtgatccatactacttgatgtgaaattttacaaaatatattctgcatcctatgaattgtratataacttgtggtacagaagatttctccctttgaaaatataatgtcttagatttggaagaatgaatggaatttggtgctggaataggtcgaatgaacaa

SEQ ID NO: 31289 - DNA, 201 bp, Homo sapiens
cccgagatggtccctcaccaaatagcggatccagtaaaacactgtaggtctaatatacacaccctcacgagtgatccatactacttgatgtgaaattttayaaaatatattctgcatcctatgaattgtaatataacttgtggtacagaagatttctccctttgaaaatataatgtcttagatttggaagaatgaatggaa

SEQ ID NO: 31290 - DNA, 201 bp, Homo sapiens
tgtttgactttttaaatcagaattttgtagttgtctttatttagattttgtacatattttgttagatttgtatttcagcatttaattttttggtattaagwtaaataatatttttactttaaatacgtgttgttcattgctggtatagaagaaattgatttttgtgtattaatgtcctgaaactttcctataattgtctat

SEQ ID NO: 31291 - DNA, 201 bp, Homo sapiens
ttgaaacctctgttgatttctttactatgtattttttgagttatgctcttaattcttatgtactcggggattgcaatatgtgttattttaattcatctaamatcgtaacttcacagtctacttcagaataatactcatttaattccagtaaaagatagaaaacctgctccaacatagcttcatttcctttcccttccttca

SEQ ID NO: 31292 - DNA, 201 bp, Homo sapiens
ttagtgagaatcaatagtttatgcctccataatgctttactctgaaaatttttaatgcaagcaaaatttactgtgtctcatatacttaatgctagcaattmggattacattttggctttattagtatattgttgggttttagttattcttatacataggaaatgattagtataacatttatttgttcagaacttccatata

SEQ ID NO: 31293 - DNA, 201 bp, Homo sapiens
gtttgactttttaaatcagaattttgtagttgtctttatttagattttgtacatattttgttagatttgtatttcagcatttaattttttggtattaagataaataatatttttactttaaatacgtgttgttcattgctggtatagaagaaattgatttttgtgtattaatgtcctgaaactttcctataattgtctatt

SEQ ID NO: 31294 - DNA, 201 bp, Homo sapiens
ttttctcttactgctttaaatacttctatttttgtctgactgtcatgcaaacaatttgactgcagtgtgtctgggtgtggatctctttgtatttatcctayttcaggtttattgtgctacttagatgtgtaaactaatatttttcatcaaattggaagtttggggccattcattatttgtttaaatgcatttttctgaccg

SEQ ID NO: 31295 - DNA, 201 bp, Homo sapiens
tttgactttttaaatcagaattttgtagttgtctttatttagattttgtacatattttgttagatttgtatttcagcatttaattttttggtattaagataaataatatttttactttaaatacgtgttgttcattgctggtatagaagaaattgatttttgtgtattaatgtcctgaaactttcctataattgtctatta

SEQ ID NO: 31296 - DNA, 201 bp, Homo sapiens
tatataccctgacctagttgtttaattacaccatatctaattctatcatcaagattcttcaaccagaaaatattgtatctcctatggaagtggtgactcayctgcagtcagcaaaggaaagccctctgtatttaaatatatctacagcacatccatccagacaggatcacagtattattgccttccagcacttttgctcct

SEQ ID NO: 31297 - DNA, 201 bp, Homo sapiens
tagctcatacactatttttgtcttagttattgctgatccttgttatcatgaataggctaacatgtaggatatttcctacatacgtaataaacacacacacktgtgtgtgtgtgtgtgtgtgtgtgtggtgttaatttttttttaaaaaaaaaaaccttttttgaggaaagagtgaaaatgtgctccaaagtaattcgtggc

SEQ ID NO: 31298 - DNA, 201 bp, Homo sapiens
tatcatgaataggctaacatgtaggatatttcctacatacgtaataaacacacacacgtgtgtgtgtgtgtgtgtgtgtgtgtggtgttaatttttttttwaaaaaaaaaaccttttttgaggaaagagtgaaaatgtgctccaaagtaattcgtggctagaggaactgcaacagtgtttcaaatatttccatttatatgt

SEQ ID NO: 31299 - DNA, 201 bp, Homo sapiens
gattaatcttcagcaggaatatggtgtatctagattctgtggcagtcatgccaatgaagtagaaatatctttgctggcagacagtgatctccaggatatawcagtaaatttaaaaatggtaatttatatagcgtgaacccattaatggaaaaagctaatctatatatttctacatgccatgaatgtttctactgctatgaa

SEQ ID NO: 31300 - DNA, 201 bp, Homo sapiens
cgtgtttatttatgctaactcccacgatctgaaaaaatagctgtagcaggctcattactctgtggaaaaataaaattcatttgacaggattaattcatttraaacccatgtggttttcaaggatctttaaaataacatgagatattacagcaatccttactttaacattttgatctaagcaaaggcatgaaacaatttaaa

SEQ ID NO: 31301 - DNA, 201 bp, Homo sapiens
cttggctaactgcaacctctgcctcctgggttcaaactattctccagcctcagcctcctgagtagctgggattacaggcttgtgccgctgcgtctggctamtttttgtatttttagtagagatggggtttcactatgttggccaggctgaactcaaactcctgacctcaggtgatccgcccacctcggcctcccagagtgc

SEQ ID NO: 31302 - DNA, 201 bp, Homo sapiens
ctatttaatttacctaaaactaaaagcaaatgagattttaaaatcaagttacttcattcaaagatttgaattaatgagacaataaaaagaaaaagctgccyttgtttaccttagtttgttctggcatgaaataagtcagacccatattagccttgggcatcaagttttttttctgacctatgctatctaaaagccctgttc

SEQ ID NO: 31303 - DNA, 201 bp, Homo sapiens
tctttcttttctttttctttttctttttctttttttttttttttttttttttttttttttgagacagtctcgctccatcacccaggctggagtgcagtggkgcattttcggcttactgcaacctctgcttccctgtctcagcctcctgagtagctggaattacaggcatgcaccaagacgcctgattagtttttatatttt

SEQ ID NO: 31304 - DNA, 201 bp, Homo sapiens
gtttctttcttttctttttctttttctttttctttttttttttttttttttttttttttttttgagacagtctcgctccatcacccaggctggagtgcagkggtgcattttcggcttactgcaacctctgcttccctgtctcagcctcctgagtagctggaattacaggcatgcaccaagacgcctgattagtttttatat

SEQ ID NO: 31305 - DNA, 201 bp, Homo sapiens
aagacttagccggcaaattgccactgagttgagatctacaggaggaccagagtgaataggatatggagtatgggaagagcacgccagacagagggaatggygtgtacgaggccaggtgatgtgagtggacagagtgaggaggaggaattggcccaaggccagcaggatgaaacatgcgtagaaatggaaagtgcactttaa

SEQ ID NO: 31306 - DNA, 201 bp, Homo sapiens
caagaaaagctgcaacaaaagcctcctctttctagataaaggatcagggaaggggcagcttagcaagacagaaatgtgttagataataactgcactactgmagccaaaaaccacagaaaaaactgttccccacccacactgggcacaggctgagtggggaaccttgacttccactctcaccaggctgtaacaaggtgtccc

SEQ ID NO: 31307 - DNA, 201 bp, Homo sapiens
actgagtaaaaacaagtcatgaaagtaatgcacaaacatatttgtatgttttaagtctttaatctgaaaataattattgaagccaggtccatttttatatytttagatgttcttggcattttttattttaatatctttaaaatttaacctatgctttggaaaacagtttgtcagttcctcaaaaaataaaattatagcgtt

SEQ ID NO: 31308 - DNA, 201 bp, Homo sapiens
ctttcagtgagaaaaatggaagctatatgagggcaggggttttgttagttttattcattagcatatcatcagtatttaaaccagtacttggtttttccccscctattgttagagggcaataggaaagcagtttgaggatgaagtagtctacagcatgcagttgagggggctctagaggagaagaagagatagaagataatg

SEQ ID NO: 31309 - DNA, 201 bp, Homo sapiens
cctttgctctctaggttttgagacagtgttggagtaattttagtaataaaacattgaatgtattgctagaggtattataagttcaattctatttacaggamaagctaaggattaaaaaaattaagtcatttctacaaagtcacagttaaactgaggaacgggtatatatatatacatatatatatatacacacacacacat

SEQ ID NO: 31310 - DNA, 201 bp, Homo sapiens
agctcactgcaagctctgcctcccgggttcatgccattctcctgcctcagcctcctgagtagctgggactacaggctcctgccaccaccacacctggctattttttttttttttttctatttttagtagagacggggtttcaccatgttggccaggatggtcttgacctcctgacctcgtgatctgcccaccttggcctcc

SEQ ID NO: 31311 - DNA, 201 bp, Homo sapiens
gcctcctgagtagctgggactacaggctcctgccaccaccacacctggctattttttttttttttttctatttttagtagagacggggtttcaccatgttrgccaggatggtcttgacctcctgacctcgtgatctgcccaccttggcctcccaaagtgctgggattacaggcgtgagccaccgcgcccagccctgaaatt

SEQ ID NO: 31312 - DNA, 201 bp, Homo sapiens
tgaaatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattag

SEQ ID NO: 31313 - DNA, 201 bp, Homo sapiens
gaaatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattagt

SEQ ID NO: 31314 - DNA, 201 bp, Homo sapiens
aaatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattagtt

SEQ ID NO: 31315 - DNA, 201 bp, Homo sapiens
aatataggaagtaatttgaaatactgttttaggatttatggtttttttgagatggggtcttgctatatggcccaggctggtcttgagctcctgagctcaaacaatcctcctgcctcagtctctggaatatctaggattacagatgcatgccacagtgtacccagcttctaggatttatgttttcaagacatttattagtta

SEQ ID NO: 31316 - DNA, 201 bp, Homo sapiens
aggtaatgtgaattttcaagaaatcatttctttcctttcagatgaacagtgagtcaaaaagaacctcgtgttgccctgattcccaactctttcataatcarctttctttacgaagccctgttcttttttatttaataattcttctttaatttcttacgtaattcagtaaattaaacaatacttatactatttcatgtccaa

SEQ ID NO: 31317 - DNA, 201 bp, Homo sapiens
tattgtgactattagtaaaataactcatatttttgtggcaccaaaatcattctgaaggatttcatctaagtggattttctaaaatgtctgtttaattaaawtatatatatatatatatatgttaaaagagagacctagatccagtatttatataattacattgactatcatttagcttttattcttattaaaatcatgtca

SEQ ID NO: 31318 - DNA, 201 bp, Homo sapiens
tatcttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgta

SEQ ID NO: 31319 - DNA, 201 bp, Homo sapiens
atcttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgtag

SEQ ID NO: 31320 - DNA, 201 bp, Homo sapiens
tcttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgtagt

SEQ ID NO: 31321 - DNA, 201 bp, Homo sapiens
cttcttaactgactggatgaattataataattcacagactccatttatctgtaaaatgtattggtacccatgacatgcgcctacatacacacacatgcacacacacacacacacacacacgcatgcatgcacgatgttcaggaggtactctattttactgagttaatttttttcattagaaatgtatatattttcgtagta

SEQ ID NO: 31322 - DNA, 201 bp, Homo sapiens
ttactttcctcttcttcggttgcaagatgatgtagtagttctttaaagccaaataaatgaataaaagggggagtactggatagagtcctctagtctaggtrtggaatttcagccaagtggattttcttccctgaaaaacacctgagggattagacccatctctcagtgggatggctcaggatgctgatgattctttgggcg

SEQ ID NO: 31323 - DNA, 201 bp, Homo sapiens
ccatgttggccaggatggttgtctcgatctcctgaccttgtgatctgcctgcctcggcctcccaaagtgctggaattacaggcgtgagccaacacgcccgrccgactttttttttttttttttttgagacaagtctcactctgtcactcaggctgaagtgcagtggcatggtcacagctcactacagcctcagcctcccag

SEQ ID NO: 31324 - DNA, 201 bp, Homo sapiens
cattgtgcatacttctcaatgatcttccctcttcatactttaacttactcctctccttgcccagatcactaaagcggcatgactcagccagcagaattgtyatcatccccaggccttgagcagctagtttgaaaaactgaaatagatctggcctcattgaatgctgttttaggtgaaggaaggtaattttgctctggcagg

SEQ ID NO: 31325 - DNA, 201 bp, Homo sapiens
gacagggtttcaccttgttggccaggctagtcttgaactcctgacctctgatgatctgcctgctttggcctcccaaagtgctgggataacaggcttgagcyaccgtgcccagccatactgttttctataatggctgcaccattttacatttccaccaacagtgcgtagtgttctgatttctctgcagccttgccaacactt

SEQ ID NO: 31326 - DNA, 201 bp, Homo sapiens
acttctaactttgctattctgcagaataacctttagcagctcctagtccattcacataagtgtaattccctcagcatagcatatgaggccctcatttaatrtcttaatcagggttcttgagataaacagaaccaacagggtgtatgtatgtgtgtgtgtgtatatatacatatatatatagacatatatgtatatacagat

SEQ ID NO: 31327 - DNA, 201 bp, Homo sapiens
ataactcatatttttgtggcaccaaaatcattctgaaggatttcatctaagtggattttctaaaatgtctgtttaattaaaatatatatatatatatatawgttaaaagagagacctagatccagtatttatataattacattgactatcatttagcttttattcttattaaaatcatgtcaatagtaaataggccaagac

SEQ ID NO: 31328 - DNA, 201 bp, Homo sapiens
agaatcgcttgaacccaggagatggaggttgtagagagcagagattgcaccactgttctccagcctgggcaacaaagtgagactccatctctaaataaatwaataaattaattaattaattaaataaaacacttgtgtcattctttttataaaacccctatctctttaagacatgtactctaagaacattcaaaaatgcat

SEQ ID NO: 31329 - DNA, 201 bp, Homo sapiens
tcgcttgaacccaggagatggaggttgtagagagcagagattgcaccactgttctccagcctgggcaacaaagtgagactccatctctaaataaataaatwaattaattaattaattaaataaaacacttgtgtcattctttttataaaacccctatctctttaagacatgtactctaagaacattcaaaaatgcatgggg

SEQ ID NO: 31330 - DNA, 201 bp, Homo sapiens
aatgacatggcatatttctgattcaatcttaataaactattctgcaatttatgagtgacttaaagatatgtggaacctattgagtcagccattctcaaacwtttttcttttttgagatagagtctcattctgtcacccaggctggagtgcaatggtgcaatatcctccccaaaaaacaaacacaaaagcaaaaacaacaat

SEQ ID NO: 31331 - DNA, 201 bp, Homo sapiens
tttgagatagagtctcattctgtcacccaggctggagtgcaatggtgcaatatcctccccaaaaaacaaacacaaaagcaaaaacaacaattaacactccytcctgcatttttttggtgtgttttcttcaaagcactgaacaccttctgaagactatgtattcgcggtctgtttattgccttcctatccccattagagtgt

SEQ ID NO: 31332 - DNA, 201 bp, Homo sapiens
aaaaatattttttaagttttaaaagtaactgaaaataagaaaaaaagtataagtggttcaagcattaactcatttagtattatttacgtatcatgctgtgygtaagcgaagaaaatatttcactttataagcaatttgcactgctatgggaactaaattttcacacttggggtgactcaggattttattgcaaatatttgt

SEQ ID NO: 31333 - DNA, 201 bp, Homo sapiens
ctcctgggctacataacctatggctgtacatttgtacagcaatatgtacagcaaattaccatactgaatactgtaagcaattgtagcacagtggtatttaygtacataagcatagaaaaggtacagtaaaaatatagtcttatggtcttaagggatgatcattttatctgattcattgttgaccaaatcattgttatgcag

SEQ ID NO: 31334 - DNA, 201 bp, Homo sapiens
atgatctgcctgctttggcctcccaaagtgctgggataacaggcttgagccaccgtgcccagccatactgttttctataatggctgcaccattttacattyccaccaacagtgcgtagtgttctgatttctctgcagccttgccaacacttgctattttcctttctgttgatagtggccatcctaatgggtgtcaggtgat

SEQ ID NO: 31335 - DNA, 201 bp, Homo sapiens
tctgactctaacacatttgaatgtgtatgtttctgtaagaagagttttgataagttcgaaatctaaaaaaagaaatcagaatgaagtgttcatggaacccygaagcaccgttgcagaacagtttgtaaaccacaaagtttaattacacctaacgtcttttttggctttcatattttattgttttatttcatttatagctac

SEQ ID NO: 31336 - DNA, 201 bp, Homo sapiens
cctgctctctattgatgttggccatttgcatttatgaatcttcctccctcactgttcacccactaccccaacccctgacctctcttttcatctggcccttycctacctatgataacactcaatggagtgagtggccattgcctacttggtttttgtttccccttagacctaatctgagatttgccaatctcatgttctaat

SEQ ID NO: 31337 - DNA, 201 bp, Homo sapiens
tctaggagttttatagtttcatgtgttagtttaggtctttaatccattttgaattaatttttgtatatggtataaggtgtgggtccaatttcattattttrtttgtggatatccagttttcccagcaccattttgttgaagagactgtcctttccccattttgtagtcttggtacccttgtcaaaagtcattggccatata

SEQ ID NO: 31338 - DNA, 201 bp, Homo sapiens
cttttaaatgagatagagctgatactaatggacaagttggtgctatccccggaggaacatgaactgcctgtatttgagtatgtatatgtctgcagctctcrgattatagtgttatggcttgttgtgccagagagttcttctcttttcaggctgcatagaatattttcatggccactgaccttgagaaagcaattctcagca

SEQ ID NO: 31339 - DNA, 201 bp, Homo sapiens
tccttcaatcttttctatacattcattaggaagtgttctctatttgcctttagcacatatgtatgcatatattgaaggagtgtggattagtggttaacaartatcatatttggcatcaaattggcataggctctagtctggtcattgtatacccttgggttagctatttgtccccttttgacctgtttcctcatcagtaaa

SEQ ID NO: 31340 - DNA, 201 bp, Homo sapiens
aaaacatatatgttctgtttgttcctgaaatatattaagtaaagtgatttttaaaaatatactggtcttatatttagctaccttgctgaattgtcattcarataatttaccgaaagattccatagccaatcatattgtctgtgaataatgtcttttgtaatcctcataccttttttattgtcgtttcattgcactagctca

SEQ ID NO: 31341 - DNA, 201 bp, Homo sapiens
ctgggtcatgctatgttgcccaggctggtcataaactcctgggctcaagtgatcctcccaccttggctcccaaagtactgggattataggtatgagccacyacgcctggtgtaatgcccttttcttaattttgtccttttttccttttctttttgattaaagtagtagttggtagttagcttatatttaaaaaatagtcct

SEQ ID NO: 31342 - DNA, 201 bp, Homo sapiens
tgctgggattataggcgtgagccactgcacctggccccattccattctttaatgaatgaagtaaaagtagatacgaatcagaaaataagtaggaaaactgmagattctggggggattacttttgccattctcgggcatatttttaataatggtgagcaaattgatactttgggttgatacccctctttcttctctggccaa

SEQ ID NO: 31343 - DNA, 201 bp, Homo sapiens
tgtgtctgtcattagcttcctcagtaactgaatgaagaaatcaacgtcacctgatacctgttaacttctaaagtctattagtgtcacattgaggtcctggmactgccctcactattattcaaggtcttgttttactggaagaacttgatctcgacggctatctgcttttgtttttccctaatagttctggacagatatgtt

SEQ ID NO: 31344 - DNA, 201 bp, Homo sapiens
ttctactttgggaatttaaccaataatctatacaattatttgccccaatggatattcatagcagtgttacttacaatggtaaaaagttagcaaaaacttgrcctccaggtaaataggtggtttgaatttattcattgaatttcatttactttctaagcttcattaaaactgtagtaaaaattttttttttattgagggaaa

SEQ ID NO: 31345 - DNA, 201 bp, Homo sapiens
agagactatgtgcaatcagaaggagggaagagctggcccagcagaatttggtccagggtgagggccacagaaaggtcagaggcaggatggggctggcaccyaggctggtggtggcctcacatcacctatgcctgaggccagtcctggattgccccagaagaaacaatttctttactccaaagaaatccaaaggagttaaaa

SEQ ID NO: 31346 - DNA, 201 bp, Homo sapiens
ggccatctaatatgcctgcatatttcagtttattccaataaaattgaaaataaaacgtgttttctctgactttattgttataattaatagaattagaagckgtcaatgtttttcaactatttatttattggatctgacctgatagaattgaaaaacaaagaaactgttttaatgttaaaccccaaattctgaaagctttct

SEQ ID NO: 31347 - DNA, 201 bp, Homo sapiens
aatactccagtcaacccttctctgcccctcccacacagacccacgatctcctgcttctgtaggttgtctgtcttattcacctacctgaaatatttgcctcytcatctctttatcctttattcccacatgtcttcatctttgaaatgtttaattatccttcttggaatatcttaaagatgcttctaaaacatgtaacttttt

SEQ ID NO: 31348 - DNA, 201 bp, Homo sapiens
acacaaaactaggcacatcggcttacatccatgcttatcaccagtatataatacaatagaataataatgatacctcttactatgatatttccccattaaaytttgtaaataccaagactgccaatcagttactcttctgaaaggatgatggtctgtcacatccctaagttatttcatttaggaatgcaaatgtcgttcatg

SEQ ID NO: 31349 - DNA, 201 bp, Homo sapiens
tgtttttgtggggttttttaatcttttaataagctaaaatttctaagcaggctttcataggctttctcttgatcttaatttctttgagcctcctggtgtawtcttaaattccccaattatatttacatttttaaataccatggtgagaaatgatctgaggccccaaagttaggaaataagaaaaagtgtgggtggtggtag

SEQ ID NO: 31350 - DNA, 201 bp, Homo sapiens
ctgactgggcgcggtggctcacacctgtaatcccagcactttgggaggccgagatgggtggatcacgaggtcaggagatcgagaccatcctggctaacacrgtgaaaccccgtctctactaaaaatacaaaaaattagccgggcgtggtggtgggcacctgtagtcctggctacttgggaggttgaggcaggagaatggcg

SEQ ID NO: 31351 - DNA, 201 bp, Homo sapiens
tatgaaaatggaaaagaggttgggcatggtggctcacacctataatcctagcactttgggaggcaggaggattgcttgaagctgagagtttgagagcagcytgggcaacaaagagagacccctgtctctacaaaaaatttaaaaaactagctggacgtggtggtgcgcacctgtagtcccagctactcaggaggctgaggt

SEQ ID NO: 31352 - DNA, 201 bp, Homo sapiens
ggaggattgcttgaagctgagagtttgagagcagcctgggcaacaaagagagacccctgtctctacaaaaaatttaaaaaactagctggacgtggtggtgygcacctgtagtcccagctactcaggaggctgaggtgggaggatcactagaacctgggagttccaggctgcactgagctatgattgtaccaccctgggcac

SEQ ID NO: 31353 - DNA, 201 bp, Homo sapiens
tttgttatacatttatttatgtttaattggagttaatggggtaaaatgtttagaaaaatacttcactgcatgtgaattaaatgggaaaaataattttctaytgaaaagtcactcttgcattttgggcacagaaaaacttatagaggcgataaaacttgggggtaggtaggtgaattctgttcatatataattggtatagaa

SEQ ID NO: 31354 - DNA, 201 bp, Homo sapiens
taatcatgtcatctatgaagaaaaagttttatttcttccttctcagtctgtatacatttaatttccttttcttatgttattgcattatctagaacttctgwtacagtcttgagtagtagtggtgaagagaacattcttgatttggtcctgatatagaagcaacaagtttcttatgattgagtatggtgttggctgtaggca

SEQ ID NO: 31355 - DNA, 201 bp, Homo sapiens
atttcaatgtaataacctaaaaactgacatttactgttgttttcacttatatttgaaaatgtggatactgaatcgtttttgaattttattcacttattaasagttgagtttgaatttgttatacatttatttatgtttaattggagttaatggggtaaaatgtttagaaaaatacttcactgcatgtgaattaaatgggaa

SEQ ID NO: 31356 - DNA, 201 bp, Homo sapiens
catcacctatgcctgaggccagtcctggattgccccagaagaaacaatttctttactccaaagaaatccaaaggagttaaaaagtgagagcccaaatccartctgtgctcagggagcaggcctctctgcagggggcaagggcacggctggagacggaggtcctgcagctgcagctgaggcccccactcttcctgcactggg

SEQ ID NO: 31357 - DNA, 201 bp, Homo sapiens
ggcttggcaagatgcaggacaactggaagccgtgagtcagacccgcgactggctcaagaagattgcacaagacctggtctagaaattggagaagttccagygggagatcctcttccacgaggaaatggctcaggaagtgtggatggccaccgggtccaccaagcgggtgctccaggagctccgggaagaatatgacttcaa

SEQ ID NO: 31358 - DNA, 201 bp, Homo sapiens
ctggtctagaaattggagaagttccagcgggagatcctcttccacgaggaaatggctcaggaagtgtggatggccaccgggtccaccaagcgggtgctccrggagctccgggaagaatatgacttcaagaggcagaagccggctcactgggaggccaagttccagcctttctggacagtgctttggctcctagggctccag

SEQ ID NO: 31359 - DNA, 201 bp, Homo sapiens
gcctgagctgctccctcgaaaacacttttatctcttgttactttaggtaccatttattaattgaaactgaaattgttcttagtgaagttggatagatagcrttaggagtgtaagatactgttttaccaataaagattgttggatgtaaaaaagaaagtttttcacacttgtttctccataataattcaagtacttctattt

SEQ ID NO: 31360 - DNA, 201 bp, Homo sapiens
cttcactacttcaaacgcttgcatcagctaccagattttctctgcttttttttttttttttttgaaacggagtctcacactgtctctcagactggagtgcrgtggcacgatcttggctcactgcaacatctgcctcccgggttcaagcgattctcttaactcagcctcctgagtagctgggattacaggcgcccaccacca

SEQ ID NO: 31361 - DNA, 201 bp, Homo sapiens
ttacattcctcatggtagatatgtttatttcaatgtaataacctaaaaactgacatttactgttgttttcacttatatttgaaaatgtggatactgaatcrtttttgaattttattcacttattaacagttgagtttgaatttgttatacatttatttatgtttaattggagttaatggggtaaaatgtttagaaaaatac

SEQ ID NO: 31362 - DNA, 201 bp, Homo sapiens
cttcttcaggtatgttttctagttttttccttgttgtgatagatcactcctatttttctttgcttcgtatcctttaagacaaaaaaaaaaaaaaaaaaaaacaactttgagtgaggtgtggtggtggtgtgtactgagtcccagatactcaggaggctgaggtaggaggatcacttgaggctaggagtttgaggttgtagt

SEQ ID NO: 31363 - DNA, 201 bp, Homo sapiens
ggttgatttttggttttgccatggagttgcacacagtattgtattattgtaatttcccattctttgtgtttttactttctgttttatctttagcctggttkgtgagagctttgttttatttatcatcacaaggaatcaaattttgagtttataaatcttttctagtactttatttgacttctagtttagtaatttcactta

SEQ ID NO: 31364 - DNA, 201 bp, Homo sapiens
gcccatagactccctggtctttgttttttctcatagtttgcatcactgggtgccgtgtgttggtcttgtgacaatctctgcaaagaagctctgatgctggytgggtgctgtgtgttgtgggggtgggaacttatcccgctatcttggaaagcaggcaccggggaccacaggtaggcttagattcctagggaaggcagcact

SEQ ID NO: 31365 - DNA, 201 bp, Homo sapiens
ggttattggatggcattactatatggtgacacggacgcggatgcattttatctttggtgagatagggcacagaaactttaaaccttacatgtttgacagcwtcacagagtacaaagctcaccgtggctcttttcaagtacagccccattccatggcactgactcaggaagcttgtcatagactgtgccagtatttagattt

SEQ ID NO: 31366 - DNA, 201 bp, Homo sapiens
tttctcaatcctatatttattaatcttttctcatttaaaactacgttgtggacatgtgttctggatattagcaaatccagttgcccaccaacatttttaayggcttcatggtgttctgtaatattcatccctctattaatgaacatttaagttgttcccagtatttcactattgtaaataataatacatagaatatcctta

SEQ ID NO: 31367 - DNA, 201 bp, Homo sapiens
tacaaatactaataatttaattctaacaactctataggttaggtaacattattgtcctgtttaatagatgaagggactaaggctcagagaaattcaataartgagctaacacagaaccagctcccggagccaggcagtttggcatcagtatccttgatcttaatcaccccactgtgttctctaaagattcttactgactat

SEQ ID NO: 31368 - DNA, 201 bp, Homo sapiens
catttccagacgcatacaaattgagataatttagatacaggagatggggttcttcaggcagaaaggaaatgataccagactgaaaagagtaaatgcaggasggaaagaagactaagtaaatatatggccaaatgtaaattaatgctaactatacaaaataatcgtattaatgccttgtggggtttaaaatatatgtgcaat

SEQ ID NO: 31369 - DNA, 201 bp, Homo sapiens
gtgatggttcatagctgtgtaactataccaaaaagcattgaaattgtgtaccttaaataaatgaactttatgatatgtaaattatatttccataaagctakataaagagaacatgagaccaatataatacaaataatatgaaaatatgataaatataactaataaatataaactcatattttaagaataaaactaaatgtt

SEQ ID NO: 31370 - DNA, 201 bp, Homo sapiens
aggaaacaataataccaatcttaaactctttcataatacttcccaactgattttatgaggccaacataaccctgatcctaaactatgacaaagaccatgcaaaaaaaaaaaaaaaaaaaaaaaggtatagactaatatttatcagggactgtaggtgtagaaatcctccacaaaatattaaaatattgggaaatccatccc

SEQ ID NO: 31371 - DNA, 201 bp, Homo sapiens
tatttttatattctagtaaaaagcaattacaaaataaaaataagtgatttcacttatattagtataatgaaacaacacatacctaggaataactctaatamaagatgtgtaaacctttacacagaaaattgagaaacattttgagaaaaataaagatgaccttaaaaaaaggataaatataccatgttcatatattgggag

SEQ ID NO: 31372 - DNA, 201 bp, Homo sapiens
tttatattctagtaaaaagcaattacaaaataaaaataagtgatttcacttatattagtataatgaaacaacacatacctaggaataactctaatacaagrtgtgtaaacctttacacagaaaattgagaaacattttgagaaaaataaagatgaccttaaaaaaaggataaatataccatgttcatatattgggaggctc

SEQ ID NO: 31373 - DNA, 201 bp, Homo sapiens
cttaacacaccaggattctgaatggaaattaaagtctcctcaagactgatattcctactccactttctcccaagagtgcaaaacagtgaggcttttcattrttgaaatgtttttgtatttgctctgtgacttatatgaagaatcctttaagattgacttaactgatggctttattttatcttcattatttttctggtttta

SEQ ID NO: 31374 - DNA, 201 bp, Homo sapiens
gttttaggatccaactttcttgatgcaatattttgagaattttgccatcttttcagtgccctttcagtagtgttttccaacaatttcatgttctcttgtctttttttttaaattttttttagccctttaaagacaaggaaacttgttttttaatttaccatttctgatgacctttgaaaactatgacttgtatgttatatt

SEQ ID NO: 31375 - DNA, 201 bp, Homo sapiens
taagtattactatcatgtcagtgctaaaacatattgatgccaaaatacatgttcatttggaagtcatataataaaaagattctgctgggttttagaacackgatgatcactatgtgtaaatgttgcagcaaattttagattggagctctttttttctttgaagacctatccagttcatgtcttatgctttggccattagaa

SEQ ID NO: 31376 - DNA, 201 bp, Homo sapiens
aaaaaaacaactttgagtgaggtgtggtggtggtgtgtactgagtcccagatactcaggaggctgaggtaggaggatcacttgaggctaggagtttgaggytgtagtgcactatggtcactgcactccaacatggacaatatattgagaccccatctttaaaaaacaaaaagaaaaaactctgatgtttggtgtaatataa

SEQ ID NO: 31377 - DNA, 201 bp, Homo sapiens
tttgtattattaatagacactggattttgtcaaatactttttcttcatttattgatatgatcaatgatttttttctttagcatgttgatatgatggattayactatggttcagtgatatcttaattaccttatgtatacaaaaggagaaaatattcatttttgctatcatacttgtattcaaacagcacattccttttgaa

SEQ ID NO: 31378 - DNA, 201 bp, Homo sapiens
ggacaggtttgttggaattgaatagagacagagaaacaaccatgatcagagagagtaattttaagtcacagagaaaaatttgtagagtttagatagtggargacaaaaatgtgtagagtttagatagtggaggacaaaaatttgagtcatagtgagttcttgggcactgctagatcgttgggcagcagaagtaagatagaa

SEQ ID NO: 31379 - DNA, 201 bp, Homo sapiens
gctgtctcaaagagagagagggagagatagggaaagagagaggaagagataggggcagagaggagagacagagagagaggaaagagagagagagagagacrgagagagatcacgattgagaaatctggcctgcaccagagtgcaccagattttataggcaggcttgaggaagcagtgtctgatttgcatagggcccaaaga

SEQ ID NO: 31380 - DNA, 201 bp, Homo sapiens
ttgctatcatacttgtattcaaacagcacattccttttgaaataaaaaacagtgatttctagaaatacctgttatgacatttataatatattttgtttagmttatgaaataactactgatttttgaagggagaattgaattctgtggtatatcacagaaattctatggtatattcattgaaagttgagtttggataaatga

SEQ ID NO: 31381 - DNA, 201 bp, Homo sapiens
ggcttcatggtgttctgtaatattcatccctctattaatgaacatttaagttgttcccagtatttcactattgtaaataataatacatagaatatccttayacatgtgtctttgagaacttgttgaattctttttttaacaaaaattcctactgggcttggtggctccagctactttggaggctgctgcgggaggatcaat

SEQ ID NO: 31382 - DNA, 201 bp, Homo sapiens
tgtaaagagataggtgcagggcagcctcagagcagagtgttaacactggctgaatcaactgcacagcgaaatgcttaactggaaaacagagagagaaaagrcatgaacagagccaagcatcctttaaggtcaaccaagtacagtccagtgttttcagagtcttcagttttgtcagttacaggcacagtttcatcagataca

SEQ ID NO: 31383 - DNA, 201 bp, Homo sapiens
ttagacattgtggtttcatcccttagccttttaatactattatttttatttttaaggggaatttattggagacctggtatgttttctttatatctcaaagygcatttttgcacatttttatattattaaagtgtatgttattgtttcaaatttgctttgatatttgcctataaaatataaacttcaacatggctttattaa

SEQ ID NO: 31384 - DNA, 201 bp, Homo sapiens
ctccatggttgagtgtatttcttcttttgtgagtttcctacttaatacattatttgcctgcttttctaatgggagcgcctcttctcaatatataacagctrtttataagataagattatttacccttagtgaattaagtacaattgcttttcttagtttgtaatttactttccacgaggtttatagtgtggtgcttttaca

SEQ ID NO: 31385 - DNA, 201 bp, Homo sapiens
agtcttcagttttgtcagttacaggcacagtttcatcagatacaaattattatttgctgttgtctttttccagtcaatctgttgattgcaggcattcctamtgaaaagggaagccctgtgctcagagataacataatgaaagtcaagggaaagaaggacccttagagtatatttaatctaacattcttactttagaggaaa

SEQ ID NO: 31386 - DNA, 201 bp, Homo sapiens
tgttttttctccagaggaagtggtgttgcttagtttttagaggcagtaacaatgatgagatgcacatgtgtatgtatataacttatttcaattgtgctttsctctttacaaagtgcatacatatgcatcatttttttcctctctgtaataagtctgacgttgctgaacacacactctcctcatctcgttagtgccctagct

SEQ ID NO: 31387 - DNA, 201 bp, Homo sapiens
aattgtgctttcctctttacaaagtgcatacatatgcatcatttttttcctctctgtaataagtctgacgttgctgaacacacactctcctcatctcgttrgtgccctagctgcagattcaaactgaagaattcttgagtagaaaagggatcaaaagtagggttaattgtcttcctgggatctagaccattctagtcttta

SEQ ID NO: 31388 - DNA, 201 bp, Homo sapiens
ccagctacttagaaggctgaggcaggagaatggcttgaacccaggaggtggaggttgcagtgagcgagatcgtactattgcactccagcttgggcgacacrgtaagactccttttcttaaaacaccccccaccaaaaaaaaaaaaacaaaaaacaaaacaaaacaaaaaaaagcaagaaaaacccctataatgtgttcaat

SEQ ID NO: 31389 - DNA, 201 bp, Homo sapiens
tgcaccctgagtatgccccaagaaagagcagagacttgtacttaggatttgtgatttgcagacgcaagctttgctgtatttgttttgctcgaagggcttaytgctgtggtattcagaatgtgaaataatagttaatggagacaaggggattaatagcagcatttaaaatcatttagtgactaataactttgtggcttataa

SEQ ID NO: 31390 - DNA, 201 bp, Homo sapiens
cgcataggctgtagaaatatgtacaccgctgtttactttggtgaccaaggagttcaaattagaggaaagaaaaagagtaaaacactgggttctctaggacrgggaattgcttgtcaaaacttgtgataaatagcaaatgggaagtcattagacccaaaggatagagaagaaagggtctaatgaacagtaacaccaattatt

SEQ ID NO: 31391 - DNA, 201 bp, Homo sapiens
agggcttactgctgtggtattcagaatgtgaaataatagttaatggagacaaggggattaatagcagcatttaaaatcatttagtgactaataactttgtrgcttataaaatctgtaccttgatatgcaggggtggctgttctattaacatttctaagctatttaaaagtcagttggatgcttttcggttgcacattcatt

SEQ ID NO: 31392 - DNA, 201 bp, Homo sapiens
ctgtgattacttggtgtatagtatgtttgattggttatgtgttgattactgaacagctactctgatggccagttttaggtgtcagcttgactggattgacrgatgcctggatggctggtgaagcattgtttctgggtgtgtctgtgagggtgtttccagaagagattgacgtgagagtcagaggactctcaatgtgcatgg

SEQ ID NO: 31393 - DNA, 201 bp, Homo sapiens
agacacctgactgatacacctacgtttcactctgtattatccatcttgcatgcatcatctctgatcctcacaaaaccttttcagagtagattattttacarttgaggaaatgcctgtaacaatgtcaaatacatattattttcaggaagtactggttgggagaaaacccctcagaattagaaaatattcttgctgtttcga

SEQ ID NO: 31394 - DNA, 201 bp, Homo sapiens
gttgggagaaaacccctcagaattagaaaatattcttgctgtttcgaaggagtccagtatgtcaaagtctacctgcctctttcattaataaatactgggargctgaggtgggcagatcacttgaggtcaggaatttgaaaccagcctggccaacatggtgaaaccccatctgtactaaaaatagtaataaaaaaatgtagc

SEQ ID NO: 31395 - DNA, 201 bp, Homo sapiens
aagataatgcttataagataatgctaagattaggaggatcttgacattttcttgattaaatgtaggaggcataggaattaaattttatatagtcttttgarggaggtttccatttaatagcaaaatacttaagctagagtgttttaatggcaatctgatctacaagattgaaaaatttctactgattaacttttaatttca

SEQ ID NO: 31396 - DNA, 201 bp, Homo sapiens
tctcttctgttttctgaaagaatttgtgttaattctacattgtttctttttcaaatatttgatagaatttatcattgaaaccacgagcctagagttttatmctataggaaaggtattttgttatgaattcaatgtatttgatagcttgagagctatttagattttctatttatttgtgtgtcagctttgataaattatgtt

SEQ ID NO: 31397 - DNA, 201 bp, Homo sapiens
tatataggcataaaattgcactaatgtgctcttattattcttttaatgtctgtaggatctttaatgatatctctcttttcattcctggtaatgatagttgmtgttttctctctttttatcttgatcacttctctaagggattaattgattttatgaatcttttcaaaggttaattgaacttaaatgtacttttgttttggt

SEQ ID NO: 31398 - DNA, 201 bp, Homo sapiens
agcatgaaccctagctgagtgtcctcttccaattcagtttcacactatctacctggagatagtgtcagatcccacaggttgggggctcagtccccacaagmccccagtaaccctggacaccagtctctaatccaggctcccagaacttctaaccaactggctttgagttggggttcccatgaccccctgtttggatttaat

SEQ ID NO: 31399 - DNA, 201 bp, Homo sapiens
cagggaattgcttgtcaaaacttgtgataaatagcaaatgggaagtcattagacccaaaggatagagaagaaagggtctaatgaacagtaacaccaattattttttccaccttgcttttacttttttttttaaattgctttttccattattctttacattctaccactaatttagtggcagggacaatagtgttatctacc

SEQ ID NO: 31400 - DNA, 201 bp, Homo sapiens
gtcaaaacttgtgataaatagcaaatgggaagtcattagacccaaaggatagagaagaaagggtctaatgaacagtaacaccaattattttttccaccttscttttacttttttttttaaattgctttttccattattctttacattctaccactaatttagtggcagggacaatagtgttatctacccgatagggctgtt

SEQ ID NO: 31401 - DNA, 201 bp, Homo sapiens
tagcaaatgggaagtcattagacccaaaggatagagaagaaagggtctaatgaacagtaacaccaattattttttccaccttgcttttacttttttttttwaattgctttttccattattctttacattctaccactaatttagtggcagggacaatagtgttatctacccgatagggctgttagggggattaaatgatta

SEQ ID NO: 31402 - DNA, 201 bp, Homo sapiens
atatatatatacacacacacacatacatacatatgtacatgcatacccctacctgttgggcaaggggtttgaaacagtttcagttttcctgacaacgtaaytggttttacctcaagcctttcccactcaatgttctatatatgcctgggaccacagtgattaagaagtcagagtgaatacctttacagacaaccagaaaca

SEQ ID NO: 31403 - DNA, 201 bp, Homo sapiens
agtgctcttgaaccacattcttccctcccttctttagttttagaagctgaaaagcaaaattctcaaaatcttaacctcacttaaaactgcgggtgcccatrttgccccattctggcctgtaatatcagctaaactccctgggagagctttgcttcccaaagaaagcctttctaggagaaagactcaggccctacctcaatc

SEQ ID NO: 31404 - DNA, 201 bp, Homo sapiens
cataagagaagacacctcacaggaaggagggactgaggaaaggagaaatggcaggagcctgagtggtcgatggcatggaactcatgtgctgttgactgtcyggctccttcctagtttgagccagagtagtaggactttcccttacttgcagctgaacaccatgttgataaaaggcctcttacaatgtgtaatatttacagc

SEQ ID NO: 31405 - DNA, 201 bp, Homo sapiens
ttagcatacttctcaggattcacatgctgacaggtgtttattttttcttgatcaaaacacaacagaataaaaaccagagggctttaaactgaagtatatcrtgcccttactgtaagctcaaggacactgcatctccatgggttctaaacataagatctcccaccaaccctgcgtccactctgactccagcacctgatgacc

SEQ ID NO: 31406 - DNA, 201 bp, Homo sapiens
cagatacttgtcagtttttgtggtgaaagcaccagtgacaccagtcactatgtatactaagagtatctgatcagttcatacgcatgaccactctgaattcmtttggggaatgaaagataaatcacatattttccctgacttcaagtgtgtctagtgattatgtcgctgggccaaagttaattgaaaagacaaagattggta

SEQ ID NO: 31407 - DNA, 201 bp, Homo sapiens
cttgacgtatgtatcacctgaggtcaggagttcaagaccagcctggccaacatggcaaaaacccgtctaaaaacccctctactaaaagtacaaaaactagrcaggcgtggtggcacatgcctgtaatcccagctactcaggaagctaagacaggagaattgtttgaatctaggaggtggggcttgcagtgagctgagatcg

SEQ ID NO: 31408 - DNA, 201 bp, Homo sapiens
ctctgaattcatttggggaatgaaagataaatcacatattttccctgacttcaagtgtgtctagtgattatgtcgctgggccaaagttaattgaaaagacaaagattggtatgagtaagtacagttgattgagttgatgtatttcagaatggtggcattttcttctggatgttctcagtccttgaaatacgatttgggggc

SEQ ID NO: 31409 - DNA, 201 bp, Homo sapiens
caaaccaccacttagcatctctgagacttctgtggacaattgctgtaatgtgtaggtggcaaataagatgaggtcttcccactactgacccagtattcttyagcgtttttctagtgaattaattttaggtagcaacttccttattctacttgagaaaatgtgaacagaggagtgatactgtaaaatacatacttggtgttc

SEQ ID NO: 31410 - DNA, 201 bp, Homo sapiens
ttgaagggtcatgattcagaagcccaggcctcttctccacacttctgactgattgttgaaggagtaagttttgctgtttgatgtcttctctccagttcttmtttattgacttttcctctgtgtatagtatttgcaaaagagtagaaaacattctaaagcactgtgatttaacaagaggtacttggctgattttagctgaag

SEQ ID NO: 31411 - DNA, 201 bp, Homo sapiens
atgttctcagtccttgaaatacgatttgggggcaagagatagctgactaaaaactgctagtcaggaggctacagagtatttctgagtttgactttttgtgyagtctgttccctgcacagttttgcagtgatgaaagtggtctctctttggcattcctgccatttcttcccctctcttagtaagtgccagtgagtgaagtcc

SEQ ID NO: 31412 - DNA, 201 bp, Homo sapiens
actcttaataatgggatggcgtgctttgagatatcatgttgaggaattatctacaatataagatgtttttggtatggtcctttcctaaaaggtgggagggwaattgttggaggctctatccaaccattgacagagtatcctttgattagtagtgatacggttttgctctgtgtccccacccaaattttatttcaaactgta

SEQ ID NO: 31413 - DNA, 201 bp, Homo sapiens
cgtgagactctgtctcaaaaaaaaaaaaaaaaaaaaaaaaaaaaaaaagaacgagtctttgagtggtctccagatatcaaagcttcatgctcatgtacagwacaacttgtggtacctgtaaataggatggtttaaggcttccaaagtccttataattctttcttgcagagtataagctcatcatttttcaaagatgaaaaa

SEQ ID NO: 31414 - DNA, 201 bp, Homo sapiens
tgatagttttataagggtctcttccctctttgtgctctccctctctcctgccgccatgtaagacacacctgcttccccttccaccatgattgtaagtttcyggaggcctccccagccatgctgaactgtgagtcaattaaacctcttacctttataaattacccagtctcagatatttctttatagtggtgtgagaaaaga

SEQ ID NO: 31415 - DNA, 201 bp, Homo sapiens
atttactgaaactgttttatgcttaagtagaaaaacaaaggtgacacatttgaaatttatatactgttcatggtcctgttactcactggcttagtggcctkgagtaccatactataaaccaaacttattttcacaatgataaaatgagcgtgttctactagatgtcatataaattcctctttgtctttgaaattatgacta

SEQ ID NO: 31416 - DNA, 201 bp, Homo sapiens
tgtccagatcagttggtcatactgtaccaggctacggggttatactgattgtacatcagcatatctatgatgtcatccatgtatgaagcatccttaggttraacatgttgaaacatgataaaacgtgtcttagaattaacgaaatgtaatatatctctagagctaattttggaagccaatgggcaacagtttggcatttga

SEQ ID NO: 31417 - DNA, 201 bp, Homo sapiens
ttattcccctaaggttagtaggaaagaagtaaagattgaagacgctgcaaaaacctgtgtacagggaaaatcaggaggaagctgagggcagtctactgtayaattattgtcttcaggttgaaatagaaaatgagtttattttcctaaggagtagaagttagggcaggctggactggattagaagccttgaagagagcagta

SEQ ID NO: 31418 - DNA, 201 bp, Homo sapiens
caagctctccaagaagtttcaatgcattatcttcttagattcttcagtacattctgaagtgttttgttttgtttgctcgtttgtttgtttaatgggttttrtttttttcaggcttaggagcatctacttgttaatctcaatattttgaaaaatgtttctagattttagtccaattagcccctcatttttctgtgctgcgta

SEQ ID NO: 31419 - DNA, 201 bp, Homo sapiens
aagaaagtacatctgatgtgattaagtgtagaaagagttgaggaagggtagatggtccacttaggataaaatatagggtacagatgggcagagagaacagrcatagatgaaggtagaaagattagggcaaaatatggaatatcttgcaaactcagctaagaaatgtggataaatttgtataaggagtaccagccccaggaa

SEQ ID NO: 31420 - DNA, 201 bp, Homo sapiens
ctgtaagacatgtgtatctacctttccttctttatttggctgtcaaaacctttggttcaaatattaactccaaatttgttaagcctccttcccgttattcsaaataggtagaccatagattctctcctggggttatatgtgaaataagccactgtctttgtattttttcttcagtgtgtctattttgcacagagagaaaac

SEQ ID NO: 31421 - DNA, 201 bp, Homo sapiens
tcactaagaggagattcaaaacattcatttataatagtctatactgctgttgctgacatttaaaaaaaagtcaagggcataaaaagtttaataaaattgartcaagccttatgtaattaatcagaattataatttattttctcttaggagaatgcttacatattccagataaaacatgaactctgtatttgagttgtagta

SEQ ID NO: 31422 - DNA, 201 bp, Homo sapiens
gttgtagtatctttggagtactgttgtcaataatattttaaagcatttgaaaatggaatttattcttatttactacaaggtttaatcaagatttgaattgytttatccaaaataataccagaaggttgaaaggatggctgattaataccaataattttaaaaagtattatcattagacctaaaagattctagatatgtata

SEQ ID NO: 31423 - DNA, 201 bp, Homo sapiens
aaattaggagttacatctattaatgcatactagaatgtaatgtaatattttatttgcaaatatcaacataattaaaaataaggataactacctgatcattytttcttccctgaaaataatctccaaatttttgtgtaatttatagctcatatttatctcttagattcatttagggaagattacaggcatgttttaaggaaa

SEQ ID NO: 31424 - DNA, 201 bp, Homo sapiens
caagtgatccttctgtatcagcctcttgagaagcttggacttacaggcatgcactaccatgtctggctgaatttttaaactctttgtagagacagggtacyactatgttgcccgggcgcgatcctcccgccttggccttccaaagtgttgagactacagctgtgagccaccacacctggctgaaaactagcatttaaccag

SEQ ID NO: 31425 - DNA, 201 bp, Homo sapiens
cctaatgctatccctccccgctccccctaccccacaacaggccccggggtgtgatgtggaatgctgttttctatgcctggctctcatcctttggatcaggrctgtccaatcttctggcttccctgggccatagcagaaaaagaattgtcttgggccacacataaaatacactataatactaacaatagctgatgagctaaa

SEQ ID NO: 31426 - DNA, 201 bp, Homo sapiens
aaaaaaaaaaaaaaaaaaaaagaacgagtctttgagtggtctccagatatcaaagcttcatgctcatgtacagaacaacttgtggtacctgtaaataggayggtttaaggcttccaaagtccttataattctttcttgcagagtataagctcatcatttttcaaagatgaaaaagttgtaagctgtgaaataaattgtgcc

SEQ ID NO: 31427 - DNA, 201 bp, Homo sapiens
cctgtaaataggatggtttaaggcttccaaagtccttataattctttcttgcagagtataagctcatcatttttcaaagatgaaaaagttgtaagctgtgraataaattgtgccataatcttgtgtagcaggaagttttcctccttgatatttacttaagtgtgggcaattgaattagaaagaacaagagctcacatgata

SEQ ID NO: 31428 - DNA, 201 bp, Homo sapiens
attttattttccctttgcatagccctttagggtggcattccacaaaaatcttagttagccagaggaataaaagaggaagtcttgtctcgtaaaacccaccraatccattaagggcttacttgagaaaaactgcttattagaaaacaaaatcagccgggtgtggtggctcacacctgtaatcccagcactttgggaggccga

SEQ ID NO: 31429 - DNA, 201 bp, Homo sapiens
ccagaggaataaaagaggaagtcttgtctcgtaaaacccaccaaatccattaagggcttacttgagaaaaactgcttattagaaaacaaaatcagccgggygtggtggctcacacctgtaatcccagcactttgggaggccgaggcaggcggatcacgaggtcaagagatggagaccatcctggccaacaaggcgaaacct

SEQ ID NO: 31430 - DNA, 201 bp, Homo sapiens
tcactgaagataacaacccccagttccatccatgttgctgcaaaagacatgatttcattctttttatggatgaatagtatatagcctaaactgaatagtayatagcttaagctttctcaggacaatgtataaataagtgggtttttctttcaagtgagattctctttttccttagtggaagatgtccaggtgtcttgttat

SEQ ID NO: 31431 - DNA, 201 bp, Homo sapiens
atggctatttattaccattgtctggtctgattgcatcttgctcataccattctagttattaaatatttttagcatcacccttggtcaagtaattgcattgkgtcacttgctttccgtcaagtttaagtgtctgttacctacctaaggtacattgtcatggcttaaagcctctgtgtgggtctgagttcagaggtgcttctc

SEQ ID NO: 31432 - DNA, 201 bp, Homo sapiens
tgctttattgcttttctacttacatttgcataaccacttttaagcagaaaaactgcatgatttcaaacttgattattaaaaaaccttttaaaatattactsttgtgtcattgactaatttttctagcacaaatattggtagaaaagaagaacattgagaaattctcagggcaatttatacagcattttgtttcctctttag

SEQ ID NO: 31433 - DNA, 201 bp, Homo sapiens
catgttgaaacatgataaaacgtgtcttagaattaacgaaatgtaatatatctctagagctaattttggaagccaatgggcaacagtttggcatttgaatwactcttggtcaggttaaatgcttcatattaaatattgttggtcactatatttaaatatctctaaatggagaatgtgatatagtgatatgtggaactatat

SEQ ID NO: 31434 - DNA, 201 bp, Homo sapiens
agaggtgaccaggatgaggtctcagagtgtagtcagcccattaggatacaatgtcctaattgtgggcaatagggcctgttccaaagtttcctactatttcrttatcaaaaacagggttcatccctaccaagactgactcatcagaaatggcagctcattttaaaatcattctatttctatcttctttgctgctatgtttag

SEQ ID NO: 31435 - DNA, 201 bp, Homo sapiens
gaggtgtgtatctgaggacaagggaaatagctgggtccttgaaatactgtgagttgaaaagtatcaatcttttggttttttcaccacccagagcaatgaakcaattatgtaaacttaagtacataaaaatccagttgccacctgaaagttttatcatcttacaaaactctgctggcccttcctgttcttcctgataacgtg

SEQ ID NO: 31436 - DNA, 201 bp, Homo sapiens
ggagttatgagccaggaaccaatacatgttatggacaaaaaactatacatatatatttatcataacattataacacaatgtggcaagaaggtcaccagccrctccagtcacacattatgccagctgtgagataggcagagagagctcctccttcctcagtttcattactggtatttattctccttgcaccatcctgggtca

SEQ ID NO: 31437 - DNA, 201 bp, Homo sapiens
gaccaggatgaggtctcagagtgtagtcagcccattaggatacaatgtcctaattgtgggcaatagggcctgttccaaagtttcctactatttcattatcaaaaacagggttcatccctaccaagactgactcatcagaaatggcagctcattttaaaatcattctatttctatcttctttgctgctatgtttaggagaag

SEQ ID NO: 31438 - DNA, 201 bp, Homo sapiens
ttcaacagagaaatattttcatgggcttattcaggcaggattttcatacactctttaaccttctcagaataacagtggattcaaatattctccatttgtcytcagcaagtgctatctaattatacatatcagctgcccttttgcggtcttattaatgagcataataatactttctatggtgctatttctaacttcctgctt

SEQ ID NO: 31439 - DNA, 201 bp, Homo sapiens
tcagacaccacctcctcaagctgaaatataaaatccagctcatccatcccagccggccttttcctctcggaatcccgtctctatcactagagagggagctsttttcctttctctttctttctctttcttttgcctattaaacctcctctcctaaactcctcctgtatgtctgtgtcctgaattttcttggcgcgagacaat

SEQ ID NO: 31440 - DNA, 201 bp, Homo sapiens
ctttccaagatgtgaatttccaccccttcccacttgaacatggccttccttcccaccttcactgggagggagagcagctcctccctcatcatttcataagmaccacatccagtactctgggccagtatccccctgtggattgtgagtgcacgcaagtagctagaatatctcaaggcaccaagttacccttaaacgtcgtga

SEQ ID NO: 31441 - DNA, 201 bp, Homo sapiens
actaaaattagctgggtgtggtggtgcatgcctgtagtctcagctgcttgggagactgaggcaggaggatcccttgagcccaggagtttgagactgcagtraactatgatagtgtcactggactccagcctgtgtgacagagggaagctctgtctttggaaaaaaaaaaaaagagatagctaagatagcttgtatttgtac

SEQ ID NO: 31442 - DNA, 201 bp, Homo sapiens
gtagctacaagattaatttgatttattaaaagcaaggttttcccatgttcacactgctaagatatgatatggagaatttcagatggaaacgcataataatrgcaaaggctgatacaagttttactatgttttggatactgttctagtctctttaaatatattaacttacttaatctacacaataactttataaagtgaata

SEQ ID NO: 31443 - DNA, 201 bp, Homo sapiens
aacatgtcctcaaacttcttcaaatgataattttcctataaaattgattatagttaaaataacagcaggaatccatcccagcggcgtgctttgtttccacraattgctgccacatggagagaggcaatgcagttactttccaagatgtgaatttccaccccttcccacttgaacatggccttccttcccaccttcactggg

SEQ ID NO: 31444 - DNA, 201 bp, Homo sapiens
tgaattcccaagtaaccttggtacttttacttattttaaaagtaattgaatcttcctctcctttcatatatttttggcctgattttttgcagcatttgctytcttattatatttgattggaattttgctcagaaataagatttgtttctgatgatttatttttggatgatttgattccatctataggattacatgacttaa

SEQ ID NO: 31445 - DNA, 201 bp, Homo sapiens
ttgtctatatttctcttaagggcaaaaaagatctgtcacaatgtagatatgaattctagatttagaaatgttattcaagatagataaggtaagacatttcyttcaatttatgaaagaccctagaccctggattttatccagctagctttctctgagattaaaatgaccaataatatgggtagaatattctagatctaaggt

SEQ ID NO: 31446 - DNA, 201 bp, Homo sapiens
aggttacagactgtggccagtttcagagcagaaacgacatgtgtctttttttcaaagttgttttctcactcagagacattaatagtggggaggatccttayagccaacagttgtaggcagttgcatcctgccagctctactcccactgccgataagaggtaggtgggaggaatctgtcaccacctgatgtcttggtgcctg

SEQ ID NO: 31447 - DNA, 201 bp, Homo sapiens
tcattttaatttgaaagaaaacatcttttaatgattcctgccttataaaccctataatgattttctttcctaatttttctatgagactgcttgagaaggasggagaaggaaaagctctcgacactgtgaaatagcttactggaagagtaagcatttaagctcgtgcaaaaataattgtttctttaaaaactgccttttcgc

SEQ ID NO: 31448 - DNA, 201 bp, Homo sapiens
caagatagataaggtaagacatttccttcaatttatgaaagaccctagaccctggattttatccagctagctttctctgagattaaaatgaccaataatatgggtagaatattctagatctaaggtcaaccaatcaaggcagtaggtcaaatccagcccactgcctttttttgcaaataaaattttattgttacacagcca

SEQ ID NO: 31449 - DNA, 201 bp, Homo sapiens
cactcgtaaatggcacatccatacttctgcatacaacttgtactggctcaaatttgtattctgtagttgggaaactaacctagtggcagcagactaagtgrtgaggtaggggaaattagtcctcgcagtctttaattctcttactgcatgtatggatctcatttttaaagaggaactagtttagaaccaaaatggcagacc

SEQ ID NO: 31450 - DNA, 201 bp, Homo sapiens
aattacacagactttcgtagagtgcccactctccctttctcacctattcattgtggaaagattcctgtcagggctaatctttaataagagaggcagttacrgtaactatagggcgaagaagggaacagtaaaagttgagcccactcagatgtcatggacctgaaaggtgctggtgggttggaagcttcattatgctcagct

SEQ ID NO: 31451 - DNA, 201 bp, Homo sapiens
ctgggattataggcgtgagccattgcgcccggccgaacaaatgtactcttagacatttttttaatctttagattgagcatctttggatatcagataccagytgagtttaaataactagtttccattactagatgaaattttgatgagaacctttagaaggttagtaatttctttgtccaacccaaatgtagtttttatatt

SEQ ID NO: 31452 - DNA, 201 bp, Homo sapiens
cttgcagagtacagtctaagaaagagagagtcaaaagcaagcaatgtgatgagggttgtgaagcgtggtcccagtgaggaaattcatcagtctactcttckatttacagagtggtttacactttgatcctgtagaaatgcattttttaggcaacttagaacggtctttcttaatatgcctcaggtagtaatgggatggact

SEQ ID NO: 31453 - DNA, 201 bp, Homo sapiens
tttctttttgtgttatagtgagcatcaatttcatgaccagaaaagggtaacaaatacaactttatattgaattttgacatgcaaaatacttcagaaccatmtgctgccaatattttttattgaattcattgtaatcataagatagccacatatacctaaatatatacttcagtttgtctggaaaagtctcagatctgcagc

SEQ ID NO: 31454 - DNA, 201 bp, Homo sapiens
tgagagtttttttaatgtttttgagttcttatgattttctttttgtgttatagtgagcatcaatttcatgaccagaaaagggtaacaaatacaactttatrttgaattttgacatgcaaaatacttcagaaccatatgctgccaatattttttattgaattcattgtaatcataagatagccacatatacctaaatatata

SEQ ID NO: 31455 - DNA, 201 bp, Homo sapiens
ctgtatcagcctcttgagaagcttggacttacaggcatgcactaccatgtctggctgaatttttaaactctttgtagagacagggtaccactatgttgccygggcgcgatcctcccgccttggccttccaaagtgttgagactacagctgtgagccaccacacctggctgaaaactagcatttaaccagtatctagtaact

SEQ ID NO: 31456 - DNA, 201 bp, Homo sapiens
ttttagtgggagatggggtgtttccactggatagaattatgagagtttttttaatgtttttgagttcttatgattttctttttgtgttatagtgagcatcratttcatgaccagaaaagggtaacaaatacaactttatattgaattttgacatgcaaaatacttcagaaccatatgctgccaatattttttattgaattc

SEQ ID NO: 31457 - DNA, 201 bp, Homo sapiens
tatgttgcccgggcgcgatcctcccgccttggccttccaaagtgttgagactacagctgtgagccaccacacctggctgaaaactagcatttaaccagtawctagtaactctgtgcgagctattggaggcaaagtaggaagaagaggggctataacatgaagcagctcccaagttccaccatttttagttgtgcgatgttg

SEQ ID NO: 31458 - DNA, 201 bp, Homo sapiens
ctgctcgggaggctgaggcaggagaattgcttgaacccaggaggcagaggttgcagcgagccgagatcatgctgctgcactccagcctgggtgacagagcragactccatctcaaaaagaaaaaaaaaattaaatacataaaaaaataaaataaaatcccttaatggcttttcattgcttttaagctaaatatggtgcttt

SEQ ID NO: 31459 - DNA, 201 bp, Homo sapiens
tcactagtcagacatttatacgctcaaagatccgatggactataatgtgggcactgaattgcctttaccctggctaatgaatgctggcccagttggtgtargagcttggggatgatttctcattttaaattatacattccttggtagtagccccatatccattaaacatcttttggttgtccccaccaacactcctttttt

SEQ ID NO: 31460 - DNA, 201 bp, Homo sapiens
gaaatagatgaaaattacactatcattttcaatgacagatgcccagcttgattccctagctcataattatttgtatttgtgggagtagagaaaaacaaacygtattctgggaaacattcattgtcgcagaaaaataatatattctaaaggcatataagttttctttcagtagaaagtatgtgaggttcgatttttaaaata

SEQ ID NO: 31461 - DNA, 201 bp, Homo sapiens
tttctttttcttttcttttctttttttttttttttaagacagagtttcactcttgttgcccaggctggagtgcaatggcgcgatcttgactcactgcaacytccgcctcccaggttcaagcaattctcctgcctcagcctcccaagtagctgggattacaggggtgtgccaccacgcctcgctaatttttgtatttttagt

SEQ ID NO: 31462 - DNA, 201 bp, Homo sapiens
taacacaggattttgatgaattgtctgaaattttgtggttgaggttgctgggcttttattagaggttttgggaggacctgcgttttggtcttcaaggcagrttataagctttatgtagcaataatcattaagtagtaactttgtaggggtcagtcatgaatctaaattttctactatagaaaggctttcagagtttatcca

SEQ ID NO: 31463 - DNA, 201 bp, Homo sapiens
gtcctctgagatcttcctaatgaggcgtcccccaaattgcctatcatctcatgtttatggggtagtctgggacctttagtgacttaaatttagccttcatrtcttgggtgcagttgttaagagaaaaactggggagtataatgcctcccctggttccccaactgggaagatgtccagagaccaaggaatgactcaaacaag

SEQ ID NO: 31464 - DNA, 201 bp, Homo sapiens
cttattttatttcaaccataaaataatagcaaatacttacatcacgttgctttgatccaagctctgttctaaatgtcttacatgtattgctattcataacratttctcctctcccaggcaccattattacatccatttcatagaggtggacactggagcacagagatgttaaatagtttgctaaaaacctgcaaggacaca

SEQ ID NO: 31465 - DNA, 201 bp, Homo sapiens
tctgtttttcagtactacacatgtaggacaaaaactatttaaaacaaatgaaaaataagcttataacccggaaggggaatggagattagaatgaaactttyggaatgtgtttcttatctagaactaaaatacaagataggatagaggaatggtgcattcattccttcaacagatacttattgagcacctattatgtatgct

SEQ ID NO: 31466 - DNA, 201 bp, Homo sapiens
taggagggaaaaaaatccccaaacaaatacctgtggtttgaataatttgtaattaattcactgggtctctgattgtgacttctttcgctgatctgctgtgracaccgccaaactgtttgactggcactgtatctccactgtttcctttacatggggcagttcaattcctactaattagcactcagccggagtcttcctgtt

SEQ ID NO: 31467 - DNA, 201 bp, Homo sapiens
tctaagtagattagcttttattttaatctgtttcaacaaatgctgagcacaaactgcgtactagataataagaatacaaagatagcaagacaattctaatsctaaaagtcataaaatagtgttagataaggtcaagttaaatctactacaacatggtatggtaagggtgggactagtggtatgaataaggcactacacagt

SEQ ID NO: 31468 - DNA, 201 bp, Homo sapiens
taaatccaattaattaataagtgtgggcatggatattaatttacctaggcttgcccctttggggacttcttaacagatacaggtttatgtggtgatatcartgatttctagacgattacgattttttatatattgcttcttaagtatgtgtatgtcttatagttcaattactgttaactgctggaaaacaacagcaaacca

SEQ ID NO: 31469 - DNA, 201 bp, Homo sapiens
agactcaccaaatgaggtaactttcaacctttgcaagctgattgagattttgcagtcttagacggtgggagtgtatttagatctgagaataacatcagcaraggattgaaggtgggcaagttcctataagtttcaagagggccttgcctgtctggttcactgctgatcccattccttggaacagtgcctggtaggtgctta

SEQ ID NO: 31470 - DNA, 201 bp, Homo sapiens
tgtgtccattttttttaactgaaagggaaagtaaatgagttgtaatattttaacagtaagacatgcagtccactttaataacagtaattcttataatttaytttcttcgttagatataggaaagggtcaaaatatgtatagtcataagatcattttattaatttgacaaatatagatcaagaataaattatccaaagaact

SEQ ID NO: 31471 - DNA, 201 bp, Homo sapiens
tgtctggttcactgctgatcccattccttggaacagtgcctggtaggtgcttaataaatatatatgattcatatgtaggtatacatattaattgttgtttktgggaggaagcggcaggaattgaggctgcaaaggaaggttgcactatctggtttagggactgatattctatgctaaggggagtggactttgaccttggaa

SEQ ID NO: 31472 - DNA, 201 bp, Homo sapiens
actgatatgaatcaaataaatcattctttcaagaaaagatagccatgcttgaaaatctctttcaggtcacaagggtaacaaaataattaaaaagtgtttcwctttagttatcatatgtatattattcaataaaaggcctatagaaaaaaaaatgccgagattacacacattgcactagtcattgaactgataggtgagcta

SEQ ID NO: 31473 - DNA, 201 bp, Homo sapiens
tctctgtgtagcaactggtagcttttgtttatgcttattccaaacttatggaatgaaaataagtttatataacttggatgaagtataagacttaaaagactttccatagattaaaagttaattatagttatatactgtagagaggaaaggcagctaatgttactggccttttgttgtcaggcctcattaagttgcatgaat

SEQ ID NO: 31474 - DNA, 201 bp, Homo sapiens
tgcatgaaaggttagttttcctcaattttttgcaagaatgacatgtgaaaaaaatattggtgaacctagctattccttttccttgtattttgtgaccaagrtatttctatttataggaagaatataatcaagccattaatgtcaatgtcgtttttgttattcatacaaaccagttaaggaatctaaatgtgttaaatgtgc

SEQ ID NO: 31475 - DNA, 201 bp, Homo sapiens
ctctgtgtagcaactggtagcttttgtttatgcttattccaaacttatggaatgaaaataagtttatataacttggatgaagtataagacttaaaagactytccatagattaaaagttaattatagttatatactgtagagaggaaaggcagctaatgttactggccttttgttgtcaggcctcattaagttgcatgaatt

SEQ ID NO: 31476 - DNA, 201 bp, Homo sapiens
tttaacaaccacaaagattatgcccaggaaaagccctctcgtctgaaacaaaggttactaatttatacgctgtgattttaaatttgtagttatgtgaggarggttacagtccagagtaaagggtctcctagtgtaaattttttcctccttctcctcctcctcctcctcctcctcttcccccttctcctcctcccccttctc

SEQ ID NO: 31477 - DNA, 201 bp, Homo sapiens
ggtattagtgaaacaaatagccaaaggtcaactatacagatatttacagctatccaataactttccatgtaggctaggaactccttctacaaataaagtgrtcagaaagaaatagatgtttaccatttgaggaaatgtttctatcttggtagctcctagtttatgttaaatgggtgctagatttactaatttctgttaatg

SEQ ID NO: 31478 - DNA, 201 bp, Homo sapiens
attttccatcacctcctttttaacttaatattacatatttgtccaaaggcttagaaacattttaaacatacttttttggtttttttaaaatcaactttttrttttgaggaatatctgccctgcagaaaagtgcaaaaaaatgctttggtaacacctgtatattcttcaatcgtcaattatttttatttgccatattaattt

SEQ ID NO: 31479 - DNA, 201 bp, Homo sapiens
taaatagaacgagaaaggagctcttgaaggtggagcaatgtttctattgggatgtgttcagttggaaataacagaatacccaaacccaaactggcttcaamaacagaggggattttggggcttgcacagctcgccgtctaccagtgggtttgacacaatggctccatcttatctccagaaccagctgctttatgtctccac

SEQ ID NO: 31480 - DNA, 201 bp, Homo sapiens
gcagtgcagcacactttgctgatgttgctgggcgagaagcaggagagtcttggaaatccattctgaattctctgtatgagttgctgggtaagaagcatgaytgggttcatagcaacagagttatctatttaaaatgtccataaatggactaggtgtgatggctcatgcctgtaattccagcaatttgggaggctgaggtgg

SEQ ID NO: 31481 - DNA, 201 bp, Homo sapiens
gcccataaagcagcagattgctgctgccagagtagcagacagattgggcactgcatgccccaaggcaaaaggcagccacctaccaatcacgcaaggtgctrtttgtcttttgagagatctacttttcaatttcttcctgcttttggtccaagtgcctttaagtcaattcttaaaaggattttttccaaattttataatagt

SEQ ID NO: 31482 - DNA, 201 bp, Homo sapiens
tcccccttctcctcctcccccttctcctcctcctctttgtgcaaaggatgctgtagggaaaaattaagcaacctgttagtcatctaatttgttagcgtagrtgcaatctatctcaagagttacttttaaagatgtctgtgtttacattcttgcctgaaacttgcagagcattttctccaaatagtattttttatgataaag

SEQ ID NO: 31483 - DNA, 201 bp, Homo sapiens
tcctcctctttgtgcaaaggatgctgtagggaaaaattaagcaacctgttagtcatctaatttgttagcgtagatgcaatctatctcaagagttacttttwaagatgtctgtgtttacattcttgcctgaaacttgcagagcattttctccaaatagtattttttatgataaaggcggcaagttattttaacatcctttct

SEQ ID NO: 31484 - DNA, 201 bp, Homo sapiens
aagatcgtaagtactctgggggaaaatgagagtagaacaggataagggggtgatggagggaatgagtggtgattttaaatgtagttatcaggctgggcacratggcttacacctgtaatcccagcattttggaaggccaagacgggcaggtcacttgaagtcaggagtttgagaccagcctggccaacatggtgaaaacct

SEQ ID NO: 31485 - DNA, 201 bp, Homo sapiens
agactcaccgaagatgtccttgctgatgatcgggatgactatgatttcttgatgcaaacgtccacggtatgaggttgcagcttttgtcgtttatttctatytgtcactcattatgttttacatctccagtaatacataccgattcatcatacttagtaacattatttttaaaatgtctgtttctgtttttggatatatttt

SEQ ID NO: 31486 - DNA, 201 bp, Homo sapiens
ttttctgtgtgtgtgatggaaacacgtcagttctactctcttagcaaatttcaagtgtccaatacagtgttattaactacagggacccaccctactgtacwttaggtctccagaacttatttgttttataactttaagtttataccctttgaccaacatctttgtatttcccctcgctatgacccctggtaactaccctac

SEQ ID NO: 31487 - DNA, 201 bp, Homo sapiens
accaagttgcttttacatttaccttgctctattataggtaatagatgtgaagcttccgattcctggctcagagttggtgacttccatctcccgtggaagaygcctctgagtccactcaggatcttgtgtggtcacaaaggtgtaggaaacgtctggacacttgaggtggaagatgctttggggcattcccttccagattca

SEQ ID NO: 31488 - DNA, 201 bp, Homo sapiens
gtccttgctgatgatcgggatgactatgatttcttgatgcaaacgtccacggtatgaggttgcagcttttgtcgtttatttctatctgtcactcattatgytttacatctccagtaatacataccgattcatcatacttagtaacattatttttaaaatgtctgtttctgtttttggatatattttggggactgaaagttt

SEQ ID NO: 31489 - DNA, 201 bp, Homo sapiens
gtaccgcagaggcctccctgggagcagggccgctggagcagcaacagaaccttgcagcctgcagaagctcacaaccaaaacagagaacagggctgagctgygctgagcagagctctgggattctcttaaatctatcagtcgaaattatttctcctgaggcacataggaagtagagagggctgagagaggccgggagtgtgt

SEQ ID NO: 31490 - DNA, 201 bp, Homo sapiens
acaagtcccaatgttttccagtttgagttgggaagaataaaggtaataaaacttattcctggtattgtatttgtattttttctattaggatatagcattgwtttattctgaaatgaattcagtatattagtactgatatgaatcaaataaatcattctttcaagaaaagatagccatgcttgaaaatctctttcaggtcac

SEQ ID NO: 31491 - DNA, 201 bp, Homo sapiens
ggtgatttgcatgatcaggaaagtctgggaagtgggtcttaggaagcctgcaatgttgtctcttgtctgtgctttccaccagcgttccagttttgcacttktggtatttctgagcaagctcagcttctgtgttttggggtactggctcctaagagcagctgggtgtgtgattagacaaggaactgcttcactagtttattt

SEQ ID NO: 31492 - DNA, 201 bp, Homo sapiens
gtaacaaaataattaaaaagtgtttctctttagttatcatatgtatattattcaataaaaggcctatagaaaaaaaaatgccgagattacacacattgcastagtcattgaactgataggtgagctaatgaatggacttaaagatctgaaaccatgccacctacaatagtggtatgtatggaatactccagtaacataaat

SEQ ID NO: 31493 - DNA, 201 bp, Homo sapiens
tgcagcctgtgggtggtgcatgggcagcatctcctctctgcagtgtcctgcagcagcagtgcaatgtgattgatttcagaaatttaaaaaatatttgctgrcactgcactccagcctgggcgacagagcgagactccgtctcaaaaaaaaaaaaataataataatttcctgggataggtaggggaaacggaaatttacatg

SEQ ID NO: 31494 - DNA, 201 bp, Homo sapiens
taacaaaataattaaaaagtgtttctctttagttatcatatgtatattattcaataaaaggcctatagaaaaaaaaatgccgagattacacacattgcacyagtcattgaactgataggtgagctaatgaatggacttaaagatctgaaaccatgccacctacaatagtggtatgtatggaatactccagtaacataaatg

SEQ ID NO: 31495 - DNA, 201 bp, Homo sapiens
cttcatggtgttcagcaatgttcactgagcgtatgacctggctttgtgcaccgagaaaactgcccaaaataacaggtgccacagcttggtcacaagacagrcacagggccagtaaggtgctgtcagttgtgccccctatgctaagctgtgaaattctaatcccccggccccactttctaaccgtggaaatgttgggttgtg

SEQ ID NO: 31496 - DNA, 201 bp, Homo sapiens
tgaaagaacaactcagttggatgggttggatcagctaaagctcaaagaagaggtaacatttagtttgattactaactgtaaaatagaagctcttggggtaygtttattaggagaggtcattctgggcagaggatgagaagaagcaaaaatatgtaagagtgaacatgctgaaggttaaggaattcagtgtaaccgtaacaa

SEQ ID NO: 31497 - DNA, 201 bp, Homo sapiens
tctgtgtagcaactggtagcttttgtttatgcttattccaaacttatggaatgaaaataagtttatataacttggatgaagtataagacttaaaagactttccatagattaaaagttaattatagttatatactgtagagaggaaaggcagctaatgttactggccttttgttgtcaggcctcattaagttgcatgaattg

SEQ ID NO: 31498 - DNA, 201 bp, Homo sapiens
tattctatttgttaatattttgcttaggacttttgtagctaagtttatgggcaatacactggtatatatttttttcttataatgtctttgttagattttgrtatcaatgtaaatctagcttcctaagtaggaaattttctcttctgttttctgaaagaatttgtgttaattctacattgtttctttttcaaatatttgata

SEQ ID NO: 31499 - DNA, 201 bp, Homo sapiens
tcaagaccagtctgggcaacataatgagaccacccccgtctctacaaaaaaaaaaaaaaaaaaaagctcagcatggtggcatgcacctatagtcccagccrctcaggaggctacgggaggctaaggtgggaggattgcttaagcccaagagcttgaggctgcagtgagctataatcgtgccaatgctctccagcctgggca

SEQ ID NO: 31500 - DNA, 201 bp, Homo sapiens
tcgtgccaatgctctccagcctgggcaactaagcaagatcctatctcaaaaaaaaattattccaataaaccagggttattcttgaggtattggccatctartatgcctgcatatttcagtttattccaataaaattgaaaataaaacgtgttttctctgactttattgttataattaatagaattagaagctgtcaatgtt

SEQ ID NO: 31501 - DNA, 201 bp, Homo sapiens
tgacctaatcacctccccaaggggaacatctcctaataccattgtcaggcctttgagcccaaaggctggatgtacactgtgacctgcacgtgtacatccasatggcctgaagcaactgaagatccacaaaggaagtgaaaatagccttaaccgatgacattccaccattgtgatttgctcctgtcccaccctaactgatac

SEQ ID NO: 31502 - DNA, 201 bp, Homo sapiens
ttcttactgactatgagattatgaatggaaattaaaatatgtatagttatattgatggggtgttctcttattttggggttctgtttttgtggggttttttwatcttttaataagctaaaatttctaagcaggctttcataggctttctcttgatcttaatttctttgagcctcctggtgtaatcttaaattccccaattat

SEQ ID NO: 31503 - DNA, 201 bp, Homo sapiens
cccacatctccaatcaccagagagaaatgcaaatcagaactacaatgagataccatctcataccagtcacacttggctattgttaaaaagtcaggctgggyacggtggctcacacctgtaatcccagcactttaggagaccaaggtgggcggatcgcctgagatcaggagttcgagaccagcctggccaacatggtgaaac

SEQ ID NO: 31504 - DNA, 201 bp, Homo sapiens
taaagattcttactgactatgagattatgaatggaaattaaaatatgtatagttatattgatggggtgttctcttattttggggttctgtttttgtggggytttttaatcttttaataagctaaaatttctaagcaggctttcataggctttctcttgatcttaatttctttgagcctcctggtgtaatcttaaattcccc

SEQ ID NO: 31505 - DNA, 201 bp, Homo sapiens
cctagaaatagtattagtctattagtagactaatactccagctgtgggaaaaacaaaaaacaagcaaaacacccaaacctcccccaaaccagaagttttaraaggattaaatttaaaggatttaatcagaatatattaaatttaaaaggaaatatgattgaggcattagaaacttctgaggtagcgaggacttgaagagac

SEQ ID NO: 31506 - DNA, 201 bp, Homo sapiens
gaaaaggatcagttaagaagatataacaattgtgaatttatatgcattcaacactggagcatccaaatatatgaagtatgttttatctaaagggagagatrggcttcaatgcaacaatagtagggaagttcaacaccccactttcaacaacagcagataatccagacagaaattcagcaaggaaacagcagatttaaactg

SEQ ID NO: 31507 - DNA, 201 bp, Homo sapiens
aggcttatacagtaaacatgtgaaaggtacagttgacttctctgcttgaatttgcacatggggggaattcgttctcttcttttgcccttttcacagaaccktaaaatgtgaggactgaaggcaccttggaggatgcccagttcatccactggtggggaactgaagactagacagttacacggtagttcaaatgcaatcata

SEQ ID NO: 31508 - DNA, 201 bp, Homo sapiens
tctcataccagtcacacttggctattgttaaaaagtcaggctgggcacggtggctcacacctgtaatcccagcactttaggagaccaaggtgggcggatcrcctgagatcaggagttcgagaccagcctggccaacatggtgaaaccccatctctactaaaaatacaaaaattgcctgggcatggcggtgggtgcccataa

SEQ ID NO: 31509 - DNA, 201 bp, Homo sapiens
cccattattgctctgtcctaccctactttattttctttataccaattccccaacagatgtgtgtgtgtgtgtgtgtgtgtgtgtgtgtgatgcatatagayacattgtctctccctattttatttctacaaagacaggagttttgtctgtttcgatctttcctttccatagtgcccaaaatagtgcctgaaatgtcacaga

SEQ ID NO: 31510 - DNA, 201 bp, Homo sapiens
attcacaagagcaaagacatgtcatcaatctaggtacccatccacagtaaactgcataaagaaaatgtggtacctatgcgtcatgaaatactacggattgrataaagaaaatgtggtacatatacaccatagaataccacgcagccataataagattgacatcatgtcctttacagcaacatggatgcaactggaggttgt

SEQ ID NO: 31511 - DNA, 201 bp, Homo sapiens
catttccttggtattttagagcttaaagatagtctctcatttaaagggatatcgtccaatgtttaagtcttgtcctcgtgtctaatctcaagtgtgtcctrgcagtcctccctttactaaggcagttccctgtctcgtattcctcaaagcccctcttcccttcccattctcagctgatttcactgagaaaacagaagcagt

SEQ ID NO: 31512 - DNA, 201 bp, Homo sapiens
tgtataatatgattgatttagcaacaatccattcaattcaggcaaaatattattgaatcttaactccctatatggaaggattgaatataaattatgaccayaatcatggtcatgatcatcaccatcaccatctgcatcctcagagctgacatttgttgtgcaaggacttttccaagtggtctacgtgggttatattactca

SEQ ID NO: 31513 - DNA, 201 bp, Homo sapiens
tgtggctggagaatcacttgaacttgggaggcggaggttgcagtgagccaagatcacagcattgtactccagcctgggtgacagaacgagactccgtctcaaaaaaaaaaagagtacataaacacccatccctgaagaatatcatctcatccccttgtgaaaaaaaaaatctcatctcctttccaaaaaataccatctcat

SEQ ID NO: 31514 - DNA, 201 bp, Homo sapiens
caaggacttttccaagtggtctacgtgggttatattactcattcattcttcacagtaacccagtaaaaattattcccattttacatatgaagaaaatgagrcagagaggtcaacagcttgcacaagttcacacaaagaagtgacatcttaagaaagttaataacaatcaaatgtgaaagtgagtcatcaacttttagttgc

SEQ ID NO: 31515 - DNA, 201 bp, Homo sapiens
ctagtccagtggaggctcccattgtcaaagccctttatagcaaagctcttaaagtgtgtttatttcataaagtccaaggattcattgtcttattttaaaamtaatgtttaatcactcactgtttttatgctttatcagcacttgttaaagataatttggcttgaggccaagagttccagaccagcctgagcaatatagtga

SEQ ID NO: 31516 - DNA, 201 bp, Homo sapiens
aggttggaggtgtcgcttacaatgtgcaatctttcattaataatgtattttatgattctgtactaaagtccactaattagaattgtgtgccctataaaatyttattgtaaatatatgcccaactgtcaagctatgaagaactcgtaaggatttgtgcttttattaatatgctaatgctagtcttttctgggccttagattc

SEQ ID NO: 31517 - DNA, 201 bp, Homo sapiens
tttgatacgggagttcagaagaaagtacctgggcagatagtgagggtaggggcatcctcggtaagattttccttttaatgtaaagcagcccccaaatggcrtgttcagaatggcggctccatctgcccttctctctatcagtcacgtgtagagtaaggagcagagaagatggtgtccttagagtggaaagtctatttgcat

SEQ ID NO: 31518 - DNA, 201 bp, Homo sapiens
tgtaagcaatttaagatagagttttccataatggaaactcttaataatgggatggcgtgctttgagatatcatgttgaggaattatctacaatataagatrtttttggtatggtcctttcctaaaaggtgggagggaaattgttggaggctctatccaaccattgacagagtatcctttgattagtagtgatacggttttg

SEQ ID NO: 31519 - DNA, 201 bp, Homo sapiens
tttgttcaaaagaggaaagatttgctaactctgacacacatgggaagagcttatgaaatattttattggtttttgctctattgttcattgctattgcatayaaacataagattatatatataatttgtgcattataaatgtacctcattcatgcataaatacatgcttcatacattaaacatgtatttttcccccatgctt

SEQ ID NO: 31520 - DNA, 201 bp, Homo sapiens
gtgtcttccaaagtactcatttttttctttggtgctgttctgttcgtaagccctttctgtacctttaaaattttagttttcatgctttttttttcttgtcyttatctcacccagctcacctttttatctcagcttgctgttctttcatctggtctgctggtttattatctcagcatattttcccattgtgaatttccactc

SEQ ID NO: 31521 - DNA, 201 bp, Homo sapiens
tttaacatatgtaatggattcatgatcaaaatttgatgtgactgattgaattgtcttttattattatttacctcttctggtgttcagtatttgttatataytctaccctttttcttgacaaaaaatgaaaccagaatgttatgtattcagaaaataggactctgaatagttctgtatcatttccccattgctctaaagtca

SEQ ID NO: 31522 - DNA, 201 bp, Homo sapiens
aagaaatttttgtcccattttgttaaataaaattttaaaaatgaaagcttgttttttaataaaatatatatacattgaagaaaatttgttaaattgggagycatagagaacaaaattaccaggaattccactattctgaagcttttaaataaaaaccctgctgctgttttcctatttaaaaataaaccatatgttatcttt

SEQ ID NO: 31523 - DNA, 201 bp, Homo sapiens
gtaagactctgtctcaaaaaaaaaaaaagtgagcttaaagttcaaaatgttatgtgtcagagaaaggaaaggccaagaacatgcaaaaaaggtgggtgacragtataaaaacccaaacattggccaggtgcagtgactcgcgcctgtaatcccagaactttgggaggccgaggcaggtggatcacctgaggtcaggagttc

SEQ ID NO: 31524 - DNA, 201 bp, Homo sapiens
aaatgacagtttgacgacatacttaacaaatccctaggcaccaaggatttggggttttgttgggaagaaaacatctaggccagaaacgatgtacttttacyttgttttgaatcttttattgtttggatcagacctcgtttaaaaatgtagaggaaaaatttaatagttccatttctacctggaaatactacctagaaatag

SEQ ID NO: 31525 - DNA, 201 bp, Homo sapiens
agcttaaagttcaaaatgttatgtgtcagagaaaggaaaggccaagaacatgcaaaaaaggtgggtgacaagtataaaaacccaaacattggccaggtgcrgtgactcgcgcctgtaatcccagaactttgggaggccgaggcaggtggatcacctgaggtcaggagttcgagaacagcctggctaacatggtgaaacccc

SEQ ID NO: 31526 - DNA, 201 bp, Homo sapiens
tactcaggaggctgaggtgggaggatcactagaacctgggagttccaggctgcactgagctatgattgtaccaccctgggcaccaaagtgagaccccgtcycaaaaacaaacaaacagaaaaaacagagagggaaaaataaagaaaaatacatatgtataataataggttctcaatatatattagtttctttccctttcta

SEQ ID NO: 31527 - DNA, 201 bp, Homo sapiens
aaggccaagaacatgcaaaaaaggtgggtgacaagtataaaaacccaaacattggccaggtgcagtgactcgcgcctgtaatcccagaactttgggaggcygaggcaggtggatcacctgaggtcaggagttcgagaacagcctggctaacatggtgaaaccccgtctttactaaaaatataaaaattaactgggtgtcgt

SEQ ID NO: 31528 - DNA, 201 bp, Homo sapiens
taggattttccccaaattattagaagacattgctggaccattgtcattagccattgaggagctgtagagaaagagggagatgtaatagaggcagagatccraattctagtagctgtagattggtgtttctgatctcagtcccaggtgacaccctagactgatagtcaagtatatgttctgtgagaaacggaggccaccatg

SEQ ID NO: 31529 - DNA, 201 bp, Homo sapiens
tatagactcttagtgtaggaaggacatgtagaggtcatctattctaacatctcaccgagtgcgggggtcccttctgtagtagtttcacagttgaccattcrgtatctgcttgattaccttcagaaacagagagcccactgtgttagttttttattgttgctataatacattaacacatatttcatggctgaaagcaacaca

SEQ ID NO: 31530 - DNA, 201 bp, Homo sapiens
acgctgacccacaagtcttctgcttcttctatctgcaaccttaaccctcccttgacagggaaggtaacattcacagggtctagaaattatgatgtgggccyttttttttggtggggggcgcggggggcattgctgtgcctgaccacccccatcccatctccccaccttttccccctggcaagccaattctactttctgatg

SEQ ID NO: 31531 - DNA, 201 bp, Homo sapiens
gtcaaagagtatgaagtttcagttagatagtatgaataagttgtgaataagttctggagatctattgtacagcatggtgactatagttaatgtatgcttgmgaattgctaagagagtagatcttaaacattcttactacaaaaaataggtatgtgaggtgatagatatgttaattagtttgagttaatcatttcacattat

SEQ ID NO: 31532 - DNA, 201 bp, Homo sapiens
ttatttttttgtcaggtttttaagtccttgttttagatttagaactaatgtctgggttttttttggtggtggtggttgttttgttttttaatggaagggaygatgggcagtgtatccctgggtgtctgagtgtatattcatcctgctaattgagttgtccattttactaatgtcttctgacagcctttcattgatctttat

SEQ ID NO: 31533 - DNA, 201 bp, Homo sapiens
gtaactaaagttttgcatatgactaaatgaataggtgagtaattcagttaaaggaaactaatttgaagagaagtttcaattttctcataggctgtatgttmtattcttgctctagatctaacaagaaaatgttttatagaaaagactcttggcatcgatttgatttatgttaaaatagaaatcaacagagctctttatttg

SEQ ID NO: 31534 - DNA, 201 bp, Homo sapiens
aaagctgaactttgcctcatgtggagtacaaatgatagacatttatgaatgctttatgggcctaaaacttatgaaaaataagaaataagttgaactacacytaagattttatgctaatgagtttatatctaaaagcattccatgtagttgtatctaacaatgatacttactgaattctttcttcattgagtgccaatagct

SEQ ID NO: 31535 - DNA, 201 bp, Homo sapiens
agagagagaaggggagtccggatcatcccaaggtttctggcagacagatgatgtttcaccagctaagatggagcggtcctggaaagagtgaagatcaagartttcattctggaaatgtgggggttttcgctgtctgtcagagagtcgtggagctgctgggaggtggttagtgtggacttctggagagagggctgaaactgt

SEQ ID NO: 31536 - DNA, 201 bp, Homo sapiens
ctttgtctggtttatgagattaaagtttttaaacaaaattctgttcaaaataataacaatgtccagttcttttagcacatactctttttctcagtagctgyaacactgttttagtacattgcaaaaatagtctccagttaacaaagagctgcatgagctcttttgtattttcatatccgtcgaccttcctgaattctggca

SEQ ID NO: 31537 - DNA, 201 bp, Homo sapiens
aagacaatttttctacgggccagggctggggttgaaggtggggatggtttcaggatgaaactgttccagctcagatcatcaggccttagttcgattctcayagggaatgagcaacccagatccctcacagacacagttcacaatagggttcgcactcctatgaaaatctaaggccactgctgatctcacagggggcagagc

SEQ ID NO: 31538 - DNA, 201 bp, Homo sapiens
ctccagcacctgatgaccttgttggggttggagagatttccctctcagcatcatctgtgtgtgctcatatataacgttaggctaagaagatagcccccccyttttttatatagagctttgccatttgcttccacaatgcaatctagattatttctttggtgtcctcatatgtgttttccattttaaaggtggataaaatgt

SEQ ID NO: 31539 - DNA, 201 bp, Homo sapiens
ttgttgtctctgagaatgttacatgatatgagtagcaagtctgtttattcagaaaaacacctcagatctcaaaccaatttagagagctcagaaagcagtamttggagagacacttccgagagatagcttagtacatcatcagagtccttattcctgattctaaggccatttaagcatgggtcacactggactgctagttgg

SEQ ID NO: 31540 - DNA, 201 bp, Homo sapiens
tgggacaaataggcagatgaaagggaattcactctctctgctttctgtctcccttctgagcaggtcactttttctcctccggcctttggacatcccagtcyggtttctttggcttttggactccgggacttttaccagtggcctcctgggggctctcaggcctgaccggtggtgtgctgttggctgccttgcttctgaggc

SEQ ID NO: 31541 - DNA, 201 bp, Homo sapiens
ctggagacggaggtcctgcagctgcagctgaggcccccactcttcctgcactgggcagagagccgtgatggggcctcagcaggagtgcatggaggaggacscctactgtctggacctggaccggaggcttggcaagatgcaggacaactggaagccgtgagtcagacccgcgactggctcaagaagattgcacaagacctg

SEQ ID NO: 31542 - DNA, 201 bp, Homo sapiens
tacttcaggagcatgtcacagttatgagcctgtaggcaagaacagggttttttttttcctctccttttagggaagaacaacatattgaaggatgattaagrcacttgaaaaatgtaacagaaacatacacacacacgcattgcatacacaggatccaatccctgatgccctttgcctctcttcttgttttatttcatttat

SEQ ID NO: 31543 - DNA, 201 bp, Homo sapiens
tcttttttttcttgagctatgtatgaggaaatctatagctcagactgtgtctggtgttagtatgtatcaagctctttagccagaaggaggagcaaggcaartgaaccacatcccttggcacttagttccttcttactttccctatatgagagagtacatgcactcctgagcaaggagactgcagggcggggatctctagaa

SEQ ID NO: 31544 - DNA, 201 bp, Homo sapiens
tgagctgttggatagaaaacacttcttttgctgcggaggggcttgcgttgccaagtgcgtgttccgattgaggctggataaaagaacggcacaatcaaacygtgcagtgcagtctgtgaacaaattgtctccagctcgaaatgatgaaaagaatattttaacaacttttgacttcatttaatgatctaaacagtgattatt

SEQ ID NO: 31545 - DNA, 201 bp, Homo sapiens
cccaggctggtcttgaactcctggactcaagcaatcctcctaccttggcctcccaaattgctgttacgggcatgagccaccacacccggctacatagaggycctttataccaaaacttcctgagcagcactattttacaggcagtgttaacataattgtaacatatttagatcttggcatatttttcaatattggctttag

SEQ ID NO: 31546 - DNA, 201 bp, Homo sapiens
tgccaccctgtgatgaggagctcttcattggtggggcagttgggaagagcatgctgctctctttgggcaaagagatttcccatgtcatagactttgatctygtccgcactgtgagctccaggtcagacacacagagggaccgctaagccctagagtgcaacacttcactgcccattaacagtttattttatttttgcctgc

SEQ ID NO: 31547 - DNA, 201 bp, Homo sapiens
ttgaaaaaagtttacgtattatgatggatattatgcaatacaagagctattttagaaaaaatatttgtaatggcatgcataatcttaattttgctctgttkcttgacaaaattttaaattgcccttgaatttttcaactacatttgattttcttcatcttactgaattgtctgaagatcaatcatcataatttgtgagagg

SEQ ID NO: 31548 - DNA, 201 bp, Homo sapiens
aatatactatatcagcatatactattagtatatactaatatatactatatataatgtataacaaatatataatatataataaatatatataatatataacwacatatatcatatattttatatacactatatatgttttcatttttcttctggatatattaataaatatattcttgaagtagatgagagaggggaggaacc

SEQ ID NO: 31549 - DNA, 201 bp, Homo sapiens
atgactttttaatcatacatttaaactaatacacattcctagaggtggtactctaagctgaatattttctaacaaagtctatctattattatgtctaatamcacatttatcactgtattttagaaatgtttaatattaagattagtccccctcattcttttcccctgacccccaaattgttcttattcttcttgactattt

SEQ ID NO: 31550 - DNA, 201 bp, Homo sapiens
taaggaccattttgctagtattcttgggtcatgaataaatacatggttttcataaaatggttaaggaaacttagcagaaaactcccaatgtcatttgtgasaaagtaaatcatgaacattacgataacagaagaagatgtgtaagatgaaatgggagaaaatattacctaatgtatgaagttttggttccctaaaaagttg

SEQ ID NO: 31551 - DNA, 201 bp, Homo sapiens
cgagaatcacttaaaccctgaactcaggaggcagaggttgcagtgagccaagatcataccactgcactccagcctgggtgacagagtgaaactctgtctcaaaaaaaaaaaaaaaaaattgaagtcctgaatttatataattttttaatatatttagaagctttgaaaagttttacatgattactgagcattttaaagagc

SEQ ID NO: 31552 - DNA, 201 bp, Homo sapiens
aagtcatctcactaactgacagtagactaaggtgatcctggattatgatcaggcatctagcagaagtaaatgttaattttctctagagaaagataacatcrccatatgcctcaaattatttatatgatcaatttttttagatacagggtcttatagaaatctaaaatagcccagctgttccctggcagatgggaaaggaat

SEQ ID NO: 31553 - DNA, 201 bp, Homo sapiens
caggatggtagctagcctctaagatggcctgtaatgatccctgctttcaaatctgcatttttttttttaggtagagtcttgctctgtcacccaggctgtaktgcagtggcacgatcatggctcattgcagcttcgacctccagggttcaagtgatcctcccacctcagcctccagagtagctggcactactggcatgcact

SEQ ID NO: 31554 - DNA, 201 bp, Homo sapiens
acctccagggttcaagtgatcctcccacctcagcctccagagtagctggcactactggcatgcactaccatgtttggctgatttttaaaaaaatgtgtatrtaggtggggacgccctacgttgcccaggctggtctcaaactcctgggcccaagcaatcctcccacctcagcctcccaaaatgctaggattataagcatga

SEQ ID NO: 31555 - DNA, 201 bp, Homo sapiens
taaggagagaagaaacctgaaattgcatgggatgatgtgagagtgaacagggaaatgtcacatgattctcactggtcccacttaatgcagtgttcaggtaragttgggttttttaccaaggatggttttttgtcaagcaagtaaagggaaggaagagagggtaggcactgaggaagcatgcaagggagatctgtgatgatg

SEQ ID NO: 31556 - DNA, 201 bp, Homo sapiens
gactccgtctcaaaaaaaaaaaaaaaaaaaaccaagtgggagtcatcccttagttaggaaaggtatgaaaacttgcacccttttggttgtccacgtttccrttggtggttattggaggtgttcccttgggtctgaagtaccaagctcactaggatgacttctgaatgattcaccgctgatctgactgatccagcacttgtg

SEQ ID NO: 31557 - DNA, 201 bp, Homo sapiens
aaataatttgacagactctatggtactgaaactatggtggctttgacgaaatggaatcattgtctggcaggcagtgctgtgtgacgtgctagctcacaacrtgtgtgcagagatgcaggcgagttaacactcagtgatgtgtaggcgatgtgtgcctgaaagtgaggtttgttcaagagctaaacatagaaaagtggatga

SEQ ID NO: 31558 - DNA, 201 bp, Homo sapiens
gatctggataagattgcctttgacctctatttttcagattttgggaaatccagccccctaccccaaattttgtgaattcttcaggttcatacatttttgtkttcacttctgttcccaagctctagcttcctctgaatgaattttcctcttcgagtgagcaaatcaagtaggataaattgttcaaagcatttctggagtgtt

SEQ ID NO: 31559 - DNA, 201 bp, Homo sapiens
agcatctggtttcatgttggatttggcttggccctcaatctatcaatatcattgatgggatgaattcagaggatggaagattcttggaaaacaagtttctrgatagggctgggatggaatcttttctgtttttgtatccccggtgcttaacctaatacctggcatgtggaaagcccctgaagacagatatggcaggcactt

SEQ ID NO: 31560 - DNA, 201 bp, Homo sapiens
gtacttgaaaaggtatacggtatttagccagtgctaacttagccattgtttttgttgttgtgtgtaatgatgcagacgtcatgatgactgctgaaggagcrgaggaggacctttacaatcaacaccctttaggaaatggtggtgggccaaggacagagtcaaaggtttttaagcagtggggtgtggcatggacattgatct

SEQ ID NO: 31561 - DNA, 201 bp, Homo sapiens
ataaaactgtagcactgaacttttctttaagtgttgaagtgaaggaaatgaagaactcagcacggaccctgcttagactccggcagaacaggtggtcttgrcatgacgtcgctccaacatgcacgcaacttgccttttattctctcagctctttgtgccactagtacatggtcacctgggcatttctttagaaagggtgca

SEQ ID NO: 31562 - DNA, 201 bp, Homo sapiens
tttatatcaaaccatatggaagtgattttttctggttagtcattttcacggggattagagagtagagaaaagtcaaagaaccagggattcccaaggacacrcttggcctggtcaatattactaggattggcccagatgccaccaaatccttttttcttcctacttattgaaaaccctgttaaatttgatatgtgtaatatc

SEQ ID NO: 31563 - DNA, 201 bp, Homo sapiens
taaaagattctagatatgtataaaattttagcttttccttatagcttcttgtaacttaagattttaatgtatagttagatcttgactgccctctagtggcrtatattttcttagctatattgtttggagagcagagtgtatggttactttaggcctttttaggccctagttaggtgattggtggtgtgtcatgcctgggag

SEQ ID NO: 31564 - DNA, 201 bp, Homo sapiens
ggacacacttggcctggtcaatattactaggattggcccagatgccaccaaatccttttttcttcctacttattgaaaaccctgttaaatttgatatgtgwaatatcttttctctaaaattttagccttgcaaataaaattttgcataacatttttattgacaagacattgtgtcacattaaggcttttgaaggtgatgaa

SEQ ID NO: 31565 - DNA, 201 bp, Homo sapiens
taacttccttttagttaggtactccagggtactactttttgtgatggcagacacacttaagctatttgtaaatgtgtcaccaccttttcaaataattttcmttgaaggttaacatgttttctctgagaaaaatttatttaattaaaaaccttatgtatataagggctacaataaaattttcatggactctgagatgaaaag

SEQ ID NO: 31566 - DNA, 201 bp, Homo sapiens
aggttttaaatttttttaattaaaagtatacagaacttactatggtcttgctgaaagtgatgtcagttttgtctttagttgagttgaaggttatcttagtyctttgtgaagagggttttttttttttggacagggtcttgctctgttgccaaggctgagtgcagtggcatgatcacagctcacagcagcctcaaactctca

SEQ ID NO: 31567 - DNA, 201 bp, Homo sapiens
taaagcatacacatagaaatgagttttgggggactctttggagataacctcagaacgaaagtaaaatgttgcagtggagagttagcctaatcaagaaacasagagatgactaagtgaccttcccacacatgaacacaatattttgtctcatcctttgttcaatttagagactgacctttgctaaaatgccggtgacaagga

SEQ ID NO: 31568 - DNA, 201 bp, Homo sapiens
gatttatgtatgttgatcaatgaaggttaaaaaacactgttaactaaggttttctatttgcagtgttttctgacaaatatttttcctccagattttaagcrtgttattatgagtcaacctttatgtttgtaaagccttagtcttgttaataatgtataacttccaaatgaatcatatacttatgcatagcacttgaatatg

SEQ ID NO: 31569 - DNA, 201 bp, Homo sapiens
tttattgatggacttcctttatgtactcactctgcgttagcatgttggagacataggatttgctggcatcatctggttatgaatgtgactgtggggccccwgggaggttcccaaggttctggttggtggttcgagtcaggactcaggttttcctgtctctggaacagtcgtttgtgttataccaggccataggcacagaat

SEQ ID NO: 31570 - DNA, 201 bp, Homo sapiens
tctgcgtctgcctcattgcttcctatttttgccacacacccagtgagtaatggtatggctttgcttcccaaacaggttaaagattatgaagttctgtgctwtcataaggaggttttcaatgggaatatctgcttttacccaccggtctttctgttttgcccccaagaggttaaaagcagttttcattctcatccattttgt

SEQ ID NO: 31571 - DNA, 201 bp, Homo sapiens
atagcttcatctgcgtctgcctcattgcttcctatttttgccacacacccagtgagtaatggtatggctttgcttcccaaacaggttaaagattatgaagytctgtgctatcataaggaggttttcaatgggaatatctgcttttacccaccggtctttctgttttgcccccaagaggttaaaagcagttttcattctcat

SEQ ID NO: 31572 - DNA, 201 bp, Homo sapiens
atggttattggtgctctgtttttgttttattcttcgtagtcaaccaaaaagaacagagttgattacatgtttcatttgggatatttattaatgacaattgstttcatctttagatcttccataatcagaataggaaatttaaataccttgggtatgtcatggttatttcactttttaaaaatagggatacaatgagatgtt

SEQ ID NO: 31573 - DNA, 201 bp, Homo sapiens
gacaaatattcaaggttgggctgagagggtggtggggtttaagcagagacaggcgacaaataaataaaagaagaggtaaagctcccagttaatgatgaggrccaggcagtaggggctggcagtaggccaccgtggcagggactggctgatggctgggttaggtgggctggccagtgaggcttctcacacactttagccaga

SEQ ID NO: 31574 - DNA, 201 bp, Homo sapiens
ttcagtgagctgagatcacaccactacaccccagcctgggtgacagagtgagagtctatctcaaaaaaaaaaaaaaaaaagtgaacatagatttgcatacrtgtataagcttgaagaatttgaagcttccttatgcttaatgggttcgtggttttattacatacatacactgtatatgtgcacatatatatgtatgtgtgt

SEQ ID NO: 31575 - DNA, 201 bp, Homo sapiens
tgatgctcagaaatgctactgtcggccaggctgggctttcacaggtgcccagctgtagacgtggtgagccatgtcattgttgggtgcacagtaggtttggsctcttggggtacagtgtaaacaagacaaatattcaaggttgggctgagagggtggtggggtttaagcagagacaggcgacaaataaataaaagaagaggt

SEQ ID NO: 31576 - DNA, 201 bp, Homo sapiens
ccagcctgggtgacagagtgagagtctatctcaaaaaaaaaaaaaaaaaagtgaacatagatttgcatacgtgtataagcttgaagaatttgaagcttccytatgcttaatgggttcgtggttttattacatacatacactgtatatgtgcacatatatatgtatgtgtgtatattacacacatctagcacacacatatat

SEQ ID NO: 31577 - DNA, 201 bp, Homo sapiens
cagagtgagagtctatctcaaaaaaaaaaaaaaaaaagtgaacatagatttgcatacgtgtataagcttgaagaatttgaagcttccttatgcttaatggrttcgtggttttattacatacatacactgtatatgtgcacatatatatgtatgtgtgtatattacacacatctagcacacacatatatgctgaccagcata

SEQ ID NO: 31578 - DNA, 201 bp, Homo sapiens
ccaggctggagtgcagtggcacaatctcagctcactgcaagctccacctccagggttcacaccattctcctgcctcagcctcccgagtagctgggactacrggcacccgcaaccacgcccagctaattttttgtatttttattagagacagggtttcaccatgttagccaggatggtctcaatctcctgacctcatgatcc

SEQ ID NO: 31579 - DNA, 201 bp, Homo sapiens
catgaataacgtaatggcagaatcaaatttagaaactcagcaaaaaaaaaaaaaaagctttgtgtttcaacatgaatttctttttttttttttttttttgrgatggagtcttgctctgttgcccaggctggagtgcagtggcacaatctcagctcactgcaagctccacctccagggttcacaccattctcctgcctcagc

SEQ ID NO: 31580 - DNA, 201 bp, Homo sapiens
aaaacactggctctctctcagaagcccttaaggatgaattaactaattacattttctatggctcaggcttacttttgatgtcagtacaccatgtgactttstctctcggtctggactcacattaactacattcctggcatgtcacactgaggtactgatttgcagtgataataactgtcttataatccaaaatattcattt

SEQ ID NO: 31581 - DNA, 201 bp, Homo sapiens
ttctaaaaacaatgtagattttcaggcaggtgcagtggtgtgcctgtaatcccagctactcatgaggctgaggagggaggattgcttgagcataggggttygagaccagtctgggcaacatagcaagaccctatctcaaaaaaaaatgtagtttttaaactaaagaattcaataatggcctgtacagatttggacctccgt

SEQ ID NO: 31582 - DNA, 201 bp, Homo sapiens
aaaatgtagtttttaaactaaagaattcaataatggcctgtacagatttggacctccgtcctatccctagagggacattttatagacttcattatatatartatatgttgtttaaagtgtattatatgtatgtatgtttttcctattttcttcttgttagctttaaggatgaagtaggatttttaaaacagttgttaaagt

SEQ ID NO: 31583 - DNA, 201 bp, Homo sapiens
gcggtctcagcgcactgcaatctccacctcccgagttcacgccactctcctacctcagcctcccaagtagctgggactacaggcgcccaccaccacgcccrgctaattttttgtattttttagtagagatggggtttcacaatgttagccaggatggtcttgatctcctgaccttgtgatccacccacctccacctcccaa

SEQ ID NO: 31584 - DNA, 201 bp, Homo sapiens
aggatcacaaatcagacaattttcccttattttcctttttctctcctgttttcttctgctattcttaaaaatgattggatcccacccttcccatcttcagytgtagcattttgagacattgtgcctttttgtctaaaatattctatttgatgaacggttaaactaatagtctgtgagctcctttagggcaagaatcacgtc

SEQ ID NO: 31585 - DNA, 201 bp, Homo sapiens
ctgctattcttaaaaatgattggatcccacccttcccatcttcagctgtagcattttgagacattgtgcctttttgtctaaaatattctatttgatgaacrgttaaactaatagtctgtgagctcctttagggcaagaatcacgtccaggtttcgtctcctcagtgctgagggttgtgctcaaaacagagtaggtagggaa

SEQ ID NO: 31586 - DNA, 201 bp, Homo sapiens
agctgtagcattttgagacattgtgcctttttgtctaaaatattctatttgatgaacggttaaactaatagtctgtgagctcctttagggcaagaatcacktccaggtttcgtctcctcagtgctgagggttgtgctcaaaacagagtaggtagggaaggaatgattgccgaatgaatgaatgaatggagaaagagtggat

SEQ ID NO: 31587 - DNA, 201 bp, Homo sapiens
tctaacaattaatacttgacagacacagactgttatcaacagcagaatctttggattaactttcttaatattgaagaagggtatcttatactggtataaarcagttcaatttacaaaacaagtttatatgtattatttgtatttcgttaggatctgcaggatacacatgaatgatctcatttggaaacaatggattgtcag

SEQ ID NO: 31588 - DNA, 201 bp, Homo sapiens
tcttttctaatgataattccaaagatttaaataactttctagatttttgtaccttccacactgtataaaacacccctgtcttccctgtcaagaaaattttkggggaaaaaaaaagaaaacattgtgcacagagagttgataatgaatttaaatattactaatggaaatactttatagttatatcaactaggagggtttttt

SEQ ID NO: 31589 - DNA, 201 bp, Homo sapiens
catcctgtattaaatggaaatacaccccagttaaaatggcgcttatcaaaaagacaaaataatagatgctggcaaggaggcagagaaaggggaatgcttgmgcactgttggtggcagtgtaaagtagtacagccactgtggagaacagcatggagatgcctcaaaaaaccaaaaatagaaccaccatacgggccgggcaca

SEQ ID NO: 31590 - DNA, 201 bp, Homo sapiens
gactcaaacatgttacacttacctcctggaggttttacaatgcatattagtaaagaatctgagatgtcttaaaggaacccgcttaattttgcttgattcartgttcccaaagctattaatagactttaagaaaatgcacaactacctgttaatgtccagctagttaatattcttagggatacaaattgtaattgcctgctt

SEQ ID NO: 31591 - DNA, 201 bp, Homo sapiens
gacatagggtcaaattgaaccattttcccaccgactggggtgtcagaatcccaaccagcatgtgaagaacacaccctgcctcctccagcaggactcagacrggcctcctgtctcgcacagtggtggtttagaatgcatgttgaatgcttggatctttctagaccaggctgtgtatgggaaggggaatattggcaagaggga

SEQ ID NO: 31592 - DNA, 201 bp, Homo sapiens
aggtcttcttggaaaagtatctaatgcaaggcagagttgcataaggggctgaataaccctgggttattcttactgtgaaaaattcccctacttttttcccrtagttacctgggctatataagaggtatgcatgctatgcaggggcctctgagagctataaatgacatagggtcaaattgaaccattttcccaccgactggg

SEQ ID NO: 31593 - DNA, 201 bp, Homo sapiens
tggagtggccctggcctgagcagggccacagaggccccactcatttcccactgctgttgtgcaggaaagccactttgcttcccttcttcttcagatcctcytcactggctgttgagaaggagagatgcatataattaccaacataacttgagtgtccatgacaaatgacccttccagcactctcctaaaccaccagcttag

SEQ ID NO: 31594 - DNA, 201 bp, Homo sapiens
ttggggcaggcatggcgggtgacctcgtgggtttgtaaatagcatcactatgctagaagcattagtggaatgttgtagatatgggatataaaaatttagaygtggtgtatttgataaagtctctcttagtatccttatggaaattaagtgtgaaatgcaggaaaacagacaatggatgatggttcattgatgtggagacac

SEQ ID NO: 31595 - DNA, 201 bp, Homo sapiens
agtaaaggatgaagctgggaaaaccagtatcaacatcccacaggtgaactgtacattttattctttttaaatttggtaatttattaagcctaaataatcaratgcacaagactgtcttttcagcatgactgttaagtccactaccgatctctgctggaatcccttcatcacaatgcataaagctgatgtaaaatgaaggag

SEQ ID NO: 31596 - DNA, 201 bp, Homo sapiens
agagagggctgagagaggccgggagtgtgtaggggcgtggaggctgcagggtggaggagagtccctcctcctggcaatcaggaatgggaaaaagcatctcytttacacaccccaggtgatttgcatgatcaggaaagtctgggaagtgggtcttaggaagcctgcaatgttgtctcttgtctgtgctttccaccagcgttc

SEQ ID NO: 31597 - DNA, 201 bp, Homo sapiens
gacgaaaacaatgactaggacaaatgagaggtcaaaatgtcctcatagaggcttggctggaggatgctgcgttaagtcagctagcccagtaggcctgctarttgaattcctggaatgaggctgatgtaccgcagaggcctccctgggagcagggccgctggagcagcaacagaaccttgcagcctgcagaagctcacaacc

SEQ ID NO: 31598 - DNA, 201 bp, Homo sapiens
ttatagaaattatgaacacatggctttaagtatatgctgactttgcagtgcccagtcaagtgccaggtaatctttaaatactgataaattgaatccaatarttaattaacagactttaaaaaccacaatctcataatgaaaattctacttagagactgaaaaaaaactctatgctaatctctctttatgctcatccaagat

SEQ ID NO: 31599 - DNA, 201 bp, Homo sapiens
tggctctattagcttcatttggatttctgtgagcttccatcagcaccaagagaccagtaccactgtagcaacataacagagttatgttacttttttatatmaaataatttttaattttttctatatgacagaaaaatatatttttttaaagatttattagctggatgcagtggctcatgcctataatcccagcactttggg

SEQ ID NO: 31600 - DNA, 201 bp, Homo sapiens
atggaatgtgtggctgaaatacacagtttttattgttttcaaattattctaaattctttaatcctctttacttagggtgtcaaaatccttaaccttggctytattagcttcatttggatttctgtgagcttccatcagcaccaagagaccagtaccactgtagcaacataacagagttatgttacttttttatataaaata

SEQ ID NO: 31601 - DNA, 201 bp, Homo sapiens
atttaaaatatatttgttatattcacacagtaaacacgctatttagagtgttgatgacgtgctaagcaatgtccaaagtcatggggacagagcagagatcragacagagtgcaccatctcatggatatttcattctagtagataaagacaggaaataaaccatttagctaataattagtgatgcatgtcatggagataatt

SEQ ID NO: 31602 - DNA, 201 bp, Homo sapiens
agtgagccgagattgcgcctgggccacagagtgagactctgtttcaaaaaagcaaaaacaaattcagaaagctcatatgaacctgagggataacatcagartgctgatttgttaactgatgctcagaaatgctactgtcggccaggctgggctttcacaggtgcccagctgtagacgtggtgagccatgtcattgttgggt

SEQ ID NO: 31603 - DNA, 201 bp, Homo sapiens
acctcaaaatacatgtttttggcatattgatgattttgagctggttattttgagaaactgcaggcacaggcagggaaggaggggtattgtaaagtggaagwgtacttagcctgttaagtagagaaacaatttccataggatagggttttgtgggctggaaagataaactgcaaggctcatcgtctaaatgcctgctgttca

SEQ ID NO: 31604 - DNA, 201 bp, Homo sapiens
tctcaaactcctgacctcagatgatccgcctgcctcagcctccaaaggtgttgggattacaggcgtgagccactgcgccaggccccaacaatgctttaaaaaaaaaaaaatgaagaaatgccttaaggggtaatgaaatgaatttcccataaagtagaattcaaattcttctaatgagggatgatttccgggttccttggg

SEQ ID NO: 31605 - DNA, 201 bp, Homo sapiens
tgtatttagagatggggcctttaaaggggtaattcaggttaaatgaggtaatagtgtggggccttaatccagtatggctggtgtcctcataagaagaggaraagacaccagggttgactgtgctcagagaaaagaccatgtgaggatacagccagaaggctgccatctacacaccatggagagagacctcaggagaaacga

SEQ ID NO: 31606 - DNA, 201 bp, Homo sapiens
caggttaaatgaggtaatagtgtggggccttaatccagtatggctggtgtcctcataagaagaggagaagacaccagggttgactgtgctcagagaaaagrccatgtgaggatacagccagaaggctgccatctacacaccatggagagagacctcaggagaaacgaagcctgctgacaccttaatcttggccttccagcc

SEQ ID NO: 31607 - DNA, 201 bp, Homo sapiens
gggaacttaactcttgtttctatcaatcagcctgtggtaaaactggtttccttgtaggtcctttcccttaaggtcgcagtttccaagaacctatgcacaayactaaagatttgctgtacatgtgataaacaacatagcatgctgattaagaacatgaactctgaggttagaccacctgagtttgaatctctgcagcttcct

SEQ ID NO: 31608 - DNA, 201 bp, Homo sapiens
ttaatccagtatggctggtgtcctcataagaagaggagaagacaccagggttgactgtgctcagagaaaagaccatgtgaggatacagccagaaggctgcyatctacacaccatggagagagacctcaggagaaacgaagcctgctgacaccttaatcttggccttccagcctccagactgtgagatcacacatttctgtg

SEQ ID NO: 31609 - DNA, 201 bp, Homo sapiens
tcatgttgcacagtttttatttgtgaagtatgtctttgtcgtgaaagcagccgtagtctatgctacagggatgggcgtggctgtgttttgataaaaatttmtttacaaaaataggaggaggggtagattcagtttgctgatgtgtcaaataaagtaagttttgttcaaaactgtttcatcataacatctatgagaaaaaaa

SEQ ID NO: 31610 - DNA, 201 bp, Homo sapiens
taatccagtatggctggtgtcctcataagaagaggagaagacaccagggttgactgtgctcagagaaaagaccatgtgaggatacagccagaaggctgccrtctacacaccatggagagagacctcaggagaaacgaagcctgctgacaccttaatcttggccttccagcctccagactgtgagatcacacatttctgtgg

SEQ ID NO: 31611 - DNA, 201 bp, Homo sapiens
ccctactaagctagtactattctcaatttattcttacgggaacagccttatattatcagtagtttgaagagctaaccatatccttaattaaaaataagtgrgagagtcacttaaaatcttgatgtatagtttatggtaaaagaacggttatttatgtttggagattaccacattctacagtgtctgctgtggatacgtatc

SEQ ID NO: 31612 - DNA, 201 bp, Homo sapiens
ccttatattatcagtagtttgaagagctaaccatatccttaattaaaaataagtgagagagtcacttaaaatcttgatgtatagtttatggtaaaagaacrgttatttatgtttggagattaccacattctacagtgtctgctgtggatacgtatcttgtgttgtccatttcaagcttctcagctattctgcaagtaaaga

SEQ ID NO: 31613 - DNA, 201 bp, Homo sapiens
gtttgaagagctaaccatatccttaattaaaaataagtgagagagtcacttaaaatcttgatgtatagtttatggtaaaagaacggttatttatgtttggrgattaccacattctacagtgtctgctgtggatacgtatcttgtgttgtccatttcaagcttctcagctattctgcaagtaaagatcatctcagaggccca

SEQ ID NO: 31614 - DNA, 201 bp, Homo sapiens
gatatggcaggcacttttcttggattggcagttgaaaagaactgaaaacaatgacaacaacaacaacaaaaacacaaagaacacatagcatagtctgtacraacatctcctgtattctatgaaagaaaaaactagaggtagaacataggctaatgggaatattgaaactatggtgccttttccaggtttttaatcatagat

SEQ ID NO: 31615 - DNA, 201 bp, Homo sapiens
gaaaacaatgacaacaacaacaacaaaaacacaaagaacacatagcatagtctgtacaaacatctcctgtattctatgaaagaaaaaactagaggtagaamataggctaatgggaatattgaaactatggtgccttttccaggtttttaatcatagatttggagaatttgacaatgccgagatgaagctcttgaatgtttt

SEQ ID NO: 31616 - DNA, 201 bp, Homo sapiens
taaaagaatgtaaaattaaaggagaaaccataaaaatataatagtaatacttaatccacaagaaagcaggaaatgagaataagaaacctggagtaggacaratattaagaagaccaaattctgatgtggcctcgagattctcaccccagctatacacatcctgtatataattcctccctttttgtgtgatgggactgggta

SEQ ID NO: 31617 - DNA, 201 bp, Homo sapiens
cctcttcctctgctgtattcctggccatcatgtcaagtgtttctcaaaatgtgttccgtgggaccccacccaggtgctattctccacaaaatctattctcrgaaagttctagaatggatagtaagatagctgcactacattgtgaaggtactaaatgccaccaaattgtacattttaaaggttaattttttttgttatgta

SEQ ID NO: 31618 - DNA, 201 bp, Homo sapiens
gtacttgttggtggctttgacgttttagggtttaaacaataagatgctatttcctccccaggtctcctctcttttgtattctagatattaaagtagaaaakaatttcagcatcatatttcatatatactatgtgagggaagggtgttagtatgttttcttctagcttaatttctaagattccatcttattacctgaccttt

SEQ ID NO: 31619 - DNA, 201 bp, Homo sapiens
cctaatctggctctaaggatctcctgacctttctgcaaaagagacccctaacctgggctccagatcagatcttgggtgggcactggctgagctggccttayaatgctctttattatatgccaggctgagtctacaaccatacgaccctgaatgtgcccaatctcatccttgtatgccaggctgataaaacgtttccaaatg

SEQ ID NO: 31620 - DNA, 201 bp, Homo sapiens
tggctgttgtggcaaaggtcatattccagacaattaagttgacctggttactgtaaaagatattttttgtcccagatactatatcaggcaagaaacctatkaatggattctacaaaatatccctgtcacagaactccctagagacaacactgttgctcatcagaaatgttcactgaaggctctatcaagtgtgttcaatct

SEQ ID NO: 31621 - DNA, 201 bp, Homo sapiens
ctaaggggtagagatcaagggatctttttaaaatagcatacagtgcacaggatagcccctgcccaaggaattatccagccaaaaatgtcactggtgctgargccaagaacactgccctaaaatgcactttagtgaacccctcattttttagcagtaggcacaggcagctgtacttgttggtggctttgacgttttagggtt

SEQ ID NO: 31622 - DNA, 201 bp, Homo sapiens
tgctgcagctgcagagagctgttgcagtgatccaggggaggaatggtagtagctggcatcaggatgctagcaggagaggtggagaaaagaggttggattcyggatatattttgaatatagagataacaggaacagaggttggatatgagtagaaaaggtgttaaagaagactttaaggttcttagcctaagcgatttgaag

SEQ ID NO: 31623 - DNA, 201 bp, Homo sapiens
cagttctaagattccagaaatcaaaggcaagtgtttttctgtttgtttgtgttttaccttccctctcagagttctttattttttatttttattttattttwattttattttttgagacagagtgttgctcttgttgcccaggctggagtgcagtggcatgagctcagctcactgcaaccttcacctcctgggttcaagcga

SEQ ID NO: 31624 - DNA, 201 bp, Homo sapiens
ttgcaggagtgagccattgtgcctggctagcattctttaaaaaaaaaaaaaaaaatcaactttgattttagattcagaagctatatgttcaggtttgttgyctgggtatatagcgttatgctgaggtttgtagtacaattgatactttcacccaaatactgaatatggcacccaataattttgcaacccttgtccccccac

SEQ ID NO: 31625 - DNA, 201 bp, Homo sapiens
cagtagagaatgcaccattgtactctagcctgggagacggagcgagactctatgtagaaagaaaaaaaaaaggaaaaaagcaatccagttcttaataaaartaagaaatgtgtggtaaaacaaattcaaacagtatgcctgagtatatggtgaaaatagtttccccttctcacagattcactgttagcagtttcaagcacc

SEQ ID NO: 31626 - DNA, 201 bp, Homo sapiens
ccattgtgcctggctagcattctttaaaaaaaaaaaaaaaaatcaactttgattttagattcagaagctatatgttcaggtttgttgcctgggtatatagygttatgctgaggtttgtagtacaattgatactttcacccaaatactgaatatggcacccaataattttgcaacccttgtccccccaccacagttgtcccc

SEQ ID NO: 31627 - DNA, 201 bp, Homo sapiens
ctatatgttcaggtttgttgcctgggtatatagcgttatgctgaggtttgtagtacaattgatactttcacccaaatactgaatatggcacccaataattktgcaacccttgtccccccaccacagttgtccccagtttctgtttttgccatccatctttatgtccatgagtacccagtgttcagctctcacttgtaagtg

SEQ ID NO: 31628 - DNA, 201 bp, Homo sapiens
tgactcaacgccagtaatcccagcagtttgggaggccgaggcgggcggatcacctgaggtcaggagttgttcgagaccagcctggccaacatggtgaaacyccatctctaccaaaaatacaaaaattagctgggcatggtggcggacacctgtaatctcagctacttgggaggctgaggcaggagaatcgcttgaacccag

SEQ ID NO: 31629 - DNA, 201 bp, Homo sapiens
cgccttgctctgtcacctagtctagagtagtgtggagtgatcatagttcattgcagtcttcaactcctgggctcaggtgatcctcccatctcggcttcccaagtagttgggaccacaggcacatgccaccatgcccagctaatttttaattttttaaaatagctctttgaaaaacaaagctaactcctaagcagtgtgccc

SEQ ID NO: 31630 - DNA, 201 bp, Homo sapiens
taggcacggtgactcaacgccagtaatcccagcagtttgggaggccgaggcgggcggatcacctgaggtcaggagttgttcgagaccagcctggccaacayggtgaaactccatctctaccaaaaatacaaaaattagctgggcatggtggcggacacctgtaatctcagctacttgggaggctgaggcaggagaatcgct

SEQ ID NO: 31631 - DNA, 201 bp, Homo sapiens
ctcatctggattactgcagtgcagtagcatcccagctggtattcctgcttctgccattgtcccttttctatttccacgcaacagctagagttagttccttraaaatataagtcagacttctgcttcatgtattgatggactaggcattttggacacatattcctgttgaaggcaaccaagaagcccagataaagtctttga

SEQ ID NO: 31632 - DNA, 201 bp, Homo sapiens
tggggattggaatggggacccaagagaccagaacttgacatggaggagtaccagtccagaaccaggtatactatccaaactgagtccccagagaaatcccyggaggagagttgcaaacacaaagctacttgtgaagtcagagaaacgtgggcaatgggaaagatggtctaactaaagaggaaagaagctgtgttaaccact

SEQ ID NO: 31633 - DNA, 201 bp, Homo sapiens
gtttgagagagagagagaaagagagagatcgatctgggagtcagggaaagccagagacctctagaaatgacaggaaagtcaggaagtgggttcactgcagrgcctccagaaggaactcagccctgttgagcaataggttggtagatacttaagagtatttttaaaagaaccaactaaataaataaaaacaggtgatgatga

SEQ ID NO: 31634 - DNA, 201 bp, Homo sapiens
gcccagctaatttttaattttttaaaatagctctttgaaaaacaaagctaactcctaagcagtgtgcccagagtcaacctaatttgttaatttttttttttcttgtagaatcagggtctcgccatgttgcccaggctggtctcaaattcctgggctcaagcgagcctcctgcctcagcctctcagatacagatacaggcat

SEQ ID NO: 31635 - DNA, 201 bp, Homo sapiens
aggacattccaagacctggactgggaactgcacaatccactgttggctcactgtggggattggaatggggacccaagagaccagaacttgacatggaggartaccagtccagaaccaggtatactatccaaactgagtccccagagaaatccccggaggagagttgcaaacacaaagctacttgtgaagtcagagaaacgt

SEQ ID NO: 31636 - DNA, 201 bp, Homo sapiens
cattgtactccagcctgggtgacagaacgagactccgtctcaaaaaaaaaaagagtacataaacacccatccctgaagaatatcatctcatccccttgtgaaaaaaaaaatctcatctcctttccaaaaaataccatctcattgtcttgccaatcaattccaaagagctcaaaaaaacaattaacaaagttagtatagttc

SEQ ID NO: 31637 - DNA, 201 bp, Homo sapiens
ttaaaccagcagtatcctgatagaatttgaacctcctctacaagaatgtaggaggagaaagagaaaaatgatgtaaagtccaaggtagaaagatgattgtsgctagatagccagggagtctgacttgacatataggacgatgttcatctcagatggagagggaccccctgaaccagaggctgcaggggaaggtgtcaagac

SEQ ID NO: 31638 - DNA, 201 bp, Homo sapiens
cctgttgagcaataggttggtagatacttaagagtatttttaaaagaaccaactaaataaataaaaacaggtgatgatgagagtgtgtcacaaacaaaagkttatcagtaatccacggtccacttctgtgtattttgaaattcttcttttgagacagagtcttactctgtcacccaggctggagtgcagtggcacgatctc

SEQ ID NO: 31639 - DNA, 201 bp, Homo sapiens
tactgctaattttctatgctaacatctcaagtcaaaaatccaggttaggaaaacaacattaaattgatttataatttactaaaagattgctagctttgaamcaagtactctcaatttgtagaacacaaacatttttaataagtctgtatgaacccaagtttattaaataataagattatattgaaaatctccatatattta

SEQ ID NO: 31640 - DNA, 201 bp, Homo sapiens
gccactttttcatccctagctcattcacagtgacgggctgctgccaatcagtcaaaccagacaggagtctgtgtagcattacacacgctcatatcccagtrattgtccctaaaaactcccacatgggaatggaggccacattacctagattgacattccaattgtagcgtccaaacacttacttttaatttgcttcttacc

SEQ ID NO: 31641 - DNA, 201 bp, Homo sapiens
atagtaagtgaaattggccatatattttaaaatgcatgaacataacaaagttagtcattgaaaagcaggcaaaatctagcatgtatgtttttctttggatwtgttacgtcattgagtcatgtaatgagtatttaagaaaacaaaacagttctctggaatgcctgaattccatgttggcaattgggtacaataaagcatttg

SEQ ID NO: 31642 - DNA, 201 bp, Homo sapiens
gaaattcttcttttgagacagagtcttactctgtcacccaggctggagtgcagtggcacgatctcagctcactgcaacctctacctcccgggttcaagcarttctcctccctcaacctcccaagtaacttggattccaggcacatgccaccatgcctggctaatttttgtatttttaatagagatggggtttcaccatgtt

SEQ ID NO: 31643 - DNA, 201 bp, Homo sapiens
ggctggtcttgagctcctgacctaaggtgatctgcctgctgtggcctcccaaagtgctgggattacaggcgtgagccaccacacctgttctgaaattcctmaagaagaaacaggattgtgtctgtagagcttttgggactgatctagtaagaagaggagaaattaatgataaaggtataagtatgagaggagataattact

SEQ ID NO: 31644 - DNA, 201 bp, Homo sapiens
gtgtaagagcttggggatgatttctcattttaaattatacattccttggtagtagccccatatccattaaacatcttttggttgtccccaccaacactcctttttttttttttctggtggctcataaattgatttggaaacctaagttgtcaaaaaaaaaaggtaccaaaatttatttaaagaatatcatgaaggctgggc

SEQ ID NO: 31645 - DNA, 201 bp, Homo sapiens
acaggcgtgagccaccacacctgttctgaaattcctaaagaagaaacaggattgtgtctgtagagcttttgggactgatctagtaagaagaggagaaattratgataaaggtataagtatgagaggagataattactcatgttcctgataaggtgaaggggggtgtgatctcaagcacaagtggatgaaatgagacaattt

SEQ ID NO: 31646 - DNA, 201 bp, Homo sapiens
tggcaatcagaaagcatgaccgtgtagtaggcagaggacctggcatgtgtaaaagcgaggaggcagaagagacaggacattagccatgacctttcagtagygcagtgttgcaagaggacacctctgctgtggtgtggagaagaggtgagaagccaggccatgtatgcaggaagtgtgtcacaaaaggcttggaaagaagat

SEQ ID NO: 31647 - DNA, 201 bp, Homo sapiens
ccacacctgttctgaaattcctaaagaagaaacaggattgtgtctgtagagcttttgggactgatctagtaagaagaggagaaattaatgataaaggtatragtatgagaggagataattactcatgttcctgataaggtgaaggggggtgtgatctcaagcacaagtggatgaaatgagacaattttttcattttagcac

SEQ ID NO: 31648 - DNA, 201 bp, Homo sapiens
aagtggatgaaatgagacaattttttcattttagcacagaaaaaaaaatggctcaggtacaggtcatagtagtatcctctcttttatgagcagggtgcctygtatgtgtaggggaactccccaagcaaaatgaacggctttgaatgaatggcttctctgtatttctttatcttctccaactccctagtgtttgattgcctc

SEQ ID NO: 31649 - DNA, 201 bp, Homo sapiens
agtggatgaaatgagacaattttttcattttagcacagaaaaaaaaatggctcaggtacaggtcatagtagtatcctctcttttatgagcagggtgccttrtatgtgtaggggaactccccaagcaaaatgaacggctttgaatgaatggcttctctgtatttctttatcttctccaactccctagtgtttgattgcctca

SEQ ID NO: 31650 - DNA, 201 bp, Homo sapiens
taggagctctctcaggaactggggaagtgagcaagtgtacatttcttattatatcacagtatcacaagagttaattcagtctcccatgttcatggagagaytgactgtgcttggcattccttttctaattttcctagacacagccactcagtattttaaaaatgcatttttccaggtagctactaccaatcagtagtacct

SEQ ID NO: 31651 - DNA, 201 bp, Homo sapiens
aagaaaaagaaagagaactaagaggaagcaaaggaaccatggcatagtgaggtgagacgtttctggagtaaccttggccctatggacttttatagctaacyatgtaaaactcccttacaggtcaaagtcctcctctgaggagaaattgcaggggcgatagaggcaaaggatagagaaggatcgaaccaaaaaaaaaataga

SEQ ID NO: 31652 - DNA, 201 bp, Homo sapiens
gattgtttcttttaaaaaccatgctgctatgaacaatcttgtatgtatccttctaatgtacatgtacaagaatttctttagggtttatacctagaagagawattactgagctgtagagtatgggcatgctcattttcacaagataataccaaattattttccagagttttcaaagaaacatatataaatttcttatgtatg

SEQ ID NO: 31653 - DNA, 201 bp, Homo sapiens
ggggatgtggagcaacaggaactctcattcattcttgatgggaatgcaaatggaacagccactttggagaacagtttggcagttattttcatagctaaacrtacttttactgtacaatccagcaatcacagtccttggtatttacccaaatgagtaaaagcttatgtccccacaaacacctgcacatagatgtttatagaa

SEQ ID NO: 31654 - DNA, 201 bp, Homo sapiens
tgatttatgtatgttgatcaatgaaggttaaaaaacactgttaactaaggttttctatttgcagtgttttctgacaaatatttttcctccagattttaagygtgttattatgagtcaacctttatgtttgtaaagccttagtcttgttaataatgtataacttccaaatgaatcatatacttatgcatagcacttgaatat

SEQ ID NO: 31655 - DNA, 201 bp, Homo sapiens
gtggcagagttttccttaagtatcttgagtttgaatctgtctttagattagtggcaacattaaagaaatagtaaataaccagtctgttcttactaatgtcrccctggcttatatcctcttacatgacctggtttcctgctgtgctagagcatcatccttagtcctttcctcctaaagtaggcactgtttgaaatgaacttt

SEQ ID NO: 31656 - DNA, 201 bp, Homo sapiens
cttaaatttgcagatgaggaaaaagaggttcagaaagatgaatctgcaacccaggtgccttgatatagatgctgtagatacgacaaactactctttttttktttttatcagcttattgcatccagacagggtttgaaatggctctgaaaacaaaaaaggaagcaagaacccagtagttgtgtgttttcctgcttctactgg

SEQ ID NO: 31657 - DNA, 201 bp, Homo sapiens
gaatttaatcagtaagcagtttcattagactttgaatgttgtttgctgttgggtaggtgaagctcattatgcttcctaggcttggatccagacagacaagkttttatcattaacctagttttcatcaagggaacagtgtgcaaactgggtaccacctgtgagaagcatcatttaagaggccagaggtgagatcctagaaaa

SEQ ID NO: 31658 - DNA, 201 bp, Homo sapiens
gcccttacaaatatgcatatgtttgagaagagaggaggaaattaatcagagcccctggcttaaatgatctccattcttactagcactatcgggatgtaatkaaatcatggtttaattctttctgttagggaaatcttattcctttttaaccaagttcttaatgtatggtcatacaaggtgaatttaatcagtaagcagttt

SEQ ID NO: 31659 - DNA, 201 bp, Homo sapiens
tcatttcactctcatcacaagtctttgttttgttttaaatctttgcaataaatatttgttaaagtgcctcatgaggatacaagaaagaaatttggaaacaraagaggttattatcctgcagatatagaagatctttcatgaagacattgaggaggaagatatgacctatactcagctattgtgttgtggggctggaggaag

SEQ ID NO: 31660 - DNA, 201 bp, Homo sapiens
tctcctctagcccccaccgacaggccccagtgtgtgttgttcccctccctgcgtccatgtgttctcattgttcagctcccacttatgagcgagaacatgcrgtgtttggttttctgttcctgtgttcgtttgctgaggatgatggtttccagcttcatccatgtctctgcaaaagacatgatttcattcctttttatggct

SEQ ID NO: 31661 - DNA, 201 bp, Homo sapiens
gctacattgaaaaagtatttagttgtgttcattgtagagtgatcccatatttgagtttgatgttcacatgttctgaactatttcaaaatgagtttaggccrggtgcagtggcttaaacctgtaatcccagtactttgggagttagaggtggatggatcatctgaggtcaagagttcaagaccagcctggccaacatggtga

SEQ ID NO: 31662 - DNA, 201 bp, Homo sapiens
agaggtggatggatcatctgaggtcaagagttcaagaccagcctggccaacatggtgaaacgctgtctctattaaaaatataaacattagtggagtgtggwggtgggcacctgtaatcccagctactagggaggctgaggcaggagaattgcttgaacccaggagacagaggttgcagtgagccgacacggtgtcactgca

SEQ ID NO: 31663 - DNA, 201 bp, Homo sapiens
tgaggcaggagaatctcttgaacctgggaggcagaggcttcagtgagctgagatcacaccactacaccccagcctgggtgacagagtgagagtctatctcaaaaaaaaaaaaaaaaaagtgaacatagatttgcatacgtgtataagcttgaagaatttgaagcttccttatgcttaatgggttcgtggttttattacata

SEQ ID NO: 31664 - DNA, 201 bp, Homo sapiens
gaggcaggagaatctcttgaacctgggaggcagaggcttcagtgagctgagatcacaccactacaccccagcctgggtgacagagtgagagtctatctcaaaaaaaaaaaaaaaaaagtgaacatagatttgcatacgtgtataagcttgaagaatttgaagcttccttatgcttaatgggttcgtggttttattacatac

SEQ ID NO: 31665 - DNA, 201 bp, Homo sapiens
caataacgaaacagagactaaacaatacaaaagatcaatgatacgaagagttggttttttgaaaagacaaaatcagtaaacctttagctagacaaagaaaragatgactcaaataaataaaatccacattgaaaagaagacattacaacctataccacagaaatacaaaggataatgagaaaatattatgaaaaattgtat

SEQ ID NO: 31666 - DNA, 201 bp, Homo sapiens
gttggttttttgaaaagacaaaatcagtaaacctttagctagacaaagaaagagatgactcaaataaataaaatccacattgaaaagaagacattacaacstataccacagaaatacaaaggataatgagaaaatattatgaaaaattgtatgccaacaaattggataacctagaagaaatggataaattcctagatgtat

SEQ ID NO: 31667 - DNA, 201 bp, Homo sapiens
ggcctaaagtgaacttttaagtgaccacaacttaatggtatcaaaaaccaaattagtagaatagtataataaaaaaaaactttatataatcagtataattytataacctctgatatgaaaatatgttttgatattttaaatcttaggatgtatttttcacaatactgaaataagcccatatttcatatgatcagtctgttt

SEQ ID NO: 31668 - DNA, 201 bp, Homo sapiens
aaagcttaatgttatcaagagtgtatttttcagagacttacgtaactcattttctgttaaataataggcacagttgcatgacttgcaaggttttggcagartaaatagtctttgacaaaaataatacatagtctacttttatttaaaattagataacgatggactttagctatactgaagtaccatttgaggtacaatggt

SEQ ID NO: 31669 - DNA, 201 bp, Homo sapiens
ttttccaagttgtcaatttcttttcttttcagtatttgtttctaatttttttgtttatgatcagaaaatacgatgagtaaaagtctttaaaaatctgatarcattttctttgtggtcaagtaaaagacccttattaaaggtcaaatgtatttaaaaagctgtgtctttgtgtgagtgtgtctatttatatatgtgtgtata

SEQ ID NO: 31670 - DNA, 201 bp, Homo sapiens
tcattcatattttgcttaaaactgttcaatggcttcccatggaacttggagtctgatatcttcacaagtgtgtgcatggcccagacaatctgacacccctmctgtttgtcatcatgccttgcaccactctttgccttgttccttatgttccagccctcatggtctcttcctgataatgagttaaactttttcctgcctcac

SEQ ID NO: 31671 - DNA, 201 bp, Homo sapiens
aaagagatgactcaaataaataaaatccacattgaaaagaagacattacaacctataccacagaaatacaaaggataatgagaaaatattatgaaaaattrtatgccaacaaattggataacctagaagaaatggataaattcctagatgtatacaacctaccaagactgacttatgaagaaatagaaaatctgagcagat

SEQ ID NO: 31672 - DNA, 201 bp, Homo sapiens
ggtacttatgtgcagtggggatacacacacacagaggataagattcccttcctcataacctcctggtctggttgggacaagaagtgatggtgtgtggttgygcattctcagggtaaagcaaatggcattgatcagtgctgtggaaattctcaaggctattatctctctggggccgttagacttttagaggtatagacaaca

SEQ ID NO: 31673 - DNA, 201 bp, Homo sapiens
aacttgagtcccaaataccagctaataataaattgtactttttctttgccttgtgctctcttccttgccacgtgaggataatttacttcttcttcttcttyttttttttttttttttttttgagacagagtttcactcttgttgcccaggctggactgcagtggcgtgatcttggctcactgcaacccccgcctcctgagt

SEQ ID NO: 31674 - DNA, 201 bp, Homo sapiens
attcctagatgtatacaacctaccaagactgacttatgaagaaatagaaaatctgagcagattaatagtgagtgaggaaattgtatcaataatgaaaagtytctatcaaagaaaagcccaggactaaatgggggaaaagttgaaagcttttttttctaaggtctggaacaagacaaagatgcccactttcaccacttctgt

SEQ ID NO: 31675 - DNA, 201 bp, Homo sapiens
gtcaaatgtatttaaaaagctgtgtctttgtgtgagtgtgtctatttatatatgtgtgtatacacacacagacgtgcacaatgtctatattttgtcattcagtcttacttaatcagtctgagtgttatctgtacattggactttttaaagctttccaggtgattctaatatacaaccaaggttaagtatgttgccaaaatg

SEQ ID NO: 31676 - DNA, 201 bp, Homo sapiens
gctggaaacatcacactaactgagtttaaaatacacaaagccatagtaaccaaaacactacctgacttgaaactatactacaaagctatggtaaccaaaasagacatatagaccaataaaacagaacagagaacccagaaaaaaaaacacctatccatatccaactaattttcaacaaaggtgccaagaacacacattggg

SEQ ID NO: 31677 - DNA, 201 bp, Homo sapiens
gatacacacacacagaggataagattcccttcctcataacctcctggtctggttgggacaagaagtgatggtgtgtggttgtgcattctcagggtaaagcraatggcattgatcagtgctgtggaaattctcaaggctattatctctctggggccgttagacttttagaggtatagacaacaagtgagtccaaagtgagtg

SEQ ID NO: 31678 - DNA, 201 bp, Homo sapiens
tttatgaatttgtgttgggccacattcaaagccatcctgggctgtgggctggaaaagcttgttctagactgtaagctccatgaagccaggaactataattaaaaaaaaaaaaggttttattttttagagcagatttaggttctcagcaaagttaaaagaaagatacagagacttttcttatgccccctgtttccacaggca

SEQ ID NO: 31679 - DNA, 201 bp, Homo sapiens
cgtgatcttggctcactgcaacccccgcctcctgagttcaagcgattctcctgtctcagcctccagagtagctgggattacaggcatgcgccaccatgccyggctaattttgtatttttagtacagacagggtttcaccatttggtgaggctggtctcgaactcctgacctcaggtgatccacctgcctcggcctcccaaa

SEQ ID NO: 31680 - DNA, 201 bp, Homo sapiens
gatgctaggaagaaactgcatcaactaatgagcaaaataaccagctgacatcataatgacaggatcaaattcacacataacaatattaaccttaaatgtaratgggctaaatgctccaattaaaaaacacagactggcaaattggataaagagtcaagacccatcagtgctgtattcaggagacccatctcatgtgcagag

SEQ ID NO: 31681 - DNA, 201 bp, Homo sapiens
cagaggataagattcccttcctcataacctcctggtctggttgggacaagaagtgatggtgtgtggttgtgcattctcagggtaaagcaaatggcattgaycagtgctgtggaaattctcaaggctattatctctctggggccgttagacttttagaggtatagacaacaagtgagtccaaagtgagtgaaggccaagcaa

SEQ ID NO: 31682 - DNA, 201 bp, Homo sapiens
cagcaaagttaaaagaaagatacagagacttttcttatgccccctgtttccacaggcaactgccctcaacagagtggtacatttataacaattgataaacstacattgacacatcattatcacccaaagtccacagcatgattttttttttaaattcacaatcatgtacctagtcctcaaaaggtatccagcgcataacat

SEQ ID NO: 31683 - DNA, 201 bp, Homo sapiens
ggctgcagcccgcattgagcagcctccagagagccttgctctgccggccttgagctccttccactgcggctttttgaggaggagacacatgcctgagagcrgctctgggacttgccctgacaagtgaagggaacttgtggaagggaggtcagctttttgcgaactctgaaagtcaaagatagaggtggctgtgttgagttt

SEQ ID NO: 31684 - DNA, 201 bp, Homo sapiens
tgctaacctagtctaagctaccattgtttcccacctgaaattataatatcctcccaacagatccaattgaaatacaccctagatactctcttttctattgtttttttttgcctttttaaaaattgtacaaatttacagggtacatgtgcaattttgttacatgcataaagtaacaaaagtcaagactttgagggtatccat

SEQ ID NO: 31685 - DNA, 201 bp, Homo sapiens
caggagaatcgcttgaacccaggaggcggaggttgcagtcagtagagaatgcaccattgtactctagcctgggagacggagcgagactctatgtagaaagaaaaaaaaaaggaaaaaagcaatccagttcttaataaaaataagaaatgtgtggtaaaacaaattcaaacagtatgcctgagtatatggtgaaaatagttt

SEQ ID NO: 31686 - DNA, 201 bp, Homo sapiens
atggccatccagttttcccagcaacatgtattgaagagtgtatcctttctccaatgtatgctcttgttggctttgtgaaagccaacaaatatggctgtaartatgtagctttatttctgggttctctattctgttccattgatctattcatctgtttttctaccagtaccatgctgtgttggttactatagccttataata

SEQ ID NO: 31687 - DNA, 201 bp, Homo sapiens
tttgattctcacctctgggtttcagactcatgaaccccagctttacaatcttgggtgggtgagccatttaaccctttaaacttctaagccagctgggtgcrgtggctcatgcctgtaatccaagcactttgggaggctgaagggggatggatcacttgaggtcaggagctcgagaccagcctgaccaacatggtaaacccc

SEQ ID NO: 31688 - DNA, 201 bp, Homo sapiens
tgggtctagtcaagtggttctcaaaatatggaccatcaacatcacctgggaatttgttggaactgcagattcttgggcctcaccctaagatgtggtcactyagaaactctggggatgggtccagcaatctctttttaaaaaattattttaattagcacataattgtacatattatggggtagaatacgatatatggcacaa

SEQ ID NO: 31689 - DNA, 201 bp, Homo sapiens
ccactgcagctcagcaaggccgctgcagccagactgcctctctagattcctcctctctgggcagggcatctctggaaaaaaaaggcagcaatcctagtcayttacttacagataaaaccctcatctccttgggagagagcacctggggaaaggggtggctgtgggttcagcttcagtagacttaaacgtccctgcctgaca

SEQ ID NO: 31690 - DNA, 201 bp, Homo sapiens
taccggttttatgtgaaaaaccctcaattaacaatttaagatagcaaatgactaatggaaatttttgccagaggaagaagtcagataggagctctctgttkttgttgctgttgttacttgccaaataatatttgctacatttttgggtcagtaatgaggcttaagtgagaataagtgggttttgtatatctaagtccctaa

SEQ ID NO: 31691 - DNA, 201 bp, Homo sapiens
gcattttgatatgagttgcattgaatttatggattgctttgggcaatattgtcattttaacaatactgattcttcagatttttgatcatgggctgtttttgtgtttgtttgcatcatctataatttctttcatcattgttttatagtttctcttgtacagatcttgtacacctccttggttaaatatattttaattaggta

SEQ ID NO: 31692 - DNA, 201 bp, Homo sapiens
gctcagcaaggccgctgcagccagactgcctctctagattcctcctctctgggcagggcatctctggaaaaaaaaggcagcaatcctagtcacttacttayagataaaaccctcatctccttgggagagagcacctggggaaaggggtggctgtgggttcagcttcagtagacttaaacgtccctgcctgacagctatgag

SEQ ID NO: 31693 - DNA, 201 bp, Homo sapiens
cattttgatatgagttgcattgaatttatggattgctttgggcaatattgtcattttaacaatactgattcttcagatttttgatcatgggctgtttttgtgtttgtttgcatcatctataatttctttcatcattgttttatagtttctcttgtacagatcttgtacacctccttggttaaatatattttaattaggtat

SEQ ID NO: 31694 - DNA, 201 bp, Homo sapiens
gacagaagtaagcttcagaaggtgggtaataacaaactcctctgagctaaaggagcatgttctaacccattgcaaggaagctaagaactttgaaaaaaagwtagatgaattgctaactagaataaccagattagaggagaacataaatgacctgatggagctgaaaaacacagcacaagaactttgtgaagcatatataag

SEQ ID NO: 31695 - DNA, 201 bp, Homo sapiens
acttctagggggagagcattcaaagcagagaagcagcaagtgccaggctcttaggcagcaggaagctccacatgtttgaaggcatcgggagggagtctgcrtatccactgtagaaggtggaagggagaggaggcgggttcggaatgaggacttgaacgatgataacactgagagctgtgaccctcctccgtctctgccagg

SEQ ID NO: 31696 - DNA, 201 bp, Homo sapiens
aggaagctaagaactttgaaaaaaagttagatgaattgctaactagaataaccagattagaggagaacataaatgacctgatggagctgaaaaacacagcrcaagaactttgtgaagcatatataagtagcaatagccgaatcaatcaagcagaagaaaggatatcagagattgaaggtgacctcaatgaaataaggtgag

SEQ ID NO: 31697 - DNA, 201 bp, Homo sapiens
taaagaaaaaaaagaaaaacacatggtaataggaagagagcaacatggaatttgggagtaaaaaggaggaaaaggtgggttaatccagttctccttttctrtggatgtgccatttggtttgagtcataatgatgaaaaggagcctgccctggaaacttctagggggagagcattcaaagcagagaagcagcaagtgccagg

SEQ ID NO: 31698 - DNA, 201 bp, Homo sapiens
tccatggtaatgaagtttctgaattagtgccaggcttgattttcattgactcagggacgaggcaaatcgtagtctgcacatttgaagatctttggtatctsaagtttggcacacacatggacacacggggattgacgatgtgattgagacctcaacgtatgaactcaattttataaaggtcgtttgctttcagcagctaat

SEQ ID NO: 31699 - DNA, 201 bp, Homo sapiens
catttgaagatctttggtatctgaagtttggcacacacatggacacacggggattgacgatgtgattgagacctcaacgtatgaactcaattttataaagrtcgtttgctttcagcagctaatgacatgctttatctgtaggaaatcacctttcccaagatggtggccaactgttgccgttttctctgttacttctgtcgt

SEQ ID NO: 31700 - DNA, 201 bp, Homo sapiens
ttggtatctgaagtttggcacacacatggacacacggggattgacgatgtgattgagacctcaacgtatgaactcaattttataaaggtcgtttgctttcrgcagctaatgacatgctttatctgtaggaaatcacctttcccaagatggtggccaactgttgccgttttctctgttacttctgtcgtataagtaggcaga

SEQ ID NO: 31701 - DNA, 201 bp, Homo sapiens
gaagaatcaaatagatgcaataaaaaatgacaaaggggatatcaccatcaatcccacagaaatacaaactaccatcagagaatactataaacacctctacscaaataaactagaaaatctagaagaaatggataaattcctcgacacatacaccctcccaagactaaaccaggaagaagttgaatccctgaatagaccaat

SEQ ID NO: 31702 - DNA, 201 bp, Homo sapiens
tttactggaaaacagcagtgttggtcttggtaagtaaatgacttttatttcatctttaaggttgaaataatataatattacatttaaaaagcaaacgtttkgttaaaaaatgtgcaatggacctgaatagacatttcacaaaagaagacagatagttggccaataggtatatgaaaaaatactcgacatcactcatcatca

SEQ ID NO: 31703 - DNA, 201 bp, Homo sapiens
aaaatctagaagaaatggataaattcctcgacacatacaccctcccaagactaaaccaggaagaagttgaatccctgaatagaccaataacaggctctgamattgaggcaataattaatagcctaccaaccaaaaaaagtccaggaccagacagattcacagccgaattctaccagaggtacaaggaggagctggtaccat

SEQ ID NO: 31704 - DNA, 201 bp, Homo sapiens
tcctcaaaaaattaaaaatagaactaccatatgatctaacagttttacttctgggtatatatatccaagggaaatgaataatcagtatgtcgaagagatamgtgtacttccatggtcattgcagcattattcacaatagctgagatatggaatcaacctaagtgttcatcagtggatgaatggataggaaaaatgtggtac

SEQ ID NO: 31705 - DNA, 201 bp, Homo sapiens
caaggaggagctggtaccattccttctgaaactattccaatcaatagaaaaagagggaatcctccctaactcattttatgaggccagcatcatcctgataycaaagcctggcagagacacaaccaaaaaaaagaactttagaccaatatctctgatgaacatcgatgcaaaaatcctcaataaaatactggcaaacggaat

SEQ ID NO: 31706 - DNA, 201 bp, Homo sapiens
tcatgctaaaaactctcaataaattaggtattgatgggacgtatctcaaattaataagagctatttatgacaaacccacagccaatatcatactgaatggrcaaaaactggaagcattccctttgaaaactggcacaagtggccttctctccccactcctattcaacatagtgttgaaagttctggccagagcaatcaggc

SEQ ID NO: 31707 - DNA, 201 bp, Homo sapiens
tcccattcacaattgcttccaagagaataaaatacctaggaatccaacttacaagggatgtgaaggacctcttcaaggagaactacaaaccactgctcaakgaaataaaagaggacacaaacaaatggaagaacattccatgctcatgggtaggaagaatcaatatcatgaaaatggccatactgcccaaggtaatttata

SEQ ID NO: 31708 - DNA, 201 bp, Homo sapiens
acttcaggtgatccaccggcctcggcctcccgaagtgccgggattacaggcatgagccacagcgcctagccaacaaaaccattttagatagcatataatamatttattagtaattccaaattctgtgatctcacttaatagaaaccacacattctactagtaggccaattaattagccttaaggcattgcctttacacagg

SEQ ID NO: 31709 - DNA, 201 bp, Homo sapiens
attttgatatgagttgcattgaatttatggattgctttgggcaatattgtcattttaacaatactgattcttcagatttttgatcatgggctgtttttgtgtttgtttgcatcatctataatttctttcatcattgttttatagtttctcttgtacagatcttgtacacctccttggttaaatatattttaattaggtatt

SEQ ID NO: 31710 - DNA, 201 bp, Homo sapiens
acagaattggaaaaaactactttaaagttcatatggaaccaaaaaagagcctgcattgccaagtcaatcctaagccaaaagaacaaagctggaggcatcaygctacctgacttcaaactatactacaaggctacagtaaccaaaacagcatggtactggtaccaaaacagagatacagaccaatggaacagaacagagccc

SEQ ID NO: 31711 - DNA, 201 bp, Homo sapiens
gaggcatcatgctacctgacttcaaactatactacaaggctacagtaaccaaaacagcatggtactggtaccaaaacagagatacagaccaatggaacagracagagccctcagaaacaacaccacacatctacaaccatctgatctttgacaaacctgacaaaaacaagaaatggggaaatgattccctatttaataaat

SEQ ID NO: 31712 - DNA, 201 bp, Homo sapiens
ttttgatatgagttgcattgaatttatggattgctttgggcaatattgtcattttaacaatactgattcttcagatttttgatcatgggctgtttttgtgtttgtttgcatcatctataatttctttcatcattgttttatagtttctcttgtacagatcttgtacacctccttggttaaatatattttaattaggtattt

SEQ ID NO: 31713 - DNA, 201 bp, Homo sapiens
atacagaccaatggaacagaacagagccctcagaaacaacaccacacatctacaaccatctgatctttgacaaacctgacaaaaacaagaaatggggaaaygattccctatttaataaatggtgctgggaaaactggctagccatatgtagaaagctgaaactggatcccttccttacaccttatacaaaaattcatccaa

SEQ ID NO: 31714 - DNA, 201 bp, Homo sapiens
tttgatatgagttgcattgaatttatggattgctttgggcaatattgtcattttaacaatactgattcttcagatttttgatcatgggctgtttttgtgtwtgtttgcatcatctataatttctttcatcattgttttatagtttctcttgtacagatcttgtacacctccttggttaaatatattttaattaggtatttt

SEQ ID NO: 31715 - DNA, 201 bp, Homo sapiens
ttatacaaaaattcatccaaggtggattaaagacttaaatgttcgacctaaaaccataaaaaccctagaagaaaacctaggcaataccattcaggacatargcgtgggcaaggacttcatgtctaaaacaccaaaagcaatggcaacaaaaactaaaattgacaaatgggatctaattaaactaaagagcttctgcacagc

SEQ ID NO: 31716 - DNA, 201 bp, Homo sapiens
caggagttccagaccagcctggccaacatggtgaaaccccaactttattaaaaatacaaaaattagctgggtgtgatggtgcacaccagtaatcccagctwctcaaggaggctgaggcaggagaattgctttaacctgggagacagagtttgcgataagccgggattgtgccactgcactctagcctaggtgacagagtga

SEQ ID NO: 31717 - DNA, 201 bp, Homo sapiens
aacctaggcaataccattcaggacataggcgtgggcaaggacttcatgtctaaaacaccaaaagcaatggcaacaaaaactaaaattgacaaatgggatckaattaaactaaagagcttctgcacagcaaaagaaactaccatcagagtcaacaggaaacctacagaatgggagaaaatttttgcatttttgcaatcttct

SEQ ID NO: 31718 - DNA, 201 bp, Homo sapiens
gaactttgaaaaaaagttagatgaattgctaactagaataaccagattagaggagaacataaatgacctgatggagctgaaaaacacagcacaagaacttygtgaagcatatataagtagcaatagccgaatcaatcaagcagaagaaaggatatcagagattgaaggtgacctcaatgaaataaggtgagaagacaagat

SEQ ID NO: 31719 - DNA, 201 bp, Homo sapiens
atacaaaaattagctgggtgtgatggtgcacaccagtaatcccagctactcaaggaggctgaggcaggagaattgctttaacctgggagacagagtttgcsataagccgggattgtgccactgcactctagcctaggtgacagagtgagactctgtctccaaaaaaaaggattgaatcagtaataaaaattgtcccaacaa

SEQ ID NO: 31720 - DNA, 201 bp, Homo sapiens
taagtagcaatagccgaatcaatcaagcagaagaaaggatatcagagattgaaggtgacctcaatgaaataaggtgagaagacaagattagagaaaaaagrgtgaaaagaaatgaacaaagcctccaggaaatatgggactatgtgaaaagaccaaatatacgtttgattggtgtacctgaaagtgacgggagaatggaac

SEQ ID NO: 31721 - DNA, 201 bp, Homo sapiens
gtcccaacaatgaaaagcccaggatcagatggatttacagatgaattatacctaacatacatagaactaatatcaatcctcctgaaactgtttcaaaaaartcaaggagcaggaaattctccctaaccgctctatgaagccagtatcaccctggtaccaaaaccagacaaagacacaacaacaaagaaaactacagaccaa

SEQ ID NO: 31722 - DNA, 201 bp, Homo sapiens
aggagaattgcttgaacccaggaggcagaggttgcagcgagccgagatcatgctgctgcactccagcctgggtgacagagcaagactccatctcaaaaagaaaaaaaaaattaaatacataaaaaaataaaataaaatcccttaatggcttttcattgcttttaagctaaatatggtgctttaatttgccaaagtatccca

SEQ ID NO: 31723 - DNA, 201 bp, Homo sapiens
agtatctgttcatgtttttttgcccattttttaaatgggggtgatttgttttttacttgttgggttatttaagtcccttatagattctggatattaggacytttgtcagaaacatagtttgcaaatactttctcccattttgtagattgtccttctcagcattcttgattcaaattctagcatccatttaactacctatag

SEQ ID NO: 31724 - DNA, 201 bp, Homo sapiens
caatgaaataaggtgagaagacaagattagagaaaaaagagtgaaaagaaatgaacaaagcctccaggaaatatgggactatgtgaaaagaccaaatataygtttgattggtgtacctgaaagtgacgggagaatggaaccaagttggaaaacactcttcaggatatcatccaggagaacttccccaacctagcaaggcag

SEQ ID NO: 31725 - DNA, 201 bp, Homo sapiens
ggccgcatgtagcccgcaggctgcgtgttggacaagcttgccagatctaaggtcaggttcacttctttcgaacatgttgtctgagttccttgactcaacarttttacttctataggtactcatcctttctgtactcccagtatagaagctttccctgtgtgtgggaattacatggttgcctctgtactccaccgaccatat

SEQ ID NO: 31726 - DNA, 201 bp, Homo sapiens
tttgcaaatactttctcccattttgtagattgtccttctcagcattcttgattcaaattctagcatccatttaactacctatagaaacttagacaaatgayttaacatcttagttgtttcctcatctgaaaaaatgggattaatattaaataatataggcaaaagtacttatgtattatatggcacatagtaggccacaag

SEQ ID NO: 31727 - DNA, 201 bp, Homo sapiens
cagctctgacatatatcaaattgtcctacacttatggatctcatttgatctttgcaagtctgggccagtatcacattattttaataactatggctttacartaagtcttgatgagaagtactctaccttgctttcatttttaagatgttcctaactattccgggcactttgcattttgacacaaacttaagaatcagcttg

SEQ ID NO: 31728 - DNA, 201 bp, Homo sapiens
actcaacaattttacttctataggtactcatcctttctgtactcccagtatagaagctttccctgtgtgtgggaattacatggttgcctctgtactccacygaccatatgtttcatgacagcaggcatctcacttgatttttgttaccatttttcaaattttacttagagctcagtaaatattcatcaaatgaatgaatta

SEQ ID NO: 31729 - DNA, 201 bp, Homo sapiens
ccatttaactacctatagaaacttagacaaatgacttaacatcttagttgtttcctcatctgaaaaaatgggattaatattaaataatataggcaaaagtrcttatgtattatatggcacatagtaggccacaagcagctagctgttaccttttcttctgatcaaaaaatgtgaatttacatcttcatataatattggtca

SEQ ID NO: 31730 - DNA, 201 bp, Homo sapiens
gctatggagtgatgattaagagtgatgtcatttaccaacctgttttgttcaatttatgccaaacattccatcttaatatcatttatcattttctgacactrtatgatgtagacagtggtatacaatggtaactagttttttatttacctgttacctgtcttttgtattcaaagttgtgctccagaaagtcaggggttattt

SEQ ID NO: 31731 - DNA, 201 bp, Homo sapiens
atcaggacctactacagccttgacttcctgggctcaataaatcctcctgtttcagccccacaagtacctgaaactacaggcatgcaccaccacacctggcttttttttgtgtttttttttttttaattttagtacagacaagatctcttatgttgctcaggctggtcttgaatgcctgaactcaagcgatcctcccacctc

SEQ ID NO: 31732 - DNA, 201 bp, Homo sapiens
gaggagggctttggtggccttgccagaagaatttaagcaaaacaatgggagaggggctggtctcagtggctcatgcttgtaatcccagcactttgggaggmaggaggaatcacttgagcccagaagtttgaaaccagcttgggcaacatagtgagaccccatctctacaaaaaataaaaaattattttaggcagatgtggt

SEQ ID NO: 31733 - DNA, 201 bp, Homo sapiens
tgcttgctctcttctcttcttttcctttcttctttctctcttcttctcttctccctctccctccctccttccctccctcccttccttccttccttgtcccygtcccttttctttcttgctgacagtctcactctgtcacccaggctagagtgcactgatgtgatctcagctcactacaacctctctctctctctttttctc

SEQ ID NO: 31734 - DNA, 201 bp, Homo sapiens
ctacaacctctctctctctctttttctctttctctctccttccctccctcccttccttcctgccctcctatcttccttgtccccatcccttttctttcttrctgacagtctcactctgtcacccaggctagagtgcagtgatgtgatctcagctcactacaacctctctctctctctttttttctttctctctccttgctt

SEQ ID NO: 31735 - DNA, 201 bp, Homo sapiens
attgggatagtatgaagctgtcaaaaatataaaacatgaaaatacctattatacgtcatcaaatgaaaggtgtttcatgtcgtttacagttcttaaaacacatccatccagctccttcctgttttcttaagcattgacagtatacagtgaccacagatattgggatgtttttgggttacagtgtgaggataaagcacactg

SEQ ID NO: 31736 - DNA, 201 bp, Homo sapiens
ccacatggctggggaggcctcacaatcctggcgaaaggcaaatgaggagcaaagtcacatcttacatggtggcaggcaagagggcatgtgcaggggaactyccatttataaaaccatcagatcttgtgagacttattcactaccacgagaacagcatgggggaagacaccctcatgattcagttatctccacccagccccg

SEQ ID NO: 31737 - DNA, 201 bp, Homo sapiens
caataccagtagactgtatgttaggtatgtatataaaataatactcagagcaagcactagaaaagctgtacaaagagatacactgagaagtaccacagataaatcaaaataggattctaaatattgttcaagtaatgcatagcatagcaagtcagtaaaaataaatcagaacaaacggaaccacaggtgaaatgacagact

SEQ ID NO: 31738 - DNA, 201 bp, Homo sapiens
aataccagtagactgtatgttaggtatgtatataaaataatactcagagcaagcactagaaaagctgtacaaagagatacactgagaagtaccacagataaatcaaaataggattctaaatattgttcaagtaatgcatagcatagcaagtcagtaaaaataaatcagaacaaacggaaccacaggtgaaatgacagactg

SEQ ID NO: 31739 - DNA, 201 bp, Homo sapiens
ataccagtagactgtatgttaggtatgtatataaaataatactcagagcaagcactagaaaagctgtacaaagagatacactgagaagtaccacagataaatcaaaataggattctaaatattgttcaagtaatgcatagcatagcaagtcagtaaaaataaatcagaacaaacggaaccacaggtgaaatgacagactga

SEQ ID NO: 31740 - DNA, 201 bp, Homo sapiens
taccagtagactgtatgttaggtatgtatataaaataatactcagagcaagcactagaaaagctgtacaaagagatacactgagaagtaccacagataaatcaaaataggattctaaatattgttcaagtaatgcatagcatagcaagtcagtaaaaataaatcagaacaaacggaaccacaggtgaaatgacagactgaa

SEQ ID NO: 31741 - DNA, 201 bp, Homo sapiens
atccatcacgcctgggaaaatgctccattccgcattccttagctctggttctggtttcagacttcactttatattggcggggttttaaagctagaggagtmtttacctacttactcttatgtacagatctgaatatggaggtcaggaggggcaaatgacatgtcctaagtcagaggagattcaacaagaaaaccagacagt

SEQ ID NO: 31742 - DNA, 201 bp, Homo sapiens
tataaagattaaccatgccgaatatgaaaattcaaaacccagaatactccaaaatccaaaacattttgagcactgaaatgataccacaagtggaaaattcyacacgtaaatacttagtacaaagtttatttcatgcacaaaattatttaaaatattttataaaatttccttcaggctatgtgtgtaaggtgtgtatgaaac

SEQ ID NO: 31743 - DNA, 201 bp, Homo sapiens
ccaggcttccctacagcagaaggaaactaaatcagggtaatgagcctcagcagggacgggcctccccactgccctgagaggacacagggctgtggcatggycctgctttgaccggctagctgtgcagtagggccaggtggggcctggagtggcctgagctaggggctgacatgagctcccccaaggcactgcataagtaac

SEQ ID NO: 31744 - DNA, 201 bp, Homo sapiens
cttggggtatgtttattaggagaggtcattctgggcagaggatgagaagaagcaaaaatatgtaagagtgaacatgctgaaggttaaggaattcagtgtawccgtaacaaaggatgccttccagaatgtggctggagattaagatggataaaaggtagaacaagtccaagttgaaaaggtcttgtgtgccatgtgaaaagg

SEQ ID NO: 31745 - DNA, 201 bp, Homo sapiens
tactggttggattgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgccc

SEQ ID NO: 31746 - DNA, 201 bp, Homo sapiens
actggttggattgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgccca

SEQ ID NO: 31747 - DNA, 201 bp, Homo sapiens
attttctgacgatgctaagtccatgctttcctgcctagagggctttcaccagctttccctctccctggattgctccccctccactggtgctcactccaccrggacggttatattgtgggacgagtgaaggcaggtcacaagtgttttacaaagaaataaaacactttggtggggtgccgtgggtcacacctgtaatcccag

SEQ ID NO: 31748 - DNA, 201 bp, Homo sapiens
ctggttggattgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccag

SEQ ID NO: 31749 - DNA, 201 bp, Homo sapiens
ggttggattgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggc

SEQ ID NO: 31750 - DNA, 201 bp, Homo sapiens
gttggattgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggct

SEQ ID NO: 31751 - DNA, 201 bp, Homo sapiens
ttggattgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggctg

SEQ ID NO: 31752 - DNA, 201 bp, Homo sapiens
tgtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggctggagtgt

SEQ ID NO: 31753 - DNA, 201 bp, Homo sapiens
gtgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggctggagtgta

SEQ ID NO: 31754 - DNA, 201 bp, Homo sapiens
ttgcatcactgggtgccgtgtgttggtcttgtgacaatctctgcaaagaagctctgatgctggctgggtgctgtgtgttgtgggggtgggaacttatcccrctatcttggaaagcaggcaccggggaccacaggtaggcttagattcctagggaaggcagcactaggaccatccaggccaaagttcagggtgattcctcag

SEQ ID NO: 31755 - DNA, 201 bp, Homo sapiens
tgtgatggacacctgtggaggaataatttatgaacaatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggctggagtgtag

SEQ ID NO: 31756 - DNA, 201 bp, Homo sapiens
ggacacctgtggaggaataatttatgaacaatcagagattttgagcatttttgcttttgtggtagttgtgcctttctttgtttctttctttctttgtttgyttctttctttctttctttctttctttctttttttttttttttttttttttttgagacaaagtctcactgtgtcgccgcccaggctggagtgtagtggcac

SEQ ID NO: 31757 - DNA, 201 bp, Homo sapiens
tggtctctcaaagtgctgggattacaggcgtgagccaccacgaccggctgattggttattattattaaccatttttacttgccattccagtagtttttttwaaaaaagcaaaaaaccccaaaacctatttttgcagtttggcttattttttaggtttttaaatatttttttttgacacagagtctcgctctgtcatccagg

SEQ ID NO: 31758 - DNA, 201 bp, Homo sapiens
agcatgcaccaccacacccagctaatttttgaattttttgtataaatgcgatctccctctgttgcttagatttgtctcaaactcctgagctcaagtgatcstcctactttggcctcacaaagtgctgggattacaggtgtgagccattgcgtctggcctttttttgttttgtattttagtagtgaggctgaactttctcca

SEQ ID NO: 31759 - DNA, 201 bp, Homo sapiens
tctgtgtttcaatagttatattgaattcagtattcacccttgaatattgagtttgaaaacaaaattatctatgattttttaaaaaatcactaggctatcaygaattttattaaatcttagaaaagtgaggattccaagccttaagttgaatgttcaattgattttatcttttaaaaagtataatatgggctaggagcggtg

SEQ ID NO: 31760 - DNA, 201 bp, Homo sapiens
taacatgaagcagctcccaagttccaccatttttagttgtgcgatgttggtcaagtctgaaatttcctcctctgcatctaactcagatgttagctgggtgrccaccttctttgagatatcaattcaatgaacactcattcctctcctctgtggtttcagaaggacttaccttctcatcgtcgttctggctctgggttcctc

SEQ ID NO: 31761 - DNA, 201 bp, Homo sapiens
ttggggtatgtttattaggagaggtcattctgggcagaggatgagaagaagcaaaaatatgtaagagtgaacatgctgaaggttaaggaattcagtgtaamcgtaacaaaggatgccttccagaatgtggctggagattaagatggataaaaggtagaacaagtccaagttgaaaaggtcttgtgtgccatgtgaaaaggt

SEQ ID NO: 31762 - DNA, 201 bp, Homo sapiens
tgacagtggctgatcctagatcagaaagcacttggtaaaatgggaaagaagataagaaggtatcattatcatcatcgctctaggttgaattactaaagtcrtgatttatctttccttcttttatttatgatatctttccttctctttcacctccccatccaatgaccaccagaaatctctgtccatttcccagcagccaga

SEQ ID NO: 31763 - DNA, 201 bp, Homo sapiens
gggacagagtggggcaaggccagaggtgaaataccactactctgattgtttattcactgaccccgtgaggtggccccaaggggctcttgcttctggcgccragtgcccggccacatgcacatgccaaattgtaaagaccatcgatgctaggaagaaactgcatcaactaatgagcaaaataaccagctgacatcataatga

SEQ ID NO: 31764 - DNA, 201 bp, Homo sapiens
agggacatggatgaagctggaaaccacaattctcagcaaactatcacaaggacaaaaaaccacacaccgcatgttcttactcacaggtgggaattgaacamtgaaaacacttggacacaggaagaggaacatcacacaccggggcctgttgtggggttgggggagggagggagggatagcattaggagatatacctaatgt

SEQ ID NO: 31765 - DNA, 201 bp, Homo sapiens
tatttcatactttcagtgagaaaaatggaagctatatgagggcaggggttttgttagttttattcattagcatatcatcagtatttaaaccagtacttggtttttccccccctattgttagagggcaataggaaagcagtttgaggatgaagtagtctacagcatgcagttgagggggctctagaggagaagaagagatag

SEQ ID NO: 31766 - DNA, 201 bp, Homo sapiens
tatgtattttaagtaggtaaattgtatagcatgtaaattacagttcaacaaagatattttaaaacaaaagaaaatcaaagaaaaattaatctggctagttrattctttttatgtattacatatgtatttacattttttacatgaggtaattagatatctttcataatgtactcttgagatggttcagtttgattttaattt

SEQ ID NO: 31767 - DNA, 201 bp, Homo sapiens
tttaagctatttgaaattcctcttccactgtgcagattgttagtagtttgaatttgaaggatacgatattttaagagaaccctcagaagcataaatgtatrtatatacacacacacatatattttttgagacaaggtcttgctgttttgccaagttcaagtggcatgatcaggacctactacagccttgacttcctgggct

SEQ ID NO: 31768 - DNA, 201 bp, Homo sapiens; identical to SEQ ID NO: 8124

SEQ ID NO: 31769 - DNA, 201 bp, Homo sapiens
cacctgtggaggaataatttatgaacaatcagagattttgagcatttttgcttttgtggtagttgtgcctttctttgtttctttctttctttgtttgtttstttctttctttctttctttctttctttttttttttttttttttttttttgagacaaagtctcactgtgtcgccgcccaggctggagtgtagtggcacaat

SEQ ID NO: 31770 - DNA, 201 bp, Homo sapiens
caatcagagattttgagcatttttgcttttgtggtagttgtgcctttctttgtttctttctttctttgtttgtttctttctttctttctttctttctttctttttttttttttttttttttttttgagacaaagtctcactgtgtcgccgcccaggctggagtgtagtggcacaatctcggctcactgcaacctccacctc

SEQ ID NO: 31771 - DNA, 201 bp, Homo sapiens
cttctaaatttatttttcagtgtcacaatcacaaatttgagtcaagttttctttaaaatcagagttcagtgtttctttcttttctttttctttttcttttyctttttttttttttttttttttttttttttttgagacagtctcgctccatcacccaggctggagtgcagtggtgcattttcggcttactgcaacctctgc

SEQ ID NO: 31772 - DNA, 201 bp, Homo sapiens
gtatatagattgatatagaatgcagattttttttttttttttttttttttttttttttggagacagaggctcactctgtcgcccaggctggagtgcagtgmacgatctcggctcactgcaagctccgcctcccgggttcacgccattctcctgcctcagcctcccgaggagctgggattagaggcgcccgccacctcgccc

SEQ ID NO: 31773 - DNA, 201 bp, Homo sapiens
cccgggttcacgccattctcctgcctcagcctcccgaggagctgggattagaggcgcccgccacctcgcccggctaatttttttgtgtttttagtagagayggggtttcactgtgttagccaggatggtctccatctcctgacctcgtgatccgcccgccttggcctcccctcccgaagtgctgggattacaggcgtgagc

SEQ ID NO: 31774 - DNA, 201 bp, Homo sapiens
gccattctcctgcctcagcctcccgaggagctgggattagaggcgcccgccacctcgcccggctaatttttttgtgtttttagtagagacggggtttcackgtgttagccaggatggtctccatctcctgacctcgtgatccgcccgccttggcctcccctcccgaagtgctgggattacaggcgtgagccaccgcgccca

SEQ ID NO: 31775 - DNA, 201 bp, Homo sapiens
cccgaggagctgggattagaggcgcccgccacctcgcccggctaatttttttgtgtttttagtagagacggggtttcactgtgttagccaggatggtctcsatctcctgacctcgtgatccgcccgccttggcctcccctcccgaagtgctgggattacaggcgtgagccaccgcgcccagcccagattgtagattcttaa

SEQ ID NO: 31776 - DNA, 201 bp, Homo sapiens
cgtgatgaggactgtagcaccgtcaggcagactggtcgtactggagttctcttcttttgatctgtggctaaccaacacatccaggtcaataatagacctgygggtcaccttagatctgtaagagatttgccatggacctttgcagttagtggcttgactttgttttgaattgcatagtgaaatattctctaacatatttac

SEQ ID NO: 31777 - DNA, 201 bp, Homo sapiens
tagaggcgcccgccacctcgcccggctaatttttttgtgtttttagtagagacggggtttcactgtgttagccaggatggtctccatctcctgacctcgtratccgcccgccttggcctcccctcccgaagtgctgggattacaggcgtgagccaccgcgcccagcccagattgtagattcttaatgagaatttcttaaat

SEQ ID NO: 31778 - DNA, 201 bp, Homo sapiens
tgtttctatagttatatacatatattcatatatatatattattataaataaaactcaaaccaaaataaggtgtggggagaccagaagtaattctgaaaagrcagtatcctgaatgaacattcccaatgcctttctctttcaactcctgttctgggttataccgaatggtagcagatgcctctgattctatgagttaactgg

SEQ ID NO: 31779 - DNA, 201 bp, Homo sapiens
ttgaatactgaccatcaatgtattagttgataaataacactgtgatatacccatatacggtgaaatgtcatcccacaataaaaaagaatgaattgctgacatatgctacagtgtgaatgaatcccaaaatcatatgctgagcgaaagaagccaggcacagaaagatatatgctgcatggttatgtgtacaagtgtcctaga

SEQ ID NO: 31780 - DNA, 201 bp, Homo sapiens
caccttttattaataaagaaatttactgaaactgttttatgcttaagtagaaaaacaaaggtgacacatttgaaatttatatactgttcatggtcctgttwctcactggcttagtggccttgagtaccatactataaaccaaacttattttcacaatgataaaatgagcgtgttctactagatgtcatataaattcctctt

SEQ ID NO: 31781 - DNA, 201 bp, Homo sapiens
cccctctataaaagccaaaaaaaaaaaaaaaaaaaaaaaacagtgggtcagacataccatgtagaggatgctcacattgtttgctaaattgggataaggawctttaagtttccttcctactccaagatttcatgtgaaaggtactttcttcccttaaattatcttatcattgttttcagttggttggttgcttaggataga

SEQ ID NO: 31782 - DNA, 201 bp, Homo sapiens
cacaggacatagtttgaatgcagtgctcttctgtccagatcagttggtcatactgtaccaggctacggggttatactgattgtacatcagcatatctatgrtgtcatccatgtatgaagcatccttaggttgaacatgttgaaacatgataaaacgtgtcttagaattaacgaaatgtaatatatctctagagctaatttt

SEQ ID NO: 31783 - DNA, 201 bp, Homo sapiens
ccaggaagggagtgaggaatttccagaactgagggttccttccctttttagactatataggataacttccagacactgtcatggcctttgtaaactgtcayggtgctggtgggagtgcctttagcatgctgatgcattgtaactacgtataatgagcagtgaggatgaacagaggtcacttttgtcaccatcttgattctg

SEQ ID NO: 31784 - DNA, 201 bp, Homo sapiens
ataggataacttccagacactgtcatggcctttgtaaactgtcacggtgctggtgggagtgcctttagcatgctgatgcattgtaactacgtataatgagyagtgaggatgaacagaggtcacttttgtcaccatcttgattctggctggtttcatctggctttggctggcttccttaccacatcctattgtattagcagg

SEQ ID NO: 31785 - DNA, 201 bp, Homo sapiens
cttatgtttccttccagagttttattattctagcttttacttgtaggtgtgtgatctaaagtgagttagcttttgtgtatgatgtaagcttaagatcaagkttcatttgttgcacagatgaatatccaactgtcccagcaccatttgttggaacaattatccttaccaaattaaattaccttggcgtcttagtcaaaacct

SEQ ID NO: 31786 - DNA, 201 bp, Homo sapiens
actcagaatgttaaatagttggaatcatatagttatgattccaaactggcttctttcacttagcaatctgcatatatggcccctctatatcttttcatgamttgatagctgatttctttacatcactgaaaaacattccaatggatgtgttacagtttattcacattttggctgcttccaagttgtggtaattaaaagcta

SEQ ID NO: 31787 - DNA, 201 bp, Homo sapiens
cttcccactagtttttctttactagagctgatcaatcctatgatagggattgagcaaattaatcataaatctttgaaattgtcgattttatatttagtcarcactgacttcttcaaatatgagggactttttaaaattcaatttgactgctgtagagtattcagtggcactgcagagataccatttggtaggttaatttaa

SEQ ID NO: 31788 - DNA, 201 bp, Homo sapiens
aattgtcgattttatatttagtcaacactgacttcttcaaatatgagggactttttaaaattcaatttgactgctgtagagtattcagtggcactgcagakataccatttggtaggttaatttaatactagaccaaaaactggttatttgttttgaaaactattttgtgggaaagctactatctcagtgttatagacataa

SEQ ID NO: 31789 - DNA, 201 bp, Homo sapiens
attgtcgattttatatttagtcaacactgacttcttcaaatatgagggactttttaaaattcaatttgactgctgtagagtattcagtggcactgcagagwtaccatttggtaggttaatttaatactagaccaaaaactggttatttgttttgaaaactattttgtgggaaagctactatctcagtgttatagacataat

SEQ ID NO: 31790 - DNA, 201 bp, Homo sapiens
tgcataacttagcagtacagcttccaagaagggccctgatattgtggataaatggagtctatttttaaggttagataaatccagcctatttttgtgggcakggaaaaattattgctgaagtgtttttgataagattcttctgtgccataaactgaaatactgagagtataacagtttttcataagaggaaaggaagaaaaa

SEQ ID NO: 31791 - DNA, 201 bp, Homo sapiens
tgaatactgaccatcaatgtattagttgataaataacactgtgatatacccatatacggtgaaatgtcatcccacaataaaaaagaatgaattgctgacatatgctacagtgtgaatgaatcccaaaatcatatgctgagcgaaagaagccaggcacagaaagatatatgctgcatggttatgtgtacaagtgtcctagaa

SEQ ID NO: 31792 - DNA, 201 bp, Homo sapiens
tgaaaactattttgtgggaaagctactatctcagtgttatagacataatgtagtgctagtataccataagtgacatttttttatgctggctgaaataccaraattcatcttgaatgtgatttactttagcacatctgctctttggaagaataattttaaaatttaactattacttttctgattagatagagtaccaagtat

SEQ ID NO: 31793 - DNA, 201 bp, Homo sapiens
ctttgtcttttacatataaactgggcatagatgttccatgtacaccatagccggatttgcagactgggagcactcctagagcaagaatgagcactccccaccacacacacacacacaccatgctacatgcttatcagtttcccatgaaggaaccagggagctcttaggttctctcagtagtagaaaatgtatccagagacc

SEQ ID NO: 31794 - DNA, 201 bp, Homo sapiens
ttgtcttttacatataaactgggcatagatgttccatgtacaccatagccggatttgcagactgggagcactcctagagcaagaatgagcactccccaccacacacacacacacaccatgctacatgcttatcagtttcccatgaaggaaccagggagctcttaggttctctcagtagtagaaaatgtatccagagacctc

SEQ ID NO: 31795 - DNA, 201 bp, Homo sapiens
ttcttctttcccctcccctttcctccctcccctctccccattctgctcttcactctcattctgtcgcccagactagagtgcaatggccctatctctgctcrctgcaacctgcctcccaggtttaagcaatttctactgtgtcagcttcccaagtggctaggattacaggtgtgcatcaccactcctggctaatttttttat

SEQ ID NO: 31796 - DNA, 201 bp, Homo sapiens
aggggaaagtgagagggaaggtatagggggtggatattaagagctatttagaccatataaattagtgtctgtcttctttctttctttctttctttctttctttctttctttctttctttctttctttctttctttttctttcttttctctctttttttttttaattgaggcaaggtcttgctctgtctcccaggctagagt

SEQ ID NO: 31797 - DNA, 201 bp, Homo sapiens
ttatttgatggtagaaacccttttcaagtaaagaaggtggtacctattaaaatggcattcagcttattgacaataaattagaaaaactagaagaaattgayatccttccagcaaaatataacatacccaaataaaatctcgaagaagtagaaaaacatgaactggtacatcacagtggaagacattggaatgatttgccaa

SEQ ID NO: 31798 - DNA, 201 bp, Homo sapiens
attttcagtgcattacctgtacataaaagtggatcttaaataataatgatagtttatatattcactgtgtaagtgtttctaagacttttacaattattatktaatcctcacagtaactcttatgaggatgatgcttgtattacgctcattttacagataaggaaactgagattcagggacttctgtgtcttcccatttaaa

SEQ ID NO: 31799 - DNA, 201 bp, Homo sapiens
atttctaaagtgggatgagcatgaagccagggctttcttacaaagcacctttttctctacccttattatctatatttcttttggttttggttgggtttttkgtgtggtttaggtttttcatacccagaggttaaaacttccttgatgtactcttttgttgtgaacaaagaggagtcacaggatagagaaatgttagaatgt

SEQ ID NO: 31800 - DNA, 201 bp, Homo sapiens
gctagatacactatagtgaatgaaaaagacttttttccagtatgcctaaacagtattttgatcactgttttttttgtttgtttgtttgtttgccaggtttkgggcaataaaatcacatgtgaaaaatcctcagagatttttaaaaagtaggagagactttagaaatcatctagtataccttcttcacattactaaatagta

SEQ ID NO: 31801 - DNA, 201 bp, Homo sapiens
cttattgacaataaattagaaaaactagaagaaattgatatccttccagcaaaatataacatacccaaataaaatctcgaagaagtagaaaaacatgaacyggtacatcacagtggaagacattggaatgatttgccaaatttgagtattttaaaaagctgggagtctgtggtgggaggatctcttgagctcaggagtttg

SEQ ID NO: 31802 - DNA, 201 bp, Homo sapiens
ggttttccccaggtgtttccaaaataactctccaactgctattttcccctgctgtcacaccaccacaccatcaacacaggagacttctgtgaccggggtcrggggaggggttccccatacaccaagcatgaaccctagctgagtgtcctcttccaattcagtttcacactatctacctggagatagtgtcagatcccacag

SEQ ID NO: 31803 - DNA, 201 bp, Homo sapiens
gaactggtacatcacagtggaagacattggaatgatttgccaaatttgagtattttaaaaagctgggagtctgtggtgggaggatctcttgagctcaggartttgtggctgcaatgagctatgatcatgcccactgcattccagcctgggcaacacagtgagaccaagactttatagaaaaactaaaaataaaaaaattaa

SEQ ID NO: 31804 - DNA, 201 bp, Homo sapiens
atttaccccagacaacgtacccgcttgaattttactagtccagtggaggctcccattgtcaaagccctttatagcaaagctcttaaagtgtgtttatttcmtaaagtccaaggattcattgtcttattttaaaactaatgtttaatcactcactgtttttatgctttatcagcacttgttaaagataatttggcttgaggc

SEQ ID NO: 31805 - DNA, 201 bp, Homo sapiens
tactcaacatcccaacctctccacttcctaaattatgtgtatactacttaaattagtttttttaaaaaagctgtaaagtatatattttataattttttcctttttttttttgaattagagccttgctctgtagcccaggctggagtgcagtggcacaatcttggctcactgcaagctccgcctcccgggttcaagcaattc

SEQ ID NO: 31806 - DNA, 201 bp, Homo sapiens
acacgtgtgtacatatctgcacatctttgcagcaagacatcacctattccctcctctccttgaagatttgctcatcttgctccaaattccaggttcatggrctaagatagtcaaaaggctttcctttgatgttggtacattttaggggcttatttggttacatttttttggacttccgtgcttttttattgtcgtctattt

SEQ ID NO: 31807 - DNA, 201 bp, Homo sapiens
tttttttaaaaaagctgtaaagtatatattttataattttttcctttttttttttgaattagagccttgctctgtagcccaggctggagtgcagtggcacratcttggctcactgcaagctccgcctcccgggttcaagcaattctcctgcctcagcctcccaagtagctgggactacaggcgcccgtcaccacgcccggc

SEQ ID NO: 31808 - DNA, 201 bp, Homo sapiens
gccattttgagcagtgtgatgaaatctcacgccctgctactttgtcctgcccaggatgcgaatcatcgctttgtccccctggcccatgctgtataggctgyctacctgttagtcacttagcaaccatcttggttatcagcttgattgtcatgacactgtagtgcttttgttcaagtaacccttattttatttaataatggc

SEQ ID NO: 31809 - DNA, 201 bp, Homo sapiens
ctcaccacctgtttttttttttttttttttttttttttgagacagggtctcgccttgctctgtcacctagtctagagtagtgtggagtgatcatagttcaytgcagtcttcaactcctgggctcaggtgatcctcccatctcggcttcccaagtagttgggaccacaggcacatgccaccatgcccagctaatttttaatt

SEQ ID NO: 31810 - DNA, 201 bp, Homo sapiens
tttgttaatttttttttttcttgtagaatcagggtctcgccatgttgcccaggctggtctcaaattcctgggctcaagcgagcctcctgcctcagcctctsagatacagatacaggcatgaaccactgccttggccctgctgttttaagtaaacttttattggaacaccaccacgcttgtttgtttacctactgtctatgg

SEQ ID NO: 31811 - DNA, 201 bp, Homo sapiens
tgctttggtaacacctgtatattcttcaatcgtcaattatttttatttgccatattaattttatctctctctacagtttattttgttgagccctaaagatracttttaatggctgcacgtatttactcctgtgtatgtatcatagttaattattctcaggaatagattatttctctttttacctttttttaccatttaaaa

SEQ ID NO: 31812 - DNA, 201 bp, Homo sapiens
cttttttaaaaagacagtgtgttatattaagaagaattatgtcattgctttgcattggcgactctgtctggtaacgtaccgattcacaatgaaggtgaggyttaagaaaaagtcaaaagatttatctgacaaaaaaattcacataactcaggtgtgcctatgaatcaacggaatatacttgtagatgcaaaagtcacattt

SEQ ID NO: 31813 - DNA, 201 bp, Homo sapiens
ttacagttacctataatcacagaaaatcgtagatacggtggaattttggaatattaacttttaggtgtgaaaatagtcttgatgtatttgggtactaaacrtatgaaaacagcgaatttgcaaaggaacgttgtaaacgactgtctctttctcttttgtgcattaaacggactgggagaaagctttgggaaggataaaaac

SEQ ID NO: 31814 - DNA, 201 bp, Homo sapiens
tacctctgtagtctgagttggaaattgcagtagtagaaactgaattttagctttgattagttcaaaataaataatcattttaataggttcattaacaatcrttgtcaccgttattattgtcaaagttgtcaaaaaattttgaagtgtttatcccggggacactattctgaaatctacatgcattatcttaatttttttttg

SEQ ID NO: 31815 - DNA, 201 bp, Homo sapiens
tattgttttcttctgcatgaaggactttctttaacatttcttatcatgcaagtctgctggagatagactcttttggcttttgtacaactgaaaatgtgttytttgccttcattttaagtgatatttttgctgtgtacagcattctagattgacaagttttttttttctttgggttgactaattttactccctattgatgat

SEQ ID NO: 31816 - DNA, 201 bp, Homo sapiens
ggcagtaaactgaggcagctgtaggactcacctgatttgtttccattcctcaggaattcctgtcctttattcattgctctccagtgtcttgaaagttttcrtgtttgtttggtccctgccccgccactccccattatactttgtttttttgggttgtttcagagggaagggaaatcctgccctgtcactttgtcttggcca

SEQ ID NO: 31817 - DNA, 201 bp, Homo sapiens
cattcctcaggaattcctgtcctttattcattgctctccagtgtcttgaaagttttcgtgtttgtttggtccctgccccgccactccccattatactttgtttttttgggttgtttcagagggaagggaaatcctgccctgtcactttgtcttggccaaatgtaactcacatctagttgacatgtgcaatgcttatttcca

SEQ ID NO: 31818 - DNA, 201 bp, Homo sapiens
atacatagtatcttgaggctcaattcatagcagaagtctcttttctgctttgtctttgagtggtttgcttgcaaagttccaggtaattgtatgcacatcamcaatggctccctctcaagatatatgtgagctgatgtgatgtaagccaacattagaattagagaggtatgatggaatggttcatccaatgagtgtaccttc

SEQ ID NO: 31819 - DNA, 201 bp, Homo sapiens
cactttgtcttggccaaatgtaactcacatctagttgacatgtgcaatgcttatttccagatgagattccttgttccccttgggaaatgtagcctagaacstctttgctaattctgcattgatatttttagctatcctcctcattacaaacccatcacaaatttgccatatttttctgagttatctaacatctgcttttaa

SEQ ID NO: 31820 - DNA, 201 bp, Homo sapiens
ccgggttcaagcaattctcctgcctcagcctcccaagtagctgggactacaggcgcccgtcaccacgcccggctaattttttttgtattttaagtagagayggggtttcaccgtgttagccaggatggtctcgatctcctgacctcgtgatccgcctgccttggcctcccaaagtgctgggattacaggtgtgagccaccg

SEQ ID NO: 31821 - DNA, 201 bp, Homo sapiens
gcgcccgtcaccacgcccggctaattttttttgtattttaagtagagatggggtttcaccgtgttagccaggatggtctcgatctcctgacctcgtgatcygcctgccttggcctcccaaagtgctgggattacaggtgtgagccaccgcatccagacttttttccattgtttttaaagctcattgtttttaaagctgtgt

SEQ ID NO: 31822 - DNA, 201 bp, Homo sapiens
aataaacaacttctataagattatagaaatcttaacattgatttccatggaaacaatggaaatagaaatcaattgaaaaaaaaggaccacaggccgggcgyggtggctcacgcctgtaatcccagcactttgggaggccaaggtgggcggatcacgaggttaggagatcgagaccatcctagctaacacggtgaaaccccg

SEQ ID NO: 31823 - DNA, 201 bp, Homo sapiens
gcccagttacgtggaaggctgaggcaggagaatggcgtgaacccgggaggtggagcttgcagtgagccgagatcgcgccactgactccagcctgggtgacrgagcgagactccgtcaaaaaaagaaaaaaaggaccacagggaaaagataagccaagatactcttaagttggaaaacatggtaataggcctggcctaaaat

SEQ ID NO: 31824 - DNA, 201 bp, Homo sapiens
gctgaaggacttggagtctgatgtttgagggcaggaagcacccagcacgggacaaagataaaggccagaagataaaggcaagtcaggttcttctgcctgcytttatcctagccgtgctggcagctgattagatggtgcccacccagattgagaatgggtcagcctctcccagtccactgactcaaatgttaatctcctttg

SEQ ID NO: 31825 - DNA, 201 bp, Homo sapiens
ccgggctcgagcaatcctcctgcctcaaccgcctgagtagttgggactacaggtgcacaccaccataccttgctaattgttaatattttttatagagatgmgatcttgctatgttgcccaggctggtctccaactgttgttggcctcaagcagttgttcagccagcctcagcctcccaaactgctgagattacaggcatga

SEQ ID NO: 31826 - DNA, 201 bp, Homo sapiens
cctttgaagggacatggatgaagctggaaaccatcatcctcagcaaactaacacaggaacagaaaaccaagtgctacatgttctcactcataagtgggagytgaacagtgagaacacatggacacaggaaggggaacatcacacaccagggcctctcggtggggcgggggtgcaaggggagggagagcatcaggactaata

SEQ ID NO: 31827 - DNA, 201 bp, Homo sapiens
catctagcaaaggatgcaactgccagtgatgtaggaggaaaacctggaaagagtggtatcctggagtcaaagcataagattgccaagggcagtggggtgakcaactatgtcaaatgcagttctcccctcaaatatatccacaaatggaatgcccttgaaacaaaatgttttcattcttttctttcttatagcctcaacgat

SEQ ID NO: 31828 - DNA, 201 bp, Homo sapiens
cggccttccgcagtgtttgtgtccctgggtacttgagattagggagtggtgatgactcttaacgagcatgctgccttcaagcatctgtttaacaaagcacrtcttgcaccgtccttaatccatttaaccctgagtggacacaatacatgtttcagagagcacagggttgggggtaaggtcacagatcaacaggatcccaag

SEQ ID NO: 31829 - DNA, 201 bp, Homo sapiens
tactaggaacttaaaagaaaaagcaatatatacacatcaagtaaattgagaacctaaaggttaaaaatgacaaggtttgcttgtaataaagaatgcataaygagccctgtgtcctgagtacgtggattcagcatctctgatcttcctttgcgctcttgacatgaggcttgtatatttagcttagtaattcatagcagctca

SEQ ID NO: 31830 - DNA, 201 bp, Homo sapiens
gtaattttaagcatatagatatttagatcaggtcttttctttatctttcggtactttgggactttaagtgaccagttattacggacatgcacttcattccsgtaagaatgtggtgcatgtgcttttggttacttctccagcaggtgatgtcttcactgacccattaattaacttaagcaggttttctcttttgatgaatat

SEQ ID NO: 31831 - DNA, 201 bp, Homo sapiens
aggcttaagaaaaagtcaaaagatttatctgacaaaaaaattcacataactcaggtgtgcctatgaatcaacggaatatacttgtagatgcaaaagtcacrtttatcaaaactatgtttcaaatgtacttacaatatgagatttcactttacgtatatatataaaaaggttggcatctatattcaatttttggcttgttac

SEQ ID NO: 31832 - DNA, 201 bp, Homo sapiens
caggtgtgcctatgaatcaacggaatatacttgtagatgcaaaagtcacatttatcaaaactatgtttcaaatgtacttacaatatgagatttcactttaygtatatatataaaaaggttggcatctatattcaatttttggcttgttacttcagcagatatcctaaggatatttttaggtttgatttgaagcttttttac

SEQ ID NO: 31833 - DNA, 201 bp, Homo sapiens
cagatgcccagcttgattccctagctcataattatttgtatttgtgggagtagagaaaaacaaactgtattctgggaaacattcattgtcgcagaaaaatratatattctaaaggcatataagttttctttcagtagaaagtatgtgaggttcgatttttaaaataataagctctcaaaatcatgacatagattttggatt

SEQ ID NO: 31834 - DNA, 201 bp, Homo sapiens
tatattaataaatatattcttgaagtagatgagagaggggaggaacctgtatttgttaggtaataatatagtttaatctttaaattacaaaatgtagccayaaggttaatagctttcatttttactctagcatagtgtgattctactatctttggatttctggatgattttttttctccttgattcttgattatatttttt

SEQ ID NO: 31835 - DNA, 201 bp, Homo sapiens
tttatcctttagttgtattatttaactccagtaatcatgtttatattgcatatatatttatattgcatatatatatatccagtaatcatgtttctattgcwtatatatataaacttgcaagtttcacttaaatgcacaggagtattacctattataagtcccaaatttaggctgggcacggtagtgactcgcacctataat

SEQ ID NO: 31836 - DNA, 201 bp, Homo sapiens
ttagtatatactaatatatactatatataatgtataacaaatatataatatataataaatatatataatatataacaacatatatcatatattttatatayactatatatgttttcatttttcttctggatatattaataaatatattcttgaagtagatgagagaggggaggaacctgtatttgttaggtaataatatag

SEQ ID NO: 31837 - DNA, 201 bp, Homo sapiens
agactttactcatgcacatactgcccttcctttcctggaaagcctgaaaatggtcatgaacgtattctttaaggccccacctctgtgttgcttcgtgtackccctccttcgggtagcgttaccggcttcctctgctaaacaccacgtctcagttgtttgccttttcttccctcaactgtgatgtcttcatctttggatatt

SEQ ID NO: 31838 - DNA, 201 bp, Homo sapiens
aaatcagatgaattggcctatctacttaatattaaaggatgttgtattatgaaagatgcatgtcaaggagcaaaatgaacaccgagcaaaccatatgggaygctacgaattcactagggattttcataattagctgctaagttggcacagctgtgggtctttgtagccgcaatgtactgctaattaccactcatttaaacg

SEQ ID NO: 31839 - DNA, 201 bp, Homo sapiens
ttctattgcatatatatataaacttgcaagtttcacttaaatgcacaggagtattacctattataagtcccaaatttaggctgggcacggtagtgactcgmacctataatcccagcactttgggaggccaaggtgggtggatcacttgaggccaggagtttatcaacagagagtaaactatattgtattctacgttctata

SEQ ID NO: 31840 - DNA, 201 bp, Homo sapiens
gtataaactatatactatagagtatattatacattaataatatactatatcagcatatactattagtatatactaatatatactatatataatgtataacmaatatataatatataataaatatatataatatataacaacatatatcatatattttatatacactatatatgttttcatttttcttctggatatattaat

SEQ ID NO: 31841 - DNA, 201 bp, Homo sapiens
gtgactcgcacctataatcccagcactttgggaggccaaggtgggtggatcacttgaggccaggagtttatcaacagagagtaaactatattgtattctaygttctatacaacagaatgctacgcaaccagtaaaataataagacttacaaagtagcaaattgggctgagtgtggtggctcacacctgtaatcgtagcact

SEQ ID NO: 31842 - DNA, 201 bp, Homo sapiens
ctggttcatgtctctagttggtaaattaaaacaacaaccaccactttatctttcggaggacatagaatttgatatctccatcatttggggagaagtcgacmctcaacagttacagtgccttcctgaaggccacacagcagatgggcgcctaagcaaaaacaaacctgcctcaacttcagaccatctgctctgttttaaagt

SEQ ID NO: 31843 - DNA, 201 bp, Homo sapiens
tcacacctgtaatcgtagcacttttgggaggctgaagccggcacatcacttgaggtcaggaatttgaaagcagcctggccaacagggatgaaaccccatcyctactaaaaatataaaaattagctggatgtggtgggcatgagcctgtaatctcagctgttctggaggctaaggctcgagaatcacttaaaccctgaactc

SEQ ID NO: 31844 - DNA, 201 bp, Homo sapiens
ggccaacagggatgaaaccccatccctactaaaaatataaaaattagctggatgtggtgggcatgagcctgtaatctcagctgttctggaggctaaggctygagaatcacttaaaccctgaactcaggaggcagaggttgcagtgagccaagatcataccactgcactccagcctgggtgacagagtgaaactctgtctca

SEQ ID NO: 31845 - DNA, 201 bp, Homo sapiens
agtgtttgtgtccctgggtacttgagattagggagtggtgatgactcttaacgagcatgctgccttcaagcatctgtttaacaaagcacatcttgcaccgyccttaatccatttaaccctgagtggacacaatacatgtttcagagagcacagggttgggggtaaggtcacagatcaacaggatcccaaggcagaagaatt

SEQ ID NO: 31846 - DNA, 201 bp, Homo sapiens
gagaatcacttaaaccctgaactcaggaggcagaggttgcagtgagccaagatcataccactgcactccagcctgggtgacagagtgaaactctgtctcaaaaaaaaaaaaaaaaaattgaagtcctgaatttatataattttttaatatatttagaagctttgaaaagttttacatgattactgagcattttaaagagca

SEQ ID NO: 31847 - DNA, 201 bp, Homo sapiens
ggagtggtgatgactcttaacgagcatgctgccttcaagcatctgtttaacaaagcacatcttgcaccgtccttaatccatttaaccctgagtggacacartacatgtttcagagagcacagggttgggggtaaggtcacagatcaacaggatcccaaggcagaagaatttttcttagtacagaacaaaatgaaaagtctc

SEQ ID NO: 31848 - DNA, 201 bp, Homo sapiens
tgcttatttgtcatctgtatatctttgatgagatgtcttagatcttctggtgatttttaaattgtggttgttttttttttttttttttttaaattgagacrgagtctggctctgttgctcaggctggagtgcagtggcatgatctcggcttactggaagctcaatctcctgggttcacgccattctcctgcctcagcctcc

SEQ ID NO: 31849 - DNA, 201 bp, Homo sapiens
gagtggtgatgactcttaacgagcatgctgccttcaagcatctgtttaacaaagcacatcttgcaccgtccttaatccatttaaccctgagtggacacaayacatgtttcagagagcacagggttgggggtaaggtcacagatcaacaggatcccaaggcagaagaatttttcttagtacagaacaaaatgaaaagtctcc

SEQ ID NO: 31850 - DNA, 201 bp, Homo sapiens
aatgtagaagctggtaatttaggggaaaggtaggttatatagatggtaatggatattaactgtcagaatcaggaattttcttcttaaaattctatcacaatttttttaacctaattcattaatactaagaagctattaaagctttttatgtgaaagaatgatcagagcttccctctgagaaatacagtctggcagcaaagg

SEQ ID NO: 31851 - DNA, 201 bp, Homo sapiens
gcattttaaagagcatatgcttttcagtaaaatattttattcattttatcacattcatgaaagcaccgtctttaaaatctcagtatttttacaatattttmacccatgtatttttcagttatttttttactattaattttattaatgccaatttacttattacatattaagagactaatttaaaaatttttaccttttgga

SEQ ID NO: 31852 - DNA, 201 bp, Homo sapiens
gggcagtggaaaaagaaggaagaggtgagtattgagtgctaggcactaatcaagtacttactcatttaatctttccccaaatattatgaggtaggcactattttttttcaccaatttacaaatgtggaaactgaggcagagaggagttttgtaaatttccccaggttaagctgcagttggaagctgaactgggatatgaac

SEQ ID NO: 31853 - DNA, 201 bp, Homo sapiens
tcactgcaacctccgcctcccaggttcaagcaattctcctgcctcagcctcctgagtagctgggattacaggcacccaccaccatgcccggctaatttttyttttttattatttttagtagagatagggtttcaccatgttggccaggctggtcttgaactcctgacctcaggtgatccgcccacttctgcctcccaaagt

SEQ ID NO: 31854 - DNA, 201 bp, Homo sapiens
gatcagctgccctgagagaatgagattttaaaataatttgacaggccggcatggtggctaacgcctgtaatcccagcacttcgggaggctgaggagtgtgratcacttgaggtcaggagttcgagaccagcctggccaacattgtgaaaccccttctctactaaaaatacaaaaattagctgggcatggtggtgtgcactt

SEQ ID NO: 31855 - DNA, 201 bp, Homo sapiens
acctttttctctgaatatccctcctaatattctctccatgttagaatagggctcatatttgaggacttttgactctccagatccttctgtgatttctgctyagggattctgtttctggaatttggcaattgtgtaatgtcacaggttgcatggaggtagagaggccgaagagcccaactcaactcttctttaactgagcaa

SEQ ID NO: 31856 - DNA, 201 bp, Homo sapiens
ggtcattcagttggagaaatccagcagattggaaatattagcatgtggggttaattgagagattagagcaagaaatgacatatttggggattatctgaacaatatatatatatatataatgcttgaagctccgaggaagtagataaaactgaaggagagtagagaaagaggcaaaaggttttgaataccctggagaattat

SEQ ID NO: 31857 - DNA, 201 bp, Homo sapiens
atgaatactttatattaaaaaataatattcttttctctgattcatgaagaagtagagtttggttagctccatttaaaagcttagctcttgattatgtagaytttttagatgttaaaattcatctggattctgcagacataagcttatattaataaagctgcatttggaatatagtcctggtatgatcttggcatagtttat

SEQ ID NO: 31858 - DNA, 201 bp, Homo sapiens
tcctgaacttctatcctaaatgttcaagttcttattgcgtatgtctgcgtgaatttcacttgagacagcaattcaaatatatcaaccttaatttaattccrtcagagatgttttccttcttacagcccataacttggttatgtataccagtctactatgctcaaaactttgccttgacttttcttttaccttttatgaaac

SEQ ID NO: 31859 - DNA, 201 bp, Homo sapiens
atcagcctcttgagaagcttggacttacaggcatgcactaccatgtctggctgaatttttaaactctttgtagagacagggtaccactatgttgcccgggygcgatcctcccgccttggccttccaaagtgttgagactacagctgtgagccaccacacctggctgaaaactagcatttaaccagtatctagtaactctgt

SEQ ID NO: 31860 - DNA, 201 bp, Homo sapiens
ataataatttgatagagaaaatttttgttttattataaaatacacgtataaaacttatcaaaaccatttaaaacgatacagttcagtcgtgttaagtataygcacaccgttgtgcaacaaatctccgaacagtttcatcttatgaaacggaaactccacgaaaaacaaccaagaacagttttatttgaacccaagggtact

SEQ ID NO: 31861 - DNA, 201 bp, Homo sapiens
ggtgagatttcaagagaaatattttttaatcacagtatatttttaattttagtatcactggaagattagataataaattttttcccatgaactagagacamtaactcttccaattatttcttttaaaatgacttcttctattatatatttaatgcatagtcattacagaaaaatgtaaaggtagtacaaagatggagaaag

SEQ ID NO: 31862 - DNA, 201 bp, Homo sapiens
ctttaactgtaaagctcctatcattttagaagcaaattataatgatttagtattcccatgaatgaaacaaatgccacagtaagcaatttttagcaaatggycttttttttttattcatttcttggaacgcatgtggcttttacaagcagatgaatttgaattttccttcccttcattccatgtatcccagagcaatgactt

SEQ ID NO: 31863 - DNA, 201 bp, Homo sapiens
tacattatataatatagtataaactatatactatagagtatattatacattaataatatactatatcagcatatactattagtatatactaatatatactrtatataatgtataacaaatatataatatataataaatatatataatatataacaacatatatcatatattttatatacactatatatgttttcatttttc

SEQ ID NO: 31864 - DNA, 201 bp, Homo sapiens
ttacctgttacctgtcttttgtattcaaagttgtgctccagaaagtcaggggttatttttgattttgttcacagctatattcccagtgtgtagaacagttsctggcacatggtaggtgttcattaaatatttgctgaatggagacacctgatactctatgaagacaatgtagaacagtaacttagaaaagggattgccaaa

SEQ ID NO: 31865 - DNA, 201 bp, Homo sapiens
tcacccatgtatttttcagttatttttttactattaattttattaatgccaatttacttattacatattaagagactaatttaaaaatttttaccttttgraaagaaagtcaagatagttaatcatttgtgtttttcttatgtggtttatgttctgtgatccttctgttctctctctcccaggtcacggtggttgtggtag

SEQ ID NO: 31866 - DNA, 201 bp, Homo sapiens
ctattaattttattaatgccaatttacttattacatattaagagactaatttaaaaatttttaccttttggaaagaaagtcaagatagttaatcatttgtstttttcttatgtggtttatgttctgtgatccttctgttctctctctcccaggtcacggtggttgtggtagtactgtgtgtgtatgtgtgtttgtgtgtgt

SEQ ID NO: 31867 - DNA, 201 bp, Homo sapiens
gtataattaacaattgtatatattacattatatatgtaaagtatatattatacattatataatatagtataaactatatactatagagtatattatacattaataatatactatatcagcatatactattagtatatactaatatatactatatataatgtataacaaatatataatatataataaatatatataatatat

SEQ ID NO: 31868 - DNA, 201 bp, Homo sapiens
tataattaacaattgtatatattacattatatatgtaaagtatatattatacattatataatatagtataaactatatactatagagtatattatacattaataatatactatatcagcatatactattagtatatactaatatatactatatataatgtataacaaatatataatatataataaatatatataatatata

SEQ ID NO: 31869 - DNA, 201 bp, Homo sapiens
ataattaacaattgtatatattacattatatatgtaaagtatatattatacattatataatatagtataaactatatactatagagtatattatacattaataatatactatatcagcatatactattagtatatactaatatatactatatataatgtataacaaatatataatatataataaatatatataatatataa

SEQ ID NO: 31870 - DNA, 201 bp, Homo sapiens
gagaggggaggaacctgtatttgttaggtaataatatagtttaatctttaaattacaaaatgtagccacaaggttaatagctttcatttttactctagcawagtgtgattctactatctttggatttctggatgattttttttctccttgattcttgattatattttttgttcttcataaattaagatgatatacatcttt

SEQ ID NO: 31871 - DNA, 201 bp, Homo sapiens
actatttgtatctaaataggtttctgttgtatggataattcatgtattataggcatgataacctgtttacagaaaattctaagcatgtggatctcctatcttttatgattttttcgtgtaaaagtttcctttaaaatcagctgttttatattgatttaactcagtttgggcatctctttttcatcctttattcattcattg

SEQ ID NO: 31872 - DNA, 201 bp, Homo sapiens
gttgtacagttttactgtttctactgtttgataaagctgaaatcaaatattccaaaatcattagcaatctttgtggaagtgatgacatattttaaataatkttttaaaactataaagttcaaagctaattctcattaatgagtattttattgttttgtaatgtaagttccagcatagtcagaaaattagtcagaaacattt

SEQ ID NO: 31873 - DNA, 201 bp, Homo sapiens
ctatttgtatctaaataggtttctgttgtatggataattcatgtattataggcatgataacctgtttacagaaaattctaagcatgtggatctcctatcttttatgattttttcgtgtaaaagtttcctttaaaatcagctgttttatattgatttaactcagtttgggcatctctttttcatcctttattcattcattga

SEQ ID NO: 31874 - DNA, 201 bp, Homo sapiens
agcgccgtgcgtcgcgtgtgctgtcaggggaagggggcgtcagggcatccactagcggggtccgggcagagtgacagcgggcagcggggactcgcgggcgrggcgagggggtgccccctgaggatgcgggaggagcgggcatcaccaagtgtgtgcaggtgtgcgtgttggggcgagggaaggcaagggcgcgtgtctgtg

SEQ ID NO: 31875 - DNA, 201 bp, Homo sapiens
taattgcttggtaggcattataaaaggggacaagagcattaaaagagagtttgactttcatgataaaagattaagagtgttggccgggcgcggtggctcaygcctgtaatcccagcactttgggaggccgaggcgggcagatcacgaggtcaggagatcgagaccatcctggctaacatggtgaagccccgtctctactaa

SEQ ID NO: 31876 - DNA, 201 bp, Homo sapiens
gtgggtggtgggtgagtgcaccctagtgggtagttggaggattaaatgagatagtatgcaaatagaggagagtaggtaagttccccctccatcactggatrtttttgctacttcccctactcttttgtttgtttgtttgagatggagttttgcttttgttgtccaggctaggtgcaacggtgcaatctcaacacactgtga

SEQ ID NO: 31877 - DNA, 201 bp, Homo sapiens
agcgtccaccaccacgcctggctaattttttgtattttagtagagatggggtttcaccatgttggtcaggctggtctcgaactcctgacctcaggtgatcygcccgcctcggcctcccagagtgctgggattacaggcgtgagccaccgtgcccggccccctcctctctttttatctctctgctctttagttagctggcct

SEQ ID NO: 31878 - DNA, 201 bp, Homo sapiens
ctgtttgggaggccaaggcaggaggatcacttgagtccaggagttagaggctacggggagctcggggagctatgatcacttcactgcacttcagcctgggygatagagcaagactctgtctcttaatgaaaaaaaaaaaaaatatatatatataaaatgaaatatataaaaatatatatataaatatatatttttttatta

SEQ ID NO: 31879 - DNA, 201 bp, Homo sapiens
ggagttagaggctacggggagctcggggagctatgatcacttcactgcacttcagcctgggcgatagagcaagactctgtctcttaatgaaaaaaaaaaawaatatatatatataaaatgaaatatataaaaatatatatataaatatatatttttttattaactctggcacatagcaaatattatttcacttacattcat

SEQ ID NO: 31880 - DNA, 201 bp, Homo sapiens
ctgattctaaaattcagaatattatcattcaccggaaaagaaattagttttcaaaagtaatatgatggcctaaaatatttgttcacttgggtaattttccrcaacacccgtttagttctttagtttctggagagcttatgttttgtttgtttgttttcataggggagaagatggagaaaaagaagagaaagccaaggaaga

SEQ ID NO: 31881 - DNA, 201 bp, Homo sapiens
gcttcacacacacagatacggagaaccagaagtgccagagtcagcattctggaagaaaatcatagcatatcaacagaaacttctagtaagatgttttagartgaatattgttactgatatagtgcaataccgtaataatttaggctcagtaaatgtttgctgacctctccctgagtggcagttagggaaccaggttagtcc

SEQ ID NO: 31882 - DNA, 201 bp, Homo sapiens
gtgccagagtcagcattctggaagaaaatcatagcatatcaacagaaacttctagtaagatgttttagagtgaatattgttactgatatagtgcaataccrtaataatttaggctcagtaaatgtttgctgacctctccctgagtggcagttagggaaccaggttagtccagcacatgtttgatttgctcattgtagtgtg

SEQ ID NO: 31883 - DNA, 201 bp, Homo sapiens
atggaggtgtgccactcagctgtccttccagggaacttgctatgagagtaattggtgacagtcttcagctatggaggtcatgccaaacctaccgtctactggggctgcccccagctgatgactgggcatggtgaggggagctggagctgagccctccatgcccctcttgggactcttctgatgggcaaccttttatctccc

SEQ ID NO: 31884 - DNA, 201 bp, Homo sapiens
gttttgctaatacagagagcaggaatggaagtgtaatatttctatgcattaacaacttgtcatggctatagaatattacaatatcaactacagtagagatrttgtcccattcttttattgtatgcattgttttaaaaaatatttttattttgaaatacttttgatctgtagacatgttataaagttcttttcagatacatt

SEQ ID NO: 31885 - DNA, 201 bp, Homo sapiens
tttgaaatacttttgatctgtagacatgttataaagttcttttcagatacattcaaagctatgagtttaaaaactgagaatctcagtaagctcaacaaatkaacacatttacatgccagtaatatatctttcttccaaggctagaaaatacttcatgatatttttgttagtataacttttaaatgcatttctttcagataa

SEQ ID NO: 31886 - DNA, 201 bp, Homo sapiens
ctagccaagaggaatgtctggaagagctgagggtagccttttagagaggagataactttcagcagatgatgcatctggagaagcgtgggggaatctgccgrgctgagtctgaagaaccttggccatagccggcaacatctattgtctttgcagagctctgtgctgggactaaattctgcctgattgaccaagaaaaagcaa

SEQ ID NO: 31887 - DNA, 201 bp, Homo sapiens
tgagtgcagtggcatgatcacagctcacagcagcctcaaactctcaggctcaagcaatcctcctgcctcagccttccgaacagctgggactgcaggcatgyaccaccacacctggctaatcttattttttgtagaggtaggatctactgtgtttcccagactggtcttgaactcctggactcaagcagttctcccacctcg

SEQ ID NO: 31888 - DNA, 201 bp, Homo sapiens
aatatatttgttatattcacacagtaaacacgctatttagagtgttgatgacgtgctaagcaatgtccaaagtcatggggacagagcagagatcgagacagagtgcaccatctcatggatatttcattctagtagataaagacaggaaataaaccatttagctaataattagtgatgcatgtcatggagataattaaaata

SEQ ID NO: 31889 - DNA, 201 bp, Homo sapiens
gactgcaggcatgcaccaccacacctggctaatcttattttttgtagaggtaggatctactgtgtttcccagactggtcttgaactcctggactcaagcarttctcccacctcggccccccaaatagttggtactacaggcgtacgtcaccacgcctggctaattttttattttttgtagagatacagtctcactatgttg

SEQ ID NO: 31890 - DNA, 201 bp, Homo sapiens
acctggctaatcttattttttgtagaggtaggatctactgtgtttcccagactggtcttgaactcctggactcaagcagttctcccacctcggccccccaratagttggtactacaggcgtacgtcaccacgcctggctaattttttattttttgtagagatacagtctcactatgttgcccaggctggtcttgaactcct

SEQ ID NO: 31891 - DNA, 201 bp, Homo sapiens
gggacagttggcacccctaccttccaaattcagattagccttgtagtaaaagtatagtggcaagaatgtcacatagactttttttttttttttgaggtggrgtctcactctgtcgctcaggctggagtgcagtggcgtgatctcagctcactgcgacctctgcttcctgggttcaagtgattctcctgtgtcagcctcctg

SEQ ID NO: 31892 - DNA, 201 bp, Homo sapiens
ttatttgtcttcatactataggtctagctgccctggagactctatcatattccttgtgctattttcctcagagctttctgaatgtttgatacatacacaayaatagatgtaacatatacttaagttataaagtctagtaataaagtaaatacgagtgaaacatgcatccaactcgagaactggatcttgggtatcccctat

SEQ ID NO: 31893 - DNA, 201 bp, Homo sapiens
gtggtgcactgatgcaatacatttggaataatgaatttaatgttgagttgagctggcatggaacagttatagatagtctgggggatgtgtatgtgtagcattttttttttgcagggatagttgttgaaggttataaactataatcaataaatcttttttttttaattttcccaataattttgcagacaatctgcaaaaccg

SEQ ID NO: 31894 - DNA, 201 bp, Homo sapiens
caagcaatttggcatcattgtgtaaaattgaacatttgcacgtcttggtacccaacagttccactcatagagatataccctagagacagttcgcaccgacragcaggcaaactatcattcatagcaatgttatttggaatagctaaagaataagggggtagttataggaggtggaagaaatattcttcaataagaaaatga

SEQ ID NO: 31895 - DNA, 201 bp, Homo sapiens
attttctgatgatatgattttcatatcaaagcccagatcaagacagtatggaaaagggaagttatagtccattgctattatgagcatagatgcaaaaatgmtaaggaacatactggcaaacaactcagtagtgtattaacaaagtataatatgaccaagctgagtttatcctagtagtgaaaagataggttaacattagaa

SEQ ID NO: 31896 - DNA, 201 bp, Homo sapiens
attcctttttgaagacaaaccacaaggaaatgtcagaattatgaatctgggaagatgaagcctgaagccttaaagtgtgtagtgctttccaatgaaaatcmactggtttctgaacattcctactattggttttgtagacactgttcctgtagcctatgaggttattctctgggtgagtggccgtggatactgctttttata

SEQ ID NO: 31897 - DNA, 201 bp, Homo sapiens
cacaaggaaatgtcagaattatgaatctgggaagatgaagcctgaagccttaaagtgtgtagtgctttccaatgaaaatcaactggtttctgaacattccwactattggttttgtagacactgttcctgtagcctatgaggttattctctgggtgagtggccgtggatactgctttttataacataacattgcacagtttc

SEQ ID NO: 31898 - DNA, 201 bp, Homo sapiens
gaaatgtcagaattatgaatctgggaagatgaagcctgaagccttaaagtgtgtagtgctttccaatgaaaatcaactggtttctgaacattcctactatyggttttgtagacactgttcctgtagcctatgaggttattctctgggtgagtggccgtggatactgctttttataacataacattgcacagtttctgactt

SEQ ID NO: 31899 - DNA, 201 bp, Homo sapiens
cccaaagcctcaaaagtagtgaagccagcagtgcagccttcagtctgtggccgaaggcccaagagcccctggcaaagcactggtgtaaatccaagagtccmaaagctgaagaacttggagtctgatgtttgagggcaggaagcatccagcacgggagaaagatgggggccaggagactcagcaagtcttgtctttcagcct

SEQ ID NO: 31900 - DNA, 201 bp, Homo sapiens
agtctgtggccgaaggcccaagagcccctggcaaagcactggtgtaaatccaagagtccaaaagctgaagaacttggagtctgatgtttgagggcaggaarcatccagcacgggagaaagatgggggccaggagactcagcaagtcttgtctttcagcctttttctgcctgcttttattctggctgtgctggcagcttatt

SEQ ID NO: 31901 - DNA, 201 bp, Homo sapiens
tctcccatttctttgtcattcatttcttattgcagtctctttttctacctctttttgagtctgagcacttgaacattgggaatagatttgatggtcacttrgcaaaatctcaatttccctcagtgcatgtcttttacaaattatacctgtactttcctttaaacaacattttttttttcagtcagggtctcgctctgttgc

SEQ ID NO: 31902 - DNA, 201 bp, Homo sapiens
ctgtactttcctttaaacaacattttttttttcagtcagggtctcgctctgttgcctaggctggagtgcagtggcactatctcagctcactgcaacctccrcctcctggcttcaattgagtctcctgcctcagcctcttgagtagctgggattacaggcatgcatcactgcacccagctaatttttataattttagtagag

SEQ ID NO: 31903 - DNA, 201 bp, Homo sapiens
tgagaactgtcctttcaaaatattcataacgggctatagaacaaaatctatttattcacttgctgtggtttgaatgtgtttcctctaaaattcaggtgatkcttggctgggtgcagtgtttcatgcccgtaatcccagcacattgggaggccagatctcttgagcccaggagtttgagaccagcctggacaacagtgaaaa

SEQ ID NO: 31904 - DNA, 201 bp, Homo sapiens
tagggtgactataactaacaataatttattatatatttcataatagccagaagagaagatttggaatgtgcccaatgcaaagacatgataaatgtttgagrtaatgtacatcccaactaccctgatttcatcattatacattgtatgctgttatcaagatagcacatgtgcctccacaagtatgtacaactattatgtatc

SEQ ID NO: 31905 - DNA, 201 bp, Homo sapiens
ttattaactacagggacccaccctactgtacattaggtctccagaacttatttgttttataactttaagtttataccctttgaccaacatctttgtatttyccctcgctatgacccctggtaactaccctactactctctctcatctgtacaaccaaatgtgtgtgtgtgtgtatatatatatatatatatatatatatat

SEQ ID NO: 31906 - DNA, 201 bp, Homo sapiens
gcacagaacagcaaagatacttggaaattttatgatagtgttataatctccttggcagatggctaagcattaaattgcagacatctctcttgtttttgactttttttttttgctgcatattttgttttgttgtttacaaagaaagttctttggaaaaagttcagaacatactagaaataatacagaaaatattaggttcac

SEQ ID NO: 31907 - DNA, 201 bp, Homo sapiens
tagaaagtaccaaataagtgctagtttctttctcttcccatagaaagttaattaccataaaatagttatagatggagtgagttgggtgtttagagtgagawgactttcagctgtggggatcagggaaggtttgtggtcttatgagctaaaggattggaagaattaagacttacagaaataaagggaaaggacattgaagag

SEQ ID NO: 31908 - DNA, 201 bp, Homo sapiens
cacagaacagcaaagatacttggaaattttatgatagtgttataatctccttggcagatggctaagcattaaattgcagacatctctcttgtttttgactttttttttttgctgcatattttgttttgttgtttacaaagaaagttctttggaaaaagttcagaacatactagaaataatacagaaaatattaggttcacc

SEQ ID NO: 31909 - DNA, 201 bp, Homo sapiens
tctaatgataattccaaagatttaaataactttctagatttttgtaccttccacactgtataaaacacccctgtcttccctgtcaagaaaattttgggggaaaaaaaaagaaaacattgtgcacagagagttgataatgaatttaaatattactaatggaaatactttatagttatatcaactaggagggtttttttagtt

SEQ ID NO: 31910 - DNA, 201 bp, Homo sapiens
acagtgataaattaattctagtttgtttagggcactaattctagtttgcttagggcaaacataattatatcaatattttctgtgtctagtctcacctttargtcttgattccaatgtcatcttctcaagtggtctccctcaacgtctttaaaattgtgctctatttaaaaacgtgcttcctcctatccccctttcctactt

SEQ ID NO: 31911 - DNA, 201 bp, Homo sapiens
ctgacaatagagaaatgtttatggtttattttaggggccttgatgctctcagcaagaaagcgaaggcttccacagtcgatttgcctatagagtccgtaagyctaagtctgcaggatctcattggctacttccaccccccagatgagcatttagagcatgaagacaaacagaacagactacgagccctgaagaatcggcaaa

SEQ ID NO: 31912 - DNA, 201 bp, Homo sapiens
gttgggaaaattttccatctattttgaccatctttgcgttttgcaatatagaggagaaagtatactactgaacaggagaaacaggccttagagaaatctcracatgatttttatttatttatactatccatgagtattaatttaaaaacatgaatcttttcattctcctggcaagagacatttactgtctgctcagccctc

SEQ ID NO: 31913 - DNA, 201 bp, Homo sapiens
cttctgtaaggtaagatgggacagctatttaggatccccgggatctttgctttctgatttcaggatatttctgaatatcctaatattgtcttagttttgtrttcatttaattttaaaaaggtatacttgttagaaaaagaacaaaggttattttaagcagcgatgatacgtgtgcatgtgcctagccttctgcttaaacac

SEQ ID NO: 31914 - DNA, 201 bp, Homo sapiens
atagttatatcaactaggagggtttttttagtttgttaactcaggagttttaataaaaaattgtctctaagaatgctgtttccactgcatttacataaggratatataatttattagacatctttttcatgtaaatattcacatgagtatttcaaattgtgaaattacaagtgggtctctttccatgcatactagaagaca

SEQ ID NO: 31915 - DNA, 201 bp, Homo sapiens
tttcacattttaatggattcatattttagtaagcctagggactgaactttacaggttgtggaaagtcctccaaatattttttactacattctagtaattaygttactaaggttttgttaggttacacattttaaccaattaatatggagctctcacaatgtcatttcacgccagtagtatttacacttcagtttgttctag

SEQ ID NO: 31916 - DNA, 201 bp, Homo sapiens
ctcatgcctgtaatcccagcactttgagaggctgaggcaggcggagcacctgatgtcaggagtttgagaggagcctggccaacatggtgaaaccctgtctytactaaaaatacaaaaaaattagccgggcatggtgggcacctgtaatcccagctacttagaaggctgaggcaggagaatggcttgaacccaggaggtgga

SEQ ID NO: 31917 - DNA, 201 bp, Homo sapiens
tcttctatccctcaccctcttcccaccctttccccacaagtccccaaagtccattgtgtcattcttatccctttgcatcctcatagcttagctcccacttrtgggtgagaacatacgatgtttgcttttttattcctgagttacttcacttagaataatagtctccagttccatccaggttgctgcaaatgccattaattc

SEQ ID NO: 31918 - DNA, 201 bp, Homo sapiens
agtggccattgcctacttggtttttgtttccccttagacctaatctgagatttgccaatctcatgttctaatatcccgactgctttttcaaataggagttagcagagtatggtgactccattttaatttgtgctgaatatttaggagtaaactcataataggcctattctggactctgctgttagaaatactccaacaatg

SEQ ID NO: 31919 - DNA, 201 bp, Homo sapiens
attcctgagttacttcacttagaataatagtctccagttccatccaggttgctgcaaatgccattaattcattccttttaatggctgagatgtattccatmatatatatatctcacagtttctttatccattctttgattgatgggcttttgggctggttccacatttttgcaattttgaattgtgctgctattaacatgc

SEQ ID NO: 31920 - DNA, 201 bp, Homo sapiens
tgcatgtcagtcaagagtaatggctattagttttgctattcccagcttggtagtcttattgttattttgaaatggagtcttgctctgtcacccaggctggrgtgcagtggtgcgatctcagctcactgcaatctcttcctcctgggttcaagggattctcctgcctcagcctcctgagtagctgggattacaggcatgcgc

SEQ ID NO: 31921 - DNA, 201 bp, Homo sapiens
ttaccagttaggaggtcatcagtgaccttttgatagtagcttaggaaagacacgggcatggaaccactgagcacctaatgaaggaaagagtattgaaatgktaatatgacgtattcaggttaggagaaagagaattctcaggtagtaaagataaagcatacacatagaaatgagttttgggggactctttggagataacct

SEQ ID NO: 31922 - DNA, 201 bp, Homo sapiens
ctcctgcctcagcctcctgagtagctgggattacaggcatgcgccaccacacccagctgcgatgacaggggcacaccaccatgcctggctaatttttgtatttttttttttatagagatggggttttgccatgttgcccaggctggtcttgaacttgttgtcttgagctacccatccaccttggcctcccaaagtgctggg

SEQ ID NO: 31923 - DNA, 201 bp, Homo sapiens
ctctcctttgctcgtagcactcattgtgagaaagtagatcagtcaatagtactgagcttttcttggtttgaactctttttatttgcagtgttatcattaattttttttcttaggaagtaccaggaaaagataagaaatttatgaaaaatgcagatggggataaaatctatgtccaaagagttagaatagaggccaagaaat

SEQ ID NO: 31924 - DNA, 201 bp, Homo sapiens
ttttatagagtagcttgaggaggcggtgtctgattttcacagagcctaaaagattggttggaccaggtgtgccatttgcatagcacatgaagaagctggcygcctcaccctaatcttttattatgtagatgggttttctacctggcctgcatctccttgcctccttctttactgcacacgtggcaacaaagaaaagggagg

SEQ ID NO: 31925 - DNA, 201 bp, Homo sapiens
aaatatcaactcccattattgctctgtcctaccctactttattttctttataccaattccccaacagatgtgtgtgtgtgtgtgtgtgtgtgtgtgtgtgrtgcatatagatacattgtctctccctattttatttctacaaagacaggagttttgtctgtttcgatctttcctttccatagtgcccaaaatagtgcctga

SEQ ID NO: 31926 - DNA, 201 bp, Homo sapiens
ctcagcagagcaggtatagatgttgagagtgaaggtagtgaaattggacagtaattggggttaagagagcaagtaggggaaaagctaataagggcaagaargtatggaaagttatatagggaagggaagaatgaaggaatctaatgagtttgaagagtgagtgtataagaaaatgagaaaacagggagaaaaaatggtgat

SEQ ID NO: 31927 - DNA, 201 bp, Homo sapiens
agctaataagggcaagaaagtatggaaagttatatagggaagggaagaatgaaggaatctaatgagtttgaagagtgagtgtataagaaaatgagaaaacrgggagaaaaaatggtgatcacacaatctctgtattttaagaatttagagatagagccactgacagttgtttgacaaggtttgattttaccgaagttatgt

SEQ ID NO: 31928 - DNA, 201 bp, Homo sapiens
ctaataagggcaagaaagtatggaaagttatatagggaagggaagaatgaaggaatctaatgagtttgaagagtgagtgtataagaaaatgagaaaacagrgagaaaaaatggtgatcacacaatctctgtattttaagaatttagagatagagccactgacagttgtttgacaaggtttgattttaccgaagttatgtga

SEQ ID NO: 31929 - DNA, 201 bp, Homo sapiens
tgacaaggtttgattttaccgaagttatgtgaacagtgagcaatgagaatagagtggcatattctacagtagaagctgagattatgtttagtgtttactaygtgccaggatataacagcatgcttcatagtagggatgcaagtgatctgtatggaaaagacataagaagaaagattaattttccaatgggaggaatcagta

SEQ ID NO: 31930 - DNA, 201 bp, Homo sapiens
ttttccaatgggaggaatcagtaaagggagaaatatcttcagagttagatgttgaaaggatcaggaatcagtaaagggagaaaatgtcttcagaattagaygttgaaaggatcaaaatttcaacaagtagagattagtgtcagaaaggccatcgctactagaaagaaagtacatctgatgtgattaagtgtagaaagagtt

SEQ ID NO: 31931 - DNA, 201 bp, Homo sapiens
atgactatagtatatactaattctatatttagaaaattaggagttacatctattaatgcatactagaatgtaatgtaatattttatttgcaaatatcaacrtaattaaaaataaggataactacctgatcattttttcttccctgaaaataatctccaaatttttgtgtaatttatagctcatatttatctcttagattca

SEQ ID NO: 31932 - DNA, 201 bp, Homo sapiens
ggtgaacaaaaaattgctggtttttagaaatcaacagggcagagaatgatagactgaacacaggagactgaacacatggtaaatgtggagcatgagaagtrgaattttcaccagactgtgctgataaagagcttgtgagttcagcacagaacagcagtcagtatcatcttttctaagtcatggacccatctaaatatctgg

SEQ ID NO: 31933 - DNA, 201 bp, Homo sapiens
tttgaaggtagtttggggtgtaaatatttatttgtgtcattctacctcaggtggaacatcctcagagatctaaaaaggctgtatggcataaactactgtcyaagcagaggaaaagggctgttgtagcctgcttccggatggcccccttatataatctgccaaggtcggaattactttattttttgtaatagatcaatgtta

SEQ ID NO: 31934 - DNA, 201 bp, Homo sapiens
tgttaactatgacccaagaaacatatatgttcagcatattcattctaaagaataagagtccggtgtgcttagtatttcataaagacaatttctaagcttayaaatcttgtagcaatatatagattatatattttgggagatcctggcctttgttttgttgtcttttttcaaatatttctgaaagtattaggattatatttt

SEQ ID NO: 31935 - DNA, 201 bp, Homo sapiens
agtagttggtacagaggtaggtgagcaagtgcaataacatttataaagtacttgctctgggcaagcactgtactggatgccttacatgtgaccttgtatgmcatctttgtcaccctttctctacatgtgtgccacttacagaaatagtctaagctcacacgtcctttgatcagttattttctttgttaatgcactcactac

SEQ ID NO: 31936 - DNA, 201 bp, Homo sapiens
tggctggttgtggactgcaaagttgccagatgctggtgtctaagggctatccagacattgggtggaacccagttgaaggagagagatatcttgactttctyagatttgctgtcttctgtaatggtaggacttgatttcttgaggtcttttgagttatcattaaaactgcatagagatataataaggattcatctcagcact

SEQ ID NO: 31937 - DNA, 201 bp, Homo sapiens
ttaaaatagtaatttagtttttttcccaacttctcatataagacaatctggatggggacttggaaatgttcttaggtccatggtatctcttaaattctgtgtgaaataagttaattggtttagatagtggtttatatagctctttatgtggttagatagctctttatgtggtttgccacgctttttacaaccttgatctac

SEQ ID NO: 31938 - DNA, 201 bp, Homo sapiens
tcactgtgttagccaggatggtctccatctcctgacctcgtgatccgcccgccttggcctcccctcccgaagtgctgggattacaggcgtgagccaccgcrcccagcccagattgtagattcttaatgagaatttcttaaatcctcttaggatgactgtttttaaagaagactttttgaaaaaaacacacaaaccttaggg

SEQ ID NO: 31939 - DNA, 201 bp, Homo sapiens
cgtgttctactagatgtcatataaattcctctttgtctttgaaattatgactaaatatttttattttatatttaaatataataagtcaagtgttgtattgcccccctctataaaagccaaaaaaaaaaaaaaaaaaaaaaaacagtgggtcagacataccatgtagaggatgctcacattgtttgctaaattgggataagg

SEQ ID NO: 31940 - DNA, 201 bp, Homo sapiens
cagtgtttcatgcccgtaatcccagcacattgggaggccagatctcttgagcccaggagtttgagaccagcctggacaacagtgaaaacctgtctctaccaaaaaaaaaaaaaaattaaaaaataattcaggggttgccaatgcgatagtattaagaggtagggcctttaagaggtaattaggtgatgagagctcctgcct

SEQ ID NO: 31941 - DNA, 201 bp, Homo sapiens
aaggggtggattattcatgagttttccaggaagggagtgaggaatttccagaactgagggttccttccctttttagactatataggataacttccagacaytgtcatggcctttgtaaactgtcacggtgctggtgggagtgcctttagcatgctgatgcattgtaactacgtataatgagcagtgaggatgaacagaggt

SEQ ID NO: 31942 - DNA, 201 bp, Homo sapiens
aatccaggctcccagaacttctaaccaactggctttgagttggggttcccatgaccccctgtttggatttaatttgctggatcagctcacggaactcaggaaaacacttatttacatttacgggcttattataaagactcctgcgaagggtacagatgaagagctgtgtagggtgaggtatgtgggaaggggtgcagagct

SEQ ID NO: 31943 - DNA, 201 bp, Homo sapiens
aagcctgtaatcccagcactttgggaggccgaggtggatggatcacaaggtcaggagttcgagaccagcctgaccaacatagtgaaaccccatgtctactraaaaatacaaaaaattagctgggcatggtggcatgcacctgtaatcccagctatttgagaggctgaggcaggagaattgctcgaacccaggaggcagagg

SEQ ID NO: 31944 - DNA, 201 bp, Homo sapiens
gcctattaaacctcctctcctaaactcctcctgtatgtctgtgtcctgaattttcttggcgcgagacaatgagccccgggtatttaccccagacaacgtacccgcttgaattttactagtccagtggaggctcccattgtcaaagccctttatagcaaagctcttaaagtgtgtttatttcataaagtccaaggattcatt

SEQ ID NO: 31945 - DNA, 201 bp, Homo sapiens
gtttttatgctttatcagcacttgttaaagataatttggcttgaggccaagagttccagaccagcctgagcaatatagtgagacgctgtctctaaaaaataaaaaaaaaatactaaaattagctgggtgtggtggtgcatgcctgtagtctcagctgcttgggagactgaggcaggaggatcccttgagcccaggagtttg

SEQ ID NO: 31946 - DNA, 201 bp, Homo sapiens
ctctgcctcccaggttgcagtgattctcctgtctcagcctcccaagtagctggcattacaggttcccaccactacacccaactaatttttgtatttttagyagaaatggggtttccccatgttgacctggctggtctcgaactcctgaccttgtgatctgcccgccttggcctcccaaagtgctgggattacaggcgtgag

SEQ ID NO: 31947 - DNA, 201 bp, Homo sapiens
agaaataatacagaaaatattaggttcacccttaatcctatcatctagacataattacccccatgcttattttctcaatcctatatttattaatcttttctcatttaaaactacgttgtggacatgtgttctggatattagcaaatccagttgcccaccaacatttttaacggcttcatggtgttctgtaatattcatccc

SEQ ID NO: 31948 - DNA, 201 bp, Homo sapiens
tggggtttccccatgttgacctggctggtctcgaactcctgaccttgtgatctgcccgccttggcctcccaaagtgctgggattacaggcgtgagccaccrcacctggctgatctgttttctttccttttctttttatttttttgagacagagtcttgctctttcgctcgagctggagtgcggtggcacaatcttggctca

SEQ ID NO: 31949 - DNA, 201 bp, Homo sapiens
tttaaggaaacaatttatcggtaatctgttttttgaggaaatactaactctgagtaaaaatttgactttcctgtttgtttagtattgcagcactgagaackagtttctttctttctttctttttttaaacacagagtcttgctctgttgcccaggctagagtgtagtggcatggtatcggctcactgcatcctctgcttcc

SEQ ID NO: 31950 - DNA, 201 bp, Homo sapiens
taaggaaacaatttatcggtaatctgttttttgaggaaatactaactctgagtaaaaatttgactttcctgtttgtttagtattgcagcactgagaacgastttctttctttctttctttttttaaacacagagtcttgctctgttgcccaggctagagtgtagtggcatggtatcggctcactgcatcctctgcttcccg

SEQ ID NO: 31951 - DNA, 201 bp, Homo sapiens
tgggtgatttctgcatttccaactgaggtacccagttcatctcactgggactggttggacagtgggtgcagcccacagagggtgagcagaagcagggtggsgtgtcatctcacccaggaagcacaaggggttgggggatttccctcccctagccaagggaaactgtgagagactgtaccaggaggaattgtgcactccagc

SEQ ID NO: 31952 - DNA, 201 bp, Homo sapiens
tttgactttcctgtttgtttagtattgcagcactgagaacgagtttctttctttctttctttttttaaacacagagtcttgctctgttgcccaggctagartgtagtggcatggtatcggctcactgcatcctctgcttcccgggctcaagcagttctcctgctcagcctcccaagtagctgggattacaggcatatgcca

SEQ ID NO: 31953 - DNA, 201 bp, Homo sapiens
gaggctcgtctcctctgctgttcctcttggtagcttcacagtaccagtgttttccacagcacaaacgtggaaaaatatttcacaggaaagcttttgtcctygtagtctcaaaacccttccctacaacccatgaatgcagtgaaattcaccaagtaagacattgcttttccatggttatcaaaaagataaatcatctttgtc

SEQ ID NO: 31954 - DNA, 201 bp, Homo sapiens
tgttaaagatacatatgtagaggaaaaatgcatatacattgacgcagcgattccgtatcaggagtttatctttaagctataattagtggtatgtttgtatraacatttaatagctacaatgcttaatgtagtgttgtttataatcacaaacggttttcattttcaacattattggtaatttctattaagttggatggaagc

SEQ ID NO: 31955 - DNA, 201 bp, Homo sapiens
ttatgaaatggtttttctgtttatcacaaacaaactttataaataaaacaaaagaaccaaagcaaattccagtgccgcaagtgtatggagaccgatggtgrccccaaattttctgggtagatagtgtctccattgtgcagtgggtcttaggaaacctctagaggctaagtgagccatcacctcaacttggaggtatctctg

SEQ ID NO: 31956 - DNA, 201 bp, Homo sapiens
caccacgtctcagttgtttgccttttcttccctcaactgtgatgtcttcatctttggatattagtcccctctcccaaacaccacctgtcacctatcacagkgccttgtaacagtcacattgagcacagataattacatgttgtactgaatgcacctatgtagaaaaaggaagacactggtcattgtacaccaattaatcat

SEQ ID NO: 31957 - DNA, 201 bp, Homo sapiens
agctcacctcagtaagggctgttttgctgagtagtatctctgggaatgatggtgaggctatcctttcgtttgcaataacttttagactcggtgaatataawagcatgatcattcttgcctatagaacagagaggtaagcaaagcagctgtcaaatagtagttttctctaaattagggaataaatatagttctttaaaaaat

SEQ ID NO: 31958 - DNA, 201 bp, Homo sapiens
tacaactttaagtgaaaacataattatacgtagtcactagtgcaaatgactcaactgaggagacagttggataagcatacctttttgaatgtccgtgaccraactttataaggataaatgatgtcaggccttctgggaagaaaataatagaacaaaacaaataaaagtagtaggacaccttatattaattgccataccttc

SEQ ID NO: 31959 - DNA, 201 bp, Homo sapiens
aagacattttaaatgacaaatatggatacaactttaagtgaaaacataattatacgtagtcactagtgcaaatgactcaactgaggagacagttggataarcatacctttttgaatgtccgtgaccgaactttataaggataaatgatgtcaggccttctgggaagaaaataatagaacaaaacaaataaaagtagtagga

SEQ ID NO: 31960 - DNA, 201 bp, Homo sapiens
agttgttattataggtgctggggattcaatggtgaacaaagtagataaatgtttttctcccttgaagtttattttggaagatggagggattctggcgataraataagcaaacaaggtatttgcaggcagcattttgttgtaaagaaaaaaaagaaaaacacatggtaataggaagagagcaacatggaatttgggagtaaa

SEQ ID NO: 31961 - DNA, 201 bp, Homo sapiens
tcaaatgtcaaatttcacttctgtcaaaagcccccacctcatttaagtttgcttgtttcaagttttgtagtctgaagaaaattaaaattattacatttgtrtgtaaaccaaaagacagtttattttgtgaaaattgaaggcccttctgtaaggtaagatgggacagctatttaggatccccgggatctttgctttctgatt

SEQ ID NO: 31962 - DNA, 201 bp, Homo sapiens
tacagcacttttttttgacttacaacagaaaacctttattcatacagttacttctaaatttatttttcagtgtcacaatcacaaatttgagtcaagttttytttaaaatcagagttcagtgtttctttcttttctttttctttttctttttctttttttttttttttttttttttttttttttgagacagtctcgctccat

SEQ ID NO: 31963 - DNA, 201 bp, Homo sapiens
gtgaaaactgaaaatgaaaagaaggcaatttacttttctctcgctcatgtttcttttctttcagttccaattgtgtgtaaaagcggaaacctgtgggcaartgttcctagttggtttcacaggtagaatgaagactgagaaaccatgattgcacatgcttctaaatgatactttgctaaagagcttagtttacaacttaat

SEQ ID NO: 31964 - DNA, 201 bp, Homo sapiens
ttaatagctttccctgaaataaaaaaaaataaacttacgaaaacttttacagcacttttttttgacttacaacagaaaacctttattcatacagttacttytaaatttatttttcagtgtcacaatcacaaatttgagtcaagttttctttaaaatcagagttcagtgtttctttcttttctttttctttttctttttctt

SEQ ID NO: 31965 - DNA, 201 bp, Homo sapiens
agcagttcaatgatctcatccataacccagatcttaatatttttctgctctgtgatcctcagcctgtggttttcttcctaaaatgctcaccttattctttstgcagtaatcatgtcatcacccagttacactcattttgaaagaagggaactctagtctcttatcactgatggaataactttcccagaagacccttagcaa

SEQ ID NO: 31966 - DNA, 201 bp, Homo sapiens
catttaactgtttcaaaaagtgtttttcaatggaactcagattaaaatagttttgcttaaatgagcagaatgtataaaagattttagtaagttctttttcrttgttgagattgataaacaattagcgataaggttacctgctttcttcaagttgaagtgacatcagaatctcctttaaagcagcagtccccaacctttttg

SEQ ID NO: 31967 - DNA, 201 bp, Homo sapiens
tcctggtcctctcagaactcatggaattcctttcctcgggagaaaaccagattatttttgtaattaaaatagctgtatagctgtagacagaaaagaaaatraaaaagagaggcagggaaaactttccattattgattttatcatgctgctgttttagaaaaaaaaaagaagccaggatatagaactactagtttgttccta

SEQ ID NO: 31968 - DNA, 201 bp, Homo sapiens
acagaaaagaaaataaaaaagagaggcagggaaaactttccattattgattttatcatgctgctgttttagaaaaaaaaaagaagccaggatatagaactrctagtttgttcctacagtatgctttgtaccctcagttgaaatattgcagcagttagattatttgatggaaatgggtggcttattcagaagtctggttttc

SEQ ID NO: 31969 - DNA, 201 bp, Homo sapiens
ttgatattagactagaagcttattttacaaaagcttagtattttagtttttcaggttcattttttgtttacaacaaagtttgaaattattaaaatatatawagtttcttttaaaaatttctattctttcatgtaaaccttctcagttatgcttaagttatgaaagagtaaaacaattctcaatttagtttcatttctacct

SEQ ID NO: 31970 - DNA, 201 bp, Homo sapiens
cccaaagtgctgggattacaggcgtgagccaccgcacctggctgatctgttttctttccttttctttttatttttttgagacagagtcttgctctttcgcycgagctggagtgcggtggcacaatcttggctcactgtaacttccacctcctgggttccagcgattctcctgcctcagcctcccaagtagctgggattaca

SEQ ID NO: 31971 - DNA, 201 bp, Homo sapiens
tcccagctactcaggaggctgaggcaggagaattgcttaaaccacggaggcagaggttgcagtgagccgagatcacaccactgcactccagccttgacaayagagcaagactccacccccccgcaaccccgcccccccccccccccccaaaaatgatgatgtatcatttgaaaaaaaaatccattggtttcaaaggagaaa

SEQ ID NO: 31972 - DNA, 201 bp, Homo sapiens
caataattttactctgttcaatatcacagactttagaaataacaaagtcattgacactctgcaatttctctctattccctcataattgtgagagaaatttrtaagttctggcacagtggtatttcacattgttaatagaattctgccaagattaatcatttcttcagagaaaagaatacaatattagaaaagtagagaaaa

SEQ ID NO: 31973 - DNA, 201 bp, Homo sapiens
aaaatatcaactcccattattgctctgtcctaccctactttattttctttataccaattccccaacagatgtgtgtgtgtgtgtgtgtgtgtgtgtgtgtgatgcatatagatacattgtctctccctattttatttctacaaagacaggagttttgtctgtttcgatctttcctttccatagtgcccaaaatagtgcctg

SEQ ID NO: 31974 - DNA, 201 bp, Homo sapiens
ataaagtatacatagcattagatcaacatagtattagagcgatacagataattctttcagttgaacatagcattataggagaatttcctggctttgaaaamtgaatagaatatgtagttattcaaaatgtgtcctcggtttgactgaaactcctcaccaaattagggaaccaataattttactctgttcaatatcacagac

SEQ ID NO: 31975 - DNA, 201 bp, Homo sapiens
aagaaaggcttccctgacctccttgataatactccgtcctgctactattataatagtctctggtgccgtgtacttttcctccatgtcactgatggtatgcytaccagattaatatctctcttctctcgcataaactctcagctctgtgaggtcttcctgttgcactctcagtgcctggcaggaagtctggcacacagtaaa

SEQ ID NO: 31976 - DNA, 201 bp, Homo sapiens
catcccaaaagcaatttatcatcataagtccagacgtggagccagtcaagaggtagcggctgacccacgtgatccatctttctgctttccttatacttgatttttttttttttttttttttagctggcgtctcactctgtcacccaggctggagtgcagtggtgcaatctcggctcaccacacctctgcttcctgggttca

SEQ ID NO: 31977 - DNA, 201 bp, Homo sapiens
cagtttcccccatactgttatggtggtagtgaataaatctcatgaaatctgatgattttataaggggaaacccatgtcgcttgtctcacattttctcttgyctgccgccgtgtaagatgtgcctttcgccttctgccatgattgggaggcctccctagccacatggaactgtgagtccattaaacctctttttctttataa

SEQ ID NO: 31978 - DNA, 201 bp, Homo sapiens
attacaggcatgagccactgcacccggcctatactttatgttaatccgtccattcactcatcataggacggctgcaggactttcacatatcccattccgaygtgtcaatgtctggaggacattatggctccatttcttcttgtggctctttcttagaggagaggagcatttttccagaaccctcttgcccccggagacgtc

SEQ ID NO: 31979 - DNA, 201 bp, Homo sapiens
tgaggcaggagaatcccttgaacccaggaggtcgaggttgcagtgagccgagatcgtgccattgcactccagcctgggtgacaaaagtaagactccatctaaaaaaaaaaaaaaaaagaaagaaaaagaaaaaaagaaaagggctttgcacatctgaggagcaaaatagcggtatgtgtggttggattgtagcaagcagag

SEQ ID NO: 31980 - DNA, 201 bp, Homo sapiens
cctaggaggcagaggttgcagtgagtgagtcacaccactgcactccagcctgggcaacagagtgagactccagcctgggcaacagagctctagaccatttaaaaaaaaaaaaaaaaaagagagactaccgtcaccttgtataaaaccacacacacagcataaatagttaagcctactaatgaaatatcctgtcatttcctc

SEQ ID NO: 31981 - DNA, 201 bp, Homo sapiens
gtcaatgtctggaggacattatggctccatttcttcttgtggctctttcttagaggagaggagcatttttccagaaccctcttgcccccggagacgtctayttaagtcttattaaccagagtttggtcaaatgcctgttcctgaaataattactaacaaagtaaaaataacctctacaaatcagggtgtgatagcttccct

SEQ ID NO: 31982 - DNA, 201 bp, Homo sapiens
ggacctttcagcctggccctagggaaggctgtgttggcattttccatttttgtaaatgacatcatagtctttcaactgaatggctagtgactatgtcctatttttttttaagacagaaatatgtgaaatttaaggaacagctttctctacagctgatgatgtgggaggtttgtgaataaccgttggcaggtcctatgaaga

SEQ ID NO: 31983 - DNA, 201 bp, Homo sapiens
ttccgataggcaattttcagaattatcaatcataaatcattttcagacacccaaatataattttaatgtgcgagatgtgtttacaacatcattttgtataraaacttgccagttttatctaaggaaacactatgtttggaaatttgtgccatatttttaaagtataagttaagtctctcttcacaaggtttttaatgaggc

SEQ ID NO: 31984 - DNA, 201 bp, Homo sapiens
tgaggcaggagaatggcgtgaacctgggaggcggagcttgcagtgagccaatatcgcaccactgaactccagcctgggccacagattgagactccatctcaaaaaaaaaaaaaggaagcttggggccagtggacttgttggtgcatattaaatgggttagagagacacgttcttaatgttatggctcttcaaacatactcc

SEQ ID NO: 31985 - DNA, 201 bp, Homo sapiens
tgattgaccaagaaaaagcaaaagagggtcagcatgtcctttgtaagccggaagcgcagagcaaggtttcagattggcagtggctttctgatcaaatttcrggtcttgacacagcaagtgataaagctttgacccctgggtatattgttgatgggagacccgacttactgagccatgtccgtgtcgtcctgttggtaaggg

SEQ ID NO: 31986 - DNA, 201 bp, Homo sapiens
attagtaactggagattatattccatgatttcaatattgatttcattgttgcattaaagggaagaactagatgactatttctctcttaatattttgaatastgggaacatttgctaaaagaaaacattttgatatagaattacaaaattacttacattaatatgaaccttgttaagcttatgttttattttcataaggcta

SEQ ID NO: 31987 - DNA, 201 bp, Homo sapiens
tcattttcaagtctaccaagatttacttcctgctggttcctaggtgtctttcttgtgcatgtgcaacttcagtcaaaaatatactgagttagagctggtasaggatcaccaggtgtgtgctagcagatctgttggacctccctgggatgtgtcactttcatagatggtgcagtgtgcatggcatctgctccaaatcaagtg

SEQ ID NO: 31988 - DNA, 201 bp, Homo sapiens
tagagtgaagggggttcgtgtgggtcacagaaggactggtaggcattttctaaatttagatcatttccatgactattggaaagaaccctacctccccaccyccacaaaaggctgatgattgtgcttcaaagtaaatggaagtggaccgaggagtatttatttatttcctgagctgaaatcagtgttgtccatctcatttaa

SEQ ID NO: 31989 - DNA, 201 bp, Homo sapiens
tacccttgggcctgattttcagctggaaaacctagagtgagggtgcaggcaagaactcccatctggatgttgttcattctggaaggagtccaatctaggcwttttttactctcccccctgaaggttcttctctctctctctctctctctttccctttcccctcctgattaaccccaggcttcctctgggttgttgctgtgg

SEQ ID NO: 31990 - DNA, 201 bp, Homo sapiens
tagttttcaaatccatttttcccttcccttgaatactctacatcacatttcattttttccctagtttaggttcttcttagctgtattttattttttaaagmtgttcattttacttgcttctttcctgggactattattataagagacagaggtctgatcatcttgttcctattttttatggacctggtatagtctgtgtgg

SEQ ID NO: 31991 - DNA, 201 bp, Homo sapiens
ttgttcctacagtatgctttgtaccctcagttgaaatattgcagcagttagattatttgatggaaatgggtggcttattcagaagtctggttttcaacatrgtgtgaattaaggttagtaggtctgtaccatccccaaacccacctgcctggctttaccataacagctgaagttcctgtcaccagcatcctctgtgcaacc

SEQ ID NO: 31992 - DNA, 201 bp, Homo sapiens
atcaatctccagttcctcctttaccctcagtgtccagttagttttcaaatccatttttcccttcccttgaatactctacatcacatttcattttttccctrgtttaggttcttcttagctgtattttattttttaaagatgttcattttacttgcttctttcctgggactattattataagagacagaggtctgatcatct

SEQ ID NO: 31993 - DNA, 201 bp, Homo sapiens
tctgccctgcagaaaagtgcaaaaaaatgctttggtaacacctgtatattcttcaatcgtcaattatttttatttgccatattaattttatctctctctayagtttattttgttgagccctaaagataacttttaatggctgcacgtatttactcctgtgtatgtatcatagttaattattctcaggaatagattatttct

SEQ ID NO: 31994 - DNA, 201 bp, Homo sapiens
gactctctttccctcagttggtctgaatgacatttggttacacatcaccataatttgttgtctaagtaacacaagatattttgttagtagaagtttcacarttagggtttccttgatttgagcatatcgtgacaaaatatcaatttagtaggtatctatcctatataaacttcccgatgaagttactagatggtgagtgtt

SEQ ID NO: 31995 - DNA, 201 bp, Homo sapiens
tgtaggactacacccagccttttgcctctcaatctccaggcatagtaagacaccagtctacagtgtcccagctcccagggatatcaggtatccctgaagcyacccttgctaggcttgaagtgagggcaagcttgggaggcaggcaggattccaggcccacctgcacttctctccaagaaaccatttctttgctgcctggcc

SEQ ID NO: 31996 - DNA, 201 bp, Homo sapiens
atgttgttcattctggaaggagtccaatctaggctttttttactctcccccctgaaggttcttctctctctctctctctctctttccctttcccctcctgrttaaccccaggcttcctctgggttgttgctgtgggagagaggaggtatggggaaggaaaggtctcttccggggcacatgtaatcccagagtgcaccacgg

SEQ ID NO: 31997 - DNA, 201 bp, Homo sapiens
ttgaaacctaagaatgctttcatgtttgacttccacatggatcatttcagtgtaggcccaggggagacactagtctgccactaagaaaatacggttggtamgcaatgaatggagacatgttttcagtgtacgttaacatttgcttcatcttccaagatatatggtgtttagatgtttgctctcctgagcaaagaaaatgtt

SEQ ID NO: 31998 - DNA, 201 bp, Homo sapiens
aaagcccttcagaagttgaaaatatcgtaagccaaaaatgcatgtaatacacctaacctacagaacattatagcttagcttagcctcccttaaacgggctsagaacacttacattagcttacagtggggcaacatcatctaacacaaagcctattttatactaaagtgttgaatatctcatgtaatttattgaatactata

SEQ ID NO: 31999 - DNA, 201 bp, Homo sapiens
gctaacttgagttttgtttttgtttttcatatttgttagcattctgtgaaacttcagggctcctgaaatattcagtgctttgacccttagagtctgttccmttccttatgatatttatgtagatcctgaaaattatggctctcaggcctaaacccagtttattgtgactttacatatatgtaagttaatttgggctattaa

SEQ ID NO: 32000 - DNA, 201 bp, Homo sapiens
tcatgtttgaaatggtttttaaaaatatatggagtcttctgtattctgacatgggcaattttttatgtgtaggtgatgatctgaatagagggcaggctttrtatgtcttcaagacatcagtatccatttgccctctgtagaaatcaatgtgttgcttttgatttagagaaattctctatcgagacaagctgggaaatgaag

SEQ ID NO: 32001 - DNA, 201 bp, Homo sapiens
aaaggaacaaggaatgctagtctagatttttatagtatgagatagtcacattattgtacattattgtaaaaagtagaatttttacaataattctgtaattscttttgtaatatgttcagtatgattttacttctacatatattcattggcttatctactttttgaaatttgtcatttatttatcaagctaacttgagtttt

SEQ ID NO: 32002 - DNA, 201 bp, Homo sapiens
atggtttttaaaaatatatggagtcttctgtattctgacatgggcaattttttatgtgtaggtgatgatctgaatagagggcaggctttgtatgtcttcargacatcagtatccatttgccctctgtagaaatcaatgtgttgcttttgatttagagaaattctctatcgagacaagctgggaaatgaagaaagccctaga

SEQ ID NO: 32003 - DNA, 201 bp, Homo sapiens
ttgcaatcttctaagctactgcattcccttattctattaacatggctatcttgggactataccgtacttccttttgcaacccagttgacatgcaggtataygtaaatttggtatttgcctgctttcttagttctgaaaatgggagaggaccaaacactactctcgtcattcaaatactgagtaaagctctgctccagtgat

SEQ ID NO: 32004 - DNA, 201 bp, Homo sapiens
caagacatcagtatccatttgccctctgtagaaatcaatgtgttgcttttgatttagagaaattctctatcgagacaagctgggaaatgaagaaagccctrgatacctcttctatttcatgttttaggcatttatgcagctctttgctttataaacctgtcacagagataaagtgtgagaacttatagtagcttatcggaa

SEQ ID NO: 32005 - DNA, 201 bp, Homo sapiens
cacacttaaactcatttaaaaagtattcaggcctcaacttattaaattagaatttcagtgagagcccagcatgtgtgctacttaaaagctacacaggtgamtctgatgaacccagaaggctgagtctgtgctttggcatgccactctcacatacaagaatgtatgatgatttctagcagttccggctgcgttggcagttgc

SEQ ID NO: 32006 - DNA, 201 bp, Homo sapiens
aacaattcagaatgtataattaactctatgtaggatttataggtaatataaagttctggagtattttaaacgttgtaataagatcttttaatatttttacsgctagaatctctatgaacattgtctaaaatgaatagatgtaattgggatcttttaatatatgtgatagctttctataaaaaggaaaaaatattgccataa

SEQ ID NO: 32007 - DNA, 201 bp, Homo sapiens
gatgattctgcttctttttgtcatccatttgacacccagggccgtctatgtgttaaaatgtagcaatagcaatttctcttcctggcttccatgttaatgtrgcatgtgcccccaggttttgcttgtatttggagctccatctgatgtgtcaattccggattaatctaaacctgggacactgagttactgacatctgcagtt

SEQ ID NO: 32008 - DNA, 201 bp, Homo sapiens
gcaagtgaaactgctatattgccttctccctttatccttcactttggagattttgcagcatatctctaatgtagccattcctagacctaagttaattgtgstagtaaaaatatgcatatgcctttttctaattgttgtataataccgtagattgtaatctctccacatctttttcacattttgcacagaagcatttttttt

SEQ ID NO: 32009 - DNA, 201 bp, Homo sapiens
ctctagtaaaagctttagggaaggtgaaaatcaggtggcatttgtggttaatatcactgggttttttttttttttttttttttttgcatattctagttaartctgtctctcagatcactgggaattgtccagaaaggggcaaaattttagccaaattttaagtatatcaaatcactgaaggcttatgtagaatttgcctaa

SEQ ID NO: 32010 - DNA, 201 bp, Homo sapiens
cagagtgcaatggcactctcttggctcactgcaacctccgcctcccaggttcaagtgattctcctgccttagcctcctgagtagctgggattacaggcacrcaccagcatgcccagctaattttttctatttttagtagagatggggtttcaccatgttggccaggctggtcccaaaatcctggcctcagttgatccaccc

SEQ ID NO: 32011 - DNA, 201 bp, Homo sapiens
tagtatagctgtattatatatatgacagatatatatattactatatatcagctatatatatgtggtactttgtatgttttctgtatggttatacacatttrttttacttttgaatccatgtaacttttcttcacatgcttttaaaaggtttttaaaaatcaagctttggagcttttaaatttagataaatcacgtttagat

SEQ ID NO: 32012 - DNA, 201 bp, Homo sapiens
cgtggctgtaatcccagcactttgggaggccgaggtgggtggatcacctgaggtcaggagttcaagaccagcccaggcaacatggtgaaatcccatctctrctaaaaatacaaaaattagctgggcatggtggcgggcgcctgtaatcccagctactcgggaggccgaggcacaggaatcgcttgaacccaggaggcggag

SEQ ID NO: 32013 - DNA, 201 bp, Homo sapiens
ttacaggcacacaccagcatgcccagctaattttttctatttttagtagagatggggtttcaccatgttggccaggctggtcccaaaatcctggcctcagytgatccacccgcctcggcctcccaaagtgctgagattataggcatgagccactgcacctggccaagagttttatagtcacaggaaatacagaaaggaatt

SEQ ID NO: 32014 - DNA, 201 bp, Homo sapiens
ttttaaaaatcaagctttggagcttttaaatttagataaatcacgtttagatttaacaactcaacaaacaacatttgacatttttgggtcatattgtaacwttatatttaattagctaacattaagaatttctcttattaaaacaattttagtagctctccatttagaatattcactctggggattatgttgactttgcat

SEQ ID NO: 32015 - DNA, 201 bp, Homo sapiens
ttgtggaggattgaaaaagaaaataaactccctgtgttttagaacaggaatgtgacacaaaaatgttttatagaaaataatgtcagccaggtgcagtgtawcgtggctgtaatcccagcactttgggaggccgaggtgggtggatcacctgaggtcaggagttcaagaccagcccaggcaacatggtgaaatcccatctct

SEQ ID NO: 32016 - DNA, 201 bp, Homo sapiens
tttctgatgttatgacagaataccaaatggaaagaacatatatttatttatcatagttctcaaggctgagatgtccaggatcaaggtactggcatctggtwagggtcttcttgctgtgtcctcgcatggctaaaggtgggcaagagacatgaagcctcttttacaagagccttaattccattcatgagggaagaacactca

SEQ ID NO: 32017 - DNA, 201 bp, Homo sapiens
gattatattgctcttttactactctgttatgttttcttttgtttccttgaggttgagatgtcaaaacacgtaaatggtcagactttttaggcccttgccaygtagaacctgtgttttccattttcttactgtgcatttggtgccttttgtatgctagtcattatgtaaggtgctttatcggatttacttcgtcattttaga

SEQ ID NO: 32018 - DNA, 201 bp, Homo sapiens
tagtttttcaaagtagatttttcccttttcttctcagttatgtgaaaaaagtgactgttttgttttgtttttgtttttttgtttgtttttgttttcgagayagaatctcgctctgttgcccaggctggagtgcagcggtgtgacctcggctcactgcaacctctgcctcccgggttcaagccattcttctgtctcagcctc

SEQ ID NO: 32019 - DNA, 201 bp, Homo sapiens
tactaatttagagagcttcagacaagattgtcattctttagcttttcaatattaagcattttgttctcttcccaactttctttttaataaaaaaaatcttragaataaataactctcaaatgaattgcaggttagttaaaaattggggatacataatagcttgctgacataaaaatattcacttttcttaggtcaagatta

SEQ ID NO: 32020 - DNA, 201 bp, Homo sapiens
aggggcaaaattttagccaaattttaagtatatcaaatcactgaaggcttatgtagaatttgcctaaggactttgatagtgtctggaaataaatgcttctyatttcagaacaagtggtaaaacaaaacaaaacaaaaaaaagctaaaaaaaatccatgagatgaaaattacaaatttggatgatttttaaatagttaaact

SEQ ID NO: 32021 - DNA, 201 bp, Homo sapiens
tctttccccatgtacagtttcttcagtaaccttgcttaatgaattgattggaaacctgttttggctttcagaggactgaaataaattgtctctccatacayttttaagcaacccaggatcctttctgatatgatcaagcaactaatgcttggttgaactaagatgacttttaccatcactttgaagtgagaaagttctgtt

SEQ ID NO: 32022 - DNA, 201 bp, Homo sapiens
tgggattacaggcgcccgccaccatgcccagctaatttttgtatttttgtattttagtttcacagtgttggccaggctggtcttgaactcctgacctcacwcgatccacctgtcttggtctcccaaagttctgggattacaagcgtgagccactgcgtctggccccccaaaaaaagtggtttttcagcagtttttcttatt

SEQ ID NO: 32023 - DNA, 201 bp, Homo sapiens
ctaagacaggagaattgtttgaatctaggaggtggggcttgcagtgagctgagatcgtgccactgcattccagcctgggtgatagagagagactcgtctcaaaaaaaaaaaaaaggatactcctcaaattatgcctacttgtaatttggagtatggtcgctttttcctgtgcacaagttaaatctttgataatcttaagaa

SEQ ID NO: 32024 - DNA, 201 bp, Homo sapiens
cctgggtacaaagaactagggataagattattagcaagaacacagaaagtccttgccccatgaggtttatattctagtagaaaagcaaacaagtaaatcartgatataatttgaaaactgataagggctaggaagatttaatggattattaagtttgtaaaggaaccaatagtcttaggctcattgtatttttttataaga

SEQ ID NO: 32025 - DNA, 201 bp, Homo sapiens
aaaactttgtgttattttggggagaggagacatttatgatgtggatgatcattttaggtggatagctttttttttcttcttgatcttatccagcaattttrtattagttcttgatggaccctttttaggtgactttttatactctgtttttcttgagtgaattctgatgaatgtttactccatttttgtgcatgttacatg

SEQ ID NO: 32026 - DNA, 201 bp, Homo sapiens
tatatataaaaagagaataagaagcagaataatatctaaaggtaataaaggtcaactagttaaataaacataactatttaaaaatgaactaaaagaaattwaaaaaataagagacactatgaaagagcaacatacattcttaactcagaaacaagatgagtagagaacagagatttggaaaagggagctgaataacaggcc

SEQ ID NO: 32027 - DNA, 201 bp, Homo sapiens
gacctccagatgatcctcccatctcagcctcctgagtagcaggaccacaggtgtggtccacaccagtagctaccacacctggctaatttttgtatttttartagtagagacagggatttcaccatgttgcccaggctggtcttgaactcttgggctcaagtgagtcttccttcctcagcctcccaaagtgctgggattaca

SEQ ID NO: 32028 - DNA, 201 bp, Homo sapiens
ttaatgtagatatatgataatgtagatatatatgatatgtaggtattacatatgataactatatatttctatttaaatataaaaatgcatatttaatgtamatattatatatgatatgtatatcctatgtatatgtgtatatatgtatcacgtatatacatatgacacagctgtatgccacataccacatatatgacagtg

SEQ ID NO: 32029 - DNA, 201 bp, Homo sapiens
tggcgtgatctcagctcaccacaacctctgcctcccaggttcaagcaattctccaacctcagcctcctgagtagctgggattacaggcatgcgccaccacrtccggctaatgttttttgtagttttagtagagacggggtttctccatgtcagtgaggctggtcttgaactcccaatctcaggtgattcacctgcctcggc

SEQ ID NO: 32030 - DNA, 201 bp, Homo sapiens
agaaaaggctgaaaaagcaacatctgttagtgatgtcacttgcttcaacacttgaggctcagagagcatgggcttagcactgagaaaataatctgttgtayctgaatcttctacatccttgcccactgtttttattaagctaagtctcttcctaatgacgacaatatgaccataaattatatagccatggaaaacgtataa

SEQ ID NO: 32031 - DNA, 201 bp, Homo sapiens
aaagacattgaaatgttggctatctgcatttctcttaatcaccgaaaatacaacaattcagaatgtataattaactctatgtaggatttataggtaatatraagttctggagtattttaaacgttgtaataagatcttttaatatttttaccgctagaatctctatgaacattgtctaaaatgaatagatgtaattgggat

SEQ ID NO: 32032 - DNA, 201 bp, Homo sapiens
aaattatatttcaatgcaaatggtggtcactttggaaaacagtttgtcagttccttataaaattcagcatgagtttacaatacaacatagtggcctactcrtggttatttacccaagagttatttgtccctgtttctacccagagtcttgtactcgtatgtttggggcagttttactcacaatagcctaaaactggaaatg

SEQ ID NO: 32033 - DNA, 201 bp, Homo sapiens
aagtgaaattacttgtacgtgtttcggtatacagtcaagaaaatactgtgtgtgtcgacaataaataaaaccttatgttataaatcattatgcattgtgcmgagcatttttaggtacacaggtagattatatttatttcagtgtttttctgaatactttctagtaagggttacttctttcacgaatatatgaacacttaaa

SEQ ID NO: 32034 - DNA, 201 bp, Homo sapiens
ggcgcccgccaccatgcccagctaatttttgtatttttgtattttagtttcacagtgttggccaggctggtcttgaactcctgacctcacacgatccaccygtcttggtctcccaaagttctgggattacaagcgtgagccactgcgtctggccccccaaaaaaagtggtttttcagcagtttttcttattttaatacctt

SEQ ID NO: 32035 - DNA, 201 bp, Homo sapiens
tttttgtattttagtttcacagtgttggccaggctggtcttgaactcctgacctcacacgatccacctgtcttggtctcccaaagttctgggattacaagmgtgagccactgcgtctggccccccaaaaaaagtggtttttcagcagtttttcttattttaataccttttaatatctgtttttagaatagttctgagtttt

SEQ ID NO: 32036 - DNA, 201 bp, Homo sapiens
aaattttagccaaattttaagtatatcaaatcactgaaggcttatgtagaatttgcctaaggactttgatagtgtctggaaataaatgcttcttatttcaraacaagtggtaaaacaaaacaaaacaaaaaaaagctaaaaaaaatccatgagatgaaaattacaaatttggatgatttttaaatagttaaacttttttga

SEQ ID NO: 32037 - DNA, 201 bp, Homo sapiens
tcacagtgttggccaggctggtcttgaactcctgacctcacacgatccacctgtcttggtctcccaaagttctgggattacaagcgtgagccactgcgtcyggccccccaaaaaaagtggtttttcagcagtttttcttattttaataccttttaatatctgtttttagaatagttctgagttttttcaaacaaaacataa

SEQ ID NO: 32038 - DNA, 201 bp, Homo sapiens
tggtcttggtaagtaaatgacttttatttcatctttaaggttgaaataatataatattacatttaaaaagcaaacgttttgttaaaaaatgtgcaatggamctgaatagacatttcacaaaagaagacagatagttggccaataggtatatgaaaaaatactcgacatcactcatcatcagcaaagtgcaaattgaaacca

SEQ ID NO: 32039 - DNA, 201 bp, Homo sapiens
tggccaggctggtcttgaactcctgacctcacacgatccacctgtcttggtctcccaaagttctgggattacaagcgtgagccactgcgtctggccccccaaaaaaagtggtttttcagcagtttttcttattttaataccttttaatatctgtttttagaatagttctgagttttttcaaacaaaacataaagttatttt

SEQ ID NO: 32040 - DNA, 201 bp, Homo sapiens
ttttaatatctgtttttagaatagttctgagttttttcaaacaaaacataaagttattttgagaaactatatggaacaacaagaatgtgatatttgtttartaaaaaggttgtaataatattggatattaaagcatctttctgtacttcttaaggcacaggtcagtatcatcactcttattctgaaaatttttaaagacct

SEQ ID NO: 32041 - DNA, 201 bp, Homo sapiens
ttttcaaacaaaacataaagttattttgagaaactatatggaacaacaagaatgtgatatttgtttagtaaaaaggttgtaataatattggatattaaagyatctttctgtacttcttaaggcacaggtcagtatcatcactcttattctgaaaatttttaaagacctccttttcctgcaaaaagaattacaaacttctcg

SEQ ID NO: 32042 - DNA, 201 bp, Homo sapiens
catagggaaaaggcactgaacaaaatttaaattctatttatgtttaaaaaataataaaatacctccttaacattattttataagcgcatgtgcacacacaygcttcagttcaaaatcagcactttctttaaggtagtacactagcagttaaagtcaggtgtaagttaaggatgtccagcatgccctctgcaatacatgcct

SEQ ID NO: 32043 - DNA, 201 bp, Homo sapiens
ttcaaacaaaacataaagttattttgagaaactatatggaacaacaagaatgtgatatttgtttagtaaaaaggttgtaataatattggatattaaagcayctttctgtacttcttaaggcacaggtcagtatcatcactcttattctgaaaatttttaaagacctccttttcctgcaaaaagaattacaaacttctcgtc

SEQ ID NO: 32044 - DNA, 201 bp, Homo sapiens
agttattttgagaaactatatggaacaacaagaatgtgatatttgtttagtaaaaaggttgtaataatattggatattaaagcatctttctgtacttcttaaggcacaggtcagtatcatcactcttattctgaaaatttttaaagacctccttttcctgcaaaaagaattacaaacttctcgtcataatattttgtacct

SEQ ID NO: 32045 - DNA, 201 bp, Homo sapiens
ggcacaagggcgctcctgtctgcagagggaaggtatacagccacacaggcagagcaagaattcacagaagatgttgctgctggaccatgtcaagggagttygacaaacaagcaaggctctacccataggtcttcggtgctcaaggtggcaagagtaaggcacagccttgatgtggaaaagctagagttcagggaggacacc

SEQ ID NO: 32046 - DNA, 201 bp, Homo sapiens
actgttttaattaatgctttttaaaatctgattaactctgggagatagtaggatagaataaaatgatttctgagtaggagataagtgaatataatttgtaytcctgagagctggtgttaaatttttgcaacccagttttactcatgggcagacctttttaaaaggaaacacccacagtctgtatgaatttgattctcgtgt

SEQ ID NO: 32047 - DNA, 201 bp, Homo sapiens
tttgagaaactatatggaacaacaagaatgtgatatttgtttagtaaaaaggttgtaataatattggatattaaagcatctttctgtacttcttaaggcayaggtcagtatcatcactcttattctgaaaatttttaaagacctccttttcctgcaaaaagaattacaaacttctcgtcataatattttgtaccttccatg

SEQ ID NO: 32048 - DNA, 201 bp, Homo sapiens
tatttaacagttttcttggcagattgttgaattggacctgaatggaactgcttgttaaattgtgattcataagttatgtggaaataattcttcttactggttttttttttttttgttttctgagatggagtctcactctgtctcccgggctggagtgcagtggtgcaatctcggctcactgcaacctccaccttctaggtt

SEQ ID NO: 32049 - DNA, 201 bp, Homo sapiens
cgaggctttaaagacaacattttctaagttaataatcacatgacaggttccaattgtcacttcatagggttcaaagataacctctctgtatatgcaattayagtttgtcacacagcatagaaaaatcactggtattttctctaactttattattctgttcaggatcaagtctcactctatcttactgagttgggaatgttt

SEQ ID NO: 32050 - DNA, 201 bp, Homo sapiens
ctgaggcagcagaatcgcttgtacctggagagggagattgcagggagctgagatcgtgccactgcactgcagcctgggcaacagagcgagactccgtctcaaaaaaaaaaaaaaaaacaacaacaaaaagtgaaatagtaagtatacagtggatattacaaattattattatattacttattatttctgtctaatagatga

SEQ ID NO: 32051 - DNA, 201 bp, Homo sapiens
taaagtaagtataggaaatgtttgtagatatttgattactggcttctctgactttattttctatgacaacatatacatttcttagatacatcatgcttgamgctgggaaatttctcccaattattgaaatgggcatagaagttataggaatgtatacatcaacttgaaataaacaacttctataagattatagaaatctta

SEQ ID NO: 32052 - DNA, 201 bp, Homo sapiens
ctgtgaataatgctataccatgccccatgtttttgctgaaaactcattggtgtttattctcctatgatggtatactaaatatctgtccagattactgttattttttttatttagtcttgagaatttgccctgtgtttgtgcaatacaagaaaaaatacacttgctgaaggtcattgtgttgtgcaatacaagaaagaacca

SEQ ID NO: 32053 - DNA, 201 bp, Homo sapiens
attatgaacattagctttgttccaacagacaactgagaccttctatgatgcagcacttactcagaagattagtatttgatgttccattattaaatgaacaygcaaagatgcctcttaaagtaagtataggaaatgtttgtagatatttgattactggcttctctgactttattttctatgacaacatatacatttcttaga

SEQ ID NO: 32054 - DNA, 201 bp, Homo sapiens
cctccagttgggttttaataaaagatgacatgcctttggatatactctgttctcgctcttcctggaagacccttgcgcgttcttcacctgaaggaagtctyttcattgtttaggtatctgtcaaatgttttttcctttgtaaagtcttcctgtgtttacaatgcatctccctcctttatgacaaataattctgttttcttt

SEQ ID NO: 32055 - DNA, 201 bp, Homo sapiens
gggacacaggagtgtggcagagggagaagtcagccaggtgatttggagtttattccctgacagtctttagaattgccttttgatgtggtttggctgtgtcrccacccaaatctcatcttgaattgtagctcccataattcccacatgttgtgggagggactcagtgggagataattgaatcataggggcagtttcccccat

SEQ ID NO: 32056 - DNA, 201 bp, Homo sapiens
taggtatctgtcaaatgttttttcctttgtaaagtcttcctgtgtttacaatgcatctccctcctttatgacaaataattctgttttctttcttgcttgcytgtctacctggttgctttctatttccttctcttcctctctttctcattcacttgatcgctttttctctttttcttcctccctcccacgctcctctctttc

SEQ ID NO: 32057 - DNA, 201 bp, Homo sapiens
ttctctttttcttcctccctcccacgctcctctctttcaagcaaaattaattcctcctttgactgcgtaacttgctgctaactcatgtgtccctttacatktactttggcgtttctcaaattatgaaagcacctgcaggcagagacagcctctcagtcatcttgtatctcaggtacataatacagttttgaaggaagtaga

SEQ ID NO: 32058 - DNA, 201 bp, Homo sapiens
ggagtgtgagaacagactaatacacctgtgtatggtgattatagaaaggaaaccaaattttcatcagtagattaccatttcaaagctccctacaaagtcaycaccttcttgcctgtatctggggctggctgtgcccttgactccttcaccttccttggttctctgctgctcctcttaattattccgtttcctggattttag

SEQ ID NO: 32059 - DNA, 201 bp, Homo sapiens
actaatacacctgtgtatggtgattatagaaaggaaaccaaattttcatcagtagattaccatttcaaagctccctacaaagtcatcaccttcttgcctgyatctggggctggctgtgcccttgactccttcaccttccttggttctctgctgctcctcttaattattccgtttcctggattttagggtaacatggaaact

SEQ ID NO: 32060 - DNA, 201 bp, Homo sapiens
aggaagacctcctccaggctcactcgcctctgcattcagtcccttggaagcatggcactttttctattttttgccttggtggggaagaggaaccttatttyagcatttccagatggaaacgtcacacttgataattctaataacatttcctttaaaatcaaataaaagtgaaagcttaagtcagttttggtctactcacag

SEQ ID NO: 32061 - DNA, 201 bp, Homo sapiens
tgcacacataaaatggatttggaaactcgtatttaatcttaaaaaaaatcttttagtgtttgccagagcattttaatctgaaaatatttaaaaatactcgyctgtaatcccagcacttcaggaggccgaggcaggtggattacatgaagtcaggagttcgagaccagcttgggcaatattgcgaaaccccgactctactaa

SEQ ID NO: 32062 - DNA, 201 bp, Homo sapiens
ggtactgaccagtgatgttagacctagaatttaagaacaacaaccctcataagaaagccatttgaacagcagagtcatatttagtgttttttagcccttgrgaaatcaaaaattgacaactcagaacctcaatgaactatagaatttcacctataaggaaagtggactgtcctcagtaattatatattctaaatgcttatc

SEQ ID NO: 32063 - DNA, 201 bp, Homo sapiens
tgaggcaggagaatcgcttgaacctgggaggcaaaagttgcagcgagcagagatcatgccactacactccagcacgggtgacagagcgagactccatctcaaaaaaaaaaaaaaaaaacaaaaactcatctgttagtataactaatgctccaggaagctgccacatatttacctcaggacctatttctatcttcgccccac

SEQ ID NO: 32064 - DNA, 201 bp, Homo sapiens
tgctgtctcaggaatggtagagggggaagaacatcttagtaagtgggcccgtgcagttgaaacctgtgttgttcaagggtcaactgtatataaaatatgtwaaaaatatgcaaaagtttcattccatttttttttttttttttgagacggagtctggttctgttgcccaggctggagtgcagtggcgcgatctcggctcac

SEQ ID NO: 32065 - DNA, 201 bp, Homo sapiens
aagaacatcttagtaagtgggcccgtgcagttgaaacctgtgttgttcaagggtcaactgtatataaaatatgttaaaaatatgcaaaagtttcattccatttttttttttttttttgagacggagtctggttctgttgcccaggctggagtgcagtggcgcgatctcggctcactgcaagctccgcctcccaggttcacg

SEQ ID NO: 32066 - DNA, 201 bp, Homo sapiens
ggaatcacttcatgtttgtctgggaagtctgattattgcaaagttgttacctttttaaaaaataaaggcagatgttaagcacaatttatatttaaagtctrtaaacataggggattatcgtgggctacctgtcttgaggtcagactgacatttctgctgtggctaaaaacaagtttagggaccctgggagcctcttggcta

SEQ ID NO: 32067 - DNA, 201 bp, Homo sapiens
taatctaagattctgtaaaattgaaccaaaatgcctatctcacagatattttctaagtattacatgaggtaaaacacttgctgttgcctgacacagtagawgttcactgtgtacattttctctcccttccttctctggcaaatttgctgtctcagcctttttttcctcctttctgttccaatattccctcttctttttctt

SEQ ID NO: 32068 - DNA, 201 bp, Homo sapiens
cgtgggctacctgtcttgaggtcagactgacatttctgctgtggctaaaaacaagtttagggaccctgggagcctcttggctataaccttgggagccattkctttgtagttaagagtcagaatcagaatctgcaggtcaatttgatttcacatccccatggcactgaattccacctaacataccagcatatctgccaccga

SEQ ID NO: 32069 - DNA, 201 bp, Homo sapiens
gacatttaaagatgtaactaaagaatacatttccatgtgtcatagtgctatcatcttccggatagtgaaattgtatgtccccatgttaatccctttgaagrttatctactgccaaacacaaatggccttctactctctgattctttttcaggcagctttgagtgctacagacatggccttggccctcaatcggtacctttg

SEQ ID NO: 32070 - DNA, 201 bp, Homo sapiens
agggatagatggatgccaaattacaggtcagaataagactctgctggtacaactataaaccttaacgatggctggtcactgtggctcatgcctataatccyggcaccttgggaagtggaggtgggagattgcttgagtttaggagtttgagatcaccttgggcaacatagggagatctcatctctatggaaaaaaaaaaaa

SEQ ID NO: 32071 - DNA, 201 bp, Homo sapiens
ttcatgaaatatatgagagcagaatcacaaaaatgaaatgaaaatttcttttttctttgttttgtgtattcacctgacgttgtggacctggatagtatggrcgataacatagtagtaatacagttatcctttggttattggtgctgatagacatgagaagaataaatatgaataataaagagaattcagaaagaatttacg

SEQ ID NO: 32072 - DNA, 201 bp, Homo sapiens
ttcccgtagttccctacctcttctgaattcctcaattatttattgtatttattatttgttgtctgcctgccttcatcagaattaaactcacaaggcagatrattttttcttccttcttttttgatgtatcccagctactaaagcaatggttagccaatagtgggtacactataaatgtttgaatggatgaaaagctacctg

SEQ ID NO: 32073 - DNA, 201 bp, Homo sapiens
ggacttgagccgacagtagccccttcatgaaatatatgagagcagaatcacaaaaatgaaatgaaaatttcttttttctttgttttgtgtattcacctgamgttgtggacctggatagtatgggcgataacatagtagtaatacagttatcctttggttattggtgctgatagacatgagaagaataaatatgaataataa

SEQ ID NO: 32074 - DNA, 201 bp, Homo sapiens
gggtggatcacctaaggtagggagttcgagaccagcctggccaacatggagaaaccccatctctactaaaaatacaaatcagccgggcgtggtcgcgggcrcctgtaatcccagctacttgggaggctgagtaatgagaattgcttgaactgggaggcggacgttgcagtgagtcgagattgcgccactgcactcctgcct

SEQ ID NO: 32075 - DNA, 201 bp, Homo sapiens
ttatttattgtatttattatttgttgtctgcctgccttcatcagaattaaactcacaaggcagataattttttcttccttcttttttgatgtatcccagcyactaaagcaatggttagccaatagtgggtacactataaatgtttgaatggatgaaaagctacctgcaactgtaaaaatgtgaattggatgaatgaagata

SEQ ID NO: 32076 - DNA, 201 bp, Homo sapiens
ttctaaatgttattgtagtagttatgctactatacatatttaatacctactttcatgtactcattaattttatcaattaaatgtgcttttttgatttcaargcacattaggacttgagccgacagtagccccttcatgaaatatatgagagcagaatcacaaaaatgaaatgaaaatttcttttttctttgttttgtgtat

SEQ ID NO: 32077 - DNA, 201 bp, Homo sapiens
atgggtaccaattcttctttgaatgtctggtagaattcggcagtgaatctgtctggtcctggacatttttgttgttggtaatttttaaattaccatttcawtctcactgcttgttattggtctgttcagggtatctaactcctcctgatttaagctaggagggttgtatttttccaggaattcatctgtctcttctaggtt

SEQ ID NO: 32078 - DNA, 201 bp, Homo sapiens
aaaaacacagattacatgttgactgtaagaatacttacaaaatattgcttggtaattcacttattcactcatgcaaaatgaatttgtggtgagggcctatrataggctagcaggagctggagaaacctcagtaaacaaaacataccaagtcccactgttagggacttacattctggcattgaggaattaggaaaaaaaaga

SEQ ID NO: 32079 - DNA, 201 bp, Homo sapiens
ccacatggagaatctgccattatcagcttaaatgttcttttctttgaaacactgtggaataagctgaagttctaaatgttattgtagtagttatgctactrtacatatttaatacctactttcatgtactcattaattttatcaattaaatgtgcttttttgatttcaaagcacattaggacttgagccgacagtagcccc

SEQ ID NO: 32080 - DNA, 201 bp, Homo sapiens
ctgtctggtcctggacatttttgttgttggtaatttttaaattaccatttcaatctcactgcttgttattggtctgttcagggtatctaactcctcctgakttaagctaggagggttgtatttttccaggaattcatctgtctcttctaggttttctagtttatgtgtgtaaagatgttcatagcagccttgaatgatctt

SEQ ID NO: 32081 - DNA, 201 bp, Homo sapiens
atgttcatgatattgatagtaccttttaataaattactttattgatagaatgtaaatgcagtctaatcaggaattaaaaattctatggtctttattttgcmcctgatgaaaaggctatattaatgaggttgtgattacctattctgatatttatgaaagcaaattattatgtgaggaacacatgccatgttaagaagggag

SEQ ID NO: 32082 - DNA, 201 bp, Homo sapiens
gagtctaatgataattttctttgtattattgctcatgttattgataggtatttacatgtaattttggaaagtaaactttcataaacacgtcagattctcartatatcttaacagtccccaaaaggataaaaactattattctaatggatgaaccaactggcctagaccatagtataaataacttggtgtatgctgaaatca

SEQ ID NO: 32083 - DNA, 201 bp, Homo sapiens
aatggtctatcaattttagttatcttttcaaagaaccagctttttgttttatcttttgtatttcttttctttcaatttcatttagttctgctctgatcttkgttatttctttcttctgctgggtttgggtttggtttgtttttgtttctctagttccttgaggtgtgtccttagagtgtcagtttgtactctttcaatatt

SEQ ID NO: 32084 - DNA, 201 bp, Homo sapiens
tctttcttctgctgggtttgggtttggtttgtttttgtttctctagttccttgaggtgtgtccttagagtgtcagtttgtactctttcaatatttttgatrtagacatttagggctatgaacttccctcttagcaccacctttgcagtatttcagaggttttgatagcttgtgtcattattgttgtctggttcaaataatt

SEQ ID NO: 32085 - DNA, 201 bp, Homo sapiens
agtagagacggggttttgccatgttggccaggctggcctggaactcctaacctcaagtgatccaactgcctcggcctcccaaagtgctgggcttacaggcrtgagccagcgtacccagcctagattagtattttctgaaactttttgacccaaatgaaattaaagtttcgtggaataatacttttactctgtaatacattc

SEQ ID NO: 32086 - DNA, 201 bp, Homo sapiens
ccagttttatgccactgtggtctgagggattgcttgatataatttcagttttcttaaatttattgagccttgttttatgccctatcatatggtctatcttkgagaaagttccatgcgcttttaatagaatgcagttgttggatgaaatgctccgtatatatctgttaagtccatttcttccaatgtgtagtttaaatccat

SEQ ID NO: 32087 - DNA, 201 bp, Homo sapiens
cagcatttgtttgtctgaaaaagactgtatctttccttcatatatgatgcttagttttgctggatacaaaattctaggctgtttgaggaggctgaagatayggccccagtcgcttctggcttgtagggtttcttctgagaaatctgctgttaatctgataggttttcctttataggctacctggtgcttctgtctcacagc

SEQ ID NO: 32088 - DNA, 201 bp, Homo sapiens
tgggaaaaataattttctactgaaaagtcactcttgcattttgggcacagaaaaacttatagaggcgataaaacttgggggtaggtaggtgaattctgttsatatataattggtatagaatttcaggcaaaaactttaaaatagttgtacagttttactgtttctactgtttgataaagctgaaatcaaatattccaaaat

SEQ ID NO: 32089 - DNA, 201 bp, Homo sapiens
tgcttagttttgctggatacaaaattctaggctgtttgaggaggctgaagatacggccccagtcgcttctggcttgtagggtttcttctgagaaatctgcygttaatctgataggttttcctttataggctacctggtgcttctgtctcacagctcttaagattatttccttcatcttaactttggataacctgaggacaa

SEQ ID NO: 32090 - DNA, 201 bp, Homo sapiens
tgaatatttgagggggaccttctgtaggtctccagggttccctcttgtgagccctctcctctctgtgtcctgtgaattctagcaaccttggtctcctggaygctcagcaatatctcttcaactcatggagactgtcaggccacacctgggttcccttcctgctccatggcctggaaattctcctaggcagtaaactgaggc

SEQ ID NO: 32091 - DNA, 201 bp, Homo sapiens
cctctgctgagtcatgcaggttgtcagggaagtgggggaaagccagtagtcacaggcctcacccagctcccatgcaaacagaagggccagtcgtactcccmctgtgccccccaacaacagccctgagtctgtttccaggcggagggtgtgatgggtttgaacacttaccccagggtacctgccttccagctgcaaaataaa

SEQ ID NO: 32092 - DNA, 201 bp, Homo sapiens
aaaagggcttggttcctcccctgcctatggagtctggacactagatttgcaccctcccctgagttctggccaggaggcctctcaccccattcaaattgttrcaaaggccagctagagatttccttctgcctgtggagttttaccccgtgctcctctcccattggatccctgtggtgccaggcaggtatggggtgcttgggg

SEQ ID NO: 32093 - DNA, 201 bp, Homo sapiens
gtggtcccagtgaggaaattcatcagtctactcttcgatttacagagtggtttacactttgatcctgtagaaatgcattttttaggcaacttagaacggtstttcttaatatgcctcaggtagtaatgggatggactaatctgtgtgaaggtaaactgaatggcagattgggaatagctctacaggactgtgttacattta

SEQ ID NO: 32094 - DNA, 201 bp, Homo sapiens
tcatttaaagggatatcgtccaatgtttaagtcttgtcctcgtgtctaatctcaagtgtgtcctggcagtcctccctttactaaggcagttccctgtctcrtattcctcaaagcccctcttcccttcccattctcagctgatttcactgagaaaacagaagcagttggaagagaacttatacatcctttcacccgccaaac

SEQ ID NO: 32095 - DNA, 201 bp, Homo sapiens
cgtccaatgtttaagtcttgtcctcgtgtctaatctcaagtgtgtcctggcagtcctccctttactaaggcagttccctgtctcgtattcctcaaagcccstcttcccttcccattctcagctgatttcactgagaaaacagaagcagttggaagagaacttatacatcctttcacccgccaaactcccagccactttacc

SEQ ID NO: 32096 - DNA, 201 bp, Homo sapiens
caaaactaccataataattgaacgcccattatagctttaggcaaagctagaaattaaaaatcttccccgcctttggcttccccatttgagacagtttcttytccttgtgcatctgtagctcatcttcctttgctgtctctgtacctctcttctaactcattttcatttgcttaaggaaaatatcttttctttactctatac

SEQ ID NO: 32097 - DNA, 201 bp, Homo sapiens
caggggagtgggttagaaagatgggcattgtggccagagagttgaagggttgaaattgagaccatggaaggatgccacccctgtgatgtgccccctattgkcatgcagaggtctatgcagaagatcattggctggggagtcaggcatggcctggttgcttcctggacccatctcttgctgagtttagcaaacttaggcaca

SEQ ID NO: 32098 - DNA, 201 bp, Homo sapiens
ggagtgcagtggcacaatcactgcttactgcagcctggacctcccaggctcaagcgatcctcccatctcaacctcccaagtatctgaaactacaggcatgygccaccaagctgggctaatttttgtattttttgtagagatggggtttcaccatgttgcttgggctggtcttgaactcctgggctcaggtgatccaccagc

SEQ ID NO: 32099 - DNA, 201 bp, Homo sapiens
ctgggcttggtggtgcacacctgtaatcccagctactaaggaggctgaggcaggaaaatcgcttgaactggggaggcggaggttgcaatgagccgatattstgcctcatgccactgcactccagcctaggtgacagaacgagactccgtctcaaaaaaaaaaaaaaaaaaaaaaaaagaatgcttaaagaaacagcagata

SEQ ID NO: 32100 - DNA, 201 bp, Homo sapiens
gaggatactgtggacagcacctgggattgctgcaccgttgtctgctttatatgttgaacattggggctcaattctgaggtataaagggtcttaagctctaraaatggttgtaaacgcctcacccagataatgtcttttctcatttttgctgttttatgttctgaggtaaaaggatatgttaatcttcttttcaaaaatatc

SEQ ID NO: 32101 - DNA, 201 bp, Homo sapiens
gaagattcatgtgcctattagagcttgaaaatcactagtcctgggatcaaagtgagacccgggtgcccagagattggtgcccaaagcccttgtactgctgytggtggactggtgctactatatttttgtgtaaatcctgcagtggttacatatttcagcctaaggccgacttggctttcatcctctgccagtgtctgtttt

SEQ ID NO: 32102 - DNA, 201 bp, Homo sapiens
tctgtttttgctttaaggataattcatctcagtttcagtaactgaaactgttgttgctttctgaatattgcataccacaagcctgacgtgatgtagttttyacccagacttccctttgctgtttaagcagcaaaattggaagcattcaaattagaatattttcttcagaagagtagaccttatttagagaactttatatga

SEQ ID NO: 32103 - DNA, 201 bp, Homo sapiens
cttctttccttatttaaattaaaatttttaggcatctaagttctcctaaattttttattttgaattctaataatagtttggattatgacatcattctatartaataacaagttagtgagaatcaatagtttatgcctccataatgctttactctgaaaatttttaatgcaagcaaaatttactgtgtctcatatacttaat

SEQ ID NO: 32104 - DNA, 201 bp, Homo sapiens
actgaaattttcatatgcttatggttctctcatatttattatttatcttcaggcatagatatgatttggaaattgcctttttaactccgtcacctattttrttactgctgtaaactccttattacctaaaatcaaggtcgttggtttggcgccagcctttgtctgtggacctatcagtcattccacctcttagcatgtgct

SEQ ID NO: 32105 - DNA, 201 bp, Homo sapiens
aggactaacattcgtataaaacaaaaatattttaagaggaaaggccaggcaaaaatatgttatgtgctaatttcatcaatactgaaaagtgggtcatcttwtcaaaaatttcctgaacactgaaaccttggctaaaaaagtaaaagtaactgctcaaaataaggtgtttgctaaatgctgtgtgtctgatttgaaccaagg

SEQ ID NO: 32106 - DNA, 201 bp, Homo sapiens
tctctccttacaattcctgtagcacgttgattatgatttacacagcatttttaaaggctttttcctaccttccatatccatttatttatttattattttatttttttttgagaagtagtctcgctcttttcgcccaggctgcagtgcagtggcgtgatctcggctcactgcaagctctgcctcccgggttcacaccatttt

SEQ ID NO: 32107 - DNA, 201 bp, Homo sapiens
tgcaagctaaattgtagtgagagaaaaccgattgtctgggactaggtgtgtggggagaaagggactgcaaagggcccagggagctctgaggagtgacggcmatgttctgcgtcttgattatggtgtgttctcacagatgtctacatctctcaaagctcattgaatttatacttcaaagagatgagtttattgcacattggt

SEQ ID NO: 32108 - DNA, 201 bp, Homo sapiens
gggtcctgcaggagcagtccgcttccttcagaggctctgtggatcctctcgggattgctggtttgttcttgcagctgatctgggtctaaaattaacaatgygagcccccacatactgctctgtctagagctgcaatctagtcctgcctcccatccaccatgatgatcctctactagtttgtattagtcctttctcatgctg

SEQ ID NO: 32109 - DNA, 201 bp, Homo sapiens
agtctcgctcttttcgcccaggctgcagtgcagtggcgtgatctcggctcactgcaagctctgcctcccgggttcacaccattttcctgcctcagcctccygagtaactgggattacaggtgcctgccaccatgcctggctaattttttgtatttttagtagagacagggtttcaccatgttagccaggatggtctcaatc

SEQ ID NO: 32110 - DNA, 201 bp, Homo sapiens
gacatatgctacagtgtgaatgaatcccaaaatcatatgctgagcgaaagaagccaggcacagaaagatatatgctgcatggttatgtgtacaagtgtccyagaaaatgcaagctaaattgtagtgagagaaaaccgattgtctgggactaggtgtgtggggagaaagggactgcaaagggcccagggagctctgaggagt

SEQ ID NO: 32111 - DNA, 201 bp, Homo sapiens
atggcctgaagcaactgaagatccacaaaggaagtgaaaatagccttaaccgatgacattccaccattgtgatttgctcctgtcccaccctaactgatacrtatattctcccccacccttaagaaggtactttgtaatattctcccccgcccttaagaatgtactttgtacacctaccccaaacctataagaactaatgat

SEQ ID NO: 32112 - DNA, 201 bp, Homo sapiens
acaatgcgagcccccacatactgctctgtctagagctgcaatctagtcctgcctcccatccaccatgatgatcctctactagtttgtattagtcctttctyatgctgctaataaagacctgagactggataatttataaaggaaagatgtttaattgactcacagttccacagggctggggaggcctcaggaaacttagaa

SEQ ID NO: 32113 - DNA, 201 bp, Homo sapiens
caggctgcagtgcagtggcgtgatctcggctcactgcaagctctgcctcccgggttcacaccattttcctgcctcagcctcccgagtaactgggattacargtgcctgccaccatgcctggctaattttttgtatttttagtagagacagggtttcaccatgttagccaggatggtctcaatctcctgacctcgtgatcca

SEQ ID NO: 32114 - DNA, 201 bp, Homo sapiens
ggtcaaatagagttggattccttttgattagtcttatttggctaaaaatctattctattcccctggaatacccagttttgtttggttggttgatttttggktttgccatggagttgcacacagtattgtattattgtaatttcccattctttgtgtttttactttctgttttatctttagcctggtttgtgagagctttgt

SEQ ID NO: 32115 - DNA, 201 bp, Homo sapiens
cccagtagaaaggaaaatatatgtccacacaaagacttgggcatgaatgtttctaacagctttattcgtcatagccaaaaagtgcaaacaacttgaatacygaccatcaatgtattagttgataaataacactgtgatatacccatatacggtgaaatgtcatcccacaataaaaaagaatgaattgctgacatatgctac

SEQ ID NO: 32116 - DNA, 201 bp, Homo sapiens
ccccacatactgctctgtctagagctgcaatctagtcctgcctcccatccaccatgatgatcctctactagtttgtattagtcctttctcatgctgctaayaaagacctgagactggataatttataaaggaaagatgtttaattgactcacagttccacagggctggggaggcctcaggaaacttagaatcatagcagaa

SEQ ID NO: 32117 - DNA, 201 bp, Homo sapiens
gggtggagaatgtgtactattaatatacatagtacattcagtgaacccatgatgaattaacaaatgatggtaatctacttatcataatattacatgagctwtcacttggacacagatatgagcacgggtattttgaattattttcagagtttggttaaaatcggtgtcattcacatggatttgtatgtgtgtgtgcctgtg

SEQ ID NO: 32118 - DNA, 201 bp, Homo sapiens
tattggaaatgtaaatatttgtatattctgtacacaaatatatactttcattttatttatatttatagaaacttatattttaaatatatattaagataatwgtatgtaaaataaatatatttaatcaaactctatgtagttatgtatttttaaaaattcatcccctactataatgtcaagccagggaggtcagagtggttt

SEQ ID NO: 32119 - DNA, 201 bp, Homo sapiens
atgtttaattgactcacagttccacagggctggggaggcctcaggaaacttagaatcatagcagaaggggacgcaaacacgtccttcttcacatgatggcwgcaaggagaagtgctgtgcaaagagggaaaaggaccttaacaaatcatcagatctcatgagaactcactcagtatcacaagaacagcagcatgggggtaa

SEQ ID NO: 32120 - DNA, 201 bp, Homo sapiens
tgaggagaggaataagagcaaattattgccaagtcttatgtatcaactggtaaactttcaatcttattcattggaaaaatgactgataaacactgtgtacmtatcacaatgtttaaagtttctttggttttatttttaagagaaagagagtgaacgacctcttcttgatggtgacttgagaatagtatctttatgttaaag

SEQ ID NO: 32121 - DNA, 201 bp, Homo sapiens
gttgtcttctattctgggtgtcccttctgaggaattttttttaattatgaaaatacgcaaatgtcaaaaagtagcaacaacaatataatatatgcctttckgggtattaaaatgtctctttccaaagatccaaatcatatgatttttaaattagcattttaaagaataagataaaggtgagacatgcctttaccatattca

SEQ ID NO: 32122 - DNA, 201 bp, Homo sapiens
tgctgtgtaaaactgaaaccttttctccacttccttaaactcttcctgtttcctttactgctttattttcaactattggaaatgtaaatatttgtatattmtgtacacaaatatatactttcattttatttatatttatagaaacttatattttaaatatatattaagataattgtatgtaaaataaatatatttaatcaa

SEQ ID NO: 32123 - DNA, 201 bp, Homo sapiens
catcagatctcatgagaactcactcagtatcacaagaacagcagcatgggggtaaccatcaccatgattcaattacctcccactgggtccctcccatgacatgtgggaattatgggaactacaatttaagatgagatttgggtggggacacagccaaaccatatcatactttatataaaggatacatttttgtaagcatgc

SEQ ID NO: 32124 - DNA, 201 bp, Homo sapiens
gattttgagtgttttcaccacacaaaagtgtatgtgaggtaatatgtatgttaactagctcaattgagtcattccacaaagtatacatatatttcaaaacrtgtacacaatatatacaatttttatttgtcaattcaaaatacgtaaaattaaactttaatgtaaatcaatgtagattaatacactatggatggtgtttag

SEQ ID NO: 32125 - DNA, 201 bp, Homo sapiens
gcaataaccaagactaacctttttaggtaataacttctggtcttttttaaaatatgtattttatacaaatgaatatattttacatagttgcaattataatstatatgttattttggatctactcttaaaaagttacattgattattatatatttctatgatgttaaaaggttctctcaaatcatttctataaacttattaa

SEQ ID NO: 32126 - DNA, 201 bp, Homo sapiens
atcagatctcatgagaactcactcagtatcacaagaacagcagcatgggggtaaccatcaccatgattcaattacctcccactgggtccctcccatgacatgtgggaattatgggaactacaatttaagatgagatttgggtggggacacagccaaaccatatcatactttatataaaggatacatttttgtaagcatgct

SEQ ID NO: 32127 - DNA, 201 bp, Homo sapiens
tttggccttaaaaaaagagggaatcctgtcattttcaacaacatggatgaacctggaggatattacattacatgaaataagctacgtgtagaaagacaaawaccacatgatctcactttcatgtggactctaaaatcaaagtcgaactcatagaaacagagagtagaatgaggttaccaggtgtaggggggagtggttggg

SEQ ID NO: 32128 - DNA, 201 bp, Homo sapiens
tgatgatccttcactgcatttttgactcagctctcctgtaatctcaagaatgcaaaactttctgtggttctgcccacttgccctccttgtttctctgtgcytcgctgtgtctctcgccaaggtctaacaggctggtttaatttctcctgatttactaatttacctgattttatttgaatcaaactaactttgattccatgt

SEQ ID NO: 32129 - DNA, 201 bp, Homo sapiens
catacgtattcatgtcaatgttattttttgtaatggcaaaaacaagcagaagatcactatacatctatcagaagagtgaaaatccaaaactcagacaacamccaatgctggtggggatgtggagcaacaggaactctcattcattcttgatgggaatgcaaatggaacagccactttggagaacagtttggcagttatttt

SEQ ID NO: 32130 - DNA, 201 bp, Homo sapiens
ccgtgaaaagacatggaggaaccttaaatgcatgtcactaagtgaaagaagccaatctgaaaaaggctacataatacgacattctggaacagtcaaatctmtggagacagtaaagagatcagaggttgccagggataaggggcagggagggatgaataggtgagcacagggtatatttagtacagtgaaactattttgtaa

SEQ ID NO: 32131 - DNA, 201 bp, Homo sapiens
agtgcatattcttggctatttccagaatatcagtgtctatctgctatctgtgccttgtgtaaagtctgtccgtgtaaaaagagaatcattatgttctagaraatcattatgttctggaaatattttgacaaactgacagatttttgctgatgtcgaaattaaaatttatctcaaaatagtatgtggtgatgctgagcatga

SEQ ID NO: 32132 - DNA, 201 bp, Homo sapiens
ctgaaggcaggaactccatcttaattttatcttggctgaccccagcactttgcacagtactgaggaacaagtgattaatgaataaataatttccttcttayatcctcaaggatagcaaccttttttagtcattcgtttgcccagagctctagaactaggaatgaagaaactgatattagcaatatctgagacaaaaattga

SEQ ID NO: 32133 - DNA, 201 bp, Homo sapiens
tgtaatataattgaagcagtcatacttaagccgcttaaacagcaatattaaaacttcccacatggaataaaatacctgacttttcactattttaaaatatytgtagcatttttcagttttggcaagatgcagaatcgatcttaaggtcccctcaagatccacaatcagcataatttcctctatggcagcggggtgctttag

SEQ ID NO: 32134 - DNA, 201 bp, Homo sapiens
tccactaacagtacaatgtagatttcccatttctcagtcatgctactaaatagaaattgactcctccaaagatagtgaccagcattattatttccttcatkgcagtgggagagctctgagttatgcctaatgatagattagagggaattcttcagagtagacttttcacagttaaagaaatccatctgtttaccagggaag

SEQ ID NO: 32135 - DNA, 201 bp, Homo sapiens
tgggaggccacgaaggaccttctctgccctgccaaggaatctacactttatctgaggccacagagagccattaaataccacttaagtgatactatgtgtaktgttaaatgatccacctagaattgagttcctaacgtttattgttcaaataatgcttctgctagactccactaacagtacaatgtagatttcccatttctc

SEQ ID NO: 32136 - DNA, 201 bp, Homo sapiens
tcgagaaggatattaggagctctctcaggaactggggaagtgagcaagtgtacatttcttattatatcacagtatcacaagagttaattcagtctcccatrttcatggagagactgactgtgcttggcattccttttctaattttcctagacacagccactcagtattttaaaaatgcatttttccaggtagctactacca

SEQ ID NO: 32137 - DNA, 201 bp, Homo sapiens
aaggaaaatctgaaatgtgctagtatctgaatttcggaagaaatgtagcttggttttagatagctgttaggaaatatcgccatctaatggcttttgcatcraattgcagataacagttcctgaaggactccataaaagaccccataagacgcctaaggacttcataaaatgaagactccataaacttggtccaatagattt

SEQ ID NO: 32138 - DNA, 201 bp, Homo sapiens
cagagtgtgatatgtagaaaacctaattataattttaagtgctcattttgttcatcaaccatcgttaaaacaaaaatagtatcttgttacaaataaacttmtttagtgtattcatttatgcatattttgattattgacttaagtcagtaactgttagaatgaagtttaaaaatccgtaaattcagagaggaacttcttttc

SEQ ID NO: 32139 - DNA, 201 bp, Homo sapiens
ataaaaatatttagaatagtttgctactgctctaccttacaaattaatcaatgaatgtagtaagatgaatatgtaaataagagattgcagtgagagaaggyactgtgtggatggtttgttatgtatctttaaatcttttagtggacatttttcatattaacatggacacttaggtaactattagttaataattatttattt

SEQ ID NO: 32140 - DNA, 201 bp, Homo sapiens
agaaaaagaatgggatgcaacacgtttttttgagtatactactgatttatacatgtataaatctaagcaatcattaataataagcttatatagttcggggwtttgaaaataagatggaaaaattgcctattgagtagtgttcgctactcaggtgatggtacaaccaaagcccaggctgtttttttgtggtacagcaaaagc

SEQ ID NO: 32141 - DNA, 201 bp, Homo sapiens
gaccatcctggccaacaaggcgaaacctcgtctttactacaaatataaaaataagctgggcgtagtggtgcgcacctgtagtccctgctactcaggaggcygaggcaggagaatcgcttgaacctgggaggcagaggttgcagtgagccgagatcacaccactgcattccagcctggtgacagagtaagactccgtctcaa

SEQ ID NO: 32142 - DNA, 201 bp, Homo sapiens
agatgaatatgtaaataagagattgcagtgagagaaggtactgtgtggatggtttgttatgtatctttaaatcttttagtggacatttttcatattaacayggacacttaggtaactattagttaataattatttatttttataatttaataaaaatacatagggaccatttagaaaattaagagtcatttaaccagctgc

SEQ ID NO: 32143 - DNA, 201 bp, Homo sapiens
attataggagtgagccactgtgcatggccagagttcaacgtttcttatgaatcactttctattattatcaagtttatgatcttgagtggttaaaatgacartgtggttttcagatataggggaatatattggcattttatttgcattttgtatttggttaaaaatggtagtttttgtttttgcttaaataatttctagatg

SEQ ID NO: 32144 - DNA, 201 bp, Homo sapiens
ggagaatctgagtcacggaaatgaaatgcagtaattcgtgtgacaaaatccaagaacttagcccagataatgccatcagaatggagaggtttacttgcatyatagacatttagataaaagtgatgggtttaggggagaactagacacaggctgtgagagaaggtatctaatccagcgccatctttttttctgcctcagggg

SEQ ID NO: 32145 - DNA, 201 bp, Homo sapiens
caagaatcagactcttaagtagatgcctgtagctcccagaaataaacagcagcatcagtctatgtgtatagcaacagactgagaggtagcagcatgataargatggatggtctccatagagaactagaaatttaggtattttatcagagaccataaagagaaagttaaaaggaagtatagtaatttagccttcatatctaa

SEQ ID NO: 32146 - DNA, 201 bp, Homo sapiens
acaaaaagagagaggaagaaaagaggctgaccagtgaatgttatttatgagggctggtaagcaacattgcttaacttaatgtcagatgtttttgacattgytctaagttgtgcatgaaagaaattacaaggcctcagaattatttgcccaagtgtattctttaaatatttttttctgcctctctgtttttttatactagga

SEQ ID NO: 32147 - DNA, 201 bp, Homo sapiens
aaacgtgggcttctaacacaagattaaaaacattcataggaatttgagctgttggatcttggcaaaaatgaaaaacaatgagacatttgatgcatttagaktatatgaatagaaaaacagacaatagattaaaatcaacattatacaaaaaaatctctcgatgattttctcaattaaaatttaagaacatgacttgtctac

SEQ ID NO: 32148 - DNA, 201 bp, Homo sapiens
tgagcccacaggaatagaacaaaaagagagaggaagaaaagaggctgaccagtgaatgttatttatgagggctggtaagcaacattgcttaacttaatgtyagatgtttttgacattgctctaagttgtgcatgaaagaaattacaaggcctcagaattatttgcccaagtgtattctttaaatatttttttctgcctctc

SEQ ID NO: 32149 - DNA, 201 bp, Homo sapiens
gctttagcacctgcctgcggctcagctgctcagccacatgctcccaaaggtaccagcagcagaaattctcctatgaaaatgtgtcaactgaaacgcttatratttcactctgaaataaccttttaagactggatctgcttttcaatcacctcaactcaattcttttaatatttattgagggacttgtatagcccagacatc

SEQ ID NO: 32150 - DNA, 201 bp, Homo sapiens
tgttctgggtgacagccctgagcccacaggaatagaacaaaaagagagaggaagaaaagaggctgaccagtgaatgttatttatgagggctggtaagcaasattgcttaacttaatgtcagatgtttttgacattgctctaagttgtgcatgaaagaaattacaaggcctcagaattatttgcccaagtgtattctttaaa

SEQ ID NO: 32151 - DNA, 201 bp, Homo sapiens
aatttcactctgaaataaccttttaagactggatctgcttttcaatcacctcaactcaattcttttaatatttattgagggacttgtatagcccagacatytttggcatgtgctgggtatgaaaacatgtctaaggccctgccactatctttctggaactcaccgtctctattagtctgttctcacactgctataaagaaa

SEQ ID NO: 32152 - DNA, 201 bp, Homo sapiens
cctaagagagtctttttggtctctactcagtgttatattttgttctgggtgacagccctgagcccacaggaatagaacaaaaagagagaggaagaaaagargctgaccagtgaatgttatttatgagggctggtaagcaacattgcttaacttaatgtcagatgtttttgacattgctctaagttgtgcatgaaagaaatt

SEQ ID NO: 32153 - DNA, 201 bp, Homo sapiens
atatgagaggatatacataggttatatgcaatttctgtgccatttcatatagaagacttgattgtctgtggcttttcatctctatggagggtcctggaacsaatactccatggatactaaaggatgattgtattccaaactctgaaaaagaaatcctagatctgaaacacttccggccccaagcatttcagataagggata

SEQ ID NO: 32154 - DNA, 201 bp, Homo sapiens
ttttatttttgtgactgaattcaaagagcagtagaaacaatagcaactatttgctcctcaaactaatatactagcaaagatgccattagtaattcaaagtrgtttctgaaagacattctatgcagtggaaataagggatgagattttagatagtacttaggacgccaacaaggcttccaagattaaattgtgctttctgaa

SEQ ID NO: 32155 - DNA, 201 bp, Homo sapiens
aggagtgagagatcctgtaatgtatacttcttgtctatgtggaacttgtctgttttctttataacttcaaatatatatcccaccatctcctttgatcctgyaagccacatccctttgtttgaaaaaaaacaatgattgtttcattttttatttgaccaaaagttatcacaccccccgtaaatggctatatggttttgtgtc

SEQ ID NO: 32156 - DNA, 201 bp, Homo sapiens
taatgtctcctgcttatgttttacttaagaagaccctcattacttagtatgtatattcagaagtccttagatccagagacaggagtgagagatcctgtaaygtatacttcttgtctatgtggaacttgtctgttttctttataacttcaaatatatatcccaccatctcctttgatcctgtaagccacatccctttgtttg

SEQ ID NO: 32157 - DNA, 201 bp, Homo sapiens
gcaggggtaaccagctcgttctgttcccagaataagtgattatatagctttgaaaaaagaaaaaataaaacacttaatctctccaaaacatttatcaaaawataatgtctcctgcttatgttttacttaagaagaccctcattacttagtatgtatattcagaagtccttagatccagagacaggagtgagagatcctgta

SEQ ID NO: 32158 - DNA, 201 bp, Homo sapiens
cattaaatatagtatgtaatatataaaacattgatattaggtatattaaatataatactatttaaaatatagtcttcctgactgggaaaaacaaatttctraagtaaaattcaatagcatttttttcccctgaggatgacaaaaaatgtcctcaacaattcagttaacaccattttttgacaatttatacaatagagtcca

SEQ ID NO: 32159 - DNA, 201 bp, Homo sapiens
aacagacgtgaggaaaatatttattgaagaacaacatgatgtcaagtttttcagtaaacccttggtttgatattttttcctgaatagaagtcttaaagatktggccttaaagacttctgcccaattagatcactcattccatgtacatatgcagatagtggcacacaacgcagtttgcttgcatgaggtaggagtccatat

SEQ ID NO: 32160 - DNA, 201 bp, Homo sapiens
ccagtccagttcccacttcctcccctcgaccccagtattctcatcaatcctggcacatgtagtttgccgatttaatgatgccgcagcagtgttagaatagrgagttgatgatagcatttgcttgtttccatgtgttttgtagttaataaagtttcataatttaagtaatattgtgcttttggctattccttttatcttaat

SEQ ID NO: 32161 - DNA, 201 bp, Homo sapiens
ctggctgaaattgtctgagcaggaatggaaagtgattgggttgggtaaacaggagcccatgataggaggatggcagaagccagagaaggaaattttatttwaaaaaaaaaaacaaaacagaacaaaacatgggaaccagtggggtttgtgtggtctgagtaagctttgtggccttattgtgggcatcatttatccataaaa

SEQ ID NO: 32162 - DNA, 201 bp, Homo sapiens
cttactttgtggctcaggtgcttgatactacaaggtatgcaaaataagtttgttacggattgcttggatctttttaaaaaactcctacaaacccagatttyactttgtattagtattttagcaagaggtataatgttgaactgttgcttctttaaaacgtagttgcaaactaccctaaactaacttaataaatatatacta

SEQ ID NO: 32163 - DNA, 201 bp, Homo sapiens
cttataatgtctttgttagattttggtatcaatgtaaatctagcttcctaagtaggaaattttctcttctgttttctgaaagaatttgtgttaattctacrttgtttctttttcaaatatttgatagaatttatcattgaaaccacgagcctagagttttatcctataggaaaggtattttgttatgaattcaatgtattt

SEQ ID NO: 32164 - DNA, 201 bp, Homo sapiens
agagattttaatatcacaaggccctgctataaagatctttgtctctgcattgaatattcaaagacattttaaaatccaaaagccaagtatagctttttttyccctctctctctcttgaaatgcctccttcttgagagcagtggatacttcatggtcttgtttcaaaggggctgaggggtgtaggaagcccttcaagtaaaa

SEQ ID NO: 32165 - DNA, 201 bp, Homo sapiens
ccctattccctaagctcctaacccgatgtagttttcttcttagcatttaacattctctgaaattatgtttttcacttgcgggtatgcttttttattctttstctcctccatggtggcagaaatgttctccctcacttttaggtctgcagcaccaagaatggtgcttgaaacagtaggcttgcgatcaattgtttggggtaa

SEQ ID NO: 32166 - DNA, 201 bp, Homo sapiens
atatgttttcacagcacatgtggtgctgttatactccgaaccaatctaatgggctttaattatgccaaggtctgtggatcccggagatgctgacaaattcrtaatgtgttttaaattgctaggatggaaagtacaaatcaaaagtttaatctggagtagtgtttagaaaataatttcctttgctaagatgccacctgtcat

SEQ ID NO: 32167 - DNA, 201 bp, Homo sapiens
actgggtaatttataaagacaagagtcttaactggctcacacttctgcaggctctataggctggggaggcctcaggaaacttacaatcatggcagaaggcraatgggaaggaggcatgttttacgtggctggaggaggagcaagagagcaaaggggaagtgctacacagttttaacaaccagatctcgtgagaactcacta

SEQ ID NO: 32168 - DNA, 201 bp, Homo sapiens
gactacaggcacccgccaccacgcctggctaattttttgtatttttagtagagatggggtttcaccgtgttagccaggatggtcttgatctcctgaactcrtgatgcgccctcctcgatgtcccaaagtgctgggattacaggcatgagccaccacgcccagccaggactatctttaacttccccacactttcacttcccg

SEQ ID NO: 32169 - DNA, 201 bp, Homo sapiens
aaggaaagaacatggatggcctttggtctttcattcagcaagtgttctcacttattttttctaatgtaacttcagcattttttacctcactcaagggtcayagtaattattaaaacagtcatcggccgggagcggtggctcacacctgtaatccctgccctttgggaggccgaggtgggtggatcacctgagttcaggcgt

SEQ ID NO: 32170 - DNA, 201 bp, Homo sapiens
cacaaaattatttaaaatattttataaaatttccttcaggctatgtgtgtaaggtgtgtatgaaacatagatgaatttcatttttagacttgggttctatyctcaaaatagctcatgtgtatgcagatggagctggtcctctctatctgtgggttctgcatctatggattcaaccaactgtatattgaaaatattcagaaa

SEQ ID NO: 32171 - DNA, 201 bp, Homo sapiens
attcttgcaatgacaaaaccatagagatggaaaacaaatttgtggttgccacgacttaaggatgaggggcagacagagggatgtgggtgtgctcatgaaarggtaacaggagggatctttgagataaaggaattatcctctattttgactgcactaatgttgctatcctggttatgagattgtactacagttttgcaaagt

SEQ ID NO: 32172 - DNA, 201 bp, Homo sapiens
gaagcacatacttttaggaaaacaaacataaaagttttaagggaaaaaaaatcagaaaaaaatctttgggatcatagagttcttaaacttgacaccaaaaktatgtctataaaagaaaaaattaggctggacgcagtggctcacacctgtaatcccatcactttgagagactgagacaggtggatcacttgaggtcaggag

SEQ ID NO: 32173 - DNA, 201 bp, Homo sapiens
ctatatgattccatttatgtaacattcttgcaatgacaaaaccatagagatggaaaacaaatttgtggttgccacgacttaaggatgaggggcagacagarggatgtgggtgtgctcatgaaaaggtaacaggagggatctttgagataaaggaattatcctctattttgactgcactaatgttgctatcctggttatgag

SEQ ID NO: 32174 - DNA, 201 bp, Homo sapiens
tcacacctgtaatcccatcactttgagagactgagacaggtggatcacttgaggtcaggagttcaagaccagcctggccaacatggcaaaaccctgtctcyattaaaaaatacacaaattagccagctgcttgggtggctgagacaggagaatcgcttgaacgcaggaggtggagattgcagtgagctgaggtcatgccac

SEQ ID NO: 32175 - DNA, 201 bp, Homo sapiens
atagaggtgaacaatgaaaaatgaaatatgttacactaaataaaattttgttattatccgaattacttaaaattgagaatagtctgcctaataaaccagaygtcaaacatattaaaataaaagtgatacaatgaaaatgatgaaagttcttcatatataatactgttgagggaagagggagagaaattttctttaaagaaa

SEQ ID NO: 32176 - DNA, 201 bp, Homo sapiens
agaaagtaatgaaactgaaaacaggacaatagaaaaaatggatccaaaagctggtttttaaaaaatagcaataaagttgacaaacctctaaaacaactgamaaagaaaaagagaagatacaaattacccataccaggaatgaaactacttatcatggcacaccctgctgacgtcaggtgataacatgggatttttttcttc

SEQ ID NO: 32177 - DNA, 201 bp, Homo sapiens
caggttcacgccattctcctgcctcagcctcccgagtagctgggactacaggcacccaccaccacatctggctaattttttgtatttttagtagagacagkgtttcaccatgttagccaggatggtctcaatctcctgacctcgtgatccacccgcctcggcctcccaaagtgctgggattacaggcatgagccactgcac

SEQ ID NO: 32178 - DNA, 201 bp, Homo sapiens
cagaaaggtaactggaaaatctccaaactcttagagatactaaacaacacacttctaaataatctatggtttgaggaagtatggggagaaatttaaagatkcattaaactaaaagaaattggacacatcacatttgaaaatttttgccacagctaaagcaaggccaagagggaaatttctaacactcaatgcttacattta

SEQ ID NO: 32179 - DNA, 201 bp, Homo sapiens
agcctcccgagtagctgggactacaggcacccaccaccacatctggctaattttttgtatttttagtagagacagggtttcaccatgttagccaggatggyctcaatctcctgacctcgtgatccacccgcctcggcctcccaaagtgctgggattacaggcatgagccactgcacctggtctataatttggtatcttgtt

SEQ ID NO: 32180 - DNA, 201 bp, Homo sapiens
aataatagatctaccaaggtttgtagactactccacccaacgacaaggtacacactcttttcaagtgttcatgaaacatttgctaagatggaacatatccygggccataaaataacctcaagacatttttaaaagttgaaatcatacacatttttttatcacattgttatcaaattagaaagcagtaacagaaaggtaact

SEQ ID NO: 32181 - DNA, 201 bp, Homo sapiens
agctgggactacaggcacccaccaccacatctggctaattttttgtatttttagtagagacagggtttcaccatgttagccaggatggtctcaatctcctsacctcgtgatccacccgcctcggcctcccaaagtgctgggattacaggcatgagccactgcacctggtctataatttggtatcttgttgtcatgaagagt

SEQ ID NO: 32182 - DNA, 201 bp, Homo sapiens
aggaatcagacacactggctgtctttatgctcctcaagatgtctaaagggtcctttattaatgtctcctctgtttattaaagtcaattggatgtttgcatygctgacctgcttttttgctcctcgttcctttagtcagcgttgactgaagccttactctgggtatgcacttaggggaaacacaagtgaaccctgcctttca

SEQ ID NO: 32183 - DNA, 201 bp, Homo sapiens
atcactaactcatttgcggtaatcgttttccattttttttcaagatttaaaatcattcagacagcatttgactaaggaatctgacacacatttaatgtaasaagctattccaactgcaaaaacataattattagaattttatttctgcacatctgctggctttgtaatgtactccccatgttgaaacctaagaatgctttc

SEQ ID NO: 32184 - DNA, 201 bp, Homo sapiens
actgcaaaaacataattattagaattttatttctgcacatctgctggctttgtaatgtactccccatgttgaaacctaagaatgctttcatgtttgacttycacatggatcatttcagtgtaggcccaggggagacactagtctgccactaagaaaatacggttggtacgcaatgaatggagacatgttttcagtgtacgt

SEQ ID NO: 32185 - DNA, 201 bp, Homo sapiens
agagacagagcggcagtcttcccatatctcagccagtttgggtgacccaagaggccccatggggcagaccagaggggccctgttccagtcctgggtcagcrccagtgaaagtcaaggtgacctcagcattgttaccagttatccacaagacagccacgtgaatcacagaatcttaaatcagagggcccaacaccctaatgg

SEQ ID NO: 32186 - DNA, 201 bp, Homo sapiens
gtggtttaccatgattgtgcctgtgaatagctactgacctctgaggcaagttatgctataaaagtgcttggaacagtgcctggcacatagtaagcacccaataaatgtcaccttatgttattttttaaaaaaacatgagtactgggcttgtttgagacagagatagcatcttcagtggtggggcctggctgtgtgtttctt

SEQ ID NO: 32187 - DNA, 201 bp, Homo sapiens
aaattcaaaggaatagaaattgcacagaccacagttttggaccgaaatacaataaaactaaactcatattaaaaatataaacaggccgggcgcggtggctyatgactataatcccagcactttgggaagccgaggcaggtggatcactcggggtcaggcattcaagactagcctggccaacatggtgaaaccccatctcta

SEQ ID NO: 32188 - DNA, 201 bp, Homo sapiens
agagactgaggaagcatagggcaaggcctcagggagatggaggacctcctccccctggtgcagtgctttggtttggcttcgagcatccctgtcaagttatstttctgcgcctcgcagcagcttgtgagttagggcacgggcaattttttacagctaagggtgcggggggggggacgttcagaaaggggacttgaattgctc

SEQ ID NO: 32189 - DNA, 201 bp, Homo sapiens
aataaaactaaactcatattaaaaatataaacaggccgggcgcggtggcttatgactataatcccagcactttgggaagccgaggcaggtggatcactcgrggtcaggcattcaagactagcctggccaacatggtgaaaccccatctctactaaaatataaaaataagctgggcgttgtggcaggtgcctgtgatcccag

SEQ ID NO: 32190 - DNA, 201 bp, Homo sapiens
gtagtatattaactattgtttgtgttgccttatttcttcatctggactatgaactcctttaggacaagaactacctacttaaaagtgtgtatcttgccagrtgcagtggctcatgcctgtaattccagcactttgggaggccaaggtgggtggatcacctgaggtcaggagttcaagaccagcccggccaacatggtgaaa

SEQ ID NO: 32191 - DNA, 201 bp, Homo sapiens
gccctgggcctgtttacctgttagagtgagccacacaagaaggaattcaacgtggcagagctcttgccagagggagctgaccatcttcaaatgttaaaaaaggtagacagaagagagcccttagcccaacccctatggttttgagggacttgatttgcattcaccttgcttggacactgaaccagctgaggaaggagtttc

SEQ ID NO: 32192 - DNA, 201 bp, Homo sapiens
aaaaaaaagtacacttctaactatttgatcaggaacacgtaaaaaatattgccagatacttagaaaataaagacgttgcaaatcaaaacttagagaatgtyagagaatgtggctaaaactggaagagttaaattcctttttttttttgagtcagggtctcgctgtcacccaggttacagtgcaatggcatgctcacggttc

SEQ ID NO: 32193 - DNA, 201 bp, Homo sapiens
atgggaagtaacgggactaacagttggatggaaaaccacaatccgactgggtgcattggctcatgcctgtaatcccagcactttgggaggccaaagcaggycgacatggtgaaaccccatctctactaaaaatataaaaattagccaggcatggtggcacatgcctgtaatcccagccacttgggaggctaatgggggaga

SEQ ID NO: 32194 - DNA, 201 bp, Homo sapiens
cagatctgagatcgtgccactgcactccagcctgggtaacagagcaagaccccgtctcaagaaaaaaaagaaaaaaaatgaaatacagatagtactaaagsaaatggcgtatttttaagtatatttttaatctcatgcatagaaaattagtgagtggaatgggggcagggtggcaaccagaaaatagatttgtggagcact

SEQ ID NO: 32195 - DNA, 201 bp, Homo sapiens
agaaagaagagaaacacagaggaggagcactaaatgctgttcatgaactctgcccacatcttgcgtgcagccatattaattgcctgtgtaaaattttaaartccacacttttcagaaaaacataatgcaatccagattctctacagcatattaatttttcttttttttcttttttatttttttattttgagtctgagtttc

SEQ ID NO: 32196 - DNA, 201 bp, Homo sapiens
ttgaggctgggatgcggaggttacagatctgagatcgtgccactgcactccagcctgggtaacagagcaagaccccgtctcaagaaaaaaaagaaaaaaaatgaaatacagatagtactaaaggaaatggcgtatttttaagtatatttttaatctcatgcatagaaaattagtgagtggaatgggggcagggtggcaacc

SEQ ID NO: 32197 - DNA, 201 bp, Homo sapiens
ctgagtttcactctgtcacctggactggagtacagtggtgcgatcttggctcactgcaacctccgcctcccgggttcaagcgattcccttgcctcagcctyctgagtagctgggactacaggcgcgcgtcacacaccgtctaatttttgtagtagagttggggtttcgccatgttggccaggctggtcttgatctcctggc

SEQ ID NO: 32198 - DNA, 201 bp, Homo sapiens
aagagttaaagatgtaaattatgtaaagtataattctagagtaactttttttcttcttctgagacagggcctcactctgtcatccaggctggaaggcagtrgcacaatcatggctcactaaaccctcccaggctcaaccaagcaatcctccctccctgagacctcctaggctcaagcaatcctcccacctcagcctcccat

SEQ ID NO: 32199 - DNA, 201 bp, Homo sapiens
tgctaggattacaggtgtgagccaccatgcccagccaagagtaattatttttttaaatgcaaagagatatagctaaaaagccaatatataaattaaaattkatttctaaaaatatttacttagtctaaaaatattacttagaataagaaaagaagaagagaacagcagcaaaatgatggaacaaatagtaaaatgatagac

SEQ ID NO: 32200 - DNA, 201 bp, Homo sapiens
cttgagcacaagagttccaggctgcagtgaactgtgattgtgccactgcactccagccaggggcacacagcaagaccctgtctcaaaaaaaaaaaaaaaaagaatttataattccaccaccaaaacataatctctgttaatatttatagtttcctttgttttttgtttattacattatatttttatgtagctgggatcaaa

SEQ ID NO: 32201 - DNA, 201 bp, Homo sapiens
accttcctgtgcctatagtcccagctacttggaggctgaggtgggagaatcacttgagcctgggaggtcaaacctgcagtgagctgtgatcacaacactgyactccatccagcctgggcgacagagtgagatcctgtctcaaaaatcaaataagtaaaagacttatatgctgaaaaactgtaaaacattgttgaaagaaat

SEQ ID NO: 32202 - DNA, 201 bp, Homo sapiens
ataagaagcaaaagaggatttagtcagtgatttgggacaactgatacagtttttgcagttttaggggagtaacttaaaattttttttaagtagaaaaaaaygtaaagtatttatcagacctcaggaagggcagtggtctgtttaggcttaaaagtgatagataatgttataaaagaaagaatagccacctttattaatgta

SEQ ID NO: 32203 - DNA, 201 bp, Homo sapiens
aaaacatttgtagaaatggctttccttttgttgatgattttagccagcttggtgataaggtaaaacatagctttcatcttaactttcattttcttcatatrttttcttcttttctactgttagctgatgtttgtattttcagcttcagttaatacgggacactttaccaagaaataatgttactggtagacggtcttgacc

SEQ ID NO: 32204 - DNA, 201 bp, Homo sapiens
gggaggcggaggttgtggtgagccaagattgcaccattgcactccagcctgggcaacaagagcaaaactcagtctcaaagataaataaataaataaatagkttaattttttaaaaaagcatttaactatggttatatgcagtaacatatgaatctcagaagcattatgttgagtgaaagaagctagacatgagactacgta

SEQ ID NO: 32205 - DNA, 201 bp, Homo sapiens
tgtcagttgcttaaaaaaaactaaacttgtagctaccatacagcccaacaattacacacctgggtgtttatcctgagaaatgaagatgtaacgttcacacagaaatttgtccacaaatgttcatctcagctttattcatgtcaccaaaaattagaacacccccaatgtccctcagtagttacatggttaagcaaattgtgg

SEQ ID NO: 32206 - DNA, 201 bp, Homo sapiens
ttgtcagttgcttaaaaaaaactaaacttgtagctaccatacagcccaacaattacacacctgggtgtttatcctgagaaatgaagatgtaacgttcacacagaaatttgtccacaaatgttcatctcagctttattcatgtcaccaaaaattagaacacccccaatgtccctcagtagttacatggttaagcaaattgtg

SEQ ID NO: 32207 - DNA, 201 bp, Homo sapiens
acttgaagtcgggaggtggaggttgcagtgagccgagatcgcgccattgtactccagcctgggggacaagagtgagaccccatctcaaaataaataaatamataaatattttaaaaaataaatgaaaaataaaagtgtccaaattagaagtaaaaacttgaagtagccccattttttaaaaggcatattgtcccacttacc

SEQ ID NO: 32208 - DNA, 201 bp, Homo sapiens
tgtgcatcttgttccttaggctggcagggctaggatacctatttacaaatcagaataatacaaagactgataaggttgccaatcttgtagagcaaaaattwttttctgggctatgctagaaacttgaccccccctccccccggttatcttatgaggcagatattaatactacccaccctttacaaaggaagaaatagaatc

SEQ ID NO: 32209 - DNA, 201 bp, Homo sapiens
tttgggaggccaaggtgggtggatcacctgaggtcaggagttcaagaccagcccggccaacatggtgaaaccccgtctctactaaaaaaataaaaaataaaaaaattagctgggcgtggtggtgggcgcctataatcctagctacacaggaggctgaggcaggagaattgcttgaacctgggaggtggagggtgcagtgag

SEQ ID NO: 32210 - DNA, 201 bp, Homo sapiens
ctttgggaggccaaggtgggtggatcacctgaggtcaggagttcaagaccagcccggccaacatggtgaaaccccgtctctactaaaaaaataaaaaataaaaaaattagctgggcgtggtggtgggcgcctataatcctagctacacaggaggctgaggcaggagaattgcttgaacctgggaggtggagggtgcagtga

SEQ ID NO: 32211 - DNA, 201 bp, Homo sapiens
gctgatctcaggctgctgagagcgctgtgtaagttcaaagaatcattaagtgggacaaatactatctgtagacaggtctgttaaatcattcctttactcaragacagcaagtccagcatgggtaggtgccatgaagacagataagagttatatgatacagtccctgccttcaccaaattataagctgggtaggaagctatt

SEQ ID NO: 32212 - DNA, 201 bp, Homo sapiens
acagaacaaattccgaaggtgacctgagaagaccaaatggataagctaatacatccaggtgtctccgattatattatgataaagtgtagggaggttgaackttacataaataccactggatatttttctttgttagatgtggccccatggtattggatgctttaatcaagattaagaatgaagttgactctactttgacct

SEQ ID NO: 32213 - DNA, 201 bp, Homo sapiens
ataaaggatcttgttcccgtgagtttctgcatctctctggttttgtttttatttgcatggggggcagtgctatgtgtgttacgctattagtttttcagggmaggatttgtttgagtatttaaggctcctcttctagtcagatagtaaatagatgggactgtttcctatattatggcaggaggaggaccacagtgtcactga

SEQ ID NO: 32214 - DNA, 201 bp, Homo sapiens
tttcttcctctctatttccccaccttcttctctggcctccaaatctttatccactccatccaactccaagcctgcaccctaaggacactttactggaggarcaacaaccagccttcagcaccattcagaattcacccttctcagttcagttgttgcttaccttgcttaaattataaactatgaaattcatactatccaaga

SEQ ID NO: 32215 - DNA, 201 bp, Homo sapiens
tccaaggatgtgaaaagcatgtccctaaatcaaatcaagaactctccttcaatagctggctttcacagagatactcacttattaaggtcaacttcataagrctgcatatgaggtttgtctccagccttgtctgggtcccatcgatagatggcaaatttcttgatacggggagctgtggctgcagctgtctgggctcctcgg

SEQ ID NO: 32216 - DNA, 201 bp, Homo sapiens
acattgctttgtcaaaactcattatacccttaaaattagtgaattttattataatgaattataccttattaaatctcacagaaaaaagaccaaaaaaaaaatgggacattaagcaagcaaagtccactggagttgataccttcaggaatctttcctctcacttcctcccaaataccacaaggtggcattagatgttcatgt

SEQ ID NO: 32217 - DNA, 201 bp, Homo sapiens
atatagtctcattgtatgattagagcaacaacttcttttgttccttggatctcattgtgaaatggaattatctttttgcactgttgcgttttatgtttgcrttttcaccactggttataatggctaaaaggttggatttttgaatcaagtgacctgtgttgctatatgatcctatcctcgtcttttaactgggaacaacaa

SEQ ID NO: 32218 - DNA, 201 bp, Homo sapiens
agtgacctgtgttgctatatgatcctatcctcgtcttttaactgggaacaacaaaacatttttcatagagatgttataaagattagagattatttggcacygtgtgtgacagattataaaggttcgatgaatgaaatctggcaaatttttagatatatgtattcaacgaattttttggtggaacacagataacataatcct

SEQ ID NO: 32219 - DNA, 201 bp, Homo sapiens
tttctctgtcccagtatgatctgcaggattactttttacctttgatttgaatttatttatttatttatctatttatttatttatttttttgagacagtctygctctgtctcccaggctggagtgcagtggtgcggtctcggctcactgcaacctccgcctctggggttcaagcaattttcctgcctcagcctcccaagtaa

SEQ ID NO: 32220 - DNA, 201 bp, Homo sapiens
cccaagtagctgagattacaggtgcccgccatcgtgcctgtctaatttttttgtatttttagtagagacggggtttcaccgtgttggccaggctgatctcraactcctgacctcaggtaatccacctgcctcggcctcccaaagtactgggattacaggcatgagccaccacgcctggcctataaaatacatttttgacac

SEQ ID NO: 32221 - DNA, 201 bp, Homo sapiens
ctgtaaaacattgttgaaagaaatttaagaagacataaataaatggaaagacatgccctgtttgtgggttggaagacttaatgttgttaaggaggcagtgktctccaaattgatttccagattcattgcaatccccatcaaaatcccacctgccttttctgcagaagttgacaagttgattctaaaaatcttatagaaatg

SEQ ID NO: 32222 - DNA, 201 bp, Homo sapiens
attacaggcatgagccaccacgcctggcctataaaatacatttttgacacaaaacaaatttaaattagttgtactgaaaaaaaaaaaatgatgacattttrgggcactccaaaactgatgttgggatatgtcgacttagatattcagtgtagtacatcctggcattgctcttatttcacatcattcatatgataagacttt

SEQ ID NO: 32223 - DNA, 201 bp, Homo sapiens
taaaagacttatatgctgaaaaactgtaaaacattgttgaaagaaatttaagaagacataaataaatggaaagacatgccctgtttgtgggttggaagacytaatgttgttaaggaggcagtggtctccaaattgatttccagattcattgcaatccccatcaaaatcccacctgccttttctgcagaagttgacaagttg

SEQ ID NO: 32224 - DNA, 201 bp, Homo sapiens
ggatatgaaacagatatttaaatgttataaagaaatgttgaagggaaaacctcattgcaggtaaccacagtcatcccacaggccttgtggttctgataccsagcttgatagagcctaatgcctgttgcccactgacaatactaaatcaggctttagaactagggggttatgcctggcacagtggctcacacctgtatgtaa

SEQ ID NO: 32225 - DNA, 201 bp, Homo sapiens
aggctgaggcaggtggatcacgacatcaggagttcaagaccatcctggctaaaacggtgaaaccccatccctactaaaaatacaaaaaagttagccgggcrtgtgacacgcgcctgtaatcccagctacttgggaggctgaggcaggagaattgcttgaacccaggaggcagagagatctcgccactccactccagcctgg

SEQ ID NO: 32226 - DNA, 201 bp, Homo sapiens
gaccctgtctctacaaaaattagctggacatgatggtgtgcacctatagtcccagctacttgggaggctgagtcaggatgatcgcctgagcccaggagttmaaggctgcagtgagccatgatctccagcctgggcaataaagctagaccatgtgtctataaaaataaaaaataaaggccgggcaaggtggcctgtacctat

SEQ ID NO: 32227 - DNA, 201 bp, Homo sapiens
ttacaaatcagaataatacaaagactgataaggttgccaatcttgtagagcaaaaattattttctgggctatgctagaaacttgaccccccctccccccggttatcttatgaggcagatattaatactacccaccctttacaaaggaagaaatagaatccgaaaagctaataatttgcagaagaatacacagcttgtaagt

SEQ ID NO: 32228 - DNA, 201 bp, Homo sapiens
aatatccagtctcttggggaactctaggagtatttgcttaagacacatctttgggttcccttacactctttctaagatttacaggagaaggagagtcttaytgtcttttctagtcttatgaaagtgataaccgactgggcgcagtggctcacgcctgtgatcccagtactttgggaggtctaggtggtaggctagcttgag

SEQ ID NO: 32229 - DNA, 201 bp, Homo sapiens
aaccccgtctctactaaaaatacaaaaattagccaggtgtggtggcgggcgtctataatcccagctactcaggaggctgaggcaggagaatcacttgaacscgggaggcagaggttgcagtaagccgagatcgtgccactgcactccagcctgggcgacagagcaagactccatctaaaaaaaaaaaaagatgataaccag

SEQ ID NO: 32230 - DNA, 201 bp, Homo sapiens
cgggtgagtagtgtgaacccgtgaatggcccagagtggaccaaggagctagagccctgtgccccgcctgcaggggcgggtggttgctgtgtggctactccmtctttttcaaaagaaaccagtatgtaaattgcctgggctttaaaaagtgaccactaagtcagaactgttccctcactgggggcaaaatgaaacacatatg

SEQ ID NO: 32231 - DNA, 201 bp, Homo sapiens
taacttacactttgctttctactgcttcagatgtatgcaccatgcgccataaaaccatttcactgttgctggacaatgaaattgtttccaattttttactrttagaaataaggctagatgaacatctttatccttcaagttctgcccaaaacattctaatttcttattacagatttttctaggagtgggttaaagaatatg

SEQ ID NO: 32232 - DNA, 201 bp, Homo sapiens
acactttgctttctactgcttcagatgtatgcaccatgcgccataaaaccatttcactgttgctggacaatgaaattgtttccaattttttactgttagarataaggctagatgaacatctttatccttcaagttctgcccaaaacattctaatttcttattacagatttttctaggagtgggttaaagaatatgactatt

SEQ ID NO: 32233 - DNA, 201 bp, Homo sapiens
gtggcagtcactggggatgatgttgatgttcccagtgaaaacctgagggcccttctgctgagcccagggcagaagcagctacagactcctgctgcttcagyccctaggcttttgaatctctcccgtcttgacctcattccaggaagctggaatttatgggagttgtttttgtgttcttgttttctatttcttttttagaca

SEQ ID NO: 32234 - DNA, 201 bp, Homo sapiens
ctcaaaaaccaacttctctttctcattttcccacaaaaagagaagttacaggtttgtgtgaccacatgagcaatattgattcccagccatgtgaagattgrataatgaagtacactcatacttgtcacttttaccagctgctccgagttggggatgtagaggtcctctaagtaacactgctagagcaggcctatggtcatg

SEQ ID NO: 32235 - DNA, 201 bp, Homo sapiens
gtattgattatatcttatacatctggacctgtgttttctataataataacagaaccgccagaaacttgccttgaatggacaaggtagggatgtggttaaaatgttaaaaattggactggcgtgttagttttctatttctgtcagagcaaattaccacaaacttagtgacttaaaacaacctaaatgtattatcttatagtt

SEQ ID NO: 32236 - DNA, 201 bp, Homo sapiens
actttgggaggccaaggtgggtggatcacctgaggtcaggagttcaagaccagcccggccaacatggtgaaaccccgtctctactaaaaaaataaaaaataaaaaaattagctgggcgtggtggtgggcgcctataatcctagctacacaggaggctgaggcaggagaattgcttgaacctgggaggtggagggtgcagtg

SEQ ID NO: 32237 - DNA, 201 bp, Homo sapiens
cactttgggaggccaaggtgggtggatcacctgaggtcaggagttcaagaccagcccggccaacatggtgaaaccccgtctctactaaaaaaataaaaaataaaaaaattagctgggcgtggtggtgggcgcctataatcctagctacacaggaggctgaggcaggagaattgcttgaacctgggaggtggagggtgcagt

SEQ ID NO: 32238 - DNA, 201 bp, Homo sapiens
gtccctaaatcaaatcaagaactctccttcaatagctggctttcacagagatactcacttattaaggtcaacttcataagtctgcatatgaggtttgtctrcagccttgtctgggtcccatcgatagatggcaaatttcttgatacggggagctgtggctgcagctgtctgggctcctcgggaggcctgaaattttttaaa

SEQ ID NO: 32239 - DNA, 201 bp, Homo sapiens
attagctggacatgatggtgtgcacctatagtcccagctacttgggaggctgagtcaggatgatcgcctgagcccaggagttaaaggctgcagtgagccaygatctccagcctgggcaataaagctagaccatgtgtctataaaaataaaaaataaaggccgggcaaggtggcctgtacctataatcccagcactttggga

SEQ ID NO: 32240 - DNA, 201 bp, Homo sapiens
agttcaagccattctcctgcctcagcctccctagtagctgggattacaggcacacgccaccacaccctgctaattcgtttttttgtatttttagtagggayggggtttcaccatgttggctgggctggtcttgaatccctgatctcaggtgatttcccaacctcagcctcccaaagtgctgggattacaggtgagaagagt

SEQ ID NO: 32241 - DNA, 201 bp, Homo sapiens
attacaggcacacgccaccacaccctgctaattcgtttttttgtatttttagtagggacggggtttcaccatgttggctgggctggtcttgaatccctgayctcaggtgatttcccaacctcagcctcccaaagtgctgggattacaggtgagaagagtatgtggagtctcagtattattttcttctttttgttttgtttt

SEQ ID NO: 32242 - DNA, 201 bp, Homo sapiens
ggcagagagatctcgccactccactccagcctgggtgacagagtgagactgtctcacaaaaaaaaaaaaaaaaaaaaaaaaaaaagaactaggggattatrctccagtcccagattctgtttaaagcccggttaggggccaggcgcggttgctcacacctgtaatcccaacactttggaacgctgaggcaggtggatcact

SEQ ID NO: 32243 - DNA, 201 bp, Homo sapiens
acaaaaagagaagttacaggtttgtgtgaccacatgagcaatattgattcccagccatgtgaagattggataatgaagtacactcatacttgtcacttttrccagctgctccgagttggggatgtagaggtcctctaagtaacactgctagagcaggcctatggtcatgtgattaactcgtttcagcctgctgatctcagg

SEQ ID NO: 32244 - DNA, 201 bp, Homo sapiens
ttctactgttagctgatgtttgtattttcagcttcagttaatacgggacactttaccaagaaataatgttactggtagacggtcttgaccacaagtcgtcmaggtttttagcatgttgaacaaaaaattggacaaaacacacaagcaaagcaacagaagacgaaagcatagatttattgaaatgaaagtacactccataga

SEQ ID NO: 32245 - DNA, 201 bp, Homo sapiens
acactcatacttgtcacttttaccagctgctccgagttggggatgtagaggtcctctaagtaacactgctagagcaggcctatggtcatgtgattaactcrtttcagcctgctgatctcaggctgctgagagcgctgtgtaagttcaaagaatcattaagtgggacaaatactatctgtagacaggtctgttaaatcattc

SEQ ID NO: 32246 - DNA, 201 bp, Homo sapiens
gggacactttaccaagaaataatgttactggtagacggtcttgaccacaagtcgtcaaggtttttagcatgttgaacaaaaaattggacaaaacacacaarcaaagcaacagaagacgaaagcatagatttattgaaatgaaagtacactccatagagtaggagtgggattgagcaagtggttcaagagccccagctgcac

SEQ ID NO: 32247 - DNA, 201 bp, Homo sapiens
agtttggctcttagttgcaaggagtagactgactcgggccacctcaggagcaggctttatttgtaggctacacagggacattgtgggagttaaggatgcasaggaacccatgagcaggtacctgcgttcaaccttcccaggaaacagaaagcgaaagccgttggaacgtgggcagctgtgaggacttcatttcttctccat

SEQ ID NO: 32248 - DNA, 201 bp, Homo sapiens
gctagtgggtcctcagtggatgtaggctgggcgccgcgatgttcgacgggacaccggcggagagcgacctcggggttaaggggtggggctgacgtcaggarccaagatggcggcggtggtcgcactctccttgaggcgccggttgccggccacaacccttggcggagcctgcctgcaggtgagtcctggagcctcagagag

SEQ ID NO: 32249 - DNA, 201 bp, Homo sapiens
tcctcttcctgctcgcatttgctgctgcttttggctcactctggcctggattttgcctcccagcacacttccagcttcagccacccgcctgcctcccagcmcttctcagcacagtttcctgagagggtgtcgcattggcccagctcaccttctcatgcctgcacatcagaggccacagctggctacagaccggctgccctt

SEQ ID NO: 32250 - DNA, 201 bp, Homo sapiens
cacatgagcttttggggacacattcaaaccatagcaggtgtcagccctggtccagtcagccttgcccagtgggcagggaagggctagggctgtgtggttcrgaacacggctgccctccgagcaaagactgtgggtgatttcactcaaaagttgcagtgagtcagtgggcggcaaggtggaaaactgtagggtggccagtta

SEQ ID NO: 32251 - DNA, 201 bp, Homo sapiens
catagcaggtgtcagccctggtccagtcagccttgcccagtgggcagggaagggctagggctgtgtggttcagaacacggctgccctccgagcaaagactrtgggtgatttcactcaaaagttgcagtgagtcagtgggcggcaaggtggaaaactgtagggtggccagttagccgtaaaaaaagatcacactgtgtgttt

SEQ ID NO: 32252 - DNA, 201 bp, Homo sapiens
ctgatagagacatctggaaaacagctgcagctctctgctgggtgaacttgctgtgcaacctaattccttttcttgggtaaatgcatccaaaattctaaccrtggtgcaagttctggtttctgagtttactttccttcaggagcattctatcctgtggttactgcatctggcggtccctgtgagctgctccacgcttcaagg

SEQ ID NO: 32253 - DNA, 201 bp, Homo sapiens
tttcttatatcacatttatctgtattttttcacccactatattttggagattatcccatgttggtatatgaagagtgtctttttgaccagcctggacaacrtagtgagatcccatctctacaaacaaaaatttttttaattagccaggtgtggtggcacgcacctgtagtttcagttacttgagaggctgaggccggagga

SEQ ID NO: 32254 - DNA, 201 bp, Homo sapiens
tgcctcctgcaaagcagatgttaacagctgtaggggcaaactgcagctaataccaatggtattggccagttgaaatcatcatggttttacaaagggttaayagagagggtagtttcttccacatacttttgagagctggtatatgctgatttctgctgctgcctatttaataatgatgatgtaaaagatttagagatgtct

SEQ ID NO: 32255 - DNA, 201 bp, Homo sapiens
aggggcgcaaaccatgccttgcagatgtttaaaatgtatttccgtttgcctggtggtcagaggctccccctctccctctcataggatttgtaacataagayttgtagcgagcaagcaggggagaaagcagtgtctttgaagggcagctgcccagctatgagattggaagctgtttcccagctaatgaaagcctggatttag

SEQ ID NO: 32256 - DNA, 201 bp, Homo sapiens
acagccacgtgaatcacagaatcttaaatcagagggcccaacaccctaatggttcaggcaaggaaactataggtcaaagatggggaggggcttatccaagktcacatggccttgaagagaatattccaggttagacctagaggttcaggcctcactacacaccccctttaatgaggccacactggcggtatagcggggttc

SEQ ID NO: 32257 - DNA, 201 bp, Homo sapiens
caaacagggtaattggttgcattgtattcacttgctttcggtaaatctggggccttgtctgcaaattgcctttgtttcagtgcagtgagggtcaccccaarggggcgcaaaccatgccttgcagatgtttaaaatgtatttccgtttgcctggtggtcagaggctccccctctccctctcataggatttgtaacataagac

SEQ ID NO: 32258 - DNA, 201 bp, Homo sapiens
gttgaacaaaaaattggacaaaacacacaagcaaagcaacagaagacgaaagcatagatttattgaaatgaaagtacactccatagagtaggagtgggatygagcaagtggttcaagagccccagctgcacagtcttctgggattaaagtaccctgtacgggtttcctattagttacaccctatgcaaatgaagacttggc

SEQ ID NO: 32259 - DNA, 201 bp, Homo sapiens
tgtgaaaagcatgtccctaaatcaaatcaagaactctccttcaatagctggctttcacagagatactcacttattaaggtcaacttcataagtctgcatargaggtttgtctccagccttgtctgggtcccatcgatagatggcaaatttcttgatacggggagctgtggctgcagctgtctgggctcctcgggaggcctg

SEQ ID NO: 32260 - DNA, 201 bp, Homo sapiens
actgcaggcatgagccaccaccctcagaccacaccccacactccttccccttaattctggtttgtcaagcctccacttagatgacatgtgaggaagccttstctgactcttcactcattgaagtctctgctgtattcatccagagctccctgtactttcccaacagtatcactctttatattcatcgtgaatgtttaattt

SEQ ID NO: 32261 - DNA, 201 bp, Homo sapiens
ctccacttagatgacatgtgaggaagccttctctgactcttcactcattgaagtctctgctgtattcatccagagctccctgtactttcccaacagtatcrctctttatattcatcgtgaatgtttaatttaactcttgttcactacaaagtaagttctgtgaagatgaaggtttttgtgtattaagtgctgtgtcactag

SEQ ID NO: 32262 - DNA, 201 bp, Homo sapiens
gtgtcactagcccctaataccatgtctgatatattagcatatgataggtgcttaatacttgttggatattgaatgcctgccttttctaagaagattatgtrtcagtaatgtgtgagtttatatccagcgttacatctgttgtgccagcaaaatggaattatcttgtatttctaatttttttttcctttttgtgaactttaa

SEQ ID NO: 32263 - DNA, 201 bp, Homo sapiens
aggctgggcgccgcgatgttcgacgggacaccggcggagagcgacctcggggttaaggggtggggctgacgtcaggagccaagatggcggcggtggtcgcmctctccttgaggcgccggttgccggccacaacccttggcggagcctgcctgcaggtgagtcctggagcctcagagagggaaaagtcaggaaagccacaga

SEQ ID NO: 32264 - DNA, 201 bp, Homo sapiens
tatcgatgggacccagacaaggctggagacaaacctcatatgcagacttatgaagttgaccttaataagtgagtatctctgtgaaagccagctattgaagragagttcttgatttgatttagggacatgcttttcacatccttggaaggcttaaaaatctgagatcatccgatggctctgtttttaaaacaagaatgagct

SEQ ID NO: 32265 - DNA, 201 bp, Homo sapiens
cagtgagctgagatcatgccattgcactccagcctgggcaacagagtgagactctgtctccaaaaaaaaaaaaaaaatgaggttgttacctgattcagaaraataataccaaaataattcccaaatgaaagtatgacaaatttctagaaatactggtataattaactttatgcacagtatttaaagtcatttaatatatta

SEQ ID NO: 32266 - DNA, 201 bp, Homo sapiens
gttgagtccttcttcacatcacatctctcaaaaccactcttcttccaacatctttcacttttaaggaactccacagttagccaaagaaaagaaagaatctrgcaagttagtctctagcctcctgctgctccactccacgcccccatataaccagaactgttctctgatctgttttatgtgtaagtgaataagtgttttatt

SEQ ID NO: 32267 - DNA, 201 bp, Homo sapiens
ctgttttatgtgtaagtgaataagtgttttatttgtttcaaacaaaagcttctgtggcaccaaaaaaaagtttgaataccacgaatactctaaatgcttaytttgactttctgtggtgacaagtaagtgctgttaatgaggtagcattaattgatatataaccttcttaaatagacaaaattttcaaatactcagcaacca

SEQ ID NO: 32268 - DNA, 201 bp, Homo sapiens
ggaaaatatgtcaggatcaggccatgaaaatttctaagtccttctgcagctgtgactttctggcatcccaaagtccagggcggaggtacagccgcccaggratttattcctccataactttgagctccccaaatccccacgaagcccaggaatgatgtgactgcagggcatgtgggcccattggcaccaacagcccctcca

SEQ ID NO: 32269 - DNA, 201 bp, Homo sapiens
agaaggtcacgggggaagccaaatgggcatgcgccgctactgcgctattgcgcacgctcgctgtgcttgccccgccttccctccgcccacccgggaaacckgaagccgcctcccacttggttgctcgtacgcggctagtgggtcctcagtggatgtaggctgggcgccgcgatgttcgacgggacaccggcggagagcgac

SEQ ID NO: 32270 - DNA, 201 bp, Homo sapiens
ggaggccgaggcgggtggatcagctggcgtcaggagttcgagatcaacctggccaacatggtgaaaccttgtctctactaaaaatacaaaaattagccggstgatagcggacgcctgtaatcctggctactcgggaggctgaggcaggaacccgggaggtggagtttgcagtgagccaagatcacgccactgcactccagc

SEQ ID NO: 32271 - DNA, 201 bp, Homo sapiens
ttcttcttcttcttcttcttcttcctcttaaccacaggatttgagcaacttctatgcacagtacaaatccattgagccttatttgaagaagaaggatgaayctcaggaaggcaagcagcagtatctgcagtccatagaagagcgtgagaaactggtcattagtccctatttattgtttcaatctgaagaatttattgcaaa

SEQ ID NO: 32272 - DNA, 201 bp, Homo sapiens
tatttttagtaaagacaaggtttcgccatgttggcaggctggtcttaaactcctgacctcaagtgattcacccgcctcggcctcccaaagtgctgggattmcagacgtgagccaccatgcccggccgaaattatctgttcttaagaaaaagaaagatttttgaaaagggaaagcgctcctgtgatctatggaacagcatca

SEQ ID NO: 32273 - DNA, 201 bp, Homo sapiens
gtgagcccgaggtctctgtcattctgctgactgtaagctgagggctgttccaagcttccagaggctgccgcactccttggctcttggcctcttcttccatygtcaaaagcagcagcagcaggttgagtccttcttcacatcacatctctcaaaaccactcttcttccaacatctttcacttttaaggaactccacagttag

SEQ ID NO: 32274 - DNA, 201 bp, Homo sapiens
atctttttgtaattagtcaattaaccttccgagtttttacttttctatatcagtttattttaaaaattagcagtcctggagtatagtcttttctttctttktttcttttttattttgtatttttgaaaaagagtctcactctgttgcccaggctagagtgcagtggcatgatcttggctcactgcagcctcaacctctcgg

SEQ ID NO: 32275 - DNA, 201 bp, Homo sapiens
tcacacttttcagcaagcctgcaccttgtattttactcaggcttatcttcatacagtcctttttgctttcttcctctctatttccccaccttcttctctgkcctccaaatctttatccactccatccaactccaagcctgcaccctaaggacactttactggaggaacaacaaccagccttcagcaccattcagaattcac

SEQ ID NO: 32276 - DNA, 201 bp, Homo sapiens
ttctccattgtaaaattaataagtattttgcattttaataagtaattaatatagattatgaatggagatattttgagactatgttaatatccttttcctcwtctaacttttattcactcttttagcatccattgatgattttttcagctattactctgattttctaattctgtcatttcttctatacttaagagttggcat

SEQ ID NO: 32277 - DNA, 201 bp, Homo sapiens
tgtagtatcagttgtttcatatctctttaatattctttaacctaagaatactaagaacagtcctcagtcttcccttgtctttgacgattacgggcctgttrttttgtaaaatatacctcagtttgggtttgtttggtattttctcacagttagattcaggttgcacatttttggcaggtataccacagaacttttgctccg

SEQ ID NO: 32278 - DNA, 201 bp, Homo sapiens
gtgtaatcttctcattatactataatggctaagagtaatgttttcatgaagaaagaaaaaaaatccttcatagcctatgtgtgaaatacatacacagagtsaataattatgtacattttagattttaactggggcatccttttgtgaatgctaactactttgattttaccttagaagtcttttactttttgcttgtaagca

SEQ ID NO: 32279 - DNA, 201 bp, Homo sapiens
agtctggaaaaatatccagattaactgctctcataatccagattcagataaggttttcaactgtccgcctaatggactgccccacagcctgagaaagaaakgtgtgtgtgtgtgtgtgtgtgtgtctgtgtgtgtgtgagagagaaagagagagagagggagggagggagagagacagaaaagggatttcattcaaatgtc

SEQ ID NO: 32280 - DNA, 201 bp, Homo sapiens
  misc_feature (1)...(201): n = A,T,C or G, or insertion/deletion polymorphism (see Tables 1-2)
cagttcaccctttagagacactgcacacatcccagccagctggctgtctcgcagggcccccttgcaatgcagctgtttaatgtgctcctggatgcagttgnccaccacctccttgcccaggaagttttgcgggtagcagaagctgacttcccgcagacagcgcatgatgtactctagggaaattttctccaattcctgcct

SEQ ID NO: 32281 - DNA, 201 bp, Homo sapiens
agaagaaaaaagagagctatacttttttccttgaacaatccaagaacaagatgataggacataagatagggaaacatacttacagaaaagagaagtgtaargcaggtcaatctactgctaagggatttcagcccagcaaatgcacacattaagaataatgccagaatgtagaaaagtggctttatctttcagtagcggtgg

SEQ ID NO: 32282 - DNA, 201 bp, Homo sapiens
  misc_feature (1)...(201): n = A,T,C or G, or insertion/deletion polymorphism (see Tables 1-2)
ccgcagacagcgcatgatgtactctagggaaattttctccaattcctgcctcatgatgtgtcccaggggcatttcacgcatagtgcagaagtcggggaccnccagcgtgcacccagagagggaacgatgtatgtgatgtgaagccaaggtgtggggagtgtggccatggtcccaagccactgcagtcagtactggggacag

SEQ ID NO: 32283 - DNA, 201 bp, Homo sapiens
  misc_feature (1)...(201): n = A,T,C or G, or insertion/deletion polymorphism (see Tables 1-2)
tagggaaattttctccaattcctgcctcatgatgtgtcccaggggcatttcacgcatagtgcagaagtcggggacctccagcgtgcacccagagagggaangatgtatgtgatgtgaagccaaggtgtggggagtgtggccatggtcccaagccactgcagtcagtactggggacaggggaaagttgctcacaactctcag

SEQ ID NO: 32284 - DNA, 201 bp, Homo sapiens
agtcaaattgagaactggagataaaaactcatctgattgacctcatcctacccaatcctctaccttttcttccaagcaaaccgccatcagaagtgagtagsgtggagattctgctgaagcacatactagtgaggctttctaatgaaatgttcattaaaactatttattattatttgatagtataattattaactgatgtgt

SEQ ID NO: 32285 - DNA, 201 bp, Homo sapiens
  misc_feature (1)...(201): n = A,T,C or G, or insertion/deletion polymorphism (see Tables 1-2)
tcacgcatagtgcagaagtcggggacctccagcgtgcacccagagagggaacgatgtatgtgatgtgaagccaaggtgtggggagtgtggccatggtcccnagccactgcagtcagtactggggacaggggaaagttgctcacaactctcaggagaagggatctgcgttcagggatcagtgggagtggtgcgggactccac

SEQ ID NO: 32286 - DNA, 201 bp, Homo sapiens
  misc_feature (1)...(201): n = A,T,C or G, or insertion/deletion polymorphism (see Tables 1-2)
tagtgcagaagtcggggacctccagcgtgcacccagagagggaacgatgtatgtgatgtgaagccaaggtgtggggagtgtggccatggtcccaagccacngcagtcagtactggggacaggggaaagttgctcacaactctcaggagaagggatctgcgttcagggatcagtgggagtggtgcgggactccacgatctag

SEQ ID NO: 32287 - DNA, 201 bp, Homo sapiens
  misc_feature (1)...(201): n = A,T,C or G, or insertion/deletion polymorphism (see Tables 1-2)
agagccctactgccttgcacagcctcagtatgctgccaccagaatcctagaagcctcagctgaaaggacaactgatacagctcaggctgctgctgtggagngtacaagttgtaagccttgctggtttctatgtgatgttaagccttgaggttcatggaatgcaagagtgaagggggtctggcagcttccatgtagatttca

SEQ ID NO: 32288 - DNA, 201 bp, Homo sapiens
taagatttttgtccccaagctgagcagaggtaagcttggctaatgttagatttatgtgagctctgaagagagtctgtagtgctgtgtggtgttggtaattsaaaatgtagcatttatttctctaaagtaatttcgttttagcagaagggcaaaggaagcaatgttaaaatgagaagtaaaacaaaagtgtgtcctacttag

SEQ ID NO: 32289 - DNA, 201 bp, Homo sapiens
cctcttcaggcggttttagtattctcacaaagttgtgcagccatctctttgctccctttctcacatgggtagctaattatccttggatcatgtaagcatgwctttgtggaatcatagtctgcagatttagtattagtatcaaattgatatctctaaaggggctttctgcttccatatttactctggccagtgcttcaacca

SEQ ID NO: 32290 - DNA, 201 bp, Homo sapiens
  misc_feature (1)...(201): n = A,T,C or G, or insertion/deletion polymorphism (see Tables 1-2)
tcatgtgtcttcaggaatttgtgaatgattctgatatcccagtgatataaaacatgatctggcaaaatttgatggtgaccttttctgcttgtacctttacncatagatgaggttttccgagttctgctgctttcccctttgccagcatatactgcttttgttgaggaatcaaggtctccggtggtcgccaagtgaaaagga

SEQ ID NO: 32291 - DNA, 201 bp, Homo sapiens
aggcatagctggtggtgtcttaggggtgtcagctgcacagagcagagtgtgtgagggaaggataactcgtgtccctggttgcagagtctgagtgatccccscagtaaactaatgtaggatatatttggatgtccaggtcagcagagtgaaagtaaacagtccagggtctgtgctaggattgagtgtggccacagatagcac

SEQ ID NO: 32292 - DNA, 201 bp, Homo sapiens
ttccttctttggttactttaggcttgaaaatatgtcttctccgtgtgtacttccacagccttctcagccagatggcctcagtgggagcctgaagtgtcatktaactgctttagtttttaaatatttgtcacgttatgtatcaagctcttagaacagtacctcgccgatagtaagtgctagataagtgtattagagaaaatc

SEQ ID NO: 32293 - DNA, 201 bp, Homo sapiens
catttccacacgtcgtacccgacatgaattcctaacctgtcaccgctcctgatcccacctcctagctatccctctcttctccagcattttggacatgtctstcagcatatgtgtctgcctatctctcagaatggagtatgagtgtccactcagagacagagacttatttatcagtgctgagcacatagcctagaacatggt

SEQ ID NO: 32294 - DNA, 201 bp, Homo sapiens
gagagcatctgaaggtccatgcagtcttggcaagaaaacactaagtcccacacataagacagggatggggagtttttcatcactgaagaggccatctttakatctcaactcttttttttttttttttttttttttgagatggagtttcattcttgttgcccaggctggagtgcaatggtgcgatcttggctcactgcagtc

SEQ ID NO: 32295 - DNA, 201 bp, Homo sapiens
agccctgccatctggagacagaaacctcattcatttccacacgtcgtacccgacatgaattcctaacctgtcaccgctcctgatcccacctcctagctatmcctctcttctccagcattttggacatgtctctcagcatatgtgtctgcctatctctcagaatggagtatgagtgtccactcagagacagagacttattta

SEQ ID NO: 32296 - DNA, 201 bp, Homo sapiens
gccagccacttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaa

SEQ ID NO: 32297 - DNA, 201 bp, Homo sapiens
ttcagtgtgtatttcctaagaacaaggacaaggacagggacactcttgtaccaagccacagtactgcatcaaaatcaggaaattaacattgatgaccatayggccattaaatgtacagattgttcagattttgcagattgtcccaatagtgttctttattaggtgtagtatcagttgtttcatatctctttaatattcttt

SEQ ID NO: 32298 - DNA, 201 bp, Homo sapiens
  misc_feature (1)...(201): n = A,T,C or G, or insertion/deletion polymorphism (see Tables 1-2)
ctactactgtaggctagatgccaactaaaaacaactgctgggggcagtggagagggaagtagactgcagggttgatgtaagaaaaacaggtgagtttgcanttgttgggggagcgccaggaaacaagagtgtcaatttctggctcatgagtgagaagtattcctccttagttgtgcctgagaagctcccagcttccataac

SEQ ID NO: 32299 - DNA, 201 bp, Homo sapiens
ccagccacttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaac

SEQ ID NO: 32300 - DNA, 201 bp, Homo sapiens
taaatacttcagtgtgtatttcctaagaacaaggacaaggacagggacactcttgtaccaagccacagtactgcatcaaaatcaggaaattaacattgatraccatacggccattaaatgtacagattgttcagattttgcagattgtcccaatagtgttctttattaggtgtagtatcagttgtttcatatctctttaat

SEQ ID NO: 32301 - DNA, 201 bp, Homo sapiens
ttcctaattaaattcctgaatttctttttggcttctgtcctttcttcattatcaaagtaccaaacagtatagcacatctggtctcataggaagacagcacytcgtgtagcttcctgcgatctgaccaggagagcaggactttttcacaattggcctccacatctgccacgaatgatttctcctctgaaaatagccatagga

SEQ ID NO: 32302 - DNA, 201 bp, Homo sapiens
tttttttgtgtatgtgtggtaagaaccacacaaatcctctcagcaaattctaagtgtataatacaacattactaattagagtcccatgctgtacatcctcytctcttatttccttagctagttgccacctaggactctttacctctcctgaacctccactttgtcttagacagggcagtagtgctgttctcttctcttccc

SEQ ID NO: 32303 - DNA, 201 bp, Homo sapiens
agccacttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaacaa

SEQ ID NO: 32304 - DNA, 201 bp, Homo sapiens
tgttcacctgttacccttaaatacttcagtgtgtatttcctaagaacaaggacaaggacagggacactcttgtaccaagccacagtactgcatcaaaatcrggaaattaacattgatgaccatacggccattaaatgtacagattgttcagattttgcagattgtcccaatagtgttctttattaggtgtagtatcagttg

SEQ ID NO: 32305 - DNA, 201 bp, Homo sapiens
ctaattaaattcctgaatttctttttggcttctgtcctttcttcattatcaaagtaccaaacagtatagcacatctggtctcataggaagacagcacctcstgtagcttcctgcgatctgaccaggagagcaggactttttcacaattggcctccacatctgccacgaatgatttctcctctgaaaatagccataggatcc

SEQ ID NO: 32306 - DNA, 201 bp, Homo sapiens
gccacttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaacaac

SEQ ID NO: 32307 - DNA, 201 bp, Homo sapiens
aggagagcaggactttttcacaattggcctccacatctgccacgaatgatttctcctctgaaaatagccataggatcccaccgtgtagcctggtatcccarttcttgttcagatagtagatgcaggtggtgcagcagccatcgttgttgaggtgtccacatgatgaatgtaacctattccatttttaagatagcaagccac

SEQ ID NO: 32308 - DNA, 201 bp, Homo sapiens
ctaaaagacttcccatctcacatgggaaaacctttctgtgctgaaaaaagttctccttaaggaccttttaaaccctgttggccatggctcaccatatgcaktgtattttatattgccacacagtacatgccacacagtacacacgggtttgaaacagaacttccacgaatgatcctacctgtataacatgtgctgtatctt

SEQ ID NO: 32309 - DNA, 201 bp, Homo sapiens
cacttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaacaacag

SEQ ID NO: 32310 - DNA, 201 bp, Homo sapiens
aaaaatatctggatgctaaattacaacaaacatatcaaattattttttaacttttatttttgaataattttaaacttacagaaaagttgtaaaattggtaygcaaaactacagttttatcactgagattctccaattataaagtgctatcccatttcctttttttgacttatttcctctgtgaagtgtgtacatacatata

SEQ ID NO: 32311 - DNA, 201 bp, Homo sapiens
acttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaacaacaga

SEQ ID NO: 32312 - DNA, 201 bp, Homo sapiens
ttctctggtgtatgtgttttgttaaattttgcattattctgactaatttgcagtcgtggtattggaattccattttcatttgtcaggcatctttgataatagcctaccaaattattatttttctaatatatggcaagaattgctttttttataatagagaatttccagttttcataatgtttgaatttttaacaacagaca

SEQ ID NO: 32313 - DNA, 201 bp, Homo sapiens
ggctgaggcatgagttcgtttgaacccgggaggtggaggttgcagtgagccaagatcgtaccactgcattccagcctgggcgacagagagactgtgtctgaaaaaaaaaaaaaagaggctcccctgcgtttgagtagggggtgtttcttacaggtcttagataaattgggacgaagtctagagtgtctggtctgattttct

SEQ ID NO: 32314 - DNA, 201 bp, Homo sapiens
aggttcaagtgattctcctgcctcagcctccagagagtagctgggattacaggcatttgccaccatgcctggttaattttttgcatttttttagtagagayggggtttcaccatgttggccagacttgtctcgaactcctgacctcaggtgatccacctgccttagcctcccaaagtgctgggattataggcgtgagccac

SEQ ID NO: 32315 - DNA, 201 bp, Homo sapiens
  misc_feature (1)...(201): n = A,T,C or G, or insertion/deletion polymorphism (see Tables 1-2)
gggacaggtttagagttaagtaacttacccaaatcaaacaataaactagtagtaaagttggggtgtgaatccatatactcaggagaatccacatttttgtntacaatactatacttcttcagtaaatattcatgagttgaagaaaaccaattctgattaagtgaagctgaaagggaatttattatattaggaagacataaa

SEQ ID NO: 32316 - DNA, 201 bp, Homo sapiens
ttgtgtactaaagatgaggtcattggtagctagaaaagtaaaattctctttcaaaaaagtcattataataaatagtttaaccaaaaatttttaatgaaatyacaagttaaagccaggatagtatattgtctctttatatatcaaataaatggcatattttatactaattatggaggctattcccacactcctttaaagttt

SEQ ID NO: 32317 - DNA, 201 bp, Homo sapiens
ttgttaattaaactctgcttttcctcacagatttaccatcatgtgactggaagatatgcagcttatcatgatcttccaatgtcttaaatcagtcaccagtwccagaaaagttctttacgacaatgtttaaaaattatttttctacgtaattgctaaaattatttaattaaaaaattgggcagtaggtaactggcattcctc

SEQ ID NO: 32318 - DNA, 201 bp, Homo sapiens
gcagcccttagactataaagtttctacgtcattgatttaagggtgttttaaaatgcgataggctagcttccagaccatgattagtgtcactcctgagaagyagaggtttaatatttcataactgatttcattgcagatttatgtcttccatattctctttaaaaaaaaaaaagataaacttatgttagaacctctctggaa

SEQ ID NO: 32319 - DNA, 201 bp, Homo sapiens
ctcttactaatgtctataaagccagtatgatagcaatgatggcaggtaagtgttttatgttcaaataatgttttctattgaattgatgtttttaggagaarttaagtaagtgaaagcatttagctattattaaacgtgctaaccacttggaatttttttgcgggaggaatcggatattttgtaaaaacatgttcaatgtga

SEQ ID NO: 32320 - DNA, 201 bp, Homo sapiens
  misc_feature (1)...(201): n = A,T,C or G, or insertion/deletion polymorphism (see Tables 1-2)
cgttaatcttttgaagctagtaattttattttcctctctttgcagtctctgaggttcgcaaatgaatagagcttcattattgcagtctgcatttaataacnattatccattatcttgtaattaagactccctgtaacgaatcatgaggacaatgcaaaaatacatagtacatttctttaatgaactggaaaatgttcatct

SEQ ID NO: 32321 - DNA, 201 bp, Homo sapiens
  misc_feature (1)...(201): n = A,T,C or G, or insertion/deletion polymorphism (see Tables 1-2)
atcatgtgaagttggtagtttataaattctttctgcagtaatcccaagagggagggagggaggagaggtatcttattatcatcttttagtagatgaaaacntgaagctcagaagttaagtgaatagaccaaggccacacactgagtaagtggcagaattttctgaaggacttttgactctaaactccatgcttttattaat

SEQ ID NO: 32322 - DNA, 201 bp, Homo sapiens
atagcaatgatggcaggtaagtgttttatgttcaaataatgttttctattgaattgatgtttttaggagaaattaagtaagtgaaagcatttagctattaytaaacgtgctaaccacttggaatttttttgcgggaggaatcggatattttgtaaaaacatgttcaatgtgaagtggtcaaaaactcctggctttcttcca

SEQ ID NO: 32323 - DNA, 201 bp, Homo sapiens
gctttgctttaccagtgacccaagaatgagtgttatagtatgctttttgtaaaaaatttatcaccaactggggcattgaaagtaagtttcctatgttacgyggctgctaaattggccagggacaacggaggaggaactgaatagtcaatgaaattggaaagaatttagatcatccatgtcacacaaagccagcaaaggctg

SEQ ID NO: 32324 - DNA, 201 bp, Homo sapiens
tttgattgtgcttggtgagtgattgcatgctgagcagggaagggaagggcagatccaactcctaatggtgccatttgtcaggatagggaatttaagaggaygaagtctttttcccagcccaggaaccagcgcctctgtttccatttataagacctgcacccgttcattctattattggtttattgcagaacatagcgcagt

SEQ ID NO: 32325 - DNA, 201 bp, Homo sapiens
ccaattataaagtgctatcccatttcctttttttgacttatttcctctgtgaagtgtgtacatacatatataaattatgtattatatacatatttttctgraccatttgggaataagttgcagacctgttcacctgttacccttaaatacttcagtgtgtatttcctaagaacaaggacaaggacagggacactcttgtac

SEQ ID NO: 32326 - DNA, 201 bp, Homo sapiens
agcgggcaggggcggggcgagcgctccagctggcgggaaggaggaagggccgggcgcggcgcagaggcgggcgcctaccagccggcagctccggagctgcycgcgccatgtccgcgcacaatcggggcaccgagctcggtaaggggcccgcggggctccccatcccctctccctcgcgttcagcgccgccgggactagcgc

SEQ ID NO: 32327 - DNA, 201 bp, Homo sapiens
ttttcttgacttcagatctgggctgcactttctagctctgttgtctaaagaaaaatatctgctgttactcaagatcttctgataggttctacatcgttgtytatatgttgtctacctggtctgcctctttgagcaccagagtttgacagcatagttgagtgctccatcttaacctttcataagactcagacttacctatcg

SEQ ID NO: 32328 - DNA, 201 bp, Homo sapiens
tgactttaacggaatcgtatgcaaaagagtcattgttagaatgaggaaactacatatctaaagacagggaaatatagcatggaacttttttctctttttawattttaacgtggctctaaaaaaatccataaaatccattgattgtatatgtaacgtttagtctgcccagcagctagtaaattatgtagagaacatactttt

SEQ ID NO: 32329 - DNA, 201 bp, Homo sapiens
  misc_feature (1)...(201): n = A,T,C or G, or insertion/deletion polymorphism (see Tables 1-2)
tgcccggaatgccttttgcccaaataactccacatcttggggttcagcacaggtaccacctttttcaggaattatttcccctgacactgcttctccccctnctgtttggcccattatctcctctgtgtgtccccacggcattcaagtaaaagccctatcatataacttatcacatgacattgtgattgagtgttgaatttc

SEQ ID NO: 32330 - DNA, 201 bp, Homo sapiens
atgactttaacggaatcgtatgcaaaagagtcattgttagaatgaggaaactacatatctaaagacagggaaatatagcatggaacttttttctctttttwaattttaacgtggctctaaaaaaatccataaaatccattgattgtatatgtaacgtttagtctgcccagcagctagtaaattatgtagagaacatacttt

SEQ ID NO: 32331 - DNA, 201 bp, Homo sapiens
atctctgtgaacagcaggtctatccatttagacatccaagcttgcagcctaggagtcatgcttggttctttctttttctcacctcacataaatcagtgaasaagccttgagagttctctctagacctctttgctgtgtctgacacatcttccctccattctaagtgctgctgtcttaggccaccatcctcctccacaggga

SEQ ID NO: 32332 - DNA, 201 bp, Homo sapiens
tgctcagcaaggtgttcggtaaaaatacttgagttagggggcgttcttgaaatcatcagcttattctgcagtcatgactttaacggaatcgtatgcaaaaragtcattgttagaatgaggaaactacatatctaaagacagggaaatatagcatggaacttttttctctttttaaattttaacgtggctctaaaaaaatcc

SEQ ID NO: 32333 - DNA, 201 bp, Homo sapiens
tttctatagagaggcaaggtgtttgcagaaatttataggagttggtgaacatgaaatcaatataaaagagaaaaatgacagcaagcccggggccacctgcytatgattggcccacagtaactccttgttgaaaagaaaaggtagggtgcccagagctaaaagatctcttctcaggctgcttccactgttatttgtgtttag

SEQ ID NO: 32334 - DNA, 201 bp, Homo sapiens
gcatgggtgaatatttctttatttgctgtttaaaaaaaatatttgcaggcttctaggattactttataagccaaatgaatgaaaaaaatgatttttttttwaatttggaaagatatgttaacagggaaaaattggttgaagcaagacaaaggttacattgccatcactagaataaagaaatgaagggccctgcgtgttaca

SEQ ID NO: 32335 - DNA, 201 bp, Homo sapiens
gttggtcctgcaggtgcacagaagtcaagaattgaggtttggaaaccaccacctaggtttcagaggatgtatggaatcgcctggatgtcctggcagaagtktactgcagaggggagccctcgtggagaacctctgctagggcagtgtggaagggaaatgtggggttggagtctccacacagagtccccactggggcactgc

SEQ ID NO: 32336 - DNA, 201 bp, Homo sapiens
atgggacatgtacagattgatcactatgacagcagccctttatagaggtaataatgttgtcattaggttgtgacaattctccagagacttcaacagccccsgattaataacatctggaaattgttcagatgacataaatttctgttttctgttttaaggcttccattgtgcctttctgtggcatctgccgttgtttttctt

SEQ ID NO: 32337 - DNA, 201 bp, Homo sapiens
  misc_feature (1)...(201): n = A,T,C or G, or insertion/deletion polymorphism (see Tables 1-2)
tcaacacatccaatacagacactaaatttagcatcttaaaacactgatttcatgtgatcagacctcacattacctaaagaacagagcccaatgtctgtggnttcaaagctctctataatattttcctaagggatatttacagtcacatcttctaaaacatacattcatatatctgtgtatatgtccctcctcccacctcac

SEQ ID NO: 32338 - DNA, 201 bp, Homo sapiens
tgtgccctggatgcaggacatggagtcaaaggagattattttggagctttaagacttaatgactgccctgctgagtttggggcttgtatgaggcctatagygcacccctcccccttttttggctgatttctccctttgggaatggtaatgtttacccagcacctttgccacaattgtatcttggaagtataacttgttttt

SEQ ID NO: 32339 - DNA, 201 bp, Homo sapiens
aaaggcccatttgtttttgttcatgttacccaatatatcatgcatagctttcaacaaaaaatacattggatgctagaggcaagaaaaaaaactcaaagtcttttttttttttttttttttttgagacggagtctcgctctgtcacccaggctggagtgcagtggcgggatctcggctcactgcaagctccgcctcccgggt

SEQ ID NO: 32340 - DNA, 201 bp, Homo sapiens
tgggacatgtacagattgatcactatgacagcagccctttatagaggtaataatgttgtcattaggttgtgacaattctccagagacttcaacagccccgrattaataacatctggaaattgttcagatgacataaatttctgttttctgttttaaggcttccattgtgcctttctgtggcatctgccgttgtttttcttt

SEQ ID NO: 32341 - DNA, 201 bp, Homo sapiens
cagtgttgcgatataaataataattaaaagcatgttgtatgagttgaacttcattgaaagttggctattcctattttttcttgataggcattactacagcygccgtttgtgtttatcccgcccgggtgtgtgatgctgtaaaagcactcaaggctgcaggctgtaatatccctgtggcatcaggtaaaatgtgttgtggct

SEQ ID NO: 32342 - DNA, 201 bp, Homo sapiens
atcatgaggcacagaatgagtgcctggctatcccattataagtgaagttaagtttgatcatttgcttaaggagattatagccacatccgccagtagtatasttccagtttcccgctttgacctgcatgtcctgtatgagttgatactccaataccatgtgaatgtctcatttttcattaactttttacccagtgtctttag

SEQ ID NO: 32343 - DNA, 201 bp, Homo sapiens
gcaaatgagttcatctggcaaagagagcatctgaaggtccatgcagtcttggcaagaaaacactaagtcccacacataagacagggatggggagtttttcrtcactgaagaggccatctttagatctcaactcttttttttttttttttttttttttgagatggagtttcattcttgttgcccaggctggagtgcaatggt

SEQ ID NO: 32344 - DNA, 201 bp, Homo sapiens
aggcttccattgtgcctttctgtggcatctgccgttgtttttctttttcaaacctttcaaatcaggaaatatacataaaatacaagattattttcctcacrtgtgctcctaggctcttgtcttgatagccagcgttaccaaatctatcaggtaaactgctggccaactggtatgtctgctggaatttctggaggtggaata

SEQ ID NO: 32345 - DNA, 201 bp, Homo sapiens
tcaacagccccggattaataacatctggaaattgttcagatgacataaatttctgttttctgttttaaggcttccattgtgcctttctgtggcatctgccrttgtttttctttttcaaacctttcaaatcaggaaatatacataaaatacaagattattttcctcacatgtgctcctaggctcttgtcttgatagccagcg

SEQ ID NO: 32346 - DNA, 201 bp, Homo sapiens
tggacttgttccacccacttggcccggcaggctgcacttggctcacactgctggcctgggtcgcacagctgccaagggcaagccaggcgcggagtggcaagggatgtgtgagtgagtgcacgcggggtccagccactgtgcacagccaggcacatcagctgcggcagggtgggcagctccaggtgcagactccatgcgagg

SEQ ID NO: 32347 - DNA, 201 bp, Homo sapiens
  misc_feature (1)...(201): n = A,T,C or G, or insertion/deletion polymorphism (see Tables 1-2)
ataactccatactccaccattgtcctttcctaccaacataggggaaaacctgctcattcgtttttccattgtttggcttatttgtattgaaaggaaagtgncagctgagtttgttaaaggacataatttgagattgactgggttacatttcagccatcaagccactttgattagcatatgtcattcatctagtttctgagg

SEQ ID NO: 32348 - DNA, 201 bp, Homo sapiens
acatgtatgtcttcttttgaaaagtgcctgttcatatcctttgcccactttttaatggggttgtttgctttttcttgtaaatttgtttaagttccttagagatgctggaagttagaccttttttggatgcatagtttgcaaaaatgttctcccattctgtaggttgtctgtttattctgttgatagtttcttttttagcca

SEQ ID NO: 32349 - DNA, 201 bp, Homo sapiens
  misc_feature (1)...(201): n = A,T,C or G, or insertion/deletion polymorphism (see Tables 1-2)
tcatgaaaaattttttggaaagggcatctgttgaacttattgcttcacttgtaatttcctctgtgtatgtggtctagcagcagttataataactccatacnccaccattgtcctttcctaccaacataggggaaaacctgctcattcgtttttccattgtttggcttatttgtattgaaaggaaagtgccagctgagtttg

SEQ ID NO: 32350 - DNA, 201 bp, Homo sapiens
gaatgagctcattaaaaaagaaaactgaaaaaaaacaggtacacccacatttccaactccatctctcttttcagactgttcaagatgtacacatgtacttkgtatatctgtagacctgattctttccatgttgttttcagaggttgacaccaaactaccaagtagatatttatcctttggtttaaattcagattccattcc

SEQ ID NO: 32351 - DNA, 201 bp, Homo sapiens
ggttaaatagcgtgtggagaacactgagcatttttgagggaagaggctttgaaaacgtaggggatttctcatcctttagagtaattattcctcatgaaaawttttttggaaagggcatctgttgaacttattgcttcacttgtaatttcctctgtgtatgtggtctagcagcagttataataactccatactccaccattg

SEQ ID NO: 32352 - DNA, 201 bp, Homo sapiens
  misc_feature (1)...(201): n = A,T,C or G, or insertion/deletion polymorphism (see Tables 1-2)
taaatctggcctgtgaagtacatacatcatggctatcaaacattttaggataagagaatgaaatatcagcaccaaagtcacattatttttcattttcttanatgaagagaatcctaaagaccttgaatcagggcaataatctatttttcttatttgctgatttttacacaagaaggatggtagaaagaacatctcaaaaat

SEQ ID NO: 32353 - DNA, 201 bp, Homo sapiens
ctccttaaacagttctttgaagaaagcattcaccagaagttgttcatcatttcataaatcttattgagcaggttttaaaaattgaatagtttccatgctcwgtaaatatacagaggtgttcattttactttttttatgacctctttctgttgcatctatttacctaatatatttaccagtgacagggaaatgctatcagat

SEQ ID NO: 32354 - DNA, 201 bp, Homo sapiens
tgtctgtgtgatgaatcaatacaggttcttccagttccaaatgtataggctggtacagaagcaattgtggtttttgcctttgaaagtaatggagtgatttkgcatgaagtatgccttttgttgactggtcttccatcaataaggttgtttatttatagttgtacaaaaaagaaatataagctttaaaaaaaggttgatgtc

SEQ ID NO: 32355 - DNA, 201 bp, Homo sapiens
aattagatggccttaagcaacagaaatgtgttcttaaggttctggaggccagaagcccgcagtcagggtgtcagcaggcttatgctccctctgaaacctgyaggcaagcccttcttgcttattctggcttctggtgtttgccagcaatgcttgacataccttggcttcactccagtctctgcctctgtcactagatggctg

SEQ ID NO: 32356 - DNA, 201 bp, Homo sapiens
attatgcaaaggcagaattaattgatcatgctgttatactcttaggacagttgcaaataccagtagcatttgtaacatagtatcagcatcaactgttttayctgttagattttttttttttttcaaaactgtgctcttccctgggctaaggaccacaccttccttaactttattcctctgcgattactatcaaacctggca

SEQ ID NO: 32357 - DNA, 201 bp, Homo sapiens
tggatgctagaggcaagaaaaaaaactcaaagtcttttttttttttttttttttttgagacggagtctcgctctgtcacccaggctggagtgcagtggcgsgatctcggctcactgcaagctccgcctcccgggttcacgccattctcctgcctcagcctcccaagtagctgggactacaggcgcccgccactacgcccgg

SEQ ID NO: 32358 - DNA, 201 bp, Homo sapiens
agttattttgtagctcattttatggttgtatttagttatatgcttcaagtgcacttaaaagaatgtgtatttcagatgttagagcaaatgtcagatcgaaytggttgataatgtttttcagatctagttttgttttctttttggtctactggttctgtttattactaagagagtgttaaagtctccaaacatgattgtgga

SEQ ID NO: 32359 - DNA, 201 bp, Homo sapiens
tttgtcttttggaattaacagttattttgtagctcattttatggttgtatttagttatatgcttcaagtgcacttaaaagaatgtgtatttcagatgttasagcaaatgtcagatcgaactggttgataatgtttttcagatctagttttgttttctttttggtctactggttctgtttattactaagagagtgttaaagt

SEQ ID NO: 32360 - DNA, 201 bp, Homo sapiens
atattcttgtcccaattttatatgtaacttgcacaaactaatctccccaaaagtaatttacaaatttctgactaaattctgtattctacttctgtggtggyataaaaaattttttcttaaatcaatttcattgaggcagatttgcattcagtaaaattcaggtgttagatagacagtgtgatgagtttggcagtttgcaaa

SEQ ID NO: 32361 - DNA, 201 bp, Homo sapiens
cctaacactttttagtcagatatataaacatactctggcaggcagtggggcaagctgctgtgtctttattgtcatgaacataactctcaagaaaggtgtgytttatattccaaccaaagaacctattacttgtgaatggaagaattaataagaacctaagatttttttttattactttgcaaaggggtacaccactgtatg

SEQ ID NO: 32362 - DNA, 201 bp, Homo sapiens
agttgacatccttctacgttctgagttttgacgaatctgttgctcgaagcactgcaatgtatttccctgggaatatgttgtaactgcagtgagtgtacacrtgcatgcatgtgtgtgtgtgctgggatagaggcagaaaattttgaggaaatacagttttattccacgtatgaagacatgactcctcctctctgttctata

SEQ ID NO: 32363 - DNA, 201 bp, Homo sapiens
ctgcaaagttaacgtttaatttttggaatggatatttatttatttatttgtttatttattgtttcaatagagaccgtgtgtcagtatgttgaccagactgktctcaaactcctagcctcaagtgatactccagcctctgcctcccaaagtgctaggattataggcatgagccaccgtgcatggcctagaatggcatcttaa

SEQ ID NO: 32364 - DNA, 201 bp, Homo sapiens
cgggtgtgtgatgctgtaaaagcactcaaggctgcaggctgtaatatccctgtggcatcaggtaaaatgtgttgtggcttttgttgttattttttaaacaygtttccagttcttcatacaatggggtattatatgtaggtttgtactatgatttaaattagtttatgtatttaattagttgtatttattcatgattttagt

SEQ ID NO: 32365 - DNA, 201 bp, Homo sapiens
  misc_feature (1)...(201): n = A,T,C or G, or insertion/deletion polymorphism (see Tables 1-2)
caaaatttagtatcttatatttctgaattaccttggaacaaagagcaatttagagatcatttttagtgtattatacaaaatttagtatcttatgtttctgnattaccttggaacttttcattttatgcagcttttttcccctagaagaatgaaaaccaggtcctaggattctaatgcccatctgtcaagtgagtagtttga

SEQ ID NO: 32366 - DNA, 201 bp, Homo sapiens
gagacagagtctcactctgtcacccaggctggagtgcagtggcgccatctcggctcactgcaacctccgcctcccgggttcaagtgagcctccagtctcakccttctgagtagctgggattacaggcatgcgccaccatgcccagctagtttttgtatttttagtagagatggggtttcacagtgttggccaggctggtct

SEQ ID NO: 32367 - DNA, 201 bp, Homo sapiens
gtggccattcttggctgcaagtaagctggaaaatagagtttttagcttggaatattaactactttcctgtacattcccatttccattgcgttcaccccacygccccccaagttccccattaatactcatcaacatttataattcttgccaggtttaaactcttgacagttcacaaatatctttttgtattttgtgttcctt

SEQ ID NO: 32368 - DNA, 201 bp, Homo sapiens
gtacttctcctcagcctgcctcagctgtaacagtgagttccctagaaaccaaagtggttgcaagggaaggataaatgtttaatcttggctccagcaaactmtacagattttttaaatgttgagacactctggctgcaacttctggctctctgtatagtcaggccttcctcccgcaaagcaaagtctaagacaagagtagct

SEQ ID NO: 32369 - DNA, 201 bp, Homo sapiens
agacctctaatcccattagctgaagatgtgagattaaccagaaagagtaattccgttaattttctggtagaaaaaaacatattcatgtttccttgagattrtggattaagtttgtattttggactcagggaagaaagtaggttgtaacaattcctattgtatttggtgaaggagctcaagatctgtatattgtggtatttt

SEQ ID NO: 32370 - DNA, 201 bp, Homo sapiens
  misc_feature (1)...(201): n = A,T,C or G, or insertion/deletion polymorphism (see Tables 1-2)
ctcgcggcccttcttgttgctcccagaactgtggggtgaactgatcaccccacagttcaccctttagagacactgcacacatcccagccagctggctgtcncgcagggcccccttgcaatgcagctgtttaatgtgctcctggatgcagttgcccaccacctccttgcccaggaagttttgcgggtagcagaagctgactt

SEQ ID NO: 32371 - DNA, 201 bp, Homo sapiens
ctattagtggccgctggatttccagctggacagactcatttgaagacacgattagaagagatcagattggctgtggaagatggagctacagaaatcgacgyggtaattaacagaagcttggtgctgacaggccagtgggaaggtaggtgcatgcttttacctaagagagtttcaccattcttccctggtgaatcagatgat

SEQ ID NO: 32372 - DNA, 201 bp, Homo sapiens
tttgaaacagaacttccacgaatgatcctacctgtataacatgtgctgtatcttgacattttctattttctgtttcttcttttttattttttaatttttawttatttatttatttatttatttatttatttattttattatactttaagttctaggatacatatgcacaatgtgcaggtttgttacatgtgtatacatgtg

SEQ ID NO: 32373 - DNA, 201 bp, Homo sapiens
aggcagaattaattgatcatgctgttatactcttaggacagttgcaaataccagtagcatttgtaacatagtatcagcatcaactgttttacctgttagattttttttttttttcaaaactgtgctcttccctgggctaaggaccacaccttccttaactttattcctctgcgattactatcaaacctggcatatagtaga

SEQ ID NO: 32374 - DNA, 201 bp, Homo sapiens
ttcttttctttaagaatgttgaatattggcccccattctcttcaggcttgtagagtttctgctgagagatcaactgtttgtctgatgggcttccctttatgggtaacccaacctttctctctggctgcctttaacattttttccttcatttcaactttggtgaatctgacagttaggtgtcttggagttgctcttctcgag

SEQ ID NO: 32375 - DNA, 201 bp, Homo sapiens
gtcaaattcataagaaatttgcccgaggacaaataactaaagtcaaaacacagagtctagaacaaggttctcaacctgggctgcacattagagtttcctgrcaagcttctttaatgaactgttgcaatgatcttcctaccagagattgtgatttcaggggtcatgaacggagccaaggaaattcatactttgagaaacatg

SEQ ID NO: 32376 - DNA, 201 bp, Homo sapiens
caactttggtgaatctgacagttaggtgtcttggagttgctcttctcgaggagtatctttgtggcgttctctgtatttcctgaatttgaatgttggcctgccttgctaggttggggaagttctcctggataatatcctgcagagtgttttccaacttggttccattctccccatcactttcaggtacaccaatcaggtgta

SEQ ID NO: 32377 - DNA, 201 bp, Homo sapiens
aacacaggaagtctttcctttatttatttatttatttatttagagacggagtctagctgtgtcgcccaggctagagtgcaatggccggatcttggctcacrgcaacctccgccttccgggttcaagcagttctcccgcctcagcctcccgagtagctgagattacaggcatccaccaccatgcccggctaattttctattt

SEQ ID NO: 32378 - DNA, 201 bp, Homo sapiens
tgtttgctttttcttgtaaatttgtttaagttccttagagatgctggaagttagaccttttttggatgcatagtttgcaaaaatgttctcccattctgtargttgtctgtttattctgttgatagtttcttttttagccatgtttatgtaacagttcttttaaattttttattttggatgccatagcagcaacatcagctc

SEQ ID NO: 32379 - DNA, 201 bp, Homo sapiens
tatttatttatttagagacggagtctagctgtgtcgcccaggctagagtgcaatggccggatcttggctcacggcaacctccgccttccgggttcaagcarttctcccgcctcagcctcccgagtagctgagattacaggcatccaccaccatgcccggctaattttctatttttagtagagatggggtttcttcatattg

SEQ ID NO: 32380 - DNA, 201 bp, Homo sapiens
tccaggtgccatctgtcacagcttcccttggctagggaggggaattccctgaccccttgtgcttcctgggtgaggtgatgcctcgccctgcttcggctcaygctcagtgggctgcacccactgtcctgcacccactgtccgacaagccccagtgagatgaacccggtacctcagttggaaatgcagaaatcacccgtcttc

SEQ ID NO: 32381 - DNA, 201 bp, Homo sapiens
ttatttagagacggagtctagctgtgtcgcccaggctagagtgcaatggccggatcttggctcacggcaacctccgccttccgggttcaagcagttctccygcctcagcctcccgagtagctgagattacaggcatccaccaccatgcccggctaattttctatttttagtagagatggggtttcttcatattggccaggc

SEQ ID NO: 32382 - DNA, 201 bp, Homo sapiens
atggcatttgtaaactgtcatggcacttgtgggagtgtggcagtgaggaggaccagaggtcactctcatagccattttggttttggtgggttttagctggyttctttactgcaacctgttttatcagcaaggtctttatgacctgtattttgtgttgacctccagtctcatcctgtgacttagaatgccttaaccatctgg

SEQ ID NO: 32383 - DNA, 201 bp, Homo sapiens
atggccggatcttggctcacggcaacctccgccttccgggttcaagcagttctcccgcctcagcctcccgagtagctgagattacaggcatccaccaccaygcccggctaattttctatttttagtagagatggggtttcttcatattggccaggctggtctcgaactcctgacctcaggtgatccgcctgcctcagcctc

SEQ ID NO: 32384 - DNA, 201 bp, Homo sapiens
attggccagggacaacggaggaggaactgaatagtcaatgaaattggaaagaatttagatcatccatgtcacacaaagccagcaaaggctgtttgtagaaygttagctgctatcacactggcttgatattaacattctagtgaataattaaaatattcctgtttattttttaataaaaagaaaaagcatatatgttacctc

SEQ ID NO: 32385 - DNA, 201 bp, Homo sapiens
ttttcttccaagcaaaccgccatcagaagtgagtagggtggagattctgctgaagcacatactagtgaggctttctaatgaaatgttcattaaaactattyattattatttgatagtataattattaactgatgtgtataattatagaatgattgttaattaaactctgcttttcctcacagatttaccatcatgtgactg

SEQ ID NO: 32386 - DNA, 201 bp, Homo sapiens
atcccagcactttgggaggctgaggtgggcggatcacgaggtcgggagatagagaccacggtgaaacccggtctctactaaaaaatacaaaaagttagccrggcgtagtggcgggcgcctgtagtcccagctactcgggaggctgaggcaggagaatggcgtgaacccgggaggcggagcttgcttgcagtgagccgagat

SEQ ID NO: 32387 - DNA, 201 bp, Homo sapiens
caagtgtatactgatattaagtaaattattttaaattttaaaatggagaggacacaaaccttcccatataaaattccaagtaattatgtagccaagccccygctcgaggaggtggattataacttcccactccttaaatgtgggatacccataatgacttcttttcaaagagtacagtatgaaaaatgggggaaaaagatt

SEQ ID NO: 32388 - DNA, 201 bp, Homo sapiens
acatgatgcaaaggcatacaggaagcaactgaaagagctcccagtggccaaagctggaaccgtgtgaacaataaaataaataaggtagtgaggaattatawacccaagtgtaaaataaatatcttcaagtgtatactgatattaagtaaattattttaaattttaaaatggagaggacacaaaccttcccatataaaattc

SEQ ID NO: 32389 - DNA, 201 bp, Homo sapiens
gaaattgaaaacaaaaacaacagagaaatttttttttttaaatatcctaaaagctacttttttttttctccccccgtaagattggtaaacagctagctagrctaatcaagaataaaagagaaaagacataaattacccatatcggaaatgaaagaagggtcatctcctcttcccatggatattaaaaggataataaaggaa

SEQ ID NO: 32390 - DNA, 201 bp, Homo sapiens
cttcatccaacaacagcagaatacatattcaatgttcacatggaacattaaccaagatagaccacattctggtccataaaacacaccttgacagatttaaragactgaaaatcacacaaaatatgttctcagaccacaatggaactaagctagaattcaatagcagaaagttagctgaaagatccccaaatgtttggaaat

SEQ ID NO: 32391 - DNA, 201 bp, Homo sapiens
tttaaatctgcatttgtcctactctaaagcctgcttttaatgacaacactattttgtggaagaaaatcattaattaaatcacaagttaacttggattagcrttcttggatttttagatcagaagattttccttgtcacttgttcttagaaaacaagtttctttttttagattcaataacttaagaaatgtcattccatcca

SEQ ID NO: 32392 - DNA, 201 bp, Homo sapiens
tgagctaattaaacttcttttctttataaattacccagcctcaggtattcctttatagcaatgcaataatggactaacacagcatatgttcagaaacaccwtaactaccagatacattcttatttccccccacacctaatctctagacaataaaggcttggcttgatatttaaggacttccagtttcagctttaacatata

SEQ ID NO: 32393 - DNA, 201 bp, Homo sapiens
  misc_feature (1)...(201): n = A,T,C or G, or insertion/deletion polymorphism (see Tables 1-2)
aatttattatattaggaagacataaagaagctcactgaataagtaggaagccttgcttggaaaaaaagcaggaccatgagggaataaggagcagagaacanagtcagattgtgccacaggaagagcttgggcccagggccactgctggtgctgctcctactggccagcacaggtaccacactgttggctggtggctggccc

SEQ ID NO: 32394 - DNA, 201 bp, Homo sapiens
  misc_feature (1)...(201): n = A,T,C or G, or insertion/deletion polymorphism (see Tables 1-2)
attaagtgaagctgaaagggaatttattatattaggaagacataaagaagctcactgaataagtaggaagccttgcttggaaaaaaagcaggaccatgagngaataaggagcagagaacacagtcagattgtgccacaggaagagcttgggcccagggccactgctggtgctgctcctactggccagcacaggtaccacac

SEQ ID NO: 32395 - DNA, 201 bp, Homo sapiens
ttcaaggaacatagatcatggtgtcctctgcttttgtaagtccctctgtaatctgagcctgataagcactgaataataacaggaacaccatcactgctgcyaccaacaactttgaaaacaggaactgacattccttgagcatgaacaatgtgctggatattgtccttatctattcgtgtgtgttaacctgtttgaaaataa

SEQ ID NO: 32396 - DNA, 201 bp, Homo sapiens
gaagaatgaaaaccaggtcctaggattctaatgcccatctgtcaagtgagtagtttgaactagaagggagttgacatccttctacgttctgagttttgacraatctgttgctcgaagcactgcaatgtatttccctgggaatatgttgtaactgcagtgagtgtacacatgcatgcatgtgtgtgtgtgctgggatagagg

SEQ ID NO: 32397 - DNA, 201 bp, Homo sapiens
ggttgagagctcccaaagatagagttcagaatcatctttctaaatcaacaagaggctctttcatcttaattataacagcttaaacttttagagtaagtcarcgtttaccatcattttacgtgtgcttattatcaaaggtggatctgaaggaaaaatgattgattaccttcctaaccgttttaatacttttatatttattgg

SEQ ID NO: 32398 - DNA, 201 bp, Homo sapiens
atcaatatttgcctttttatcaattgctttgtgtttgacaatctctagaacctgcgggttgtcttcctggctctacttgccaagtcctccccaacccctakaattttcagtcctcgctggtaagggtgaccttcactttccccagagctgactgcacgtccccctcacctcgcctccatcatgttgccatgatgtagcaac

SEQ ID NO: 32399 - DNA, 201 bp, Homo sapiens
aggcagtttcgggacctgcttcacactggctcctctatcctttttatgttcccatcattctttgagagcttccttgctttcttgtaatagatgtttcaggygtatctttgactttgtctgctccagctttggaatcagtcatttctccaaggagctcttgctccttttattgattaactgtatttagaaaccaagatctgg

SEQ ID NO: 32400 - DNA, 201 bp, Homo sapiens
tcagtgaagtgatctgggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagt

SEQ ID NO: 32401 - DNA, 201 bp, Homo sapiens
tgtaatcccagctattcaggaggctgaggcagaattgcctgaacccgggaggtggaggttgcagtgagccgagattgtgtcactgcactccagcctgtgcracagagcaagactccgtctcaaaaaaaaaaaaggtgaaatagatgcccatgtcttgctaagtcagtgtggtgcagaaaatgataaggagggagtattcca

SEQ ID NO: 32402 - DNA, 201 bp, Homo sapiens
tttaaaatgaaacagcttcttaaaagcaagggacggaagatgtgcaaatggttatgaggtcattgtactaaacattagcattgtgcttctcactccagaaraaattacatcagtggataatctactgagcactgtaatttgggtagtactgagatgagcaattgttttagttgttgcctgacccccaccccacccccagca

SEQ ID NO: 32403 - DNA, 201 bp, Homo sapiens
agtagtagaatgtcaattagagactcataataggaaaatggttacattcaaatttgacctagatggtgacaaccccgaggagatagcaacaattatggtaygtctgcatttggagttctaggtttttccttagtacttgatcttaatagccattgctctaggcaaatatgccatattttataatccatgtttttttaaagt

SEQ ID NO: 32404 - DNA, 201 bp, Homo sapiens
tttcttttggttattgaaaaccaaataggaaattctgaattaatacttacatgctgaagtatctttgtggagcttattttgagcgttagagtgggagactkagttctaatgcaaactatagaagaatgaccttgggtaagtttgttgtctaattagtaaactgagtggtagagttggataatcctgtcagctttaggccca

SEQ ID NO: 32405 - DNA, 201 bp, Homo sapiens
ataaatctattactaccgagatttgagttatcttttcgattcacagagtactcagggagtctctcaggttgctcctgcagagccagttgcagtagcacagmcccaagctacccagccgaccactttggcttcctctgtagacaggtacgtaaaactagaattctccttccttgactggtaaataagacggtatgaaacgcc

SEQ ID NO: 32406 - DNA, 201 bp, Homo sapiens
ttactagtaaatttagtgcttctaggacgtagtggggagggataaggaaaaaaataagtagattattggggatagtgaatgataaatctattactaccgaratttgagttatcttttcgattcacagagtactcagggagtctctcaggttgctcctgcagagccagttgcagtagcacagccccaagctacccagccgac

SEQ ID NO: 32407 - DNA, 201 bp, Homo sapiens
ataaggggattttttttctttttttttttttttttagttttttaatttattagtaataacaacttgagaattgcatagtattaaggcatcagttcttggartgtgggctgaggacccttttggggtgcctatgagggcaacactattttacagtaaaactaagacattattttcctttttcactatagacaaaaatttagc

SEQ ID NO: 32408 - DNA, 201 bp, Homo sapiens
acataagtaaagtccaagtggaccaaagatgaaatattatatcataaaatagtactatatgaaatcataaggggattttttttctttttttttttttttttagttttttaatttattagtaataacaacttgagaattgcatagtattaaggcatcagttcttggagtgtgggctgaggacccttttggggtgcctatgag

SEQ ID NO: 32409 - DNA, 201 bp, Homo sapiens
ctgagttgttcagccttagcagcagctactgaagagaaactgttttcatcaccctattataccaaaacaaatggctaaacaaaaccttggaatcttcccttcttgcatggcttcccagttcatcctcttctcattctgtggcttgccattcatcatcccgtgaagttttccctcttcctgaaattgtaacctaggcttctt

SEQ ID NO: 32410 - DNA, 201 bp, Homo sapiens
aatttctcacatgttaaaatgatcaggtagtggagagggatgattgcatcctagaatgagtgaaatatgtgaattataccaatttttattgagccatgttrgacttaagaattttagaaataatacgaatgaaatcttaattccactgggaaggaattcatttgaatttcagtaactactgtaacagcagtcgtaacttta

SEQ ID NO: 32411 - DNA, 201 bp, Homo sapiens; identical to SEQ ID NO: 8182

SEQ ID NO: 32412 - DNA, 201 bp, Homo sapiens
tcttttaaagagacagtgccacagaagccccaccccatacctccccaccacacacacacacacacacacacacacacacacacacacacacacacacacaygattcccaaccactgactcacaggcacaggcagcttctcttgcactcatacagacccatagcatttctagttctagaacttcttcattgttactatatta

SEQ ID NO: 32413 - DNA, 201 bp, Homo sapiens
cctgattgggcataggtgaacataggttattagtaggagcaggtttatgctgaaggaagtcagccacattatgcatgcataaaaattgccattattgatayagtaatcttgccaagaatatagaccagcctgatacaggatatgaaaataactgaatgatcttggaacttattttatccatgaactaatatgttaacacgt

SEQ ID NO: 32414 - DNA, 201 bp, Homo sapiens
ggtgccacggaactgtatttactgtgattgttttcattcagtcccagcaacctctagaggatcttgatgctcaattgagaagaacacttagtccagagatkatcacagtgacttctgcggttggtgtaagttttgaaaatcttgataaaatctcctcataaccctaatatattatatgcctgggacacaaactgtaaccta

SEQ ID NO: 32415 - DNA, 201 bp, Homo sapiens
gtggtgcaatcttagctcactgcaaccaccgcctcccaggttcaagcagtcctcctgcctcagctttccacgtagctgggactacaggtgcctgccaccamactcagctaatttttgtatttttagtagagacggggtttcaccatgctggccaggctggtctcaaactcctgacctcaggtaatccaccctcctcggctt

SEQ ID NO: 32416 - DNA, 201 bp, Homo sapiens
gagagattggcacagaactacagtagtatatgtattagttctgattaataaatgtttcaatttttatgatactgttattctttttttttttttttttttttgaggcggagtctcactgtgtcacccaggctggagcgcagtggtgcaatctcggctcactgcaacctccacttcccagcctcaagtgattctccctgcctc

SEQ ID NO: 32417 - DNA, 201 bp, Homo sapiens
tggcttctgtttctattagtttttggttttgaaacaaagttttcggttcttaattacaaatggccctttttcagtccaacatatggtcatgtagtcattcsatactggtttaagatcaggagttgcttgtacaagatgaaaatcacttaaaggcactttctacagaaacagttgattagtttgtttatacatgcattcact

SEQ ID NO: 32418 - DNA, 201 bp, Homo sapiens
attgcttgaacccaggaggcggaggttgcagtgagccgagatcgtgccactacactccagtctgggtgacagagcaagactctgtctcggggggaaaaaaraaaggtaagtgagcaaacatctgtttggtgccagtaatattaatagtttagactttaacctttgcttataacagtttttgtgggaaggtttattagttgg

SEQ ID NO: 32419 - DNA, 201 bp, Homo sapiens
ctttggagagacagggtcttgctttgtgcccatgctggtctcaaacagctgggctcaaacgatcctcctgcctcagcctcccaaagtgctgggactacagstttgagccaccacacctggccctagacttttaaaatgctatcaaaataatcagaagggccaattgtgttagctcatgccagtaatcccagcactttggga

SEQ ID NO: 32420 - DNA, 201 bp, Homo sapiens
cagttcctaattagaatgcaaattacaagtcacataaagctggttgagaatggaagtactgagtactaatctcctaacttgcttatctttggatgtagacraacaccaatgaactgagcaaattgtatgtgctctgttttttcttttccaaaggaattggttatctgtcttgtatttggggatatgtatgtatacttacta

SEQ ID NO: 32421 - DNA, 201 bp, Homo sapiens
  misc_feature (1)...(201): n = A,T,C or G, or insertion/deletion polymorphism (see Tables 1-2)
aggagaattgcttgaacccaggaggcggaggttgcagtgagccgagatcgtgccactacactccagtctgggtgacagagcaagactctgtctcggggggnaaaaaaaaaggtaagtgagcaaacatctgtttggtgccagtaatattaatagtttagactttaacctttgcttataacagtttttgtgggaaggtttatt

SEQ ID NO: 32422 - DNA, 201 bp, Homo sapiens
tgtacatagtatccattggttttaatgctattgggcagagtagaaacaggagtagtaacttggtttccttttattacattccttattgggtacttttggcracagagtgagaaccttaaagttcaattaataattgatgtaataactgaagagaaaaattaatgaacaggaaggtagatcagaaaacattgcccagaaagt

SEQ ID NO: 32423 - DNA, 201 bp, Homo sapiens
tctacagcagaaacaaaaattaatttttgtttcagtgatgtttttgttttagatacttttatagcatgtgttgtagaatcacaaaattgagccctcgatayatataggaagtgtattcggtctagaataattaacttctccaaagtcacttagataataagggagctacaaattataacccagaattcaagattcctagaa

SEQ ID NO: 32424 - DNA, 201 bp, Homo sapiens
tcttgttaaactgttcaacagcctttccctaccatctcaagaagttggtgataaaaattatcaataatgaattacagttttttaatttttgcctttgatgygattgtcttattttataatatgttagcatttaatatgaatatttttgttgacatttattttttatttttaaaaatagcattattgaagtatagttgacat

SEQ ID NO: 32425 - DNA, 201 bp, Homo sapiens
tccttttattacattccttattgggtacttttggcgacagagtgagaaccttaaagttcaattaataattgatgtaataactgaagagaaaaattaatgarcaggaaggtagatcagaaaacattgcccagaaagtagcatacagaaggaaatggaaaatgagagagaaattaaaggatattaaggataaactaaagttat

SEQ ID NO: 32426 - DNA, 201 bp, Homo sapiens
gctgaagtgctgattattagtcagtgggactgcgcacagcagatcatcatgtacttctggcatatccagaggtgacacttctccccagatgctctaagatrtaacattaaccgttagccattgtaaacaactggtttagagatctctttaagatgttaatacaagggtcactgtcatagatgcctctcagttgtcttaagc

SEQ ID NO: 32427 - DNA, 201 bp, Homo sapiens
actcacacacatttaaaaattgtttaaaaagaaaagaagagttggaaggggaaaaaaagagaatgagaggagacagtgtttagagagatactgagaatttycctgacttgaagacaaatacttgagtatttaagttattgcttaaaagaaaaaaaaaattaggcttcatgcagtggctcacacctgtaatcccaggctttg

SEQ ID NO: 32428 - DNA, 201 bp, Homo sapiens
ctgtcatagatgcctctcagttgtcttaagcaaagaaataatttgtccataaaactgctcatttttgacagtcctttcagctttttttcctaattgagttsagatactgaaggtctaccgagctggaccaggtatgactactttgaaagagtctaaataatatagtaaatatatatgtaaatttctaaaaaacaaataagg

SEQ ID NO: 32429 - DNA, 201 bp, Homo sapiens
  misc_feature (1)...(201): n = A,T,C or G, or insertion/deletion polymorphism (see Tables 1-2)
actgatgggaaagctgagatctggagaaggtgagtagtttacccaaacttacagcttataagaggtaaaaacagaatttaaatccaaataatctaattccncagctcaccatttgactactacccaattatgtccaaaaaaagggaagaaattaacatctctcccaagcaggaaagggaatatcaggaagactttaggaaa

SEQ ID NO: 32430 - DNA, 201 bp, Homo sapiens
ctgtgactataatattaaaatgcacagacacactataaattccctttcccttaattttctttgcctttcttttctttcttttcttttctgtttttttttttcttttttttttttgagacatagtttcactttgtagcccgggctggagtgcagtggcacgatctgggctcactgcaacctccgcctcctgagttcaagtga

SEQ ID NO: 32431 - DNA, 201 bp, Homo sapiens
atttagtccttattctcagcaatatgacttcactattctgaggactgtatgtgattttaaacaactggcttaaagatctctttaagatgtcaatataaggkttacatgaataaaaacctataagagaaaggaaaaaaaaatctagttttattttaatgttatgtaaataggtgcttttcactgcacattttacctgaagat

SEQ ID NO: 32432 - DNA, 201 bp, Homo sapiens
tcctgacctcaactgatccacctgcctcagcctgccaaagtgctgggattacaggtgtgagccaccgtgcccggccaatgatcttttttttttttttttttaaagtcattcgtagaaattggaaggaaatatctatcgtgctaacattcattagagtttaagattatgaatgacttattaaaatataaaatgataaggaca

SEQ ID NO: 32433 - DNA, 201 bp, Homo sapiens
gaacttatactctgggattttagaccacatattggttgaggagttgatgctagttttaatgtccatgcaaggacagaaagccttagaactaggtagagagrggagctagaacttagcctgtgtcaaaaaactgaactatccgtgaaaagagagacctcagtgctctagccagtgaaagctgcaaggaattttacctgtgtg

SEQ ID NO: 32434 - DNA, 201 bp, Homo sapiens
gctgagtgcagtggcgcaatcttggctcactgcaacctccacctcccaggttcaagcgattcttctgcttcagcctcccgagtagctgggactacaggtgygtgccaccgtgcctggctaattttttgtatttttaggagagacagggtttcaccatgttggccaggatggtcttgctctcttgacctcgtgatctgcccg

SEQ ID NO: 32435 - DNA, 201 bp, Homo sapiens; identical to SEQ ID NO: 8212

SEQ ID NO: 32436 - DNA, 201 bp, Homo sapiens
aaaaaagacaggcataatttaaaagcttctgaagaacttctagaaataagaacattaaaattcaaacataaatggtctaacggttaaacagcagactgaaytgaattgacaggaatattaactacgaagaaatgagcaacagaacgcacaaaaaagacagaaaatatttaaagaggatgacatagtagtgagaagacccag

SEQ ID NO: 32437 - DNA, 201 bp, Homo sapiens
tcccatttaagatcttgaggtttttagattaaaaagcagcaaaatatttgtacacagtaatcataattggggtgtgtgtgtgtgtgtgtgtatgtatgtatgtgtgtgtgtatgtataggggtgtgtgtatgtgtatgtatgtatgtatgccaccatacagcagcgtaattatgtgtatacatacgtatgcacacacggtt

SEQ ID NO: 32438 - DNA, 201 bp, Homo sapiens
actgaggctacattacatctttgttggtgaaatcaggagtagaggaaagggtagaaactagaacagatacagattgggaagtggagaggtaagattcttakcccataattttcagagaaagtagttgtttgttgatggcaccaaacagggctcctgatttatgataaagaatcataaatttggtaaaagttacagtctgaa

SEQ ID NO: 32439 - DNA, 201 bp, Homo sapiens
tcctctgtcttcacagaatctcgagtgagcagccaacagacagtttcatatggttcccaacatgaacaggcacattctacaggcacagtcccagggcatayaccttctactgtccaagcacagtctcagccccatggggtatatccaccctcaagtgtggtaagtaaatgcttaagagcatgtaatactacaatgagagcc

SEQ ID NO: 32440 - DNA, 201 bp, Homo sapiens
gcctgttttaccacatagcaaaagcattttcccatttaagatcttgaggtttttagattaaaaagcagcaaaatatttgtacacagtaatcataattggggtgtgtgtgtgtgtgtgtgtatgtatgtatgtgtgtgtgtatgtataggggtgtgtgtatgtgtatgtatgtatgtatgccaccatacagcagcgtaatta

SEQ ID NO: 32441 - DNA, 201 bp, Homo sapiens
tgaaaattattttttcaaactaatggtgttttatttttgttccttttcttttccctctgtttggaagatattccatcaaagaccttttgaaccatgccttyttccaagaggaaacaggagtacgggtagaattagcagaagaagatgatggagaaaaaatagccataaaattatggctacgtattgaagatattaagaaat

SEQ ID NO: 32442 - DNA, 201 bp, Homo sapiens
gggctttgaattttttcagatattggaactttgaattatacttaccagttaagcctcccaaatctgaactccaaaatgttcaaatgagcatttttgttgtrtgtcatgttggtgctcaagttcagattttctattggagcattttggatcttggattttctgatttggatgctcaagcctgtgccaagttttaaattttga

SEQ ID NO: 32443 - DNA, 201 bp, Homo sapiens
attcaagacaacctttatggtattgatcatactgccttatagccatattaaaccctgtgcctgaacatttttttaagtttttttttttttttttgacagcstctcactctgtctcccaggtgggaatacagtggcgtgatcttggctcactgcaactttcacctcctgggttcaagtgattctcctgcctcagcctcccca

SEQ ID NO: 32444 - DNA, 201 bp, Homo sapiens
gcttcaagcaatcctcctgtttcagcctcccaaagtattgggattacaggcttgagaaaccctcttaatttaaggactgcagaagcttactttttttttttgcataagggcctttgatagtcattgtttatggctacaaactaatttgattttgactaaattatctgagttataaacttcatttatttccaccttagttat

SEQ ID NO: 32445 - DNA, 201 bp, Homo sapiens
agttgaaacattgaactgtcatgttttgtctgctttggtatctatcataagtctgttccaagccaattactgctttagctttgattattctttttttttttgagacagtctcgctctgtcacccaggctggagtgcagtggcatgatcttggctcactgcaacctccgcctcctgggttcaagtgattcttctgccttagc

SEQ ID NO: 32446 - DNA, 201 bp, Homo sapiens
accaagggcatacagatgtatccctaagttttcttctaagagttctatcaatttaacttttctatttaggttattgttccatttttaagttaacttttgtrtatgccgtgaggtagggtctgatttcattcttttacatgttgatgtccagttatcccagcatcatttgttgaagagacttttacctattgaatggtcttg

SEQ ID NO: 32447 - DNA, 201 bp, Homo sapiens
gatgcatacgacaaaacaaagatgaaaggtaagttgcctcttttgatctgggtgatacttgaacaaaacctaaaaagtaatgtgctttgagtacaacacayattctacggtgtatttaatatttgtgattggtttctctatttgtgcctgtaacatttttaaaggtagggttttgttcattgtggttattcagatttgata

SEQ ID NO: 32448 - DNA, 201 bp, Homo sapiens
catgctaccatgcccaactaatttttgtatttttagtagagatggggtttcatcacgttggccaggctggtctcgaactcctgacctcaagtgatccatcwgcctctgcctcccaaaacgctgggattacaggtgtggctcctcacgtatagtttaagtcatcactaaattacttataatacctaatacaatgtaagtgct

SEQ ID NO: 32449 - DNA, 201 bp, Homo sapiens
ccttttatcaatacatcatgctcttctttatctcttgcatcagtatttttacttattttgcctgatattagttttgctacctcaccctcttttatttactrttagcatagaatatcatttttctttcatcctttgaatttcaacctatttctgtccttggatctataatgagtctcttgtagacagtatatagttggcttt

SEQ ID NO: 32450 - DNA, 201 bp, Homo sapiens
aggagaaatatgatgaatccgttgacgtttatgcttttgggatgtgcatgcttgagatggctacatctgaatatccttactcggagtgccaaaatgctgcrcagatctaccgtcgcgtgaccagtgtaagtcttcccctaactgattgttgaacttggggcatatctaacaaagaatcccaaggtggatgacatcaaacca

SEQ ID NO: 32451 - DNA, 201 bp, Homo sapiens
ccagcaggtggaggttgcagtgagcggagatcgcaccatcgcactgcagcgtggtgacagagcgagactccgtctcaaaaacaaacaaaaacaacaacaamaaaaaaacttatgtccgattccttttggtttacaggcagaaatttacaggtagacacatttctttcttgtactatcgatgcttattgatactgatgctgg

SEQ ID NO: 32452 - DNA, 201 bp, Homo sapiens
tcatgctcttctttatctcttgcatcagtatttttacttattttgcctgatattagttttgctacctcaccctcttttatttactattagcatagaatatsatttttctttcatcctttgaatttcaacctatttctgtccttggatctataatgagtctcttgtagacagtatatagttggctttttttctttcttttta

SEQ ID NO: 32453 - DNA, 201 bp, Homo sapiens
aggaaagaagtgcattgttttggtgactgaacttatgacgtctggaacacttaaaacgtaagttcatcagtattacaaaagctgaccaagaagtatgagakaatttgattttttaaatttcaggtctaccagtttcactttggttgttcagcctaagaagggaacagtccttccaactgttactgtattagcatatttcct

SEQ ID NO: 32454 - DNA, 201 bp, Homo sapiens
aattgataccaacttagctttaatacagcatacaaatctctgatcctatacagcctcactcctccttcccattttatgttttcattgtctcaaattttatstttatacattgtgtacccattagcatagttttataatcattattttacatgcatttgtcttttaaatcatgtaggaaataaaaggaattataaaccaaaa

SEQ ID NO: 32455 - DNA, 201 bp, Homo sapiens
gcccagctaatttttgtatttttagtagaggtggggtttcaccatgttgaccatgctggtctcaaactccttacctcaggtgatccacctgccttggcctmccaaagtgttgggattacaggcgtgagccaccgtgcctggccccaaaccgaaactcttagctcttaaaaactgagtccccattgtcccctttccctggtc

SEQ ID NO: 32456 - DNA, 201 bp, Homo sapiens
ccattaaagatgaacaacagatcatttttcattgcatggcaaccctaagagctctctagcttagcagagcatgatgggagtctttccatccccccccccccaccccccgcccgctcgttcctcttctttttttttttttttccttcctttccttcttccacaattaatccctaaataatgattttcctaagctcgcgcgga

SEQ ID NO: 32457 - DNA, 201 bp, Homo sapiens
gctgatatataattcgtggttggcagtcttcaggttttttttggggttttgcttttgtttcttttagcactttaaatatgtcatcccactgctttctgccstctatggtttttgctgaaaaatcagctcataatcttattgaggatcccatggtcataagtcacttctcccttgctactttcaagattctctctttgtctt

SEQ ID NO: 32458 - DNA, 201 bp, Homo sapiens
  misc_feature (1)...(201): n = A,T,C or G, or insertion/deletion polymorphism (see Tables 1-2)
tttaaatatgtcatcccactgctttctgccctctatggtttttgctgaaaaatcagctcataatcttattgaggatcccatggtcataagtcacttctccnttgctactttcaagattctctctttgtctttgccttttaacagtttgaatatagtgtttctcattgtggatctatttgcatttatccttagagtttgttg

SEQ ID NO: 32459 - DNA, 201 bp, Homo sapiens
aacatttccatcatatcggaaaatgcccttatgccgctttccaggcagccttttccttaccctccatccagcatgactgttttgatatattttttaaaccrtaaaacccacttttgctattagttttcttcaattagcccacccaaatgaagtaaaattttattttagttctgctatttgatttttagttagatctggatc

SEQ ID NO: 32460 - DNA, 201 bp, Homo sapiens
  misc_feature (1)...(201): n = A,T,C or G, or insertion/deletion polymorphism (see Tables 1-2)
atacaattcagtggtttttaaagtatattcagaattgtgcaaccatcacagtactaagttttagaacattttaatcacttcctccaaaaaaaaagaaaacnccatttcccctcaactcttccagttgtgtggataaccactaacctactatgtctctagatttgcctattctggacattttatataagtggaaccatataa

SEQ ID NO: 32461 - DNA, 201 bp, Homo sapiens
ttcttttccctctgtttggaagatattccatcaaagaccttttgaaccatgccttcttccaagaggaaacaggagtacgggtagaattagcagaagaagaygatggagaaaaaatagccataaaattatggctacgtattgaagatattaagaaattaaagggaaaatacaaagataatgaagctattgagttttcttttg

SEQ ID NO: 32462 - DNA, 201 bp, Homo sapiens; identical to SEQ ID NO: 8175

SEQ ID NO: 32463 - DNA, 201 bp, Homo sapiens
aagattggagacctcggtctggcaaccctgaagcgggcttcttttgccaagagtgtgataggtatgtttcaggtgtaccttggagcctgactggctttctsacattccttttatttagaatcctggctctgtcagagttttaagtgatataaaccttaagaaattcatagcttgaactcaggaggtgatccattgtactta

SEQ ID NO: 32464 - DNA, 201 bp, Homo sapiens
tcgaaatcggcagaggctcctttaagacggtctacaaaggtctggacactgaaaccaccgtggaagtcgcctggtgtgaactgcaggtaaagccccacctmctttatttgacagtcctttggatcccaaatttggctcggcgaagccagttgatcgagttcacccttcacttggcattctctgttggactccgagtgggac

SEQ ID NO: 32465 - DNA, 201 bp, Homo sapiens; identical to SEQ ID NO: 8177
  misc_feature (1)...(201): n = A,T,C or G, or insertion/deletion polymorphism (see Tables 1-2)

SEQ ID NO: 32466 - DNA, 201 bp, Homo sapiens
  misc_feature (1)...(201): n = A,T,C or G, or insertion/deletion polymorphism (see Tables 1-2)
agggcacattcacagatgacttgcacaagttggtagacaattgggcccgagatgccatgaatctctcaggcaggagaggaagcaaagggcacatgaattangaggtaagtctctcttttgccgcagagaatccgtaacacacatctgagtcaaggtgatagaaacaactaagctgctgcttaacgtcttacgccacgacct

SEQ ID NO: 32467 - DNA, 201 bp, Homo sapiens
ttgagaatgtatacagattcctaagcaagtagattgaaaacattcatattcatttctggaagaatggataactaggaccattggcagcatttggagaggcrgattgggaaggaatgggaattaattccaaaatgcatgctttttggacctttcgagtttctacctttgttctctatgtatatttacattgaaacagataaa

SEQ ID NO: 32468 - DNA, 201 bp, Homo sapiens
gaaaacattcatattcatttctggaagaatggataactaggaccattggcagcatttggagaggcggattgggaaggaatgggaattaattccaaaatgcrtgctttttggacctttcgagtttctacctttgttctctatgtatatttacattgaaacagataaaacacccatagctgaaaaataagatgggaatgtatg

SEQ ID NO: 32469 - DNA, 201 bp, Homo sapiens
tcaaagaaggccctgtcctagcaactagttcaggagctggtgtttttaagatgggacgatttcaggtaagacagtcactttgtgttgccttgattccttcytttggaggagttgtctatataataaaattactgcctacctatttgggacacaattgccagtctagtgatttctgtcacatagtactttatagctcttttt

SEQ ID NO: 32470 - DNA, 201 bp, Homo sapiens
  misc_feature (1)...(201): n = A,T,C or G, or insertion/deletion polymorphism (see Tables 1-2)
gaggctcctttaagacggtctacaaaggtctggacactgaaaccaccgtggaagtcgcctggtgtgaactgcaggtaaagccccacctactttatttgacngtcctttggatcccaaatttggctcggcgaagccagttgatcgagttcacccttcacttggcattctctgttggactccgagtgggacggggaggccaac

SEQ ID NO: 32471 - DNA, 201 bp, Homo sapiens
tcccagcctctacccactagataccagtagcacgctccctctgtacctgccttctagttgttataaccaaaagtgtgtccagacattgctatatatggccmctagaagacaaaattgccccctgttgagaatcacttatctaaagaacaaggctgtccctttcagactttatatgttagaaactcaaagctggaaaaataa

SEQ ID NO: 32472 - DNA, 201 bp, Homo sapiens
tagtgtctttccttttccttctatttgttttcaatatgaattatattagtttattatcttagccaaggttttattttggcatattgtataaagaaattcawtttacacagtaaatcaataaatagatccttgaccttattccagtttcatataaaggccttgcagtggaagatcttttatgagatatttgatggaacagac

SEQ ID NO: 32473 - DNA, 201 bp, Homo sapiens
ccaaggtggatgacatcaaaccatgtaaaagaggacaatagtggaaggcatactgagtgaactgttggggttgggggggtggtgttgaggtatgtgtaagkctattgctcatgatacagtgaaagataaagatcaaagaaccactagtttatcctgtacccaccttgcattcatttaaatctttattatgtttaaaaacac

SEQ ID NO: 32474 - DNA, 201 bp, Homo sapiens
ccccatctctactaaaaatacaaaaattagccaggcgtggtggtgcacccctgtaatcctagctactttggaggctgaggcccgagaatctctggaacccrggagatggaggttgcagtgagccaagattgtgccactgcactccagcctgggtgacagagtaagactctgtctcaaaaaaaaaaaaaaattcctttgtct

SEQ ID NO: 32475 - DNA, 201 bp, Homo sapiens; identical to SEQ ID NO: 8172

SEQ ID NO: 32476 - DNA, 201 bp, Homo sapiens; identical to SEQ ID NO: 8176

SEQ ID NO: 32477 - DNA, 201 bp, Homo sapiens
gggactacaggtgcccgccaccacacctggctaattttttgtatttttagtagagatggggtttcactgtgttagccaggatggtctcgatctcctgaccytgtgatctgcccacctctgcctcccaaagtgctggaattacaggcatgagccagaaatgtttattattaaaaactgataggaaacattttgctttaggta

SEQ ID NO: 32478 - DNA, 201 bp, Homo sapiens
tcttttctgtttttttttttcttttttttttttgagacatagtttcactttgtagcccgggctggagtgcagtggcacgatctgggctcactgcaacctcygcctcctgagttcaagtgattctcctgtctcagcctcctgagtagctggaattacaggtgcgcgccgcacctggctaatctttgtatttttagtagagac

SEQ ID NO: 32479 - DNA, 201 bp, Homo sapiens
tgacaaactagaatctcgtggtagtacatttggggaaaaggttcattagtaactactacatacttgaaagcaggtttaggaatatgctgttaattcttgtytgaatgaagaggattatggtattttgaattatgtttggttatctttcacagacatctcaaagagattcaggacctgcagagtcgccagaagcatgaaatt

SEQ ID NO: 32480 - DNA, 201 bp, Homo sapiens
agtagagacagggtttcgccatgttggccaggctggtcttgaattcttgacctcaagtgatccacctgcctcaccctcccaaagtgctgggattacaggcrtgagccaccgcgcctggctcctttcccttaattttctgaaagaaaaattcacatacagccgtgtgaattgactggactgtgaaattaaaataatggattt

SEQ ID NO: 32481 - DNA, 201 bp, Homo sapiens
ccattttgtgatttgtctttctctctctcttttttttggcgattcatttttccttcagctgatgggacggttgacagtggtcagggatcctctgtcttcayagaatctcgagtgagcagccaacagacagtttcatatggttcccaacatgaacaggcacattctacaggcacagtcccagggcatataccttctactgtc

SEQ ID NO: 32482 - DNA, 201 bp, Homo sapiens
attaccctcttacagattgcttagcacagtagatagtactggtactgatagtaggctgtggttattgtctatgaaatatgagttgtcatcttcttgggggkgtgtgtagaatgaaagatggcctttaaggatgataaaggcttaaaataacatctatgaaactttgaactgattaggaaataataattgtgaagcagcacc

SEQ ID NO: 32483 - DNA, 201 bp, Homo sapiens
cagccccaagctacccagccgaccactttggcttcctctgtagacaggtacgtaaaactagaattctccttccttgactggtaaataagacggtatgaaaygccaaactgtcagacctttaaatctcatattataaactgcacttttttttctttttaaatttcaaagtgcacattcagatgttgcttcaggtatgagtga

SEQ ID NO: 32484 - DNA, 201 bp, Homo sapiens
caaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgttac

SEQ ID NO: 32485 - DNA, 201 bp, Homo sapiens
agcaaattcaatcatttctttttgcccgaaatgtatgactaggtactaatacaatctgacttttttattaaaacatgtaatgaagtaattagggaggaaayataagccagtagattcaaaactgaggggaaaaataacaaaagttgtagtggatcaaagtagatttgtagatcaacatgctatatgagtgatattgctaaa

SEQ ID NO: 32486 - DNA, 201 bp, Homo sapiens
atatgggagagggaaatagatgaagaatacagagaattacagaaaaagccaagaagcacggccataccaagatatagtctgtataatagatattgtagtakgtgtttatttctgcacttagtactgttgtctatgttttaagattactccatattttttatcaaaaacagatatttataggagctgacttaggctagcaga

SEQ ID NO: 32487 - DNA, 201 bp, Homo sapiens
gcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgtta

SEQ ID NO: 32488 - DNA, 201 bp, Homo sapiens; identical to SEQ ID NO: 8180
  misc_feature (1)...(201): n = A,T,C or G, or insertion/deletion polymorphism (see Tables 1-2)

SEQ ID NO: 32489 - DNA, 201 bp, Homo sapiens
agcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtgtt

SEQ ID NO: 32490 - DNA, 201 bp, Homo sapiens; identical to SEQ ID NO: 8179

SEQ ID NO: 32491 - DNA, 201 bp, Homo sapiens; identical to SEQ ID NO: 8181

SEQ ID NO: 32492 - DNA, 201 bp, Homo sapiens
gaagcaaatttttggttttgttgtagattccacagttgtacagtttgggggttataaaaaattggaagttagtaaggaaattgatacagaggagaaataaataatctaatcctaggactgaagtaactaaaatttattatctaattatgctgtggtggatttcctcttgttctgccaccttctccaaataacaaggctgtg

SEQ ID NO: 32493 - DNA, 201 bp, Homo sapiens
aggagtgaaacctggaactgctccctccaagccacctctaactaaggctccggtaaaattattgttataaaataattagataaatatgatcagttttttttctccctaatgagtacatttttcacttcagccttgtaagttagaaacatatttataaaggtacctggcttatagtatttattaaattgacagcagtttgag

SEQ ID NO: 32494 - DNA, 201 bp, Homo sapiens
  misc_feature (1)...(201): n = A,T,C or G, or insertion/deletion polymorphism (see Tables 1-2)
ttgaactttttggatgtgtagattcatgtcttttactaagtttgggaaatttgtggccattattttcttaaatattctttctgctcttttctgtcttcttnatctaggactcccattgtgtatattttgctcaacttgatggtgtcccacagatctcttagactctgctcatttctgctcctcagactgtacagtttcact

SEQ ID NO: 32495 - DNA, 201 bp, Homo sapiens
gtgatctcagctcactgcaacctctgcctcctgggttcaagcgactctcctgcctctgcctcctgattagctgggactacaggtgcatgccaccacgcccrgctaattttttgtatttttagtagagatggggtttcaccgtgttagccaggatggtctccatctcctgacctcgtgatccgcccgcctctgcctcccaaa

SEQ ID NO: 32496 - DNA, 201 bp, Homo sapiens
ttgaacccgggaggcggaggttgcggtgagctgagattgcgccattgcattccagcctgggcaataagagcaaaactccatctcaaaaaaaaaaaagttckttaaagaagtttagtttcgtatattgactaagctatagggggaaaagccttactgtgccttttccacttcctacccactcaagataacctaagttggctt

SEQ ID NO: 32497 - DNA, 201 bp, Homo sapiens
ttttttcatttaagtatagtgaatctttgaacttgataggtgaatttctggttttttatcttcttgatattggtgtttaaaatggatttatcttcatggawatatttatgttatagtattaaaatctgaaattgaacttagtatacaaaaaatagatttttaaaatgtttatactagctccttatcaatgtttaaaatttt

SEQ ID NO: 32498 - DNA, 201 bp, Homo sapiens
ctatggtcgtgccactctactctagcctgggcaatagagcaacaccttgtctcaaaaaaaagtttgagctatgtatgtttgaagggcttgtgttctcaaawtggtgagaaaagggtggcgatttgatactatttatgaaccagacactgtgttttatatatattctcttttattcttgtgtcatatattcttatgtcacct

SEQ ID NO: 32499 - DNA, 201 bp, Homo sapiens
tcattcgtagaaattggaaggaaatatctatcgtgctaacattcattagagtttaagattatgaatgacttattaaaatataaaatgataaggacagtacrtgtaaactctagaacgaattttaaattcttagtaatactggtaatagttattaatacaggtatgacttctctctcgtgctgtttctggtgaacaccacca

SEQ ID NO: 32500 - DNA, 201 bp, Homo sapiens
gaggaaatataagccagtagattcaaaactgaggggaaaaataacaaaagttgtagtggatcaaagtagatttgtagatcaacatgctatatgagtgataytgctaaacagtaacaggtgtttctgttatgtgactcctgagccttaatttcctcatatgattatggtagtcataactgccaggcctactaaggttgcgaa

SEQ ID NO: 32501 - DNA, 201 bp, Homo sapiens
tagaaatttggctgttgggattggccaagactcagcagttgttacgggcatactcctaagttaggttttcagtcttgtctacctgttaagttaggttgcarttagtccacacagactcaaattagaagtacaaagtccttctcgggccatatttagtttgctttaacaacaggtatgtgcagccatcaccacagtcaactt

SEQ ID NO: 32502 - DNA, 201 bp, Homo sapiens; identical to SEQ ID NO: 8165

SEQ ID NO: 32503 - DNA, 201 bp, Homo sapiens
cattattaaatgggagtaattatagtacctattcaacaaaattggaatactaaatgcaggaaacagtgacagccaaatgttaacagtatagaaaattttasctcaacaaatagagaatatcagtaaagacatagaaattacaaaaattaaacaaattcaggaactgaaaaacaataattaatagaatatgtaagcatatca

SEQ ID NO: 32504 - DNA, 201 bp, Homo sapiens
gatttataaaactcaaaaaagagtttaatatctaacacaggaaatcttttcttagtcctttaccattgaattctaagtggtgaaataaaactttggctctytaaagtcagctcagctattacaggtctgatttgccgtccttacgccagaattgaagaagagcaaaacatcaaaattccttgagtaaaaagagaagacttg

SEQ ID NO: 32505 - DNA, 201 bp, Homo sapiens
gcaacgaggcaaaagtttgagtgactgaagctaaagatttgtggtgtctgtctgtgtgtgttttacagcctgtgtccatggcggctccaacagcaatcacrgaagcaggaacacagcctcagaagggtggtgagaaacatccttcctccttttatattactaattccagccctacccgtagttgattcaggaggtttaccg

SEQ ID NO: 32506 - DNA, 201 bp, Homo sapiens
gtgtgtgtgtgtgtatgtataaacacaattgtttagccatttatcgattggtagacatttggactgttcctaccattggctgttgtgaatagagctgctaygaagaatattcatgtacaagtttttgtttgaatatctgtttttacttcctttagatatatacctagaagtgaaattaccatgtgtatatgctaatcctat

SEQ ID NO: 32507 - DNA, 201 bp, Homo sapiens
gaccataggaaaggcaacgaggcaaaagtttgagtgactgaagctaaagatttgtggtgtctgtctgtgtgtgttttacagcctgtgtccatggcggctcyaacagcaatcacagaagcaggaacacagcctcagaagggtggtgagaaacatccttcctccttttatattactaattccagccctacccgtagttgattc

SEQ ID NO: 32508 - DNA, 201 bp, Homo sapiens
actgtgccagcctgtgtcttctgttcttaaaaggacagcagtcattgggttaaggacccacactgctcctggatgacttcatcttaactaattacttaackaattttttttccaaaaaaattcatattgtaaggtactagagattggaaccacaacatatctttttgagggacacagttcaaccccataacaattcatggg

SEQ ID NO: 32509 - DNA, 201 bp, Homo sapiens
aggtatttcttctgaattggtacaaactgaagaagtctgtatcccaaaagggagctaaatgcatctgtcagcaaaatgtacgtaaataatagcagttcatrgtctttgtttcagtgagaatgaagcaaatttttggttttgttgtagattccacagttgtacagtttgggggttataaaaaattggaagttagtaaggaaa

SEQ ID NO: 32510 - DNA, 201 bp, Homo sapiens
aaagtggatggattagagagattttgtttgtgaattagatttgagctaacctcatttgtttttttccacttaacatttatgaaaataaatgctcatgtacrtatatatacttaagatcaaacaatatcaaacctgattgtgaggttaaatatataactttagatttggggactataaaatttataatttgtatatgaaatg

SEQ ID NO: 32511 - DNA, 201 bp, Homo sapiens
caaaatgtacgtaaataatagcagttcatggtctttgtttcagtgagaatgaagcaaatttttggttttgttgtagattccacagttgtacagtttggggsttataaaaaattggaagttagtaaggaaattgatacagaggagaaataaataatctaatcctaggactgaagtaactaaaatttattatctaattatgct

SEQ ID NO: 32512 - DNA, 201 bp, Homo sapiens
gcctggctaatttttttttttttttttttttaaagtagagatggagtttcaccatgttggccatgctgctctcgaactcctgacctcaagtgatccgcccrcctcggcccccaaagtgctgggattacaggtgtgagccaccacacctggcccattctgtcgtattctaaatggagtagcaaactatgcttcttggccaaa

SEQ ID NO: 32513 - DNA, 201 bp, Homo sapiens
aggaagctgtgtgcttgcggtggatggaatggttaacaggatggaatacccagacctccttgccaccatctgtagggaagaagtatacatgtaagaaagargaaaataataccctgtgatagtgacagaatatgttaatgccatcttttattcataggggcaccttcccagaaagatgtataaaactgagaaagaaaagag

SEQ ID NO: 32514 - DNA, 201 bp, Homo sapiens
tctggcatacagccacactcacttgcttccatattatttatggctgttttcacactataatggcagagttgaataattgcaacagactgtatgatacatayagcctacaatatttactattaggcccttaacaggaaaatttacttactcctgtgttaaacatatgtcaccagaactttgtaaaacatgttcccctgtaga

SEQ ID NO: 32515 - DNA, 201 bp, Homo sapiens
ttttgtttcagaggaggctaaattttgtcagataaaataatgttttgggctaggtgcagtggctcacgcctgtaatcccagcactttgggaggccgaggcrggcggatcacaaggtcaggagatcgagaccgtcctggctaacacggtgaaaccccatctctagtaaaaatacaaaaaattatccaggtgtggtggtgcac

SEQ ID NO: 32516 - DNA, 201 bp, Homo sapiens
tccatgtggtagcatgtatcagtactttttaatagttaaataatattctattgcatatatatactacattttgttctattcagcaggttttatttcccttwagttctttagtttcttcctctttttctcaatgttaaactgcttgactctatagctgcctcttaatctggagagagattgagaacaatgttttagtccatt

SEQ ID NO: 32517 - DNA, 201 bp, Homo sapiens
tcacgcctgtaatcccagcactttgggaggccgaggcgggcggatcacaaggtcaggagatcgagaccgtcctggctaacacggtgaaaccccatctctastaaaaatacaaaaaattatccaggtgtggtggtgcacgcctgtagtcccagctactcgggaggctgaggcaggacaatggcgtaaaacccaggaggcaga

SEQ ID NO: 32518 - DNA, 201 bp, Homo sapiens
tccagcagcgatgaacaatttcatgaccaaaaagtagttttccaaagtccctttgtgacagagtccaattatgtggcctgagcctcagttaagatggatcmtatttccttttcttcatgtcctggctcttcctatgagattcccagtttcctatggaagacaaaatggcttaaatgtagctgccataattttaaaataaac

SEQ ID NO: 32519 - DNA, 201 bp, Homo sapiens
  misc_feature (1)...(201): n = A,T,C or G, or insertion/deletion polymorphism (see Tables 1-2)
cacagcctcagaagggtggtgagaaacatccttcctccttttatattactaattccagccctacccgtagttgattcaggaggtttaccgtttcaaagacncatttccacgtatttgataactgaggagcattggtagtaatatctaaagcttgaaagattagcaaattaataaatctgttccgttattatttgtcagagg

SEQ ID NO: 32520 - DNA, 201 bp, Homo sapiens
  misc_feature (1)...(201): n = A,T,C or G, or insertion/deletion polymorphism (see Tables 1-2)
aagtctggattttcttttgtttttatgaagttcagtgggagagcattctcttctgttaaaattgccactaattatgtgttttttctaaatcatattgtctncttttctccaaaacagttgaataatgtactcattttcataaaattttagaaaaattagtgagtaaatttttggcagttattttatttgacatgtgagtgg

SEQ ID NO: 32521 - DNA, 201 bp, Homo sapiens
ccaaaacagttgaataatgtactcattttcataaaattttagaaaaattagtgagtaaatttttggcagttattttatttgacatgtgagtggtatttgcyttcagatttcgaattccctgttgggaaagtaatatggttatgttgctgtgactataatattaaaatgcacagacacactataaattccctttcccttaat

SEQ ID NO: 32522 - DNA, 201 bp, Homo sapiens
gagagctggcatggtcattaatctggtagaatagtatttgaggaaacagttgcatgtgttaagctgcagtttcttttggttattgaaaaccaaataggaarttctgaattaatacttacatgctgaagtatctttgtggagcttattttgagcgttagagtgggagacttagttctaatgcaaactatagaagaatgacct

SEQ ID NO: 32523 - DNA, 201 bp, Homo sapiens
gttttttgttttatttcgttaacaacaacaacaaaaactgctaaccatctttttcttggggttgcactactgtccaatgagcacatagtgagggcagtacygctaacgcctacataacatgcctgcatcatctagagctttgctttaccttggtacaatttttggaagaatgaaaaactgcttttccacagggggaaaata

SEQ ID NO: 32524 - DNA, 201 bp, Homo sapiens
ggagggtttaaataagttcttagataatataatttatataattatataagcaatcatgatgattctgtgttgaaataggccttgaaatattgtaccttctcttttttttttttttttttttttgagacggagtctcgctctgtcacccaggctggagtgcagtggcgggatctcggctcactgcaagctccgcctcccggg

SEQ ID NO: 32525 - DNA, 201 bp, Homo sapiens
gggaacaatttgatagaataatgtttccaaaatcagagatctaatcttagaaggcttagttgaataacattggatatattactctgcggttcctaagtctrtgaattaatgggaattttgaaatctaattgaaatccaaggagaaagtgatagaaataaaattgtagtgagcgatgtcggctcactgcaacctccacctcc

SEQ ID NO: 32526 - DNA, 201 bp, Homo sapiens
ttcccatttaagatcttgaggtttttagattaaaaagcagcaaaatatttgtacacagtaatcataattggggtgtgtgtgtgtgtgtgtgtatgtatgtatgtgtgtgtgtatgtataggggtgtgtgtatgtgtatgtatgtatgtatgccaccatacagcagcgtaattatgtgtatacatacgtatgcacacacggt

SEQ ID NO: 32527 - DNA, 201 bp, Homo sapiens
tctcaaactcctggcctcaagtgatcctcctactttagcctcccaaaatgctgggattacatttacgagtaccatgactggctggtttttatattttttaatgtttggggaaaatgtcaaaagaagagtattttgtatgatacgaaaactacatgaaattcaaatttcagtgtccataaataagtttttctggcatacagc

SEQ ID NO: 32528 - DNA, 201 bp, Homo sapiens
cttcttttttggagataacctctcttaaacttctaaacttcaccatttgtactggttgcattctaggttgatgcttaggttggggatcttcattcattctmattttggagattcttcttatatctagctggtttttgatcctgcttccagaatcccatttctttctctttcttggtctcctcatttgtgaaagaataactt

SEQ ID NO: 32529 - DNA, 201 bp, Homo sapiens
gacatgtggcccatctaggttttctaaagctaaaaagctctggaatagtacatatggccctattacctatggattcttttcttttttttttttttttttttgagtgcagtggcatgatgtcggctcactgcagcctctgcctctgggttcaagcaattctccttcctcagcctcctgagtagctgggattataggcaccct

SEQ ID NO: 32530 - DNA, 201 bp, Homo sapiens; identical to SEQ ID NO: 8283

SEQ ID NO: 32531 - DNA, 201 bp, Homo sapiens
tttgctctgatgcacgtttataggaaagtctaagcagagactgcctagcaaacctttttgtataatgattcaacacattttctaatagggtaaaaaaaaaagcaatcatggaattgcagaatggaatctgggtatccactaggtactctggtcttcttacgctgctcagacatgtggcccatctaggttttctaaagctaa

SEQ ID NO: 32532 - DNA, 201 bp, Homo sapiens
cagtggagcctcatgcagcacattatcatttgttatttgggtttaataataattttgacatcttttcactcatacacaaaaaaagtcagaactggtgttayttactgttgatttcatcctcctgtgtatgaaataacaagcctagaggaatgaactagtgctactgaactgtttaaattatttttgtgttaatagtacact

SEQ ID NO: 32533 - DNA, 201 bp, Homo sapiens; identical to SEQ ID NO: 8171

SEQ ID NO: 32534 - DNA, 201 bp, Homo sapiens
agggaatacagcagacagcccctcctcaacagacagtgcagtattcactttcacagacatcaacctccagtgaggccactactgcacagccagtgagtcarcctcaagctccacaagtcttgcctcaagtatcagctggaaaacaggtaaacttttttttttttttttaaacaggtaaactcttaatttctgaaagggtgc

SEQ ID NO: 32535 - DNA, 201 bp, Homo sapiens
ttgccaaatgctgaagcattagcaaatatttctatgacaaaaggtgtagaacagtaatagtctatttagcctctttctctcctgctctcctttccatattyttatgtggcatattaacttaacactaatgtatgcagggttttgttggtttggtgtttttttttttgtttgttttttccttctttttggctaatacataaa

SEQ ID NO: 32536 - DNA, 201 bp, Homo sapiens
cacaaagtaaggctacaagtgatagcaattcccacctctcattggtaaattcaggggtctaatagccaccagtgacttggtacagcctctggggggatcartttataatagtgatgtctactacagtcttaaatggaaataattcagcactttcattgtggtatatttattgtacagatctataagagaatatttatttct

SEQ ID NO: 32537 - DNA, 201 bp, Homo sapiens
cccaaaactaaataattctgagggctgggtgcagtggctcacgcctgtaatcccagcactttgggaggctgaggcgggcagatcacgaggtcaggagatcragaccatcctgactaagacggtgaaaccccgtctctactaaaaatacaaaaaattagtcgggtgtggtggtgggcgcctgtggtcccagctactcgagag

SEQ ID NO: 32538 - DNA, 201 bp, Homo sapiens
gaatctcgctctgtcgccaggctggagtgcagtggcacgatctcgactcacggcaacctctgcctcctgggttcaagtgattctcctgcctcagcctcccragtagctaggactacaggcgcatgccaccacacccagctaatttttgtattttagtagagatgggtttcaccatgtttggccaggatggtcttgatctcc

SEQ ID NO: 32539 - DNA, 201 bp, Homo sapiens
gcaccactgcactccagcctggccaacagagcgaaactccatctcaataaaataaagatgggtccttaatgtcctcagtaaaatctcatccttcatttcayttacttatatatctgaattaaagaatgagtaattgagtttttaaagcctgttaacctttgtttttatagtatatgttaatgttgtagttggtatctagta

SEQ ID NO: 32540 - DNA, 201 bp, Homo sapiens
ccaggctggagtgcagtggcatgatcttggctcactgcaacctccgcctcctgggttcaagtgattcttctgccttagcctcccgagtagctgggactacwggcgcgcaccaccatgcccagctaatttttgtttttttagtagagacgaggtttcaccatgttggttgggctggtattgaactcctgacctcatgatccg

SEQ ID NO: 32541 - DNA, 201 bp, Homo sapiens
gaacatttccatcatatcggaaaatgcccttatgccgctttccaggcagccttttccttaccctccatccagcatgactgttttgatatattttttaaacyataaaacccacttttgctattagttttcttcaattagcccacccaaatgaagtaaaattttattttagttctgctatttgatttttagttagatctggat

SEQ ID NO: 32542 - DNA, 201 bp, Homo sapiens; identical to SEQ ID NO: 8183

SEQ ID NO: 32543 - DNA, 201 bp, Homo sapiens
accgttttagccgggatggtctcgatctcctgacctcgtgatccgcccgcctcagcctcccaaagtgctgggattacaggcgtgagccaccgcgcccggcstgtaccttctcttaagtcagcttgcaatttaaatttttagttagtaaatttaactaattttaaaatatgttagtgtctgtctgcttaactattgcatact

SEQ ID NO: 32544 - DNA, 201 bp, Homo sapiens
  misc_feature (1)...(201): n = A,T,C or G, or insertion/deletion polymorphism (see Tables 1-2)
ggaagtggagaggtaagattcttagcccataattttcagagaaagtagttgtttgttgatggcaccaaacagggctcctgatttatgataaagaatcatanatttggtaaaagttacagtctgaagtacaaaaccccaatgattttccattctagtgcttcagtgagaagcttaacagtgtactatgtataggtagataag

SEQ ID NO: 32545 - DNA, 201 bp, Homo sapiens
aagtgctgggattacaggcgtgagccaccgcgcccggcctgtaccttctcttaagtcagcttgcaatttaaatttttagttagtaaatttaactaattttraaatatgttagtgtctgtctgcttaactattgcatacttattaaagaaacatgcgtggttatccattggaagagatcgatcctagggcttcctgatacaa

SEQ ID NO: 32546 - DNA, 201 bp, Homo sapiens
atatttatatgttggaattcttgtaacaaccttccccccgtccccaactacttgcctgatattttaggttgacattattttgcaagctttcattgaatttytgttttggtgagcatgtcttttttgagacagagtcttgctctgttgcccaggctggagtgcagtggcgcaatttcagcttacagcagcctcaacctcctg

SEQ ID NO: 32547 - DNA, 201 bp, Homo sapiens
ttctcaaggttcgtccatgttgtagcaaatgttcatgcttcattcctctttaagtctgagtagtaatattccagtgtgtgtgtgtgtgtgtgtgtgtgtgkatgtataaacacaattgtttagccatttatcgattggtagacatttggactgttcctaccattggctgttgtgaatagagctgctatgaagaatattcat

SEQ ID NO: 32548 - DNA, 201 bp, Homo sapiens
  misc_feature (1)...(201): n = A,T,C or G, or insertion/deletion polymorphism (see Tables 1-2)
ttaattgtatgctatacttgtagtcttgacccagttgtcatgaaagtctatgccactgataatgagaagatccaagtaaaagtaggaatatatttagcacnactttggtgtgcttttaaaataataaaaaccgtagcaggcaatgatatcaactttttatatgaaggatagtgcgtttgaactggagcagtacacaagctt

SEQ ID NO: 32549 - DNA, 201 bp, Homo sapiens
accaccatgtctgtctaatttttgtattttttttttttttgtagagatggggttttaccctgtttcccaggctgcccatgaactcctgagctcaagcaatytggctgccttggcctcccaaagtgctgggattacaggcatgagccaccgcacccggcctgcatgtctgtcattttaagagtttcttctgattttctcacc

SEQ ID NO: 32550 - DNA, 201 bp, Homo sapiens
tgcctttcagagttctgtatcatcattcccagttcatgtctcttattattcccctttcttcccctgatgcgttgtaatttacattctctctttttttttttcctttgagcatagggtcgactgtttattgggtaatttcctcctttattttgtttaaaattgtagaaaacttaagaggtatatttgatttcttgtttttta

SEQ ID NO: 32551 - DNA, 201 bp, Homo sapiens
tgtttctgaaaaacagtctatctttgccacccccttccatcctccaaaaaagaaaaaggagaccagctagtacaaatacaaattgcaaattgagcataatytaccacttgaagaatgagagctatcagatgtatcaaccgaattaaaaaattccatcttttcacctctccagtctcgttctttttataacatcgttattta

SEQ ID NO: 32552 - DNA, 201 bp, Homo sapiens
tgctgcacctttagccaggatttctcaggaaatcccagtttactgccttgtaagtgattagatgagacccaaccacataattgagggtagtctcctttacwtaaagtcagctgattgtaggtttaaccatatctacaaaaatacctttatagcaacacctagttagtatttgatagaataattgaatactgtagcaaaatt

SEQ ID NO: 32553 - DNA, 201 bp, Homo sapiens
atagaagatgtaattatcaattgcttatttagattttgatagctgaacagaatggaaatgtttatttttaattttttatttatttatttattttttgagayggcgtctcgctctgtcgcccaggctggagtgcagtggcgccatctcggctcactgcaagctctgcctcctgggttcacgctattctcctgcctcagcctc

SEQ ID NO: 32554 - DNA, 201 bp, Homo sapiens
ccagtcttatcactaaatttttcttgttttggaaaatactgactttttaattttaaatatatatttgtaacataatgagttataatttttaatgaattaayatttttaaactttctcaggtttaccatctgccacggtaaatattaatagatgtaacacacatagtcaaaatccctctgaggtccccaataatgttaattt

SEQ ID NO: 32555 - DNA, 201 bp, Homo sapiens
agagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctcag

SEQ ID NO: 32556 - DNA, 201 bp, Homo sapiens
tagttctgattaataaatgtttcaatttttatgatactgttattctttttttttttttttttttttgaggcggagtctcactgtgtcacccaggctggagygcagtggtgcaatctcggctcactgcaacctccacttcccagcctcaagtgattctccctgcctcagcctcctgagtagctgggactacaggcacccgcc

SEQ ID NO: 32557 - DNA, 201 bp, Homo sapiens
tagagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctca

SEQ ID NO: 32558 - DNA, 201 bp, Homo sapiens
  misc_feature (1)...(201): n = A,T,C or G, or insertion/deletion polymorphism (see Tables 1-2)
agaagcaagtgctggcaattcttaggatctgaaagattgcgtcagagaattctgtgttgtgactcacttttatttttctagcagattagttggcaaaacanagtatatagaattcaaatgagaagtcagcctataaaatgtgcatatgtttttgtggggtttttttagttcaaataatacaacataaaatttgataaacat

SEQ ID NO: 32559 - DNA, 201 bp, Homo sapiens; identical to SEQ ID NO: 8279

SEQ ID NO: 32560 - DNA, 201 bp, Homo sapiens
ttagagactattggtaacattacgttacaagaaataaagtgaactttgttgataaaacctaatgtaatagccttttttgttgttgttgttgttgttgttgttgagatggagtctctctctgtcacccaggctagagtgcagtggcacaatctcagctcactgcaacctccacccaccgggttcaagcgattcttgtgcctc

SEQ ID NO: 32561 - DNA, 201 bp, Homo sapiens
caaaactcttggctgtaggttgaaaaagcagcataacctaccaaatttaaggttgtattatgcacagttattggttttgctatatcttaatatcttttgckcagtgagtattcctatttgtaaagtcatgaattcatatatgtttgcagggataggattaacaagaggattattattaaggataatcaaggatgaaagcag

SEQ ID NO: 32562 - DNA, 201 bp, Homo sapiens
tttgggtttaataataattttgacatcttttcactcatacacaaaaaaagtcagaactggtgttatttactgttgatttcatcctcctgtgtatgaaatamcaagcctagaggaatgaactagtgctactgaactgtttaaattatttttgtgttaatagtacactttgagtatctttttccacattaaaaactttctgaa

SEQ ID NO: 32563 - DNA, 201 bp, Homo sapiens
  misc_feature (1)...(201): n = A,T,C or G, or insertion/deletion polymorphism (see Tables 1-2)
ataagattgaggaaaatacagatagtgatctttgtagtcattctcataaatgaagcttttaaatacatgaatttaactttagggtcagccctgctacacanttccttgctgtgaaaagttagccctgggagtagaattctccaaattgggtcttcggaataatacaatgagtaattgagcattatccagctttggatataa

SEQ ID NO: 32564 - DNA, 201 bp, Homo sapiens
aactgggctttgtcttcaatgtggttgggcaaaaatcagtcacaatggaagaccctgaagtgcttgatatatcagagacatctttttttttttttttttttggagatggagtctcgctctgtgttgcccagggtggagtgcagtggcgtgatctcggctaactgcaacctctgcctcccgggttcaagcgattctccaacc

SEQ ID NO: 32565 - DNA, 201 bp, Homo sapiens
tgtgtgtcagtcttgtacttttgtaactttactgaattcttgtattagctcatctgtgtgtgtgttcattctttggggtttttttttttttttttttttttaaacagatggggtttcactctgtcaccgaggctggagtgcagtggtgcagtcatagctcactacagacttgaactctaggcttaaaggatcctcccacct

SEQ ID NO: 32566 - DNA, 201 bp, Homo sapiens
ttgttaattgctggtatatataaatacaactgatttttgtgtgtcagtcttgtacttttgtaactttactgaattcttgtattagctcatctgtgtgtgtkttcattctttggggtttttttttttttttttttttttaaacagatggggtttcactctgtcaccgaggctggagtgcagtggtgcagtcatagctcacta

SEQ ID NO: 32567 - DNA, 201 bp, Homo sapiens
ttggtttggtgtttttttttttgtttgttttttccttctttttggctaatacataaatcttgcttttggcagccttgctttttttttttttttttttttttaagcctgtctgttttgtttttctttaccttcccagcttccagtttcccagccagtaccaactatccaaggcgaacctcagatcccagttgcgacacaacc

SEQ ID NO: 32568 - DNA, 201 bp, Homo sapiens
tagcctctttctctcctgctctcctttccatatttttatgtggcatattaacttaacactaatgtatgcagggttttgttggtttggtgtttttttttttgtttgttttttccttctttttggctaatacataaatcttgcttttggcagccttgctttttttttttttttttttttttaagcctgtctgttttgtttttc

SEQ ID NO: 32569 - DNA, 201 bp, Homo sapiens; identical to SEQ ID NO: 8260

SEQ ID NO: 32570 - DNA, 201 bp, Homo sapiens
tacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctcactgcaacctccgcctcccaggttcaagcaattttcctgcc

SEQ ID NO: 32571 - DNA, 201 bp, Homo sapiens
ttacaagcagatgttgtattaaagaaaaaatataaattaggtattagaagatcttgaaagtcagccctaaacttcatttttttttttttttttttttttttttggagacagagtttcgatcttgttgcccatgctggagtgcaatggtgcaatctcggctcactgcaacctccgcctcccaggttcaagcaattttcctgc

SEQ ID NO: 32572 - DNA, 201 bp, Homo sapiens
  misc_feature (1)...(201): n = A,T,C or G, or insertion/deletion polymorphism (see Tables 1-2)
gaaaagtgccaccgattgcaaatataaatgaaaaactggggaaatatatatatttgtgggagggggaggggtatgtgtagtcatatcacaaaaagaactcnttttgctaatacaaagagttcctaaaattcaacatgaaccaaaaaacaatcaaaagataacagaaaaggaaacttagacatgaaaatatttaatgtccgt

SEQ ID NO: 32573 - DNA, 201 bp, Homo sapiens; identical to SEQ ID NO: 8270

SEQ ID NO: 32574 - DNA, 201 bp, Homo sapiens
ggccgcagaggaaaggaggggacttaggccgcataccgggagctgcagtcctggtccgccggtatcacagcatggctgggtctggaaggggaggtcacctsctgcagctgtgggtgtcccagggccatgttcggtcggcagctgttgtatcttgcctcctccacagacggttcaagatcttgtctcttcgctttagttaaa

SEQ ID NO: 32575 - DNA, 201 bp, Homo sapiens
tagaatagaagaactttataaagactgcacagaaaatatatttctgtgttctgacaaatattacttgtcagcatttcttgtcagtttctacctttaattgwtttttttctggattattataactagattttgctaagactttttttttaaaattttctcttgtctatactcatcatgggggagcattaggtctctatttta

SEQ ID NO: 32576 - DNA, 201 bp, Homo sapiens
atgtacatatagcctttgttctgttctccctaggggacaactttttactgtattttactattcattttataggtatatcgtagtaacccctataataacawcattagttgtcacaccgtttttttaagacagataccagagagtaacctcagtgataaacatgtcttaactatatatattttattcttatgtttgtgcatt

SEQ ID NO: 32577 - DNA, 201 bp, Homo sapiens
tgataaacatgtcttaactatatatattttattcttatgtttgtgcattcaaattagttgatttgctcttcagtacgcagtctttatatttagcgtctcayggacttgattttccctttgttgtctgtaggtgctgccagtgggtactgaacttccagcaggtactctacccagcgagcagctgccaccttttccaggacc

SEQ ID NO: 32578 - DNA, 201 bp, Homo sapiens
  misc_feature (1)...(201): n = A,T,C or G, or insertion/deletion polymorphism (see Tables 1-2)
ataaatatgatcagttttttttctccctaatgagtacatttttcacttcagccttgtaagttagaaacatatttataaaggtacctggcttatagtatttnttaaattgacagcagtttgagggtatatctacaatgaacatgagatttttttttcaagtgtggcaggattttagggttaattatgctgcacagttttcca

SEQ ID NO: 32579 - DNA, 201 bp, Homo sapiens
ataaatgaagcttttaaatacatgaatttaactttagggtcagccctgctacacaattccttgctgtgaaaagttagccctgggagtagaattctccaaawtgggtcttcggaataatacaatgagtaattgagcattatccagctttggatataactcttgtacttaaaagactttagagcttatcattttatgtatttc

SEQ ID NO: 32580 - DNA, 201 bp, Homo sapiens
gcttttaaatacatgaatttaactttagggtcagccctgctacacaattccttgctgtgaaaagttagccctgggagtagaattctccaaattgggtcttyggaataatacaatgagtaattgagcattatccagctttggatataactcttgtacttaaaagactttagagcttatcattttatgtatttcatttatttc

SEQ ID NO: 32581 - DNA, 201 bp, Homo sapiens
gagacttttacctattgaatggtcttggtactcttctcaaaaattatttaatcatatgtataggtttatttctggactctcaattctatttcattggcctrcatgtctgttcttatgccagtaccgcattgctctgattactatagtaatttttgtaaattttgaaaattagaagtgacttctccaattttgttcttcttt

SEQ ID NO: 32582 - DNA, 201 bp, Homo sapiens
aaggtcacaccactgcactccatactgggcaacagagcaagactccatctcgagggaaaaaaaaaaataagaaagaatttatttatactttataaagattytaaactattactgtgatgactactatgtagtatcacatgtgatagtggtaatgagttttcttctgagattaattgcagagcttgtctttcgtatgggtcc

SEQ ID NO: 32583 - DNA, 201 bp, Homo sapiens
agtgggcgagggtcttactccacaaggttgtaaccatgaaataatatttctgttttatgaaaaccaaatttaatctgtgttgtatccttacctaattgagwtggccattatttccctgcacaaatccccctccctctaatccttggtgagcttcttacattccagaactttatcaggaaagggctttcctccagtctttca

SEQ ID NO: 32584 - DNA, 201 bp, Homo sapiens
ggtcagttcgaaaccagcctgtccaacatggtgaaaccccatctctactaaaaatacgaaaaattagctgggcatgatggcgggcgcctgtacccatcagctcccagctacccgggaggctgaggcaagagaatcgcttgaccccggaagtggaggttgcagtgagccgagattgtgccactgcactctagcctgggtgac

SEQ ID NO: 32585 - DNA, 201 bp, Homo sapiens
acatgtgatagtggtaatgagttttcttctgagattaattgcagagcttgtctttcgtatgggtccaatatattacttttcattgtgttttatttgtgcargacaatttgctcttcagttatcataccaaaacaatataaatcctcaactcctttgagtttgttaaagattactataataatataatccctgccaaactaa

SEQ ID NO: 32586 - DNA, 201 bp, Homo sapiens
aggtcagttcgaaaccagcctgtccaacatggtgaaaccccatctctactaaaaatacgaaaaattagctgggcatgatggcgggcgcctgtacccatcagctcccagctacccgggaggctgaggcaagagaatcgcttgaccccggaagtggaggttgcagtgagccgagattgtgccactgcactctagcctgggtga

SEQ ID NO: 32587 - DNA, 201 bp, Homo sapiens
tggaagtaagtgaccccgctgtcactgttccatgttttcttgtgaagagctaagttgtcactacccaactgtgacactgcatggaccaactcctgcaggcragtcagaaaaaaagccgggatagtaagaaaggaacctaaaagaaccttaattggaaatttaaaaaacaaagttcaaaggccctgcttttattaatgtatt

SEQ ID NO: 32588 - DNA, 201 bp, Homo sapiens
  misc_feature (1)...(201): n = A,T,C or G, or insertion/deletion polymorphism (see Tables 1-2)
gaatgggaattaattccaaaatgcatgctttttggacctttcgagtttctacctttgttctctatgtatatttacattgaaacagataaaacacccatagntgaaaaataagatgggaatgtatgagtcagaaaatttggattaaggccaggcgtggtagttcacacctgtaatcccagcactttgagaggctgaggcgga

SEQ ID NO: 32589 - DNA, 201 bp, Homo sapiens
  misc_feature (1)...(201): n = A,T,C or G, or insertion/deletion polymorphism (see Tables 1-2)
ggcccaggggttggaaggagatgtggcttagtcatttgtactaacagagggcttctcttagaggagtggcaagtatctgatctgccatgtagctgattcancacccgtcaggcatggcgaaggtccagtgtctgtttctgaaaaacagtctatctttgccacccccttccatcctccaaaaaagaaaaaggagaccagcta

SEQ ID NO: 32590 - DNA, 201 bp, Homo sapiens
agacagggcctcactctgttgcccagactggagtgcagtggtgtgatcatagcacacaacacaacagcctcaaactcctaggctcaggtggtcctcctacmttagcttcctgggtagctgggattacaggcacacactaccatgccctgctaactttgaattttttttttgagacagaatcccgctctgttgcccaggctg

SEQ ID NO: 32591 - DNA, 201 bp, Homo sapiens
ataagaacattaaaattcaaacataaatggtctaacggttaaacagcagactgaattgaattgacaggaatattaactacgaagaaatgagcaacagaacrcacaaaaaagacagaaaatatttaaagaggatgacatagtagtgagaagacccagatagatttaattatctaaaaggggtttccctgtagtcctagctac

SEQ ID NO: 32592 - DNA, 201 bp, Homo sapiens
tttcccatttttttcttctgcgaataacaataattggccacatttgaaaattattttttcaaactaatggtgttttatttttgttccttttcttttccctmtgtttggaagatattccatcaaagaccttttgaaccatgccttcttccaagaggaaacaggagtacgggtagaattagcagaagaagatgatggagaaaa

SEQ ID NO: 32593 - DNA, 201 bp, Homo sapiens
gactatattttaattgggatagatagagagtttctaatcctttggtgaaattatggtagtgttaacacaattagttgaaaagtaaaagaaggttaaaataygttaaaaagcagttgcaaacttcttagcagttccattctctggaaaggttcacagatatccaaatgtagcacattagggccagttcatgcagcccattag

SEQ ID NO: 32594 - DNA, 201 bp, Homo sapiens
cctgggctcagggaatccttccacctcagcctccccactacctgggactatagttgctcaccaccatacctgtctaataaaaaaacaatttttttttttttagtagagacagtgtctattttgttgcccaggctgctctcaaactcctgagctcatcctgatttggcctcatcccgatttgacctcccaaactgctgggat

SEQ ID NO: 32595 - DNA, 201 bp, Homo sapiens
tcatattcgtaccacagttgttttagcagattaagtagttgccttgtaaaagaaagttaaatcaacacaggttaatgttagtggttacgtgtgagggggaratacagtgaatagaacagagtaccttacttggtttaggaactgaggttttagttgccctattgtttcgttgtttgttataaggagtgaaggtatacctac

SEQ ID NO: 32596 - DNA, 201 bp, Homo sapiens
taccaatagcaaacgaatgaaagatacattttctaaagcaatggaacactaatattttagtactctagttgtccctgctgaatcggcattttaaaatgttygtaacctgtcagcttcatgaaacctaacgatcattggtttaaaacatttttgtaaacttgaaagtgtagcttgtgataaacaacaaaaaaagaaagaaaa

SEQ ID NO: 32597 - DNA, 201 bp, Homo sapiens
ctcaacctccaactcccaggttcaagcaattctcatgccccagcctcccaagtagctgggattacaagcatgtaatcccaaaccaaatgtataagaacacytggctaatttttgtatttttgtatttttagttgcactatgttggccagactggtctgaaacttctggcctcaggtgatccgcccgcctcagcctcccaaa

SEQ ID NO: 32598 - DNA, 201 bp, Homo sapiens
ctcttttttttggcgattcatttttccttcagctgatgggacggttgacagtggtcagggatcctctgtcttcacagaatctcgagtgagcagccaacagrcagtttcatatggttcccaacatgaacaggcacattctacaggcacagtcccagggcatataccttctactgtccaagcacagtctcagccccatggggt

SEQ ID NO: 32599 - DNA, 201 bp, Homo sapiens
gaggatcccttgagcccaggatttgaggctgcagtgagctatgatagcaccgctgcattccagccttggtcacagagtgacttcctgtcttttaaacaaayaaacaaaaataaaaacaatgttttggttaaagatagattgattttaatcaaggcaaagatagaactggaatttatatttaggtctttgcctccaaagcct

SEQ ID NO: 32600 - DNA, 201 bp, Homo sapiens
ttgtacaaaccaagtaacagtatgagtctgaagtagaaaatataaaatgctgtgtctctaaagccttattatagagtaggatatagacattaatgtgtggrcattagctgaactgcctacatgaagcagctatgtgcaagatttagattagtctgcatttttactaaagggaacgctctctttagcacttaagatgttgaa

SEQ ID NO: 32601 - DNA, 201 bp, Homo sapiens
ggtgagccatattgggaagaaggggctgatagaggagttagaacaaccaggtaaccagatttttttttcctattcttttgaggaaaaaaaaaaaaaaaaaattttttttttttttggtctttctgaaactggtgctatttcagaatgataggtaaaagtctccatggagaagcaggggatgtgatgccatgtttacctgcc

SEQ ID NO: 32602 - DNA, 201 bp, Homo sapiens
  misc_feature (1)...(201): n = A,T,C or G, or insertion/deletion polymorphism (see Tables 1-2)
gagactgatgccatttagaaattaaagtagtatgctatagaacactatgtataggaaaggcatgtttttgttttgtttattttaacaaaaaaagaaaactntgtgaaaatggccacttacgcatagaaaaaaatccatgaaggttatgcaccaaacgactaatagtggttacctctggagaataggattaggggtattttc

SEQ ID NO: 32603 - DNA, 201 bp, Homo sapiens
ctcctgagtagctgggattataggcaccctccaccacgcctggctaatttttatatttttagtagagacagggtttcatcatgttggccaggctggtctcraactcctgacctcaggtgatccgcccaccttggcctcccaaagtgctgggatattataggcgtgagccacaacacccagcctatctattgagtcttagtg

SEQ ID NO: 32604 - DNA, 201 bp, Homo sapiens
atttggggattaagtgaagggtgcctaatgaatagaacctatgcattcgtatacatctggcttgagaaaactgtatctctctcttttttttttttttttttgagaaggagttccactcttgttgcctaggctggaatgcaatggcgagatctcgactcactgcaatctccgcttcccaggttcaagcgattctctggcctc

SEQ ID NO: 32605 - DNA, 201 bp, Homo sapiens
tatgatggtattcaatttttcttcctagtcaaaagtggaggcgctatgtaaagagacaatcagcctactctttgacagggaaataaagtgattcttttttyccttttttaaattgtctgtgatagaaattggatattgagaacttaagtttttaatctttgtccttttttatcaggtttctgttgcagcagacggtgccca

SEQ ID NO: 32606 - DNA, 201 bp, Homo sapiens; identical to SEQ ID NO: 8188

SEQ ID NO: 32607 - DNA, 201 bp, Homo sapiens
gtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccacca

SEQ ID NO: 32608 - DNA, 201 bp, Homo sapiens
caacctccctttgttctctgtagtgactagatttaaagcgaagcatatgacacgtttaactgccatttccctcacacatacccctgttatttttacctgcrttagaaatggattggctccttccagcacccctattatttgtacctgtattagtaatgagttagctgtacttgagaggcagtctttactgactttccccac

SEQ ID NO: 32609 - DNA, 201 bp, Homo sapiens
tttaaaaactattctggaagggaaggggttagtatatatatgtgggatgtggaaatataatagccaatttaaatgaacttaaagctgtaacagtgatactrtcagtctactgtggtggggttgctaatgcatttaactgagtgctttttaacagcccagctggagaaacaggaagtgggacaggatcagtggaaacgctgc

SEQ ID NO: 32610 - DNA, 201 bp, Homo sapiens
cataccaggcatttaacatttaccttgtagtttttcttattcacaggcaaccctaaaaattctacaatgccttgctaatttattttatttatttacttttrttttatttttttatttttatctatttatttatttttgagacggagtctcactctgtcacccaggctggaatgcagtggcatgatctcagcccactgcagc

SEQ ID NO: 32611 - DNA, 201 bp, Homo sapiens
gcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcatttaa

SEQ ID NO: 32612 - DNA, 201 bp, Homo sapiens
ggcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcattta

SEQ ID NO: 32613 - DNA, 201 bp, Homo sapiens
aggcaggagaatggcatgaacctgggaggtgtagcttgcagtgagccaagatcgcaccactgcactgcaacctgggcaacagagtgagactccatctcaaataataataataataataataataattctgagaactgtactatcctattctagaatttgccagtgttacattgagaaaataaaattagctggttttcattt

SEQ ID NO: 32614 - DNA, 201 bp, Homo sapiens
aggcgggcagatcacgaggtcaggagatcgagaccatcctgactaagacggtgaaaccccgtctctactaaaaatacaaaaaattagtcgggtgtggtggygggcgcctgtggtcccagctactcgagaggctgaggcaggagaatggcatgaacctgggaggtgtagcttgcagtgagccaagatcgcaccactgcactg

SEQ ID NO: 32615 - DNA, 201 bp, Homo sapiens
  misc_feature (1)...(201): n = A,T,C or G, or insertion/deletion polymorphism (see Tables 1-2)
catttttattttcaaggcaattatattctcaattggctctcattttaaaagtgatttgcaaatcattagaatggtctagaaatggaaaaatgaaaggggantgtagattatcaaaatatgtagagtatcaagtatgtacaatgaaaataataaagattactaccaataaaaagagaatgtagaatatgaaaaaggtagctt

SEQ ID NO: 32616 - DNA, 201 bp, Homo sapiens
atctttgtagtcattctcataaatgaagcttttaaatacatgaatttaactttagggtcagccctgctacacaattccttgctgtgaaaagttagccctgsgagtagaattctccaaattgggtcttcggaataatacaatgagtaattgagcattatccagctttggatataactcttgtacttaaaagactttagagct

SEQ ID NO: 32617 - DNA, 201 bp, Homo sapiens
aggagtttgaggctgcagtaagccacaatcccaccactgcactccagcctgggcaacagagcaagaacttatcattatcttttttttttttttttttttttgagacagaggtttgctcagtcacccaggctggagtgcagtggcactatctgggctcactgcaacctctgcctcctgggttcaagcgattctcctgcctca

SEQ ID NO: 32618 - DNA, 201 bp, Homo sapiens
aatttatctagcttagttcttttttcttcttttatcatgaaaacatcttgttatcattactttgttctgtctggtgcttaaaatcgtgtttaagaataatstagttcacctttcaaaaattatcagttataaaaattacattgagttctcatgtcttaagaacgagaaacctatgagtacattttaaaaactgtaactttg

SEQ ID NO: 32619 - DNA, 201 bp, Homo sapiens
tagtttaattagatcccatttgtcaattttggctttttttgccattgcttttggtgttttagacatgaagtccttacccatgcctatgtcctgaatggtamtgcctaggttttcttctagggtttttatggttttaggtctaacatttaagtctttaatccatcttgaattaatttttgtatgaggtgtaaggaagggatc

SEQ ID NO: 32620 - DNA, 201 bp, Homo sapiens
ttttcttgtaaatttgtttgagttcattgtagattctggatattagccctttgtcagatgagtagattgcaaaaattttctcccattctgtaggttgcctsttcactctgatggtagtttcttttgctgtgcagaagctctttagtttaattagatcccatttgtcaattttggctttttttgccattgcttttggtgttt

SEQ ID NO: 32621 - DNA, 201 bp, Homo sapiens
agtctgtgttggacacaagttccttccccagtatatgttcttttgctttttccctttagttggtaactgttttattactgatttattttcagaatcaactyatagaaattatttcctgaaacattttatgcttgtatacacatacacacacacaattatcctgtgttttacattagacactcttgtttctcatatagagaa

SEQ ID NO: 32622 - DNA, 201 bp, Homo sapiens
atttctagttctagatccctgaggaatcgccacactgacttccacaatggttgaactagtttacagtccctccaacagtgtaaaagtgttcctatttctcsacatcctgtccagcacctgttgtttcctgactttttaatgatcgccattctaactggtgtgagatggtatctcattgtggttttgatttgcatttctctg

SEQ ID NO: 32623 - DNA, 201 bp, Homo sapiens
tgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccacc

SEQ ID NO: 32624 - DNA, 201 bp, Homo sapiens
atgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgccac

SEQ ID NO: 32625 - DNA, 201 bp, Homo sapiens
tatgtatgtatttggttcaggatagtatctcactagcaactcccaatataacctttttttctttgtgtgtgtgtgtgtgtgtgtgtgtgtgtgtgtgtgtgtgtagtggcacgatcacactcattgcagcctcaacctcctgggcttaagggatcctcccacctcagcctacccagtagctgggactacagccatgtgcca

SEQ ID NO: 32626 - DNA, 201 bp, Homo sapiens
ttgttttcacagtactgtgtttttcatgtgtgtgtttgttttgtgttgagcctcgtcgtggccgtagcatgtcggtttgtgttcccatctttctgctgttscctctgtgtcccgcatctctcccagtgctcttccaccccaccgccagtactgtctgcacctctttctccttccctcccccggactgccccgaggaaactt

SEQ ID NO: 32627 - DNA, 201 bp, Homo sapiens
aggattgcttgagcctgggaggttaaggctgcaatggtctaggactggactactgcactccagtctgggcaacagagtaagaccctctgtcaaaaaaaaawtttttttaaactgaatatttatttggactgaaagaagaaatgacaacaaattataaagttaaaagaagtcatatcaaaaaatcacaaaatccagaaaaaa

SEQ ID NO: 32628 - DNA, 201 bp, Homo sapiens
tattagggcttttcagaagaactaaaaaaggttaagaagttagcatattctctcaaaggcctttctacatcttttatagtcaagtctccttttcttaggarttaatttctggtcagaaaatgataggtttgtttcattctttaatgggaggcctgtatacagaagccagaacgtgaaggtttagctgtatggttgactctt

SEQ ID NO: 32629 - DNA, 201 bp, Homo sapiens
gtgttcccatctttctgctgttgcctctgtgtcccgcatctctcccagtgctcttccaccccaccgccagtactgtctgcacctctttctccttccctccyccggactgccccgaggaaacttttgccgaaaagctttctaaagcattggagagtgtcctgcctatgcactctgcctctcagcgcaagcaccgacgctcca

SEQ ID NO: 32630 - DNA, 201 bp, Homo sapiens; identical to SEQ ID NO: 8185

SEQ ID NO: 32631 - DNA, 201 bp, Homo sapiens
actatttttgagcaaggagcttggtgtcataaaaatagtgtctgggggaatatctttatctaaagggtaggttgaagggtaaagagagtcatcaggcaatktttattttgatatgacgtagttgtggcttttattagtttgtgaccatggaaatgagatatggggaatcatggaattatagagattgcctgggaagacaaa

SEQ ID NO: 32632 - DNA, 201 bp, Homo sapiens
tctgtaccaatatatcaaccaaaaatgatcttcctaagtctaattacacttctctctgttccacaccaatgcaagcatgatcaatcttatgaagatgcaaatctgatcacatcttttaaaattttcggtggtgccctattctccacagtataaattttaatctccttattgttatgtgaagttctcaagattttagtgttt

SEQ ID NO: 32633 - DNA, 201 bp, Homo sapiens
  misc_feature (1)...(201): n = A,T,C or G, or insertion/deletion polymorphism (see Tables 1-2)
tgccatagcggtaagaagcatgtgaccttcctcactgcagcttcacctcagaattagctgttactgcagcacagacctgcttgtgtgtgccattccccagntggtaggatataagcttgacttgagaccagcgatggtcagtaacaggctttgaagtggcaggattgcgttaggtgtgctgctgtgatctggtgctgcttt

SEQ ID NO: 32634 - DNA, 201 bp, Homo sapiens
ccagcctgggtgagagaatgagaccgtgcctcaaaaaaagcagttgtatgtgccaataatgaagtctaacaatatttataataataatgctattaagttaygtttgtttgtttgtttttgaccaggcattcctaccagttctttaactcaagttgttcattctgcgggaaggcggtttatagtgagtcctgtgccagaaag

SEQ ID NO: 32635 - DNA, 201 bp, Homo sapiens
  misc_feature (1)...(201): n = A,T,C or G, or insertion/deletion polymorphism (see Tables 1-2)
ccattaatgtttataaaagatctatcttataaaattattttaagcatgtgggtccttgctgctgcttttccaaataaagaatatagttaactttctgaacnagcaaccccagaattttcagatttttacttaggagaatgaagaactatacagtgttattatggctttgagacataccatgagtaaataacaataaaatga

SEQ ID NO: 32636 - DNA, 201 bp, Homo sapiens
  misc_feature (1)...(201): n = A,T,C or G, or insertion/deletion polymorphism (see Tables 1-2)
agtggggggtaaggaaaacagacaagaccatgactcttctttccctcttccccaaaacgtgcctcttggaataatcttcagtgtgccctccagcagagccnaaatcaggcaggcatagactccctcctctctcatcaaaccgcagaaatagagttccttcatcataaccgcaaagcttcctcctcccctttgcaccctgcc

SEQ ID NO: 32637 - DNA, 201 bp, Homo sapiens
ataaataaaaatataggtaagtatgcagataggacagaagtcataaaagtgacataaagtttgagaaatgacactaattagactgacatcacatttctttwacaggtgaacaatgactttattctagcaatagagagagagtcgtttgtggatcaagtgcgagaaattattgaaaaagctgatgaaatgctcagtgaggat

SEQ ID NO: 32638 - DNA, 201 bp, Homo sapiens
atctgtaccaatatatcaaccaaaaatgatcttcctaagtctaattacacttctctctgttccacaccaatgcaagcatgatcaatcttatgaagatgcaaatctgatcacatcttttaaaattttcggtggtgccctattctccacagtataaattttaatctccttattgttatgtgaagttctcaagattttagtgtt

SEQ ID NO: 32639 - DNA, 201 bp, Homo sapiens
tgtaaactgaaatggaatgacaaaagtggtagccttttcatttcgttaacatacctatatatagtcctgcatcatttctcactttctagtgagaaacactrtagttggggtttctcagactcaacactgttgacatctgaggttggataattctttgttgtggtgggctgttctatgtattgtaggctatttagaacatcc

SEQ ID NO: 32640 - DNA, 201 bp, Homo sapiens
aggaaaaaaaaaaaaaaaaaattttttttttttttggtctttctgaaactggtgctatttcagaatgataggtaaaagtctccatggagaagcaggggatrtgatgccatgtttacctgcccctcccccccataattatgatatcttttcacccattgaggaaagttgggctcacatagactctcttctttatgcgataga

SEQ ID NO: 32641 - DNA, 201 bp, Homo sapiens
  misc_feature (1)...(201): n = A,T,C or G, or insertion/deletion polymorphism (see Tables 1-2)
ccttgccttctgccacgattctgaggcctccccagccacatagaactgtgagtacagttaaacccagtcttggatatgtctttatcagcagcatgaaaacnaatacagtttctatagttcgtgtctttctaggaatttctttccattttatctagatcatctactctcttgctatacagtttcttgaagtttgcccattat

SEQ ID NO: 32642 - DNA, 201 bp, Homo sapiens
  misc_feature (1)...(201): n = A,T,C or G, or insertion/deletion polymorphism (see Tables 1-2)
tacaccttttttttgagacaaagtctcactctgtcacccaggctggagtgcagtggtgcaatcttagctcactgcaaccaccgcctcccaggttcaagcantcctcctgcctcagctttccacgtagctgggactacaggtgcctgccaccacactcagctaatttttgtatttttagtagagacggggtttcaccatgct

SEQ ID NO: 32643 - DNA, 201 bp, Homo sapiens
tgtagtttttccaacctttcccaggccttcaatctctaattctgaagtttttaagaagagttagttacctacagttaatacttctgtcatctttgaattgmtgttataccatataggcctatgagagagttgccagacttaaataattatttatatgcttaatttcttttaacacatagaataattctttaaaaaattgtt

SEQ ID NO: 32644 - DNA, 201 bp, Homo sapiens
ggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctgga

SEQ ID NO: 32645 - DNA, 201 bp, Homo sapiens
ctgaagagaaactgttttcatcaccctattataccaaaacaaatggctaaacaaaaccttggaatcttcccttcttgcatggcttcccagttcatcctctyctcattctgtggcttgccattcatcatcccgtgaagttttccctcttcctgaaattgtaacctaggcttcttttaatgctcgtattctgttgcttataat

SEQ ID NO: 32646 - DNA, 201 bp, Homo sapiens
gttacaaactgctgtaccctctgcctgaagacaagtttttatttctttatcctaatacccaacaacaattagtatcactttaaaagataaaatagaggccsggcacggtggctcacgtctgtaatcccagcactttgggtggctgagatgggcagatcacaaggtcaggagtcccagaccagcctgaccaacatggcgaaa

SEQ ID NO: 32647 - DNA, 201 bp, Homo sapiens
gggcctgggcttttcattgtggaaagtttgttaaattactaattcagtctcctttcttgttataggtctattcagattttccgttgttttttttttttttttcttgagtcagtttctgatatggtttggctctgtatccccccacccaagtctcactttgaaatgtaataatcttcatgtgtcagtggcggggccagctgg

SEQ ID NO: 32648 - DNA, 201 bp, Homo sapiens; identical to SEQ ID NO: 8285

SEQ ID NO: 32649 - DNA, 201 bp, Homo sapiens
tatgacaatttggggtacatttgtatgggtatgtgaagagctccagaaggaaatttgccacttttttcccttgtgtggaaaattttacagagataaccttktacagtttgcctagttgcctgaagtacggctctgaggcaggaatagaataattggagaaaggtacaataatttgtacataactatgaacgtgatacttat

SEQ ID NO: 32650 - DNA, 201 bp, Homo sapiens
tttaagtcacagtctcagtaatttttaagattttatgtctttcctttatatgtgtatggtgtatgagattaataaatttattaagaataatgaattcactrtttaattgcttcccagataccccagaacattagatgttgtattagaggaacacttaaaggaaattgcagatctgaaaaaacaagagcttttccatcagtt

SEQ ID NO: 32651 - DNA, 201 bp, Homo sapiens
aagtacttcctgttctataaagatatgattcacaagtcacatcttaatatactgaattgtacagagactgtcctttttaaatttgttcttcaagaaggggrgagtatcggaatcaaaaatatttgaaatataagaggaaatagtggttgtgtgggggctatggagagtataattttttatagagagactattttgttattg

SEQ ID NO: 32652 - DNA, 201 bp, Homo sapiens
atcttcattcttcttgaggcacaacccaaatcctgtgtgatttgtgcagccttcccaggcagtctaagcagacttgctatcagtgtcacatatttggcatstgccattactgcctcctgttatcttttcacacatgtattgtttcttttgtttgtttgagacagagttttgctcttgttgcccaggctagagtgcaatggc

SEQ ID NO: 32653 - DNA, 201 bp, Homo sapiens; identical to SEQ ID NO: 8315

SEQ ID NO: 32654 - DNA, 201 bp, Homo sapiens; identical to SEQ ID NO: 8317

SEQ ID NO: 32655 - DNA, 201 bp, Homo sapiens
gtggtggcatgcacctgtaacaccagcactttgggaggctgaggtgggattatttgaggccaggagtttgagaacagcccggtcaacatagcaaaaccccrtctctacaaaaatttttaaaaagtggtggtggggtcctgggatgtcccagcttcttcggaggctggggcaggaggatctctttgagctcaggagatccag

SEQ ID NO: 32656 - DNA, 201 bp, Homo sapiens
aaaaaaaaaaaaaatcgataaaggccaggcgaggtggcttacacctatagtctcagcactttgggaggctaaggcaggaggatcacttgaggccaagagtwcaagaccagcttggacaacgtgatgagatcctgcctctacaaaaaatacaaaaattagctgggcgtgatggtgcgtgcctgtagtcccagctactcagtt

SEQ ID NO: 32657 - DNA, 201 bp, Homo sapiens
  misc_feature (1)...(201): n = A,T,C or G, or insertion/deletion polymorphism (see Tables 1-2)
taccgttctaatgacgtcttctttaaaaattaggtagttgagagtggtggtcctgagattttaaaaggccttgaagagaggtatgtttccttttctttttntactttttatttggaaatgacttcaaacttatagaaaacctggaaaaacagtacagaaaattcatatactctttacaaccaggttcaccatttgataata

SEQ ID NO: 32658 - DNA, 201 bp, Homo sapiens
acaaaaatttttaaaaagtggtggtggggtcctgggatgtcccagcttcttcggaggctggggcaggaggatctctttgagctcaggagatccaggctgcrgtgagatatgatcacatcactgcacttcagcctgggccatggagaaagaccctgtctctaaaaaaataaataaaattcttctggcaatttcttggggccc

SEQ ID NO: 32659 - DNA, 201 bp, Homo sapiens
  misc_feature (1)...(201): n = A,T,C or G, or insertion/deletion polymorphism (see Tables 1-2)
gattaaattgtaatgtcagaaaacagttgctgtggaaggtttcagtgaatggtccgagtttcattgaactgacttgaaatgacttttattattgacttccntaccgttctaatgacgtcttctttaaaaattaggtagttgagagtggtggtcctgagattttaaaaggccttgaagagaggtatgtttccttttcttttt

SEQ ID NO: 32660 - DNA, 201 bp, Homo sapiens
  misc_feature (1)...(201): n = A,T,C or G, or insertion/deletion polymorphism (see Tables 1-2)
tgtatttttctgaaccattgtagtactttttagatactaccagtagaatgtaattaaaataaattaagagaaatagagttactacagtataatgaagatgntatgaacctgattaaattgtaatgtcagaaaacagttgctgtggaaggtttcagtgaatggtccgagtttcattgaactgacttgaaatgacttttatta

SEQ ID NO: 32661 - DNA, 201 bp, Homo sapiens
  misc_feature (1)...(201): n = A,T,C or G, or insertion/deletion polymorphism (see Tables 1-2)
accagctcagcatgtcatagaattcggtagtgctaattgagtgttgattgctgtatttttctgaaccattgtagtactttttagatactaccagtagaatntaattaaaataaattaagagaaatagagttactacagtataatgaagatgatatgaacctgattaaattgtaatgtcagaaaacagttgctgtggaaggt

SEQ ID NO: 32662 - DNA, 201 bp, Homo sapiens
cccagcttcttcggaggctggggcaggaggatctctttgagctcaggagatccaggctgcggtgagatatgatcacatcactgcacttcagcctgggccayggagaaagaccctgtctctaaaaaaataaataaaattcttctggcaatttcttggggcccatctaaaagccttatcttgttcacctaaacttgttttgtg

SEQ ID NO: 32663 - DNA, 201 bp, Homo sapiens
  misc_feature (1)...(201): n = A,T,C or G, or insertion/deletion polymorphism (see Tables 1-2)
ttaatgtacaatgtcatttagcctccagtaagcaggaaatgtgattaaatgtgatacccatcaaattggcaaaactgttgaagtcgttagtaccagggatngggtacgtagtggcagacagtgtgattgttccaaccactttagaaagcaattggcaggatcccatgaggttgaaagttccagtaattcctgtgatctggt

SEQ ID NO: 32664 - DNA, 201 bp, Homo sapiens
  misc_feature (1)...(201): n = A,T,C or G, or insertion/deletion polymorphism (see Tables 1-2)
cagggtctcgctctattacccaggctgatgtcaaattcctggcctcaagcgatcctcccaactcgagttcccatagtgctgggattacaggcatgagccancatgcccagcctttctttacctggatatagtgagttctgcatgtatgatttgtatacatctctgtttgtgtattaaacttgtttaaacaatgagagaaaa

SEQ ID NO: 32665 - DNA, 201 bp, Homo sapiens
  misc_feature (1)...(201): n = A,T,C or G, or insertion/deletion polymorphism (see Tables 1-2)
ggttcagatatatggctgcttattagctcttgaggatttgtttaaatgatggggtcttgctatgttatccaggctggcctcaaactcctgggcttaagcantcctcccacctcagcctccagagtagctgggattatagacatgcaccactgtgcctgactaacttaatttttgtgaattctgtgaattttcatttttctc

SEQ ID NO: 32666 - DNA, 201 bp, Homo sapiens
ttcaggtttttgctgagtacccgggcagctcagctcagttgagggtgctcttggctttctatgcttctaccatagtgtcggcgctggtagctgcagaggaygtatcagacaatatcatcgccaaactatttccctatatccaaaaggttggcactgctgatgtgttaagtagattattttgtacttaaaggaattttcttg

SEQ ID NO: 32667 - DNA, 201 bp, Homo sapiens
tggctgcggatgggggcggcatatcgagggagggtaagagttttccggatatctgcggaatcagggttgaaggaaagccttggcgcggtcgccgctactgkaattagttgttaacgctgctgccatcgtctttgcatctccggggtccacaaatctcaggacacccgcgttgtgtgtccatgacggtgctgagtgcagaag

SEQ ID NO: 32668 - DNA, 201 bp, Homo sapiens
ccaaagatttagttgtgatgttagaaccttataaaaagagatatctggatcccaccccatatctaaagaatctctggggcagtaaatctgtttttgtgcawgtgtgtatatgtcttattccttcctagctgattagaatatacatatctgatccggcacttggaaacaatcggtatggatgattctgtattgcattactag

SEQ ID NO: 32669 - DNA, 201 bp, Homo sapiens
ccttagcccagcagctgcaacgactcgccctccctcaaagtgatgccagcctcttatctagagatgaagttgcttctttgttatttgaccctaaggaagcrgccacaatcgacagggacaccgccttcgccattggtgagccatcttttaacttagaaaagctcttggaagcgtttgttttctggatgttactgttttttt

SEQ ID NO: 32670 - DNA, 201 bp, Homo sapiens
aagtaaaaaaaaaaataattccttggtattatctaatacctagttcataatcatatttccatggttatcacaaaagtattttttatagttgttttctttgwatcagaatccaaagatttagttgtgatgttagaaccttataaaaagagatatctggatcccaccccatatctaaagaatctctggggcagtaaatctgtt

SEQ ID NO: 32671 - DNA, 201 bp, Homo sapiens
cttttggcatttgcattcacttctcctttaacgacgacagttcgtccagggcccatgggggtgttcaaccttgcagcgaatggcagcctctgaaaagaagscacagtcaggaccaagaggcctgcagaaagcgatctccagggaaaactcgtgtccaaagaacactacggaatgtttcagagccatgaccctgtaaatccc

SEQ ID NO: 32672 - DNA, 201 bp, Homo sapiens
taataaataaataaaaagatactgtgggttatttgggttatgacagtttataatgtaaacaaaagtagacttgtaaacagtgaagagtatataatagcacrggccctgtaaaagagtacaatcacaatactaatcggtaggttgaatagaaactaacattgctacactcctactaatatgttaggcccattactatattta

SEQ ID NO: 32673 - DNA, 201 bp, Homo sapiens
gcggagatcgctccactgcactccagcctgggcgacagagcgagactccatctcaaaaaaaataataaataaataaaaagatactgtgggttatttgggtwatgacagtttataatgtaaacaaaagtagacttgtaaacagtgaagagtatataatagcacgggccctgtaaaagagtacaatcacaatactaatcggta

SEQ ID NO: 32674 - DNA, 201 bp, Homo sapiens
ttcttgtattttccttgaaaaaatttatttatgcactgaaagctcctaaatcttttcctaaaggtaagatacaagctgtgaatcttttaaatgtgatactstgcaaaactgaatgattgactccacaatgactgtcttgaataaaaagctcccagcatgttcatgtaggatctagcatcatttctctttccatgtccttgt

SEQ ID NO: 32675 - DNA, 201 bp, Homo sapiens
tcagaacccttagtttgtactagtttttgtttcctttaacatttcaggaaatcccctcagaatggcacattgaactgatgttagacagagggatcccagtrgagctgtgggcacattatgtagaagagctcaacagcactcagagggtggccgtggaggactcggtttttcttgtattttccttgaaaaaatttatttatg

SEQ ID NO: 32676 - DNA, 201 bp, Homo sapiens
  misc_feature (1)...(201): n = A,T,C or G, or insertion/deletion polymorphism (see Tables 1-2)
aacacataatacctagatagacctgagttgaaaaaattgttttatgaaaatcaagagcaactggtaatagagtgtgtttatttttcaaggtggaggatttnataagcgtgggtgaggaggagtcctttaacctgaagcagaaagtaacgtttcatgtgatcctgtctgtgctcgtctcttgttgttcatctttaaaagaaa

SEQ ID NO: 32677 - DNA, 201 bp, Homo sapiens
tacttagaaatcagtgcttagtactttataaaggctttctgtttgtcatctcactttaaatgtaaaacacataatacctagatagacctgagttgaaaaarttgttttatgaaaatcaagagcaactggtaatagagtgtgtttatttttcaaggtggaggatttaataagcgtgggtgaggaggagtcctttaacctgaa

SEQ ID NO: 32678 - DNA, 201 bp, Homo sapiens
ggattacaggcatgtgccaccatgcccagctaattttgtatatttagtagagacaaggtttcaccatgttggtcaggctgatctcgaactcctgtcctcakgtgatccgcccaccttggcctcccaaagtactgggattacaggcgtgagccagcaccatttaaaatagcaatgtagtcttactatgttgttcagacaggt

SEQ ID NO: 32679 - DNA, 201 bp, Homo sapiens
  misc_feature (1)...(201): n = A,T,C or G, or insertion/deletion polymorphism (see Tables 1-2)
cattaaccagttggcaagtgcaattatgttcattacagtttctgaaattattcttataattacttagaaatcagtgcttagtactttataaaggctttctntttgtcatctcactttaaatgtaaaacacataatacctagatagacctgagttgaaaaaattgttttatgaaaatcaagagcaactggtaatagagtgtg

SEQ ID NO: 32680 - DNA, 201 bp, Homo sapiens
  misc_feature (1)...(201): n = A,T,C or G, or insertion/deletion polymorphism (see Tables 1-2)
ttgcttcttcaaaggccattccctcacttatgtaatgttcctgatcttattacaatacttcatgggatttctgaaacttacgatgtcagtcctcttctgcnttacatgcttccccatctggtcgtctccatcattcatcatgttacaggtgtgtggttttatattttttgtccagaaattttctaagatttgatcttaaaa

SEQ ID NO: 32681 - DNA, 201 bp, Homo sapiens
  misc_feature (1)...(201): n = A,T,C or G, or insertion/deletion polymorphism (see Tables 1-2)
gacagaagccagagagccttgggaaaaagtatgtacaattgaattgagaaatggtgctagtcagaggtgaataaaattattttgaataatttttttttgtnagataagtgattatatattttcttatattgttactcattgtctaacttgtaaagtcaacacgatatgtacttttgcttcttcaaaggccattccctcact

SEQ ID NO: 32682 - DNA, 201 bp, Homo sapiens
cattaggcagttaattgttgtcacattgtgtattcattgttgcatatggtaattcaggagagctgtaaatatttatttggcctttcactttttttttttttggagacatggacttgctttgtcgcccaggctagagtacagtggtgccatcatagttcattgaaatctcagccttgaactcctggcctcaagcaatccttc

SEQ ID NO: 32683 - DNA, 201 bp, Homo sapiens
gattgcctgagctcaggagttggagaccagcctgggcaacatggtgaaaccccatctctactaaagtaaaaaaaaaaaattagctgggcatggtggtatgmgtttgtagtcccagctacttgggaggcggaggcaggagaatcttttaaacttggaggtggaggttgcagtgagccgagattgtgccactgcactccagcc

SEQ ID NO: 32684 - DNA, 201 bp, Homo sapiens
tggctttgtagtacatgtccttatccttgtaaaaatttagataatactagctagcttttaacagtactatgtgtaaagcactgtgctacagactgacatgwattttttaatcttctaacaacccttgcaggtaggtattatttattagcaaacctgttttataggtgagaatagtgagatccagaaaggttaagtgacttg

SEQ ID NO: 32685 - DNA, 201 bp, Homo sapiens
ttgagttaatcaaatccctcactggagacgttacattgtaaatctggctttggattattttccttctaagttattactctgtactgcttgtacagagtcaratttgtcattttcttacacctgttctgcattcttttggcacttacagtataatttctaaacacctaacattttgctgcttgtttaaaatcatctgcaggt

SEQ ID NO: 32686 - DNA, 201 bp, Homo sapiens
caaggaatgaaggcggaaggagcggtgtggagggaggcggtccgtggcgcctcctgctttgttaatgtgcttcatttcactcttttgattgaatgattgcyggaaagtgcaaggcattaagaattaaactaatgagaaccgaggcaggcggactgactcagattttaattttgattttttttttttttttttagatgaatg

SEQ ID NO: 32687 - DNA, 201 bp, Homo sapiens
ctcattaactgctcttcccaacattcactctgcccatagcatcaaaattattcttcctctaatctaccttggatcttgctgctccctaggcactcttattscaggtagccaaactccactcacctactaaagttcacttaaaattctcctttcatttatttaatcagtatttatggagcatctattacataccatgtacaa

SEQ ID NO: 32688 - DNA, 201 bp, Homo sapiens
  misc_feature (1)...(201): n = A,T,C or G, or insertion/deletion polymorphism (see Tables 1-2)
gtcctccaaattttagagggcttctcattataggatttactaaatgaattatatctttttcacatttacgtatacccgcaggattttataagttctgatcntggccattgttagctaaaatgtgtaaactttaaaaagagtaaaatcttcatattttgaaaaatagtccagataggcccttcttaacttttagtttcttgg

SEQ ID NO: 32689 - DNA, 201 bp, Homo sapiens
tgaattatatctttttcacatttacgtatacccgcaggattttataagttctgatcatggccattgttagctaaaatgtgtaaactttaaaaagagtaaartcttcatattttgaaaaatagtccagataggcccttcttaacttttagtttcttggtgtcttttgtgaagtatgatgacctgaactatactggttctcag

SEQ ID NO: 32690 - DNA, 201 bp, Homo sapiens
  misc_feature (1)...(201): n = A,T,C or G, or insertion/deletion polymorphism (see Tables 1-2)
gagtgttttattatacatatgtagataacaggttattttatattgctttacttttaatacctttctcgaggtcatgagcatgttttcgcctgtagcagcangttgagttaatcaaatccctcactggagacgttacattgtaaatctggctttggattattttccttctaagttattactctgtactgcttgtacagagtc

SEQ ID NO: 32691 - DNA, 201 bp, Homo sapiens
  misc_feature (1)...(201): n = A,T,C or G, or insertion/deletion polymorphism (see Tables 1-2)
taaatacattaaccagttggcaagtgcaattatgttcattacagtttctgaaattattcttataattacttagaaatcagtgcttagtactttataaaggntttctgtttgtcatctcactttaaatgtaaaacacataatacctagatagacctgagttgaaaaaattgttttatgaaaatcaagagcaactggtaatag

SEQ ID NO: 32692 - DNA, 201 bp, Homo sapiens
aaagatggtaagtatgctttgaaagtccaccccctggatttctttctcatactcttattaaattctcagcttttgctttactagatttttcttaaaaaaawtttcttttattcttgagtacttggttttactttaaacgttgcagtgttgtttaatatattctgtgcaatgtttgaaatcttttaacattttatatatttt

SEQ ID NO: 32693 - DNA, 201 bp, Homo sapiens
tgccagtaaggtcttttaaaatttttgccaagataaaaagtatacagtgaaaaggaagccaattcatagacaaattcagaatcggatacaaggaaaaataraaagcaaaccttcataaacaatagtaaaatgtttgcctgaattcttcatgtgattctttgagtgttggtgacataagagctctctgcattcgattttact

SEQ ID NO: 32694 - DNA, 201 bp, Homo sapiens
  misc_feature (1)...(201): n = A,T,C or G, or insertion/deletion polymorphism (see Tables 1-2)
attcagttgtttttttagaaaaagtgaacagataacacaaaagaaaacaaggaaaatttaaaatttattgttggtcatgcttatatgccagtaaggtcttntaaaatttttgccaagataaaaagtatacagtgaaaaggaagccaattcatagacaaattcagaatcggatacaaggaaaaatagaaagcaaaccttcat

SEQ ID NO: 32695 - DNA, 201 bp, Homo sapiens
gttattggcatggattttaagtggtgtcttagtgtatctgaataatagttttggtcaggagaccaggatattgtcagttaagctggagtaatgtaatgatraatttttgcccaattgaagccttccaatgtgtctttcaaccaagtgtgcttgcatgtcttttaggtacgaggtacttaagatagccgctgacatattaat

SEQ ID NO: 32696 - DNA, 201 bp, Homo sapiens
gagacacatgataccatctgtggtaagtttttaatgagctctgtttatttcatttttggcaccaaagctttttgcaagaaaaagtaagcaagctccatagrggatgagagtgtgtcttacgtgtttttgtatctatcgtatgggtagatatctatcatgtaggatgtgcttggttcattttttttgagtgcctgagtgaac

SEQ ID NO: 32697 - DNA, 201 bp, Homo sapiens
  misc_feature (1)...(201): n = A,T,C or G, or insertion/deletion polymorphism (see Tables 1-2)
gttctcatgagcaaattggaagacttacactctagtttcttttccttttttttttttctttaagatggagtttcgctcttattgcccaggctggagtgcantggcacaatctcggctcactgcaacctccgcctcccaggttcaagcgattctcctgcctcagcctccctggtagctgggattacaggcatgtgccaccat

SEQ ID NO: 32698 - DNA, 201 bp, Homo sapiens
cgaaggatactgaccttttggcatttgcattcacttctcctttaacgacgacagttcgtccagggcccatgggggtgttcaaccttgcagcgaatggcagsctctgaaaagaagccacagtcaggaccaagaggcctgcagaaagcgatctccagggaaaactcgtgtccaaagaacactacggaatgtttcagagccatg

SEQ ID NO: 32699 - DNA, 201 bp, Homo sapiens
agaattgcttgaatccaggagacagattttgcagtgagctgagatcacgccactgcactccagcctgggtaacagggagacgccgtatcaaaaaaaaaaaacaaaaaatggagacgtggggataaactaattttttttcaagaagcaagtgagtcatcaagaaaacatgattttaacttgggtcttctgattgtcagaaca

SEQ ID NO: 32700 - DNA, 201 bp, Homo sapiens
ccctgtggaggtactgctttcacttcccaccagtgtcccaacttgtgacctttcatcagacttgtttcttccattagtgatctgattgaggtctccctacyataagtaggattttatgtataaaagaagagcttactggctcctgtcaggacatgtggtagatgtttgagttgggaaattttctgagatcctttgtctcgt

SEQ ID NO: 32701 - DNA, 201 bp, Homo sapiens
tagatttaagtgtttttaaattgacagtttatttcagatgatagctgagatttagcctttaggttgaaaatatgacacttttttattagaaactcactggmctgggaccttaattaggactcttaagaataaatattggctgtctggtcctgcggccatctcctagattgatttccatagcagtctttgtacctcactgga

SEQ ID NO: 32702 - DNA, 201 bp, Homo sapiens
tcagaaggctggacgtctgtggaaaaagttgttaaagcagaaattttctaaatcacatgacaagaggggccctaaaaaatgttgcctgggctgggcgtggygactcacacctgtaatcccagcactgggagggcgaagtgggcggatcacttgaggtcaggagttccagaccagcctggccaacatggtgaacccctgtct

SEQ ID NO: 32703 - DNA, 201 bp, Homo sapiens
agctaaaagggggatggaggcagtgactggggtgacggagaagtcctctcagaggactggcctagttattgtaggggatatccaaaaaaaaaaaaaaaaaagtgttccctgccacgaagtactttctgttctagtagatgagataggatttactctaaaagttgaaaactagaaatcagtgtttgggactgtattataaat

SEQ ID NO: 32704 - DNA, 201 bp, Homo sapiens
agtggctttaactggctataagtgttgctgcccccagtttccccattcagtgctagacaccaccatacttcatggcaaggactgagaacacccagcaggayctaatggtgcacaagctcattttaacaatataaacaatagaatgacagtgagatgcgtttcagcaaggccagtatcacagaagccattctgtattttggt

SEQ ID NO: 32705 - DNA, 201 bp, Homo sapiens
  misc_feature (1)...(201): n = A,T,C or G, or insertion/deletion polymorphism (see Tables 1-2)
ctgtctggtcctgcggccatctcctagattgatttccatagcagtctttgtacctcactggaaggaggacggagcagacagtctctttgaggcgtaagcancctctcagtattctttgtgcactggctcctgcctctcagcgtttctccttcccaagtgccttcttgcctgctgccttcccaggtgccctgtggaggtact

SEQ ID NO: 32706 - DNA, 201 bp, Homo sapiens
atgcaagaattttggtgcagaaaatccagatccttttgtcccagtgctgaacactgctgtgaaactgattgctccagagagaaaggaggagaagaatgtcytgggaagcgcgctgctgtgcatagcagaggtgacctccaccctggaggcgctggccatcccccagcttcccaggtatgcggccggagacttggaacagga

SEQ ID NO: 32707 - DNA, 201 bp, Homo sapiens
tggaattcttgcttactacagagcttacgtggccttagccttagcatagttctaagtcccttttactccagatcagtgggtgctttgtataagtgaaacastggctagaacatgcacatcgcttagcatgactgtgtgactcaggacccccgagtctgatttccatttagacaatctcaagctgtgacaatgggaaaatgg

SEQ ID NO: 32708 - DNA, 201 bp, Homo sapiens
cataaactaaacatctaacaacagaggcaaatggatagataagtggtatttatagaggaatatcatatgcagttaaaatgaaggaactagaacataagtcmccatgcatagatctcaaaaatatgtttccagaaaaacatgttgttccgtgatatgtagtgtttgaaacatttggaagcagatttgggatgatggttttgt

SEQ ID NO: 32709 - DNA, 201 bp, Homo sapiens
gaggcaaatggatagataagtggtatttatagaggaatatcatatgcagttaaaatgaaggaactagaacataagtcaccatgcatagatctcaaaaatargtttccagaaaaacatgttgttccgtgatatgtagtgtttgaaacatttggaagcagatttgggatgatggttttgtttgtggggcttggggtagaggga

SEQ ID NO: 32710 - DNA, 201 bp, Homo sapiens
cccatccttgttcaacttgttgatacactgggtgcagagaaattcctctggattctcctcatcttgctttttgaacagtatgtcacaaaaacagtgctggyggctgcctgtggcgaaaaggtcagaacctagggtgggaagataaggaaaatggtgatttctcacacagattttatgatattgtccagtttaaacatgggg

SEQ ID NO: 32711 - DNA, 201 bp, Homo sapiens
  misc_feature (1)...(201): n = A,T,C or G, or insertion/deletion polymorphism (see Tables 1-2)
gtcaccatgcatagatctcaaaaatatgtttccagaaaaacatgttgttccgtgatatgtagtgtttgaaacatttggaagcagatttgggatgatggttntgtttgtggggcttggggtagagggagaataggaccaaggagcagtacttgggggattccagctgaatctgtaatgtttaacttctcaacaaaggatatg

SEQ ID NO: 32712 - DNA, 201 bp, Homo sapiens
tacacaacttccacatactgagttaggacttgatttaaatggaccacttatcccacccctgctcccaggattcttattgctgtcccattttcaaaaactgkaacctcacctcaaagtacatcccaggactaaatgggaaagaggtaatatttctctcttcttctccccaggactcctgaagaaaagaatttcttacaaatg

SEQ ID NO: 32713 - DNA, 201 bp, Homo sapiens
cagagactccttccgtgatgtggtttcttccatttgattgtccagtttccctgttttgttttttgtcttaaacactcgcttctcagggccactgggtactytcttggcaaatacactcacgtttttcactaatttagaagaggagaaactggatgtaatagatgaacacatttctctgggaaaatgttatcccgttaattg

SEQ ID NO: 32714 - DNA, 201 bp, Homo sapiens
cctcctgctttgttaatgtgcttcatttcactcttttgattgaatgattgccggaaagtgcaaggcattaagaattaaactaatgagaaccgaggcaggcrgactgactcagattttaattttgattttttttttttttttttagatgaatgtgaagaagtagaacatcagtgccaaaagactattcagcaactggaaact

SEQ ID NO: 32715 - DNA, 201 bp, Homo sapiens
cctctagcgatgaagaattcacttggtgtgttagtgcttgaacaaaatactatttcattcaattgtttactaaaaatagatcttttaggctttaaataatkttaatattacatagatgtgtatccctccagcctactactgtctttcatagtattactaaaggacatgtttcagctgtttacatttgacatgttttgaggt

SEQ ID NO: 32716 - DNA, 201 bp, Homo sapiens
ggtcagaacacggccttagtcggctctgctgcccactggctgttcacaatctaaccacctcctgcttgaatcatctcactttggaaatgaagattctgacrctagcccttcttccagctcacaggaccgttcacgggtggaaggcggtaacaggcacggaagtatctgcactgtgactggtaccgaaggatactgaccttt

SEQ ID NO: 32717 - DNA, 201 bp, Homo sapiens
aacaaaatactatttcattcaattgtttactaaaaatagatcttttaggctttaaataattttaatattacatagatgtgtatccctccagcctactactrtctttcatagtattactaaaggacatgtttcagctgtttacatttgacatgttttgaggtagcaagactttttttttaatatctgctatatgtaaggatt

SEQ ID NO: 32718 - DNA, 201 bp, Homo sapiens
tttttgacatgcttttgatttacatttttgtgactcagtataattttcaagattggttagaaatttcccagcattcctttttaatgtatatcttgttttgrctgtatcatttcattaactataagtacttaatccagtaactggcagcattaaaagcaaaagtaatttttcttgcatgtctttagtgcttatagatgaaaa

SEQ ID NO: 32719 - DNA, 201 bp, Homo sapiens
ttatcttttcacacatgtattgtttcttttgtttgtttgagacagagttttgctcttgttgcccaggctagagtgcaatggcatgatcttgggtcactgcyacctctgcctcctggtttcaagtgattctcctgcctcagcctcctgagtagctgggactacaggcacgcaccaccacgcccggctaattttgtattttta

SEQ ID NO: 32720 - DNA, 201 bp, Homo sapiens
aattgtttactaaaaatagatcttttaggctttaaataattttaatattacatagatgtgtatccctccagcctactactgtctttcatagtattactaarggacatgtttcagctgtttacatttgacatgttttgaggtagcaagactttttttttaatatctgctatatgtaaggattttgtttttatttgtcctcca

SEQ ID NO: 32721 - DNA, 201 bp, Homo sapiens
cgtggcccactcgatctccagggctcaaatgatcctccgatctcagccacccaagtagctgggattacaggcatgcaccaccatgcccacctagttttttktttgtttgtttgtttttgtttttgtttttccattttttgtagagacagtgtctcactttgttgcccaggctggtctggaactcctggcctcaagcgatcc

SEQ ID NO: 32722 - DNA, 201 bp, Homo sapiens
tgggaagcgctgtgaagagttgttgccttccaagatatacccaaattcccagttccaggtaagcggcacagagccgcttgatgtggctgcggatgggggcrgcatatcgagggagggtaagagttttccggatatctgcggaatcagggttgaaggaaagccttggcgcggtcgccgctactgtaattagttgttaacgct

SEQ ID NO: 32723 - DNA, 201 bp, Homo sapiens
ataggaattggctggaccatgttgagggatatgtgaatgcaaaattggggactttttaaatgctctgtatcttataattttgtgatttttactgctactcrttctaggttgttttagcttattaataatacagtttgggcatgtgaggaaataggtgcttattattaagttttgtgttcagttggactgtttgcttttttt

SEQ ID NO: 32724 - DNA, 201 bp, Homo sapiens
tctcttctgtcccgtcctcttccttagcagtttctagcatgttgatgtatatttttaagggaaagagaacataacagtcaggtgcttggtgcttgaaatgyttatgagtagaggtatctggatttcacagatgaagaaacaaaattagagaggtcaactaatatgtcaaagagaagaacagctaaaagggggatggaggca

SEQ ID NO: 32725 - DNA, 201 bp, Homo sapiens
ccccaaatagatcattaatgtaaggaatactttttgcatttgatttttcattttatgtcttcagataacttatttattcagcaaatactaagttcagtacwtagataagtaggttgccgttgattactgttttgaaataaatgccataataaaggattaagcagagttttgtggatatagttctgcctggaatagttgaag

SEQ ID NO: 32726 - DNA, 201 bp, Homo sapiens
gcataggagtggccctggggaaatttgaagatgtccttggtttttttttgttttgtttcttgttgttttttttttaattccaaaattactctttgtaaatrttctgtgaaagcaagttagatgatcatatacttttccctgaacaattcctcagtgtttattttttgttagttctttgaaagagcacataattacatttgt

SEQ ID NO: 32727 - DNA, 201 bp, Homo sapiens
  misc_feature (1)...(201): n = A,T,C or G, or insertion/deletion polymorphism (see Tables 1-2)
gtggggtcagtgttcagaattagtaagataggagtaatgaggactttttaattagaaggagaatttaagaatctgaacgtaaagcacttgaactaaagaangttggagaaggccagcctttgataaagctcattaactgctcttcccaacattcactctgcccatagcatcaaaattattcttcctctaatctaccttgga

SEQ ID NO: 32728 - DNA, 201 bp, Homo sapiens
tgaacccaggaggcggaggttgcagtgagccgagattgcaccattgcgcaatgtccagctcatatgtgatagcagttggtgtagaacagagtttatagtaygctcttgtgtattttcaaaagaatgcaccaggtaacatatgcctaacctttctctggaatattaaatattcaaacagtgaacagagaaggagtttgaatt

SEQ ID NO: 32729 - DNA, 201 bp, Homo sapiens
  misc_feature (1)...(201): n = A,T,C or G, or insertion/deletion polymorphism (see Tables 1-2)
agaatgttggagaaggccagcctttgataaagctcattaactgctcttcccaacattcactctgcccatagcatcaaaattattcttcctctaatctaccntggatcttgctgctccctaggcactcttattgcaggtagccaaactccactcacctactaaagttcacttaaaattctcctttcatttatttaatcagta

SEQ ID NO: 32730 - DNA, 201 bp, Homo sapiens
atagatcatttgatttctaaagcagaggagatcacttcagatgctgcctatgttattcaggtaagctcgttagcaaagaagattgagtgtgttcatgcctstgtgtactggagcaattttctccattctcgacatttcactgtgtagggattttgatggactaagtcattggatttaggaactgataggtcaatatctgta

SEQ ID NO: 32731 - DNA, 201 bp, Homo sapiens
tttgatggactaagtcattggatttaggaactgataggtcaatatctgtacatctgtgtccccctacttttgaaaagatagcaatgtcatatttcaatttwgttcttttcattggataaaggtttagtgtgtagcttttcatagtaagccagctgtgtgtttttaataacgtttcttattaaggttttaaggagaaatgga

SEQ ID NO: 32732 - DNA, 201 bp, Homo sapiens
tttaggaactgataggtcaatatctgtacatctgtgtccccctacttttgaaaagatagcaatgtcatatttcaatttagttcttttcattggataaaggwttagtgtgtagcttttcatagtaagccagctgtgtgtttttaataacgtttcttattaaggttttaaggagaaatggaaaattataaacaatgtcacatc

SEQ ID NO: 32733 - DNA, 201 bp, Homo sapiens
taatttccagcgtgtcaatactgctgagctctttaaatctgtgtttgtactccaggctgtgtacgccatttactgcaaccttgaattctctaacatcacartaaattatcatctgaaaggaaaggatacatgccattagtggttccccttagtttaaaattttgtgtttgttacatgctaacggtgtcagagtaaaccatt

SEQ ID NO: 32734 - DNA, 201 bp, Homo sapiens
  misc_feature (1)...(201): n = A,T,C or G, or insertion/deletion polymorphism (see Tables 1-2)
ttggggtagagggagaataggaccaaggagcagtacttgggggattccagctgaatctgtaatgtttaacttctcaacaaaggatatgtgagctcaccagntcagcatgtcatagaattcggtagtgctaattgagtgttgattgctgtatttttctgaaccattgtagtactttttagatactaccagtagaatgtaatt

SEQ ID NO: 32735 - DNA, 201 bp, Homo sapiens
tgtgaactaatgtttaaaaagttagagcttgtctcaagtcagtacagctcttaagataataaatacagtaacactactttttatttctttgctcttttatycctttcaggttcgatttgctgctttgattactgtgttagcactggctgaaaaactaaaggagaattatattgtcttgctaccagaatccattcctttctt

SEQ ID NO: 32736 - DNA, 201 bp, Homo sapiens
tatttgtttctttataattgtacactagtgagaagaggatttggaaccagcttatttgagtaagaattaaaagtttgcttttttttttttttaattaggtkcatctagaagatgtttttcagttattcaagttctgttctgttttatggacctatggttctagcctttcaaatccactaaactgcagtgtgaaaacagtgc

SEQ ID NO: 32737 - DNA, 201 bp, Homo sapiens
ggctgctctgcagaaggttgtggagactctcccgcacttcatcagcccctatctggaaggcattctctcccaggtgagccacgatagccacgacatgctaygcagggtggctggggaaggtaaaagatcacaaatgtagtgattttgttttttctttaagggttagtttccgtttgacagaaaggagtcttatttctgaag

SEQ ID NO: 32738 - DNA, 201 bp, Homo sapiens
acacaggtgattgtttggataaagccctgtttggataagtcgaggaccatttttaaatgacttcttagacatgggatctgggagtagatctcgacccactstaaataaagtagtatactctgttctgctagaaatcctaacgcacattatcctgaaattatgccttcacaattcctaagtacagatttgttacctttttct

SEQ ID NO: 32739 - DNA, 201 bp, Homo sapiens
ggcggctgcctgtggcgaaaaggtcagaacctagggtgggaagataaggaaaatggtgatttctcacacagattttatgatattgtccagtttaaacatgrggctgatgatgcctaatgtgtgttatttagaacctttttgctcagaacctttttcaaaaaggtttttggcattttaaaaaattgcattcagagcccatag

SEQ ID NO: 32740 - DNA, 201 bp, Homo sapiens
gaactaattagtctcaccactgttatataatattgttattcctcaaattagaaaacagagtagaaaaaaagatttcctgtataatacaaacataaacttaraaggtaccaagaataagcctgacaaaaatatgtgcacaaatattacaggggaaatgtgcaagatatgaagggacacagaagaaaacttggaagaaataga

SEQ ID NO: 32741 - DNA, 201 bp, Homo sapiens
  misc_feature (1)...(201): n = A,T,C or G, or insertion/deletion polymorphism (see Tables 1-2)
agcaatttattaaaatagttattttctgctaaacttgtgggttttcaaaaaggtacatatattttatttagagataactatttctgttttccaatttggtnttaaatgtttactgtcctttgacagtggcctctgagtcatatatgtcattttgactgtaaatagcaagatggaagaacttcagttttccattggtattgc

SEQ ID NO: 32742 - DNA, 201 bp, Homo sapiens
agctctttaaatctgtgtttgtactccaggctgtgtacgccatttactgcaaccttgaattctctaacatcacaataaattatcatctgaaaggaaaggawacatgccattagtggttccccttagtttaaaattttgtgtttgttacatgctaacggtgtcagagtaaaccatttgattatacatagaaaagttccagcc

SEQ ID NO: 32743 - DNA, 201 bp, Homo sapiens
atttcttacaaatgctttaatattcaggcgtgggttcaagtgtagagcaatatcctttgattttcctgctagtaggtcaacattaaagcttttgagaaagraagaaaaaaaaaaaccttaattaaccaagtaggacagagtagtggcaatttcagcaatgttagtgaccagacttgaactatgattctaactctatgaaac

SEQ ID NO: 32744 - DNA, 201 bp, Homo sapiens
  misc_feature (1)...(201): n = A,T,C or G, or insertion/deletion polymorphism (see Tables 1-2)
atgtgccatttaagtggattgtacattcctgtgatgttactaaagaattgttgtaactgcttgtgggtgaagaagacaattgtaagagttgcatgtgtgcnctcagaagagataaatgtaatattaatttgagagggggatgagttgaggtagagaaaaacagatacaagatacaaagacaagtactggtgagtttctttt

SEQ ID NO: 32745 - DNA, 201 bp, Homo sapiens
tagcccgtgtcattaaaactccgctggcgtgaaagatgacgtccttagcccagcagctgcaacgactcgccctccctcaaagtgatgccagcctcttatcyagagatgaagttgcttctttgttatttgaccctaaggaagcggccacaatcgacagggacaccgccttcgccattggtgagccatcttttaacttagaaa

SEQ ID NO: 32746 - DNA, 201 bp, Homo sapiens
gcaggaggatcacttgaggccaagagttcaagaccagcttggacaacgtgatgagatcctgcctctacaaaaaatacaaaaattagctgggcgtgatggtrcgtgcctgtagtcccagctactcagttgcctgaggtaggcagatggcttgtgcctgggaggtcaaggctgcagtgagctgtgattgcaccactgcactcc

SEQ ID NO: 32747 - DNA, 201 bp, Homo sapiens; identical to SEQ ID NO: 8320

SEQ ID NO: 32748 - DNA, 201 bp, Homo sapiens
agctacaaaagtacattctcctttgtttcttagctcttggaggggggaggtgtgagctactaaaggggtggcatccctaggaagtttgagttttggggattcttattcagcttccagtgcaagcctgtgggcaaggaatgaaggcggaaggagcggtgtggagggaggcggtccgtggcgcctcctgctttgttaatgtgc

SEQ ID NO: 32749 - DNA, 201 bp, Homo sapiens
aacagctcccaaatggtgaaactggtattctaagatgaaagcttaatgaacataatgaagtgaataaacgcatgtgaactaatgtttaaaaagttagagcytgtctcaagtcagtacagctcttaagataataaatacagtaacactactttttatttctttgctcttttatccctttcaggttcgatttgctgctttgat

SEQ ID NO: 32750 - DNA, 201 bp, Homo sapiens
tgcctgaggtaggcagatggcttgtgcctgggaggtcaaggctgcagtgagctgtgattgcaccactgcactccaaactgggcaacagagcaagaccctgkctcaaaaaaaaaaaaaaaagggctgtacatctatacatatttctggtcacttctaagtattgcttttaagttactggcactagcaaaatctcaccaaaca

SEQ ID NO: 32751 - DNA, 201 bp, Homo sapiens; identical to SEQ ID NO: 8321
  misc_feature (1)...(201): n = A,T,C or G, or insertion/deletion polymorphism (see Tables 1-2)

SEQ ID NO: 32752 - DNA, 201 bp, Homo sapiens; identical to SEQ ID NO: 8322
  misc_feature (1)...(201): n = A,T,C or G, or insertion/deletion polymorphism (see Tables 1-2)

SEQ ID NO: 32753 - DNA, 201 bp, Homo sapiens; identical to SEQ ID NO: 8362

SEQ ID NO: 32754 - DNA, 201 bp, Homo sapiens
tggccctgatttctatgggctcatgaattctttattctgtggattctaatccatatgctgccattatatatttgggtgcaggaattttcctttctctcccwtgtcctcggggtttgcctcctggccttgctgtgtacctccttttcagatgcatggcattcccagggccactgtcctgccccttccactggaaagtgcctg

SEQ ID NO: 32755 - DNA, 201 bp, Homo sapiens
ccaggacacacccatttactgtactttgctttatcaaagagctgcatttaactcccttcaatttctctagtggtacaatttcaaattgaagtatattattwtctgaatataataccatgacatgttttaaaatgtgacgttaattctaacgggaatatatgtgtgttgtaagagctcttagaatggaatttcagcctagtg

SEQ ID NO: 32756 - DNA, 201 bp, Homo sapiens
  misc_feature (1)...(201): n = A,T,C or G, or insertion/deletion polymorphism (see Tables 1-2)
acactatttataaggttgcacatattacaaacagctcccaaatggtgaaactggtattctaagatgaaagcttaatgaacataatgaagtgaataaacgcntgtgaactaatgtttaaaaagttagagcttgtctcaagtcagtacagctcttaagataataaatacagtaacactactttttatttctttgctcttttat

SEQ ID NO: 32757 - DNA, 201 bp, Homo sapiens
  misc_feature (1)...(201): n = A,T,C or G, or insertion/deletion polymorphism (see Tables 1-2)
aggagacctgccagaggtggctggaggcactttattgccagcctggcgggctggcgagcgccaatgaagtaaaatctggtgacacacttgagtttgcatgnggcattttattttattggttttttttaaaggaagagattataaaaagacatttcacattaaagatttgcagtcctgggacacagtttggaaaacactatt

SEQ ID NO: 32758 - DNA, 201 bp, Homo sapiens
ttttaaagccccaaaactaggatattgtgacacagaatgttttttattcagtgctgagatgggagtttatcccaagcgactgtcctggcccctcatacaaytatagtggtgaccagtcaggggctgtgggtgaggagacctgccagaggtggctggaggcactttattgccagcctggcgggctggcgagcgccaatgaag

SEQ ID NO: 32759 - DNA, 201 bp, Homo sapiens
cagggacaccgccttcgccattggtgagccatcttttaacttagaaaagctcttggaagcgtttgttttctggatgttactgttttttttttttccccttsttttctcttctgtcccgtcctcttccttagcagtttctagcatgttgatgtatatttttaagggaaagagaacataacagtcaggtgcttggtgcttgaa

SEQ ID NO: 32760 - DNA, 201 bp, Homo sapiens
ttgttcctgcacacttgaggcagtgagtactaagctgctttcttggcaaaataacaagatggttggggaagcaggcaatgttatcctctgaaataccattycttgagaaaaacaatgatagctaatgtgtttttgagcatttatacactaggccctggtaagcactttatctgcattatctcatttaattctcacagcatt

SEQ ID NO: 32761 - DNA, 201 bp, Homo sapiens
atgtaatattaatttgagagggggatgagttgaggtagagaaaaacagatacaagatacaaagacaagtactggtgagtttctttttattttaaaattaaytgtgttgtccctgtctaatcattaagtttattttaaatgaacttaacagtctcgtgtctcatggggctgcactgctgaaagaagctgttggttcatctct

SEQ ID NO: 32762 - DNA, 201 bp, Homo sapiens
gggaggccgaggcgggcggatcatgaggtcaggagatcgagaccatcctggctaacatggtctctactaaaaaatacaaaaaattagccgggcgtggtggygggcgcctgtagtcccagctactcgggaggctgaggaaggagaatggcgtgaacccgggaggcatagcttgcagtgagccaagatcgagccaatgcattc

SEQ ID NO: 32763 - DNA, 201 bp, Homo sapiens
tctgttgccgaggctggagtgcagtggcgcgatctcagctcactgcaagctctgcctcttgggttcatgccattctcctgcctccgcctcccgagtagctrggactacaggcacccgccaccacgcccggctaatttttttgtatttttagtagagacggggtttcaccgtgttagccaggatggtctcgatctcctgatg

SEQ ID NO: 32764 - DNA, 201 bp, Homo sapiens
gtaaatctcataatgtcatgcactttcatccctctgtacttcagtgtgcatcttttgaaaagtggatatgactacaatgccattagaagtaaaaaaaaaaataattccttggtattatctaatacctagttcataatcatatttccatggttatcacaaaagtattttttatagttgttttctttgaatcagaatccaaag

SEQ ID NO: 32765 - DNA, 201 bp, Homo sapiens
  misc_feature (1)...(201): n = A,T,C or G, or insertion/deletion polymorphism (see Tables 1-2)
aggttacccgtttcctaaaactggttccagaccttttggccattgtgcagcgtaagaaaaaggaaggggaagaagaacaagcaatcaacagacagacagcnttgtataccttaaagcttttatgcaagaattttggtgcagaaaatccagatccttttgtcccagtgctgaacactgctgtgaaactgattgctccagaga

SEQ ID NO: 32766 - DNA, 201 bp, Homo sapiens
tgaatttatatagatatagatatgtgtgtatatagtgtttgctatctaaatatattttcatatatatagatgtatatattctatatacgtagatttgtgtrtgtgtgtgtgtaaattgagtatgaattgtagcgtgtgctttcatgtgaaaggcaaagtaattctgaaggttgtcctgtaagattccagataggctaatgg

SEQ ID NO: 32767 - DNA, 201 bp, Homo sapiens
gcattcctgctgaaatcatcactctcattgaacatgattctagaagtactagccggcagaaatagacaagtttcaaatacttatggaatgtatgaatatartaaaggcaaaatcaaagatctgtgagatggttatgtggattgttaaatgggacatctggctatccatttggaaacattaggaagtttgactccaacctca

SEQ ID NO: 32768 - DNA, 201 bp, Homo sapiens
gcttgtgcctgggaggtcaaggctgcagtgagctgtgattgcaccactgcactccaaactgggcaacagagcaagaccctgtctcaaaaaaaaaaaaaaaagggctgtacatctatacatatttctggtcacttctaagtattgcttttaagttactggcactagcaaaatctcaccaaacacaaaagtttaataatagaa

SEQ ID NO: 32769 - DNA, 201 bp, Homo sapiens
atgtgaggaacacctagacgtttttaaagccccaaaactaggatattgtgacacagaatgttttttattcagtgctgagatgggagtttatcccaagcgaytgtcctggcccctcatacaattatagtggtgaccagtcaggggctgtgggtgaggagacctgccagaggtggctggaggcactttattgccagcctggcg

SEQ ID NO: 32770 - DNA, 201 bp, Homo sapiens
aagcaggcagatcatgaggtcaggagatcaagaccatcctgggcaacatggtgaaaccccgtctctactaaaaatacaaaaattagctgggcgtggtggcrtgtgcctgtaatcccagctacttgggaggctgaggctggagaattgcttgaaccagggagttggaggttgcagtgagccgagattgtgccactgcactcc

SEQ ID NO: 32771 - DNA, 201 bp, Homo sapiens
tatagatactaggcttatgatcttgttgagtaagtggtggcagtggaaataaaacatgggtaggttgagtggaagtcaaaatttgacacccaagtgttacraatttcaaactgttttagcaatgagtcaccatttctcaaactaatgattgtattagaactttactggctataacagaccaaagcagaattttattaatag

SEQ ID NO: 32772 - DNA, 201 bp, Homo sapiens
  misc_feature (1)...(201): n = A,T,C or G, or insertion/deletion polymorphism (see Tables 1-2)
ctatccccaccccaatggtgcgttgggcagaagtactaaaatactttctaaatacttttaaataacaaagatttgaagtaattccttcttttttaagtgcnattgaaatgtcattgtgctccagagagaaatgcattgaatttatccacactatagtcttttgagttagagcaatacattctgttgtttatagatactagg

SEQ ID NO: 32773 - DNA, 201 bp, Homo sapiens
  misc_feature (1)...(201): n = A,T,C or G, or insertion/deletion polymorphism (see Tables 1-2)
ctttgtcttactcttcctagctggaaaacaggcttgggggagaagagaaattccaggaacgggtgacaaagcacctgataccatgcatcgcacagttttcngtggccatggcggatgactctctttggaaaccactgaactaccagattctgctaaagacgagagactcctcgcctaaggttaggaactgcgtgacaagta

SEQ ID NO: 32774 - DNA, 201 bp, Homo sapiens
atcgcttagcatgactgtgtgactcaggacccccgagtctgatttccatttagacaatctcaagctgtgacaatgggaaaatggacaaacattttttgcarctttaatgatttggggattctggctgtccccttcaggttacccgtttcctaaaactggttccagaccttttggccattgtgcagcgtaagaaaaaggaag

SEQ ID NO: 32775 - DNA, 201 bp, Homo sapiens
  misc_feature (1)...(201): n = A,T,C or G, or insertion/deletion polymorphism (see Tables 1-2)
ttctagaaggcaatacatttgccctagagagtattagaataatgcctggtttttgaacctgctaatatcatgaaagatagtaaaatatttgtatgttgganattttttcaaacagaagaaagaaatgagacttgttgttcaaagtctttgtcttactcttcctagctggaaaacaggcttgggggagaagagaaattccag

SEQ ID NO: 32776 - DNA, 201 bp, Homo sapiens
cgtctgcgtctaccatcggccttcgtccctgatcgcaagttgggcaagaggtgtctgcccagttttatccactgacgtttagggctgactttaaaaggaaytctgtgtgtagttaaaaagtgctaagcattttccaaacactagtacctcatcatgaagcctctctgtaagtgtgtgtttgtcagcgaagatctgcagtgg

SEQ ID NO: 32777 - DNA, 201 bp, Homo sapiens
ttttttattttttattttttaaactgctcaaaagacagacatgatataagctgtcatggttaatgtattcatttgttttaactgggcctcactgagaacgygtcagagcatggctgtcctctggagcaaagagctcctctgagatgttctgctggagagaaaggggcgatgataaagggtatgagattccatttgagttct

SEQ ID NO: 32778 - DNA, 201 bp, Homo sapiens
  misc_feature (1)...(201): n = A,T,C or G, or insertion/deletion polymorphism (see Tables 1-2)
cactgcatagcctaaacagcctgcaggtggtcacagatgtaggccccctagtaaactggcagggaagaacattgctatttgtcatccagtactagaggtcnggtcttttgtattaggcagaaatttgtgcctaagaaaattttgttttttacttacaggctatttgtaaagaatagcaatgccctatccccaccccaatgg

SEQ ID NO: 32779 - DNA, 201 bp, Homo sapiens; identical to SEQ ID NO: 8341

SEQ ID NO: 32780 - DNA, 201 bp, Homo sapiens
  misc_feature (1)...(201): n = A,T,C or G, or insertion/deletion polymorphism (see Tables 1-2)
ctggcagggaagaacattgctatttgtcatccagtactagaggtccggtcttttgtattaggcagaaatttgtgcctaagaaaattttgttttttacttanaggctatttgtaaagaatagcaatgccctatccccaccccaatggtgcgttgggcagaagtactaaaatactttctaaatacttttaaataacaaagatt

SEQ ID NO: 32781 - DNA, 201 bp, Homo sapiens
gaccctgaaaagtgctgcttgctgttgcagtttattttgaactgtttatacaaaatcttcctttttgatacccagcattttataagtaaagagagagcagragccttgatgatgcctctggtggatcaggtaaccaaacagaatcatctttcgttgctgaggaagccatcactgttcgagcttggcaggttttagatctgc

SEQ ID NO: 32782 - DNA, 201 bp, Homo sapiens
agtgcttggaagcaagattttagaggttcttaagtcctaagctaaggagggtgaattttttacttcattgttgtcagacagtgaagtgttgttttagcatsatgagcgaatgttataagtcacctcacttgggagaaagaataaagtaaatggccgttactgtcagttactggaagtaactttaaaacgcaaaaattaaga

SEQ ID NO: 32783 - DNA, 201 bp, Homo sapiens
tttagactcttctgatttagttattttaatagtgatttcaatgtaaacattggagattaaatggttaagttcagtgttttttcatttttactcttcccacrtctacagatgaagcattttttgactctgaaaatgaccctgaaaagtgctgcttgctgttgcagtttattttgaactgtttatacaaaatcttcctttttg

SEQ ID NO: 32784 - DNA, 201 bp, Homo sapiens
  misc_feature (1)...(201): n = A,T,C or G, or insertion/deletion polymorphism (see Tables 1-2)
tgtttgccggccacttagtgaagccttttgctgacaccttgaaccaggtgaacatctccaaaacaggtgggtggtcgcttcagttcagctgtcacccttgncctgtgtgccttatacaaggtaccagtaagacacaacctagtgcttggaagcaagattttagaggttcttaagtcctaagctaaggagggtgaatttttt

SEQ ID NO: 32785 - DNA, 201 bp, Homo sapiens
  misc_feature (1)...(201): n = A,T,C or G, or insertion/deletion polymorphism (see Tables 1-2)
cacctgataccatgcatcgcacagttttcggtggccatggcggatgactctctttggaaaccactgaactaccagattctgctaaagacgagagactcctngcctaaggttaggaactgcgtgacaagtactgaaactgcatcttttcactgcatagcctaaacagcctgcaggtggtcacagatgtaggccccctagtaa

SEQ ID NO: 32786 - DNA, 201 bp, Homo sapiens
gttgacattttacaacttggcagattgcattgctgaaaagctgaaagggctttttactctgtttgccggccacttagtgaagccttttgctgacaccttgraccaggtgaacatctccaaaacaggtgggtggtcgcttcagttcagctgtcacccttgccctgtgtgccttatacaaggtaccagtaagacacaacctag

SEQ ID NO: 32787 - DNA, 201 bp, Homo sapiens
tgtctgctcaacatctgccaaaaactatctccagatggtggcaaaatacccaaaggtaggtactttttggaaggaaaggttagaaaaattatctactttgrgcgtgagtgtacctgccacttagggtttttgtctttctcaccattgtagatattttagatgaggagaagttcaacgtggagttgatagttcagtgcatcc

SEQ ID NO: 32788 - DNA, 201 bp, Homo sapiens
taaaattaaatgtgttgtccctgtctaatcattaagtttattttaaatgaacttaacagtctcgtgtctcatggggctgcactgctgaaagaagctgttgsttcatctctgtttttcaagtgaaaattctatacaaaggaatatatttggacacgagtctatgaaaattccaaaatcatttgctcgtttattatatatatt

SEQ ID NO: 32789 - DNA, 201 bp, Homo sapiens
gttaatatctcatttatcctcaagtaatcctcaaagtaacctttaaccagtgacttcagaaaattaatttgatcataaactatgtcatttaaagaaatcargtcccttttatgaaaaatatcatttaaacatttgtaaagagattgaagctattttcatattgaggatttgagtcagagctccttaacctggggttctcca

SEQ ID NO: 32790 - DNA, 201 bp, Homo sapiens
tatctcacttaaaaaccacaacattttatctctgttttacaaaggaagaaactagaggcttaaaagatttcagttatttgacaaagatcacaagctagtgrgtgtgacatggggagctgtgacagttctggaacatagagtcttaggcccaggaaataacagtaaatgttattattaagggaggggtggtggagcaagtag

SEQ ID NO: 32791 - DNA, 201 bp, Homo sapiens
ggtggtactgcaatgtgtaaactttgacttaaagaagaagatttagtttttaaaaatacacaccgctgaactctaggaatcatttgaaaatggcacatctytttcctgtgttattggtagaatcacatgggtccgtttatgagcatcttgcaagagcatattggggtgatgaagaaggaagagctcacctcccatcagtct

SEQ ID NO: 32792 - DNA, 201 bp, Homo sapiens
gttgatggaaggtaattcccaaactattcccaaccattaaacaattaaggaataattcagtaaaattctgtgaaaatgtgcccaatgataatgcagatttkgatataacgtgactagcagttgatccagtcctcatacaggcagctccagtctcaaatacaggcaggctcgagctcctgttttgagttgggtggagggagc

SEQ ID NO: 32793 - DNA, 201 bp, Homo sapiens
acaccaaacaattaattcttagttgtctgctcaacatctgccaaaaactatctccagatggtggcaaaatacccaaaggtaggtactttttggaaggaaargttagaaaaattatctactttgagcgtgagtgtacctgccacttagggtttttgtctttctcaccattgtagatattttagatgaggagaagttcaacgt

SEQ ID NO: 32794 - DNA, 201 bp, Homo sapiens
tgtcctgaagatgtttagaacccttgccacaagagcagggaaatatggaatacaccaaacaattaattcttagttgtctgctcaacatctgccaaaaactrtctccagatggtggcaaaatacccaaaggtaggtactttttggaaggaaaggttagaaaaattatctactttgagcgtgagtgtacctgccacttagggt

SEQ ID NO: 32795 - DNA, 201 bp, Homo sapiens
acatgggtccgtttatgagcatcttgcaagagcatattggggtgatgaagaaggaagagctcacctcccatcagtctcagctaaccgcctttttcctggargccctggacttccgagcccagcactctgaggtaagctcaggttcactcctccaaatcctaaagctgttatccacctattgaagagtccgagaacaatcta

SEQ ID NO: 32796 - DNA, 201 bp, Homo sapiens
  misc_feature (1)...(201): n = A,T,C or G, or insertion/deletion polymorphism (see Tables 1-2)
atcatgatccatgtcaagtctgtgtattgtattgagttgcagtatctgtttagtgtcttaatctggccctgatttctatgggctcatgaattctttattcngtggattctaatccatatgctgccattatatatttgggtgcaggaattttcctttctctcccatgtcctcggggtttgcctcctggccttgctgtgtacc

SEQ ID NO: 32797 - DNA, 201 bp, Homo sapiens
tgaactctaggaatcatttgaaaatggcacatctctttcctgtgttattggtagaatcacatgggtccgtttatgagcatcttgcaagagcatattggggygatgaagaaggaagagctcacctcccatcagtctcagctaaccgcctttttcctggaagccctggacttccgagcccagcactctgaggtaagctcaggt

SEQ ID NO: 32798 - DNA, 201 bp, Homo sapiens
gaaatcttatatcttatttctagacttgatgtttaatgatagtattttagttattccttattgaatgagttccttattgaatgagttctggacaatggccrttaatgtaacaatgaattgtacaacttttacatttcccatcatttctcttttgggtgtcctgaagatgtttagaacccttgccacaagagcagggaaata

SEQ ID NO: 32799 - DNA, 201 bp, Homo sapiens
  misc_feature (1)...(201): n = A,T,C or G, or insertion/deletion polymorphism (see Tables 1-2)
taattatcccaacactctcctttacaccgcatgtgtttctgcatcatgatccatgtcaagtctgtgtattgtattgagttgcagtatctgtttagtgtctnaatctggccctgatttctatgggctcatgaattctttattctgtggattctaatccatatgctgccattatatatttgggtgcaggaattttcctttctc

SEQ ID NO: 32800 - DNA, 201 bp, Homo sapiens
aattatctactttgagcgtgagtgtacctgccacttagggtttttgtctttctcaccattgtagatattttagatgaggagaagttcaacgtggagttgayagttcagtgcatccgcctttcggagatgccgcagacccatcaccatgcccttttacttttgggcactgttgctggaatatttccggtaagcgttaatgat

SEQ ID NO: 32801 - DNA, 201 bp, Homo sapiens
  misc_feature (1)...(201): n = A,T,C or G, or insertion/deletion polymorphism (see Tables 1-2)
cctaaggcatcttgcaaagcagaatttttgtattgcacgtcagcggtttcctgtcaacacgctaggggccagtggtatttatgattgaagatgctcaagantgttgagacctggctgttccattgtgttgatcatttgccatttacaaggttaggagccttcattaccatggggcaaatgattaaaccgcttcacttacac

SEQ ID NO: 32802 - DNA, 201 bp, Homo sapiens
aaccacagtacattgatcaaattcagaaaatttaacattgatccaatccagtgatgtaatctacagttcatactccagtctccctaattatcccaacactstcctttacaccgcatgtgtttctgcatcatgatccatgtcaagtctgtgtattgtattgagttgcagtatctgtttagtgtcttaatctggccctgattt

SEQ ID NO: 32803 - DNA, 201 bp, Homo sapiens
tttatccctttcaggttcgatttgctgctttgattactgtgttagcactggctgaaaaactaaaggagaattatattgtcttgctaccagaatccattccyttcttagcagagttgatggaaggtaattcccaaactattcccaaccattaaacaattaaggaataattcagtaaaattctgtgaaaatgtgcccaatgat

SEQ ID NO: 32804 - DNA, 201 bp, Homo sapiens
ctggcttttttttcttctgtgagatctttggagttgggctggtagagccgccttttattacttgtggaaattgatgggccctgtttctactgtgagaggtwtaatcctaaggcatcttgcaaagcagaatttttgtattgcacgtcagcggtttcctgtcaacacgctaggggccagtggtatttatgattgaagatgctc

SEQ ID NO: 32805 - DNA, 201 bp, Homo sapiens
ctgcatcccagcctgaatgacggagcgagacgctatctcttgaaaaaaaaattagtagaaattaacagaaataaaaaatgttgatagttgtgttttctttyaggataaagttttacacaatatcatgtctatttttacatttatgggagccaatgtcatgcgcctagatgatacttacagttttcaagttattaacaagac

SEQ ID NO: 32806 - DNA, 201 bp, Homo sapiens
  misc_feature (1)...(201): n = A,T,C or G, or insertion/deletion polymorphism (see Tables 1-2)
aagcagattacagtagtgtttttaattaacctcatacatttatatgattgaagttttggtccccagattgtatggaaatgcctagtggcattaaggatgcngtaggatgtccacttttagtagcaaccgatgttcattcactactccatgttaggtgctttacttggattatctcacttaaaaaccacaacattttatctc

SEQ ID NO: 32807 - DNA, 201 bp, Homo sapiens
  misc_feature (1)...(201): n = A,T,C or G, or insertion/deletion polymorphism (see Tables 1-2)
tgttattttttaaattactgttgtgtccgtactgttagcactgggagatttcttgtgcttagccacataaaatgtatagacactgctttttaggctatgangcagatagcgatgtaataggcacagtttgctggtttttttcataatgccctctactccattccctagcctctgtttctgcttcaagttcttctaaagctc

SEQ ID NO: 32808 - DNA, 201 bp, Homo sapiens
cagaaaaggaaaaaaaattagctgggcagggtagcatgcacctgtagtcctagctactcaggaggctgaggtggaaggattgcttgagcttaggagtccarggtttcagtgaactgtgatcacacaactgcactgcatcccagcctgaatgacggagcgagacgctatctcttgaaaaaaaaattagtagaaattaacaga

SEQ ID NO: 32809 - DNA, 201 bp, Homo sapiens; identical to SEQ ID NO: 8331

SEQ ID NO: 32810 - DNA, 201 bp, Homo sapiens
  misc_feature (1)...(201): n = A,T,C or G, or insertion/deletion polymorphism (see Tables 1-2)
tgtagggcagtgcttgcaaggagttttgcatagtgcctgacacatagtaagtgttcagttaatgaaagacattgttattttttaaattactgttgtgtccntactgttagcactgggagatttcttgtgcttagccacataaaatgtatagacactgctttttaggctatgaagcagatagcgatgtaataggcacagttt

SEQ ID NO: 32811 - DNA, 201 bp, Homo sapiens
  misc_feature (1)...(201): n = A,T,C or G, or insertion/deletion polymorphism (see Tables 1-2)
acctgaaaggttattttaagaattaaataagaaaatgtgtgtggaagtgcctggtgcctggaggtgtgcagtggacagcagtctgtcttaattgaagttgnttttttttttaatttgtttttcttttcatgttaaatataaaatttctctttaggtcaatgccttgctgcccacagagacattcattcctgtgatcagagg

SEQ ID NO: 32812 - DNA, 201 bp, Homo sapiens
gggtgggaagataaggaaaatggtgatttctcacacagattttatgatattgtccagtttaaacatggggctgatgatgcctaatgtgtgttatttagaayctttttgctcagaacctttttcaaaaaggtttttggcattttaaaaaattgcattcagagcccatagcactctgaatatcctcagttgcagcaaaacatc

SEQ ID NO: 32813 - DNA, 201 bp, Homo sapiens
ttccgagtagtttttgaaataatttagtacagaattatttaactcgtctttctacttgaaacatttagcataaggtagacatgaacaagttctctgagtgycttcagctgccgtttgctgagcgagcctctgtgtttcaggttgctggagaccgttctcggctatatcagtgcagttgcacagtccatggaaaggaacgca

SEQ ID NO: 32814 - DNA, 201 bp, Homo sapiens
gccttaaattatttgtttctttataattgtacactagtgagaagaggatttggaaccagcttatttgagtaagaattaaaagtttgcttttttttttttttaattaggtgcatctagaagatgtttttcagttattcaagttctgttctgttttatggacctatggttctagcctttcaaatccactaaactgcagtgtga

SEQ ID NO: 32815 - DNA, 201 bp, Homo sapiens
gaggtcgatgcttctgcacagaagcgcctagttacttcttgatgatctctgtctatggcaataatccctcatttcctttctttccgagtagtttttgaaayaatttagtacagaattatttaactcgtctttctacttgaaacatttagcataaggtagacatgaacaagttctctgagtgccttcagctgccgtttgctg

SEQ ID NO: 32816 - DNA, 201 bp, Homo sapiens
tttccgagtagtttttgaaataatttagtacagaattatttaactcgtctttctacttgaaacatttagcataaggtagacatgaacaagttctctgagtkccttcagctgccgtttgctgagcgagcctctgtgtttcaggttgctggagaccgttctcggctatatcagtgcagttgcacagtccatggaaaggaacgc

SEQ ID NO: 32817 - DNA, 201 bp, Homo sapiens
  misc_feature (1)...(201): n = A,T,C or G, or insertion/deletion polymorphism (see Tables 1-2)
ataaggtagacatgaacaagttctctgagtgccttcagctgccgtttgctgagcgagcctctgtgtttcaggttgctggagaccgttctcggctatatcantgcagttgcacagtccatggaaaggaacgcagacaaactcaccgtgaagttctggcgcgcgctccttagtaaagcttacgacctgttagataaggtaggt

SEQ ID NO: 32818 - DNA, 201 bp, Homo sapiens
aaaataataaataaataaaaagatactgtgggttatttgggttatgacagtttataatgtaaacaaaagtagacttgtaaacagtgaagagtatataatadcacgggccctgtaaaagagtacaatcacaatactaatcggtaggttgaatagaaactaacattgctacactcctactaatatgttaggcccattactata

SEQ ID NO: 32819 - DNA, 201 bp, Homo sapiens
ccagggccactgtcctgccccttccactggaaagtgcctgccctgcagccaggaatgtgagctgctgagttccagtcctgtgggctgacttgtagcgctaygcgtaggactttcgtttttggagctgattttgtctgcgcccccttctcccctcctctgctgtgcggtgtcaacttctgtctccactcttccctctagctc

SEQ ID NO: 32820 - DNA, 201 bp, Homo sapiens
gcaaagcgctggaccttttgaataacaagctgcagcaaaatatatcctggaagaagacaatagtgagtgaagacccaggacacacccatttactgtacttygctttatcaaagagctgcatttaactcccttcaatttctctagtggtacaatttcaaattgaagtatattattatctgaatataataccatgacatgttt

SEQ ID NO: 32821 - DNA, 201 bp, Homo sapiens
ttgaacctgggaagcggaggttgcagtgagctgagattgtgccgctgcactccagcctgggtgacagagcaagactccgtctcaaaaaaaaaaaaaaaaaaagaaatatgcctatttattcctaccctttattggataaacagttcatatgaataaagtttgtttttagagataatgtttcaaggtaagacatagataaaa

SEQ ID NO: 32822 - DNA, 201 bp, Homo sapiens
agttcgagaccaacctggccaaaatggtgaaacctaatctctactaaagatacaaaaattagccaggcatgatggcgggcacctgtaatccttcctactcsggaggctgaagcagtagaattgcttgaacctgggaagcggaggttgcagtgagctgagattgtgccgctgcactccagcctgggtgacagagcaagactc

SEQ ID NO: 32823 - DNA, 201 bp, Homo sapiens
tttattatacatatgtagataacaggttattttatattgctttacttttaatacctttctcgaggtcatgagcatgttttcgcctgtagcagcacgttgasttaatcaaatccctcactggagacgttacattgtaaatctggctttggattattttccttctaagttattactctgtactgcttgtacagagtcatattt

SEQ ID NO: 32824 - DNA, 201 bp, Homo sapiens
caggcggactgactcagattttaattttgattttttttttttttttttagatgaatgtgaagaagtagaacatcagtgccaaaagactattcagcaactgsaaactgtcctgggagagccactccagagctatttctaagactttctgtggtgtttcatactctactcagagttcacactcatatttcatatttttatttt

SEQ ID NO: 32825 - DNA, 201 bp, Homo sapiens
atggtaagtatgctttgaaagtccaccccctggatttctttctcatactcttattaaattctcagcttttgctttactagatttttcttaaaaaaaatttyttttattcttgagtacttggttttactttaaacgttgcagtgttgtttaatatattctgtgcaatgtttgaaatcttttaacattttatatattttttca

SEQ ID NO: 32826 - DNA, 201 bp, Homo sapiens
aacgtgccgaactctagaacttgtgtcatagcaattagaagcagattcttactacaagtaaaatcatatgatcagtaaaatttaatttcagctaattacarctaatcacactaagttcatcttcatttgaattttattggttttatagagtttttagtatttcccttgtagatttaaaaaaaaatttttgttttatgtcat

SEQ ID NO: 32827 - DNA, 201 bp, Homo sapiens; identical to SEQ ID NO: 8338
  misc_feature (1)...(201): n = A,T,C or G, or insertion/deletion polymorphism (see Tables 1-2)

SEQ ID NO: 32828 - DNA, 201 bp, Homo sapiens
gttcaacttgttgatacactgggtgcagagaaattcctctggattctcctcatcttgctttttgaacagtatgtcacaaaaacagtgctggcggctgcctrtggcgaaaaggtcagaacctagggtgggaagataaggaaaatggtgatttctcacacagattttatgatattgtccagtttaaacatggggctgatgatg

SEQ ID NO: 32829 - DNA, 201 bp, Homo sapiens
  misc_feature (1)...(201): n = A,T,C or G, or insertion/deletion polymorphism (see Tables 1-2)
aatagtatgagaaaaggcatgatctaggaatgtgcacagcatgtttgaagaatgtaatggtgattgattgatggagagcagagggttgagacaggtagacnttggtttattcattcattcaagtgttttctgtcattctttctgtcatttattcaacaactatattttgatcaccaatacctggagtaaaatggttcaaac

SEQ ID NO: 32830 - DNA, 201 bp, Homo sapiens
aaagtgctggaactacaggcgtgagccaccgtgcccggctgcttagcataatgtttttgaggttcattcttgttgaagcttgaatccgtattccttttatractgaataatattgttgtatgtgtatgccacattttgtttatctgttcatcggttgatggacatttgggttgtttcaactgtggggctattataaattat

SEQ ID NO: 32831 - DNA, 201 bp, Homo sapiens
acggggtttcaccgtgttagccaggatggtctcgatctcctgatgtcatgatccgcccgcctcggcctcccaaagtgctggaactacaggcgtgagccacygtgcccggctgcttagcataatgtttttgaggttcattcttgttgaagcttgaatccgtattccttttatgactgaataatattgttgtatgtgtatgcc

SEQ ID NO: 32832 - DNA, 201 bp, Homo sapiens; identical to SEQ ID NO: 8346

SEQ ID NO: 32833 - DNA, 201 bp, Homo sapiens
cagctaattacaactaatcacactaagttcatcttcatttgaattttattggttttatagagtttttagtatttcccttgtagatttaaaaaaaaatttttgttttatgtcatctatattttaagaaggagttatacttaattttaagttgatatataaacaacaaacaacatttagatctttgagaatgtttctttgaaa

SEQ ID NO: 32834 - DNA, 201 bp, Homo sapiens
gcagtaaatctgtttttgtgcatgtgtgtatatgtcttattccttcctagctgattagaatatacatatctgatccggcacttggaaacaatcggtatggwtgattctgtattgcattactagttgtccactctaagggatgagcgtgaaattgagtgactctggactggagaagtgatactgtatcataatcaagacaag

SEQ ID NO: 32835 - DNA, 201 bp, Homo sapiens
aaattactttgtagaattacttgactaaattaaacctacacatagacacaagtatacatgaaatcataccattaacaatacaaattttttcatcaactcatgtgatgttctagaaacaaagattttgcatttttttgtttgttttctgtagttagatggttgttactgaaaatgttgggcaatttggggtggttttctctg

SEQ ID NO: 32836 - DNA, 201 bp, Homo sapiens
aaaattactttgtagaattacttgactaaattaaacctacacatagacacaagtatacatgaaatcataccattaacaatacaaattttttcatcaactcatgtgatgttctagaaacaaagattttgcatttttttgtttgttttctgtagttagatggttgttactgaaaatgttgggcaatttggggtggttttctct

SEQ ID NO: 32837 - DNA, 201 bp, Homo sapiens
cactgggaggccctgcactgagctctccctgtgctcctcgcccccatgaaggcttcagaagaaagaggggcagctcagccttgctgctaacccggccccamcccgagaggccagaatgaagcacaaaacctgaatctgcaaagcagcaagttgagggtttccattcttttgataggagcagtggaaaggactgtcaaggaa

SEQ ID NO: 32838 - DNA, 201 bp, Homo sapiens
agcctcctcgctgcccccttcactttcttattcctgagggtgtagatgagcgggttgagagcaggtgtgaccacggtgtagaagagcgatacgaacttgcyccgtgcctggttgtagcgctgcgcgggctgcaggtaggtgtagatggccgagccgtagaacaggcagacggctgtcaggtgggacccacacgtgcccacc

SEQ ID NO: 32839 - DNA, 201 bp, Homo sapiens
cttgctcctgctctggattctctggatttgaaatggagttgggagtatttaataaaagatgcaattgcatagctgtgttgatttctggaatggatgcctgrgatcagagccaggtatttcaggaagaagatgaggggtgggtgtcattgtgcttgtaaatagaggaataaaaagaacgggtaagaaagaacctacatttgt

SEQ ID NO: 32840 - DNA, 201 bp, Homo sapiens
tgcgacataggcgcggggagacgagccccgcatagcgcagcgggcggcacactgcggccgcgcggtccagagccatcaccgccaggaggacgcattcggcsgaacccagagccagcgatgcgcacagctgggccgtgcagtggctgcgcggcagccagagcgctggtccgcgcaggttggccagcagcggcggcaccacgc

SEQ ID NO: 32841 - DNA, 201 bp, Homo sapiens
agaaagagagggacactggctactgaataggagctagaggaccagatagatagtggaagagggggagccattgtggtggggagtagaagtgtaaaggaggmaggcatcctaggtaactgtcttgtggctttcacttcccaggtgcatgtccgttccgaggaatgggatttaatgacctttgatgccaacccatatgacagc

SEQ ID NO: 32842 - DNA, 201 bp, Homo sapiens
gcaacgccggcagctcacagatgaagtggtccagcaggcggggcgcgcacagcggccgctcagccaggagcgcggtttgcgcaaccgagttggtgaggccrcttagccaggaggcgctggccagcgtgcgacataggcgcggggagacgagccccgcatagcgcagcgggcggcacactgcggccgcgcggtccagagcca

SEQ ID NO: 32843 - DNA, 201 bp, Homo sapiens
ggaaaatcactaattacattttgagatggataaaggtatgttttttacatccattgaaatgcacagaaaaacgaaatgtaaagattgtcaactaaaaaaaatcacacaattcataaatttagaaggggagtttatttcttatgaaaggttatagtctgcaaggtagccattctgacaggctgggaagttttgcttctgatt

SEQ ID NO: 32844 - DNA, 201 bp, Homo sapiens
tcactggttcagaagcacagcggacaccctgccagatccgagggatggaagtcagccgcgggtctgcgacggtggcaaacggcagtggtggatggcaagcraaagctcacctcgagccgtaagaaacatagaccagaagagtgcagttgcaagatttagtagagtgaagacagagctcccatacaaagggaggggacccaa

SEQ ID NO: 32845 - DNA, 201 bp, Homo sapiens
tcaggagcggcaatgggcgcctcactggttcagaagcacagcggacaccctgccagatccgagggatggaagtcagccgcgggtctgcgacggtggcaaayggcagtggtggatggcaagcgaaagctcacctcgagccgtaagaaacatagaccagaagagtgcagttgcaagatttagtagagtgaagacagagctccc

SEQ ID NO: 32846 - DNA, 201 bp, Homo sapiens
gacctggggttcttggcctcatggattccaaggaatggaatcttgggtcatgtggtggttgttacagctctattagaagccatgggtcacggaagagaacygtggacccagtgactagtgttcagctcgattaggaagaacctgggcacttagccgtgcagaacaatggtacgcctttagcccaatcaggagcggcaatgg

SEQ ID NO: 32847 - DNA, 201 bp, Homo sapiens
ttggtctcttgctcctgctctggattctctggatttgaaatggagttgggagtatttaataaaagatgcaattgcatagctgtgttgatttctggaatggrtgcctgagatcagagccaggtatttcaggaagaagatgaggggtgggtgtcattgtgcttgtaaatagaggaataaaaagaacgggtaagaaagaaccta

SEQ ID NO: 32848 - DNA, 201 bp, Homo sapiens
gcaggtaggtgtagatggccgagccgtagaacaggcagacggctgtcaggtgggacccacacgtgcccaccgccctcctccggcctccgctgaaccgcatrcaacagacagctcgggccacggcaccgtaggaggccaggatgacggcaaacggcagcagcaggatgaccacgcgggcggcgaacatctggttctcggtag

SEQ ID NO: 32849 - DNA, 201 bp, Homo sapiens
aaatggagttgggagtatttaataaaagatgcaattgcatagctgtgttgatttctggaatggatgcctgagatcagagccaggtatttcaggaagaagaygaggggtgggtgtcattgtgcttgtaaatagaggaataaaaagaacgggtaagaaagaacctacatttgtgaaatttcaggatctaggcagaggtggtga

SEQ ID NO: 32850 - DNA, 201 bp, Homo sapiens
tgcccagcctggcctctccccagactccgcagcagcctcctcgctgcccccttcactttcttattcctgagggtgtagatgagcgggttgagagcaggtgwgaccacggtgtagaagagcgatacgaacttgccccgtgcctggttgtagcgctgcgcgggctgcaggtaggtgtagatggccgagccgtagaacaggcag

SEQ ID NO: 32851 - DNA, 201 bp, Homo sapiens
agtgccatctccactcactgcaacctctgcctcctggattcaaatgattctcctgcctcagcctcctgagtagctgggattacagggacttgccaccactmctggctaatttttgtatttttagtagagacagagtttcaccaagttcaccaggctggtctcgaactcccagcatcaattgatcagcctgcctcagcttcc

SEQ ID NO: 32852 - DNA, 201 bp, Homo sapiens
tagtgccatctccactcactgcaacctctgcctcctggattcaaatgattctcctgcctcagcctcctgagtagctgggattacagggacttgccaccackactggctaatttttgtatttttagtagagacagagtttcaccaagttcaccaggctggtctcgaactcccagcatcaattgatcagcctgcctcagcttc

SEQ ID NO: 32853 - DNA, 201 bp, Homo sapiens
accacgctagtagtgaagcccgcgtctaccaaggccaggtggcagaggaagtagtacatgggcgtgtgcaggcgcgggtcgcgcaccgccagcagcaccarcgccgagttgcccgtcaaggtcaggaggtagcacaggaggacaagggcgaagaggaccggctgcagggaaggccagtcggagaaacccagcaggagaaag

SEQ ID NO: 32854 - DNA, 201 bp, Homo sapiens; identical to SEQ ID NO: 8505

SEQ ID NO: 32855 - DNA, 201 bp, Homo sapiens
cttattgccacaaagaatccattctctcagtcttataatctctaactttgctggtcagttgtgtctaaactgcaaaagggagaagatacaatgaggcatatccaacctcctgttccatcatgactgaatgttttatttatttatatttttgagacagagtctcactctgttgccctggctggagtgcagtagtgccatctc

SEQ ID NO: 32856 - DNA, 201 bp, Homo sapiens
cccagagccagcgatgcgcacagctgggccgtgcagtggctgcgcggcagccagagcgctggtccgcgcaggttggccagcagcggcggcaccacgctagkagtgaagcccgcgtctaccaaggccaggtggcagaggaagtagtacatgggcgtgtgcaggcgcgggtcgcgcaccgccagcagcaccagcgccgagttg

SEQ ID NO: 32857 - DNA, 201 bp, Homo sapiens
atcttattgccacaaagaatccattctctcagtcttataatctctaactttgctggtcagttgtgtctaaactgcaaaagggagaagatacaatgaggcatatccaacctcctgttccatcatgactgaatgttttatttatttatatttttgagacagagtctcactctgttgccctggctggagtgcagtagtgccatc

SEQ ID NO: 32858 - DNA, 201 bp, Homo sapiens
catagcgcagcgggcggcacactgcggccgcgcggtccagagccatcaccgccaggaggacgcattcggcggaacccagagccagcgatgcgcacagctgsgccgtgcagtggctgcgcggcagccagagcgctggtccgcgcaggttggccagcagcggcggcaccacgctagtagtgaagcccgcgtctaccaaggcca

SEQ ID NO: 32859 - DNA, 201 bp, Homo sapiens; identical to SEQ ID NO: 8507

SEQ ID NO: 32860 - DNA, 201 bp, Homo sapiens
caggatgaccacgcgggcggcgaacatctggttctcggtagtgtctccgtcgcctccgcaggccagcttgagcaacgccggcagctcacagatgaagtggyccagcaggcggggcgcgcacagcggccgctcagccaggagcgcggtttgcgcaaccgagttggtgaggccgcttagccaggaggcgctggccagcgtgcg

SEQ ID NO: 32861 - DNA, 201 bp, Homo sapiens; identical to SEQ ID NO: 8509

SEQ ID NO: 32862 - DNA, 201 bp, Homo sapiens
acggcaccgtaggaggccaggatgacggcaaacggcagcagcaggatgaccacgcgggcggcgaacatctggttctcggtagtgtctccgtcgcctccgcrggccagcttgagcaacgccggcagctcacagatgaagtggtccagcaggcggggcgcgcacagcggccgctcagccaggagcgcggtttgcgcaaccgag

SEQ ID NO: 32863 - DNA, 201 bp, Homo sapiens
attatataagaaaatatgcactatggagagaacctggaattaaggcaatgcttaacacagatcttccagtgaagaaatgtctgcaatatctagattgggaraatatttctgaatggagtatgagggaggtcttctcaggctttcaagtggccattaggggtgagttttcccatcttttaggattttccagctattgaagta

SEQ ID NO: 32864 - DNA, 201 bp, Homo sapiens
gatggccgagccgtagaacaggcagacggctgtcaggtgggacccacacgtgcccaccgccctcctccggcctccgctgaaccgcatgcaacagacagctygggccacggcaccgtaggaggccaggatgacggcaaacggcagcagcaggatgaccacgcgggcggcgaacatctggttctcggtagtgtctccgtcgcc

SEQ ID NO: 32865 - DNA, 201 bp, Homo sapiens; identical to SEQ ID NO: 8503

SEQ ID NO: 32866 - DNA, 201 bp, Homo sapiens; identical to SEQ ID NO: 8504

SEQ ID NO: 32867 - DNA, 201 bp, Homo sapiens; identical to SEQ ID NO: 8506

SEQ ID NO: 32868 - DNA, 201 bp, Homo sapiens
ctggataggagaggcaggtaaataaggtggaaaatcactaattacattttgagatggataaaggtatgttttttacatccattgaaatgcacagaaaaacraaatgtaaagattgtcaactaaaaaaaatcacacaattcataaatttagaaggggagtttatttcttatgaaaggttatagtctgcaaggtagccattct

SEQ ID NO: 32869 - DNA, 201 bp, Homo sapiens
gcagttgcaagatttagtagagtgaagacagagctcccatacaaagggaggggacccaaagagggtagcgttgctggctcgaatgcctgtgtttatatccygatcattgtccctcccgctgtgatctcaggcaatagatgattggctatatctttacctcctgtttttgcctaattagcattttagtgagctctctttact

SEQ ID NO: 32870 - DNA, 201 bp, Homo sapiens; identical to SEQ ID NO: 8508

SEQ ID NO: 32871 - DNA, 201 bp, Homo sapiens
aagctcacctcgagccgtaagaaacatagaccagaagagtgcagttgcaagatttagtagagtgaagacagagctcccatacaaagggaggggacccaaaragggtagcgttgctggctcgaatgcctgtgtttatatcccgatcattgtccctcccgctgtgatctcaggcaatagatgattggctatatctttacctcc

SEQ ID NO: 32872 - DNA, 201 bp, Homo sapiens; identical to SEQ ID NO: 8510

SEQ ID NO: 32873 - DNA, 201 bp, Homo sapiens; identical to SEQ ID NO: 8511

SEQ ID NO: 32874 - DNA, 201 bp, Homo sapiens
aagaagtgtgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttcttttttt

SEQ ID NO: 32875 - DNA, 201 bp, Homo sapiens; identical to SEQ ID NO: 8513

SEQ ID NO: 32876 - DNA, 201 bp, Homo sapiens; identical to SEQ ID NO: 8514

SEQ ID NO: 32877 - DNA, 201 bp, Homo sapiens
caagaagtgtgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttt

SEQ ID NO: 32878 - DNA, 201 bp, Homo sapiens; identical to SEQ ID NO: 8515

SEQ ID NO: 32879 - DNA, 201 bp, Homo sapiens
gagacaagaagtgtgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctt

SEQ ID NO: 32880 - DNA, 201 bp, Homo sapiens; identical to SEQ ID NO: 8516

SEQ ID NO: 32881 - DNA, 201 bp, Homo sapiens
agagacaagaagtgtgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttct

SEQ ID NO: 32882 - DNA, 201 bp, Homo sapiens; identical to SEQ ID NO: 8517

SEQ ID NO: 32883 - DNA, 201 bp, Homo sapiens
aagggcagagacaagaagtgtgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttcttt

SEQ ID NO: 32884 - DNA, 201 bp, Homo sapiens; identical to SEQ ID NO: 8518

SEQ ID NO: 32885 - DNA, 201 bp, Homo sapiens
ttgctgggattacagatgtgtgccactatgcccagctattttctttttgtatttttagtagagacagggtttcaccatgttgaccaggctgatctcgaacycctgacctcagatgatctgcctacctcagcctcccaaaatgctgggattacaggtgtgagccactgtgcctgtcctccggaatttttcatttaatatttt

SEQ ID NO: 32886 - DNA, 201 bp, Homo sapiens
tttttgagacggagtctcgctctatgtcccaggctggagtgcagtggcgcagtcttggctcatggcaacgtccacctccagggttcaagtgattctcctgyctcagcctcctgagttgctgggattacagatgtgtgccactatgcccagctattttctttttgtatttttagtagagacagggtttcaccatgttgacca

SEQ ID NO: 32887 - DNA, 201 bp, Homo sapiens
ggtgagccaagggtgaccagggccctgaactcggtggcccagctttgagggaagcaaaattgttctcaattgtggaagaggagaatttggacagcagaacraaaaaggaagacagcctcttggagcagatacatttgtcacaggaagccacatcaaaccctggggcctttgctgggcctctccatctgcccagttactggg

SEQ ID NO: 32888 - DNA, 201 bp, Homo sapiens
cattccctgaccaaataaggaagctgtttcttaccctccctcttgctgatatgttttgtttttctctgacctcaggtttctagaagcagggtagaacagasggcagacacctagcccaggctggtgttgttactaaacaatggcagctggtgagccaagggtgaccagggccctgaactcggtggcccagctttgagggaa

SEQ ID NO: 32889 - DNA, 201 bp, Homo sapiens
gattcacatcctgggcaggccagagagaaaaggtacaagatttcatcacactactcagaatgtcaagcaatttaaaacttaggaattgtttatctctggakttttttttgagacggagtctcgctctatgtcccaggctggagtgcagtggcgcagtcttggctcatggcaacgtccacctccagggttcaagtgattctc

SEQ ID NO: 32890 - DNA, 201 bp, Homo sapiens
tttacctttttattttatggcttctctttgcatatctgaatttccagcgtctctactcttgtgcttttgggtcattattaagtaaaataaggcattcttgrgcacaggcaactgctatactacagtagtcaacctgataactgagatggctagctactaaggaactaatgggcaggtattgtctgcagtgtggatatgcta

SEQ ID NO: 32891 - DNA, 201 bp, Homo sapiens
actatggttttctttttctatacatacataataatgataaagtttaatttacaaattaggcatggtaagagattgacaacaataactagtaataagatagaacaattacagcaatatattgtaataaaagttgtatgaatgtggtatctctctcaaaataatttatattgtaaatcttagcaacctcagcatatgattatt

SEQ ID NO: 32892 - DNA, 201 bp, Homo sapiens
ggggagtccagctggctctcagggtgctcactaccctcatctgggggcctggaggacgtcaattcctgagaacgccacgttctagtgagtagaatgaactragagatacacagcaaagctccacatacttttccttttctttgtgcccgcagtgttcttcatcagtgtgctctcgcttttcagctactactgttggctggc

SEQ ID NO: 32893 - DNA, 201 bp, Homo sapiens
tattcagcatatgccatgccccctggtaaccctggttcttatttttttaaacttgtacaaatattttaagcaaacacagaagtagacagaagagtaaagtraccttcactgtacccttcactcagtaacacccactcttgatttatctacatcctcaaccatagcccaacaccaggttattttcaactaaatcctagacaa

SEQ ID NO: 32894 - DNA, 201 bp, Homo sapiens
tacatatcagcacacacatcttacgtctcattagcatcttaacttccctctcagagttgtgtttgctactattgtaatgagcataggtcagcccaaggacrctattcatgggtttctgggcttcctcagatgtggggatgcctcccttggctcttctacctctttgctgcaggatgttctaaccacaagcccaggatatgg

SEQ ID NO: 32895 - DNA, 201 bp, Homo sapiens
ctccagacctgctctcctcccacagtacattcttgagtctttttaaacagttgtgaaaatgccacagatgcaagcacctgtgggccactcccatggggacygttgcacaaggcagtgccactcattctcagaacctcctaccatgggctatgcttagtgacccgaggccaagccaaggaagacgccagccacagggtgcca

SEQ ID NO: 32896 - DNA, 201 bp, Homo sapiens
cttgaacccgggaggcggaggttgcggtgagccgagatcatgccattgcactctagcctgggcaacaagagcaaaactctgtatcgaaaaaaaaaaaaaargaaaagaaaagaattgtttcaaaggactttttaaaaactccacaagaaatcttttctagggagtggggagggatagcattaggagatatatctaatgtta

SEQ ID NO: 32897 - DNA, 201 bp, Homo sapiens
cactatggttttctttttctatacatacataataatgataaagtttaatttacaaattaggcatggtaagagattgacaacaataactagtaataagatagaacaattacagcaatatattgtaataaaagttgtatgaatgtggtatctctctcaaaataatttatattgtaaatcttagcaacctcagcatatgattat

SEQ ID NO: 32898 - DNA, 201 bp, Homo sapiens
acactatggttttctttttctatacatacataataatgataaagtttaatttacaaattaggcatggtaagagattgacaacaataactagtaataagatagaacaattacagcaatatattgtaataaaagttgtatgaatgtggtatctctctcaaaataatttatattgtaaatcttagcaacctcagcatatgatta

SEQ ID NO: 32899 - DNA, 201 bp, Homo sapiens
tacactatggttttctttttctatacatacataataatgataaagtttaatttacaaattaggcatggtaagagattgacaacaataactagtaataagatagaacaattacagcaatatattgtaataaaagttgtatgaatgtggtatctctctcaaaataatttatattgtaaatcttagcaacctcagcatatgatt

SEQ ID NO: 32900 - DNA, 201 bp, Homo sapiens
tgctcttgggttgttagcagtattcttcacaaagatctgtatatacagtggttccccttatccacaggtgatatgttccaagagctctagtggatactttgtttttgttgttgtttgaggcagaatctcgctctgtcacccaggctggagtacagtggcacagtcttggctcactgcaaccttcacctcacgggttcaagt

SEQ ID NO: 32901 - DNA, 201 bp, Homo sapiens
gccagagaactggaaggccaggttcttgagggcactgttactaaggcgtttttttttttgtttgtttgtttgtttgtttttgagacggagtttcactctcrtttccctggctggagtgcaatggcgcgatctccgctcaccgcaacctctgcctcccgggttcaagcgattctcctgcctcagcctccctagtagctacga

SEQ ID NO: 32902 - DNA, 201 bp, Homo sapiens
atgggtgcagcacaccaacatggcacatgtatacatatgtaactaaccggcatgttgtgcatatgtaccctaaaacttacagtataattaaaaaaaaaaaagaaaaaagaaagaaatcttttctagccgggcgcggtggctcacgcctgtaatcccagcactttgggaggctgaggcaggcagatcatgaggtcaggagtt

SEQ ID NO: 32903 - DNA, 201 bp, Homo sapiens
aatgatgagttatgggtgcagcacaccaacatggcacatgtatacatatgtaactaaccggcatgttgtgcatatgtaccctaaaacttacagtataattwaaaaaaaaaaagaaaaaagaaagaaatcttttctagccgggcgcggtggctcacgcctgtaatcccagcactttgggaggctgaggcaggcagatcatga

SEQ ID NO: 32904 - DNA, 201 bp, Homo sapiens
tactagggaggctgaggcaggagaatcgcttgaacccgggaggcggaggttgcggtgagccgagatcatgccattgcactctagcctgggcaacaagagcraaactctgtatcgaaaaaaaaaaaaaaggaaaagaaaagaattgtttcaaaggactttttaaaaactccacaagaaatcttttctagggagtggggaggg

SEQ ID NO: 32905 - DNA, 201 bp, Homo sapiens
cactttgggaggccgaggtgggtggatcacctgaggtcgggagttcgagaacagcctgaccaacatggagaaaccccatctctactaaaaatacaaaattwgccaagcatggtggtgcatgcctgtaatcccagctactagggaggctgaggcaggagaatcgcttgaacccgggaggcggaggttgcggtgagccgagat

SEQ ID NO: 32906 - DNA, 201 bp, Homo sapiens
tgagccactgtgcctgtcctccggaatttttcatttaatatttttgaaccatggttgaccatgggtaactgaagcattggaaagcaaaaccatgataaagkggaactactacatgtattgaaaatccagatcacagaattgtgtgtgtgtgtgtgtgtgtgtgtgtgtataattttggtcatggaagagatcttagagagt

SEQ ID NO: 32907 - DNA, 201 bp, Homo sapiens
aaaatgctgggattacaggtgtgagccactgtgcctgtcctccggaatttttcatttaatatttttgaaccatggttgaccatgggtaactgaagcattgraaagcaaaaccatgataaaggggaactactacatgtattgaaaatccagatcacagaattgtgtgtgtgtgtgtgtgtgtgtgtgtgtataattttggtc

SEQ ID NO: 32908 - DNA, 201 bp, Homo sapiens
actcagaatgtcaagcaatttaaaacttaggaattgtttatctctggatttttttttgagacggagtctcgctctatgtcccaggctggagtgcagtggcrcagtcttggctcatggcaacgtccacctccagggttcaagtgattctcctgcctcagcctcctgagttgctgggattacagatgtgtgccactatgccca

SEQ ID NO: 32909 - DNA, 201 bp, Homo sapiens
cctgggaggtggaggttgcagtgagccaagatcacaccattgcacgctagcctaggtgaagaagcgagactctgtctcaaaaaaaaaaaaaaaaaaaaaaaaggccaggaaggcatgaaggagaggaacgtcatgcttacatgtttgaagtaagaattgttaagttgggcgtggtagctcatgcctgtaatcccagcactt

SEQ ID NO: 32910 - DNA, 201 bp, Homo sapiens
acctgggaggtggaggttgcagtgagccaagatcacaccattgcacgctagcctaggtgaagaagcgagactctgtctcaaaaaaaaaaaaaaaaaaaaaaaaggccaggaaggcatgaaggagaggaacgtcatgcttacatgtttgaagtaagaattgttaagttgggcgtggtagctcatgcctgtaatcccagcact

SEQ ID NO: 32911 - DNA, 201 bp, Homo sapiens
aacctgggaggtggaggttgcagtgagccaagatcacaccattgcacgctagcctaggtgaagaagcgagactctgtctcaaaaaaaaaaaaaaaaaaaaaaaaggccaggaaggcatgaaggagaggaacgtcatgcttacatgtttgaagtaagaattgttaagttgggcgtggtagctcatgcctgtaatcccagcac

SEQ ID NO: 32912 - DNA, 201 bp, Homo sapiens; identical to SEQ ID NO: 8512

SEQ ID NO: 32913 - DNA, 201 bp, Homo sapiens
gaacctgggaggtggaggttgcagtgagccaagatcacaccattgcacgctagcctaggtgaagaagcgagactctgtctcaaaaaaaaaaaaaaaaaaaaaaaaggccaggaaggcatgaaggagaggaacgtcatgcttacatgtttgaagtaagaattgttaagttgggcgtggtagctcatgcctgtaatcccagca

SEQ ID NO: 32914 - DNA, 201 bp, Homo sapiens
ctctcttccttccatggttttatctttctcttaggttttaattctctgaatcttgagactggatgttaatcttgtacacacacacacacacacacacatayatatttatataaacttcttgagtctctcctgttcttccagaagccagtcacctttgaggatgtggcagtgaatttcacccaggaagagtgggactgtcta

SEQ ID NO: 32915 - DNA, 201 bp, Homo sapiens
ctactggggaggctgaggcacgagaattgcttgaacctgggaggtggaggttgcagtgagccaagatcacaccattgcacgctagcctaggtgaagaagcragactctgtctcaaaaaaaaaaaaaaaaaaaaaaaaggccaggaaggcatgaaggagaggaacgtcatgcttacatgtttgaagtaagaattgttaagtt

SEQ ID NO: 32916 - DNA, 201 bp, Homo sapiens
ttctctcttccttccatggttttatctttctcttaggttttaattctctgaatcttgagactggatgttaatcttgtacacacacacacacacacacacayatatatttatataaacttcttgagtctctcctgttcttccagaagccagtcacctttgaggatgtggcagtgaatttcacccaggaagagtgggactgtc

SEQ ID NO: 32917 - DNA, 201 bp, Homo sapiens
tggcctacatagtgaaacccccatctctactaaaagtacaaaaattagtcggacgtgctggcatgtggttgtaatcccagctactggggaggctgaggcaygagaattgcttgaacctgggaggtggaggttgcagtgagccaagatcacaccattgcacgctagcctaggtgaagaagcgagactctgtctcaaaaaaaa

SEQ ID NO: 32918 - DNA, 201 bp, Homo sapiens
tgtaattttctgcggaaaaattgcagatactaggatgaaataacttttgtcagacccagataaaatagggccaggccaggcacggtggcttacgcttgtartcccagcactttgggaggccgaggcgagcggatcacctgaggtcaggagttcgagaccagcctggcctacatagtgaaacccccatctctactaaaagta

SEQ ID NO: 32919 - DNA, 201 bp, Homo sapiens
acaatggggagctgagtgtgacatatgtgagaactatgtattatcttttcaacttttgtgtaatctaaaagtattctaaaattaataagtttattaaaaamaaacaacaacaacaaccctcagaagaggaaaggaatagggagttaaagaaaaaacagtatactttttagttttcccagggtttcctatcaaggggctggg

SEQ ID NO: 32920 - DNA, 201 bp, Homo sapiens
tgaatttccagcgtctctactcttgtgcttttgggtcattattaagtaaaataaggcattcttgagcacaggcaactgctatactacagtagtcaacctgrtaactgagatggctagctactaaggaactaatgggcaggtattgtctgcagtgtggatatgctagtcaaagggatgattcacatcctgggcaggccagag

SEQ ID NO: 32921 - DNA, 201 bp, Homo sapiens
atttctctcttccttccatggttttatctttctcttaggttttaattctctgaatcttgagactggatgttaatcttgtacacacacacacacacacacayatatatatttatataaacttcttgagtctctcctgttcttccagaagccagtcacctttgaggatgtggcagtgaatttcacccaggaagagtgggactg

SEQ ID NO: 32922 - DNA, 201 bp, Homo sapiens
tcgccatattggccacgctgaggtcgaacttctgacctcaggtgatccgccccctcagcctcccaaagtgctgggattacaggtgtgagccaccgctctcrgccgcgtgttttaatcataatactttggtctttttttttttttttcgtaaatactttcctcttttttttttttttttttttttttgagatggagtttcac

SEQ ID NO: 32923 - DNA, 201 bp, Homo sapiens
cgtggctggagtagcagggttggtgacgacaagggtgaatcccactaagcattgcaactgtttgcggtgtgaggggtgagggggattctcatcattctcasaattgctgtggataaagggttttgggttggagagagactgggtgcactcaaaggactgaaagatggcgacgacacattccctcagaggatttacattctg

SEQ ID NO: 32924 - DNA, 201 bp, Homo sapiens
gccctgagcagagaccaaagggccgtgcgactgcaggaaggccattttgcttggctgacaggcggaaaactcacgtggctggagtagcagggttggtgacracaagggtgaatcccactaagcattgcaactgtttgcggtgtgaggggtgagggggattctcatcattctcagaattgctgtggataaagggttttgggt

SEQ ID NO: 32925 - DNA, 201 bp, Homo sapiens
tagaagcagggtagaacagacggcagacacctagcccaggctggtgttgttactaaacaatggcagctggtgagccaagggtgaccagggccctgaactckgtggcccagctttgagggaagcaaaattgttctcaattgtggaagaggagaatttggacagcagaacaaaaaaggaagacagcctcttggagcagataca

SEQ ID NO: 32926 - DNA, 201 bp, Homo sapiens
aattagccgggtgtggtggtgtgagcctataatcccaactacctgggaggctgaggcaggagaatggcttgaacctgggaagtggaggttgtggtgagccraggtcacaccactgcactccagcctgggtgacagaatgagagtccatttcaaaaaaaaaaaaaaaaaaaaaatgaagaacttttttttttcttttccgta

SEQ ID NO: 32927 - DNA, 201 bp, Homo sapiens
gcggagcttgcagtgagccgagatcgtgccactgcactccagcctggctgacagagcgagattctgtctcaaaaaaaaaaaaagaaaagaaaagaaaaaaagaaaaacaagcaaagagtggtgatgaaatttgaaagaagggactaggccgggcgaggtggctcacgactaatcccagcgctttgggaggctgagacaggc

SEQ ID NO: 32928 - DNA, 201 bp, Homo sapiens
atcgcttcaacctgggaggcggagcttgcagtgagccgagatcgtgccactgcactccagcctggctgacagagcgagattctgtctcaaaaaaaaaaaaagaaaagaaaagaaaaaaagaaaaacaagcaaagagtggtgatgaaatttgaaagaagggactaggccgggcgaggtggctcacgactaatcccagcgctt

SEQ ID NO: 32929 - DNA, 201 bp, Homo sapiens
ttgccaggcgacagtgagcaaaaccggctttgttcccggccaccggaagcttcgaggctggggttccggatctgggcgcccaatgacaaactaagcgcggrggacagggccaggagcgcccaccagggcggcgatctggtgggtaggtgcagggcaatggctggaaagggtccccgaagccctgagcagagaccaaagggc

SEQ ID NO: 32930 - DNA, 201 bp, Homo sapiens
gggtgctaacaagcgcctgctttgccaggcgacagtgagcaaaaccggctttgttcccggccaccggaagcttcgaggctggggttccggatctgggcgcscaatgacaaactaagcgcggaggacagggccaggagcgcccaccagggcggcgatctggtgggtaggtgcagggcaatggctggaaagggtccccgaagc

SEQ ID NO: 32931 - DNA, 201 bp, Homo sapiens
acgtgttgaaaaagtcggcatcccagaaggaagattctgggcggatgggcatcggggaaggtagtcccaaccaatgggaccgtttctgagcacataagcgyattcagtgggtgctaacaagcgcctgctttgccaggcgacagtgagcaaaaccggctttgttcccggccaccggaagcttcgaggctggggttccggatc

SEQ ID NO: 32932 - DNA, 201 bp, Homo sapiens
aggtgccctgtccactgtgggcactctggggattccgggccgaggaagggctcctggcacgtgttgaaaaagtcggcatcccagaaggaagattctgggcrgatgggcatcggggaaggtagtcccaaccaatgggaccgtttctgagcacataagcgcattcagtgggtgctaacaagcgcctgctttgccaggcgacag

SEQ ID NO: 32933 - DNA, 201 bp, Homo sapiens
aatctttctgcataagccagagctaatcaccaagcttgagcaagaagaggaacagtggagagagtttgtccatctcccaaacacagaaggcctttcaggtragaattgccaagcagggaggaaggggaaaagggcccaggataacccctgaaaggatggagagctgatgaagaggatgaatgctctatagatgctctccta

SEQ ID NO: 32934 - DNA, 201 bp, Homo sapiens
gatcacctgaggtcaggagttcgagaccagcctggcctacatagtgaaacccccatctctactaaaagtacaaaaattagtcggacgtgctggcatgtggytgtaatcccagctactggggaggctgaggcacgagaattgcttgaacctgggaggtggaggttgcagtgagccaagatcacaccattgcacgctagccta

SEQ ID NO: 32935 - DNA, 201 bp, Homo sapiens
tgcattttcaggaaaattgttacacatcagaaaatctgtcaggaaatatttgagactccatcacaatcattgccccttaaacacacccatcaagacgactrttcttcctcctttagagagtaaaatgaaccttcagtacattgagttttgtggaattcttacctatttactctgaagtttctatttactacttacatacct

SEQ ID NO: 32936 - DNA, 201 bp, Homo sapiens
accagcctgaccaacatggagaaaccccctctctactgaaaatacaaattaggcaggcgtggtggtgcatgcctgtaatcccagctactcggaaggctgargcaggagaatcgcttgacttgaacccaggaggcagaggttgtggtgggccaagatcgggccattgcactccagcctgggcaacaagagcgaaactctgtc

SEQ ID NO: 32937 - DNA, 201 bp, Homo sapiens
tgcgtctctgtaattttctgcggaaaaattgcagatactaggatgaaataacttttgtcagacccagataaaatagggccaggccaggcacggtggcttaygcttgtaatcccagcactttgggaggccgaggcgagcggatcacctgaggtcaggagttcgagaccagcctggcctacatagtgaaacccccatctctac

SEQ ID NO: 32938 - DNA, 201 bp, Homo sapiens
tagcctgggcaacaagagccagactccttctcaaaaaaaaaaaaaaaaaaaaaaaaaaaaaaaaaaaaaaaaaaaattgcggccgggcgcggtgactcacrcctgtaatcctagctctttgggaggctgaggtgggcggatcacgagatcaggagttagagaccagcctggccagtatggagaaactccacctctattaaa

SEQ ID NO: 32939 - DNA, 201 bp, Homo sapiens
ttgggctcgcagactgcagaaggtgctgatctgtaaggcagcacagttgttgccattctttcttaacaagcattgacatgctacctccttataccctcaasgtctcaactcccagatgatccagctaaagtgtaatgatttgtttggctctgccaatagctattgttaatttccctcctttcacattcactgtgcgtctct

SEQ ID NO: 32940 - DNA, 201 bp, Homo sapiens
agaaaagagaattaaaatatgaacaaagccttcaggaagtatggggttatgtaaaacatctgtacccatgaatcataggtattcctaagggagaatgaagkgtaaaaagtgtggaaaatctacttgaggaaataattgaggaaaacttccctaaccctggctacagatttaaaatccagatagaagatacttagagaactc

SEQ ID NO: 32941 - DNA, 201 bp, Homo sapiens
gctgggcatggtggcgcgcacctgtaatcctagctactcaggaggctgaggcaggagaatggcttgaaacccggaggcagaggttgcagtgagccgaaatygtgccactgcacttcagcctgggcgacagagtgagactccctcaaaaaaaaaaaaaatatgttaacaatggggagctgagtgtgacatatgtgagaacta

SEQ ID NO: 32942 - DNA, 201 bp, Homo sapiens
aattgcttgaacctgggaggtggaggttgcggtgagctgagatcacgccattgcactccagcctgggcaacaagagcaaaactccatctcaaaaaaaaaaagaaaaagaaaagctatgtgtttggggttgagggaggatgctctgcaccaaagacatttaaatggtgagctgaggagaagacatctttaatgagtctcaac

SEQ ID NO: 32943 - DNA, 201 bp, Homo sapiens
tgtaacaacttctaaattgaaagggcattagtaagtgtggatacagaataaatgctgaaaatcagtgctttattcaaagtagcgatagagtctcccaggtrtcaatagagaggtgggccagggacttttcccagtgaccagaaacaagagcctcagggagatgaggatgtctcacagccagggacgggacagtgaagggca

SEQ ID NO: 32944 - DNA, 201 bp, Homo sapiens
aaaatatgcaaatttttccattcatcaaacaaatatttactaagtcactcctgagaaccaggtactttgctagcagctggccttttaatgtctcctttccrcatctacatgtcccaggttatggttcttaaacaaaggctacaggaggtagcctgttgtccccatcagatgtgaaggggccatacctgggaccaactcaac

SEQ ID NO: 32945 - DNA, 201 bp, Homo sapiens
ttaaacaattgcctttgttcatataaacaataaaaagttaaaatttttgtgaggcgataacctcatatataatagaaacaaaaaggtttttaatgaaaaaattactaagaagtgtgcaaactttaaatgaaaacattaaaacacatctgaaatttaaaaattagatatgaacaaatcgggccgggtgcggtgtctcacgcc

SEQ ID NO: 32946 - DNA, 201 bp, Homo sapiens
caggtgtgaaagatctgagtcactaagctcagtggtaaagagaagaaatgatagcctgcatgaaggcaaagataacacttgtaacatgatgacagtgttcycaaaatatgcaaatttttccattcatcaaacaaatatttactaagtcactcctgagaaccaggtactttgctagcagctggccttttaatgtctcctttc

SEQ ID NO: 32947 - DNA, 201 bp, Homo sapiens
tgctatgttgcccaggttggtcttgaactcctggcctccagcaatcctccctcctcagcttcccaaagtgttagcattccaggagtgagccacgggggccyagcctagacattctttagtactatagtaattcagataagatgctcttgaaagaacacttgcccagtaacggcaatgtctcccaagtagctgggattacag

SEQ ID NO: 32948 - DNA, 201 bp, Homo sapiens
aagctgaaaagctatgtgcaggccaggcgcggtggctcacgcctgtaatcccagcactttgggaggccgaggtgggcggatcatctgaggtcaggagttcragaccagcctgaccaacatggagaaaccctgtctctactaaaactacaaaaacaattagccaggcgtggtggcgcatgcctgtaatcccaggtactcgag

SEQ ID NO: 32949 - DNA, 201 bp, Homo sapiens
ccagcactatcctgttgaacttcccagcctgcaaaatcatgagctaaataaacatcttctctttataaactacccagtttcaagttattctgttatagtartactcaacatactaagacagtcattgaaaacaaagtcaacctggaggagccttaaggagacatgattaggactaaatacaatgtgatatcctcgatgaaa

SEQ ID NO: 32950 - DNA, 201 bp, Homo sapiens
tttccaaggatgagcagggaactccagtgctgggctcattgtgagccctgaataagtgattgctcttgggttgttagcagtattcttcacaaagatctgtrtatacagtggttccccttatccacaggtgatatgttccaagagctctagtggatactttgtttttgttgttgtttgaggcagaatctcgctctgtcaccc

SEQ ID NO: 32951 - DNA, 201 bp, Homo sapiens
ctcatttccctggctggagtgcaatggcgcgatctccgctcaccgcaacctctgcctcccgggttcaagcgattctcctgcctcagcctccctagtagctrcgattacaggcatgcgccaccacgccgggataattttgtatttttagtagagacgaggtccatgttggtcaggctggtctcaaactcctgacctcaggtg

SEQ ID NO: 32952 - DNA, 201 bp, Homo sapiens
ctgctacttgaaataaacttgggggtgtggaagccaccttgcaaccaaccaaacacaggtgagaaaatgaatatgaagtgttctgggagaaagcagaaaascccattgccatcatgtttccttatttttacaattctcttaaacaacgtgcctaaggttataacccctcccgtttgtaacaacttctaaattgaaagggca

SEQ ID NO: 32953 - DNA, 201 bp, Homo sapiens
ccgaggtcacaccactgcactccagcctgggtgacagaatgagagtccatttcaaaaaaaaaaaaaaaaaaaaaatgaagaacttttttttttcttttccrtaagttcttggggtacaggtggtattcggttacacgagtaagttctttagtggtgatttgtgagatttcgatgcacttatcacccgagcagtatacactg

SEQ ID NO: 32954 - DNA, 201 bp, Homo sapiens
aggccaggttcttgagggcactgttactaaggcgtttttttttttgtttgtttgtttgtttgtttttgagacggagtttcactctcatttccctggctggwgtgcaatggcgcgatctccgctcaccgcaacctctgcctcccgggttcaagcgattctcctgcctcagcctccctagtagctacgattacaggcatgcgc

SEQ ID NO: 32955 - DNA, 201 bp, Homo sapiens
gccattgggacatttctagaaatccatccttttccagtaggacatgagtaaagtcagtgaggagcgaacctgcagtccacgggcacctccaggattgtggsaggagacgcacatgtctttctgatgtgtggagtcctgaggacagaggctgagaccctgcatttcccaaagtacttgttttctaagcaagtgtttctgcta

SEQ ID NO: 32956 - DNA, 201 bp, Homo sapiens
tgtggtggtgtgagcctataatcccaactacctgggaggctgaggcaggagaatggcttgaacctgggaagtggaggttgtggtgagccgaggtcacaccwctgcactccagcctgggtgacagaatgagagtccatttcaaaaaaaaaaaaaaaaaaaaaatgaagaacttttttttttcttttccgtaagttcttgggg

SEQ ID NO: 32957 - DNA, 201 bp, Homo sapiens
cttaaggaggctcctgcgtggaccgagtccttcctgagggtttgctggatgcccccggacactgtgcagctgtgtcctccggggtccctaaagctggcacrttctgctgtgtacccagaggtggggacagatgctgccagctccaccttacagctgctacatgaaatttgaggtcagagaattctcttgtctttaagggca

SEQ ID NO: 32958 - DNA, 201 bp, Homo sapiens
ggagtagcagggttggtgacgacaagggtgaatcccactaagcattgcaactgtttgcggtgtgaggggtgagggggattctcatcattctcagaattgcygtggataaagggttttgggttggagagagactgggtgcactcaaaggactgaaagatggcgacgacacattccctcagaggatttacattctggaagggt

SEQ ID NO: 32959 - DNA, 201 bp, Homo sapiens
tctaagacttcagggtttttcagggagaagttgcttaaggaggctcctgcgtggaccgagtccttcctgagggtttgctggatgcccccggacactgtgcrgctgtgtcctccggggtccctaaagctggcacgttctgctgtgtacccagaggtggggacagatgctgccagctccaccttacagctgctacatgaaatt

SEQ ID NO: 32960 - DNA, 201 bp, Homo sapiens
gcttctactaaaaatacaaaaattagccgggtgtggtggtgtgagcctataatcccaactacctgggaggctgaggcaggagaatggcttgaacctgggargtggaggttgtggtgagccgaggtcacaccactgcactccagcctgggtgacagaatgagagtccatttcaaaaaaaaaaaaaaaaaaaaaatgaagaac

SEQ ID NO: 32961 - DNA, 201 bp, Homo sapiens
tcttttctttatcagagacatgaatatcttttttctttatggatttctaagacttcagggtttttcagggagaagttgcttaaggaggctcctgcgtggaycgagtccttcctgagggtttgctggatgcccccggacactgtgcagctgtgtcctccggggtccctaaagctggcacgttctgctgtgtacccagaggtg

SEQ ID NO: 32962 - DNA, 201 bp, Homo sapiens
cccagcgctttgggaggctgagacaggcagatcacctgagatcaggaattcaagaccagcctggccaacgtggtgaaaacctgcctctattaaaaatacamaattagccgggtatggtggtgcgtgcctataaatcccagctacttgggaggctgaggcaggagaatcgcttgaacccaggaggcagaggttgcagtgagc

SEQ ID NO: 32963 - DNA, 201 bp, Homo sapiens
caacacttttgagacaagttcccacctctccattagacgtgtcttctccacatgcagaaaatgtggtctcgtagcttcccttctcagtgctggattgctgrcatttcttttctttatcagagacatgaatatcttttttctttatggatttctaagacttcagggtttttcagggagaagttgcttaaggaggctcctgcg

SEQ ID NO: 32964 - DNA, 201 bp, Homo sapiens
aaaaaagaaaaacaagcaaagagtggtgatgaaatttgaaagaagggactaggccgggcgaggtggctcacgactaatcccagcgctttgggaggctgagrcaggcagatcacctgagatcaggaattcaagaccagcctggccaacgtggtgaaaacctgcctctattaaaaatacaaaattagccgggtatggtggtgc

SEQ ID NO: 32965 - DNA, 201 bp, Homo sapiens
cgctggggcagcctcctggagatggcctcagaagggcttctgggagcttctttaaaacctgcactacaggcaccaatttccccagttatcccatccttaartgaaaaatcaaccacagagatgatttattgtaatagccttatttcagtacaagcagacgaaaagtgtttctcttcactggcccgttagttacaatgggga

SEQ ID NO: 32966 - DNA, 201 bp, Homo sapiens
aaaaaaaattgcggccgggcgcggtgactcacacctgtaatcctagctctttgggaggctgaggtgggcggatcacgagatcaggagttagagaccagccyggccagtatggagaaactccacctctattaaaaatacaaaaattagctgggcatggtggcacgcacctgtagtcccagctgctcaggaggctgaggcagg

SEQ ID NO: 32967 - DNA, 201 bp, Homo sapiens
gaagcgcaaggcctcatacccgctggggcagcctcctggagatggcctcagaagggcttctgggagcttctttaaaacctgcactacaggcaccaatttcyccagttatcccatccttaagtgaaaaatcaaccacagagatgatttattgtaatagccttatttcagtacaagcagacgaaaagtgtttctcttcactgg

SEQ ID NO: 32968 - DNA, 201 bp, Homo sapiens
acacacaggatggcagaagcgcaaggcctcatacccgctggggcagcctcctggagatggcctcagaagggcttctgggagcttctttaaaacctgcactrcaggcaccaatttccccagttatcccatccttaagtgaaaaatcaaccacagagatgatttattgtaatagccttatttcagtacaagcagacgaaaagt

SEQ ID NO: 32969 - DNA, 201 bp, Homo sapiens
gccaaaattccatcacagggacacacaggatggcagaagcgcaaggcctcatacccgctggggcagcctcctggagatggcctcagaagggcttctgggarcttctttaaaacctgcactacaggcaccaatttccccagttatcccatccttaagtgaaaaatcaaccacagagatgatttattgtaatagccttatttc

SEQ ID NO: 32970 - DNA, 201 bp, Homo sapiens
cagtggtgcaatcatagctcactgtaacctcaaactcctgagctcaagcaatcctcccacctcaacctcctaagcacctaggactaaaggcatgtaccacmacacctggccaagttgttttcattttttctagagaaagggtcttgctatgttgcccaggttggtcttgaactcctggcctccagcaatcctccctcctca

SEQ ID NO: 32971 - DNA, 201 bp, Homo sapiens
cattctttttttttgttctgtttagaaatagggcctcactccattgccaaggctggaatgcagtggtgcaatcatagctcactgtaacctcaaactcctgrgctcaagcaatcctcccacctcaacctcctaagcacctaggactaaaggcatgtaccaccacacctggccaagttgttttcattttttctagagaaaggg

SEQ ID NO: 32972 - DNA, 201 bp, Homo sapiens
tgcagggttcccagtggtctagccatcagggattgctgctcctaaggaaagggagactgcagtacacaaaaaaagtaccagttgggacaaaggaggccagrccatgtactcatctgtgtccaagagctccttgtttgtgggctgagtgactgcaccacttccagcagagtcgtggacactgtgttcagctctgcgctgaag

SEQ ID NO: 32973 - DNA, 201 bp, Homo sapiens
aataacaggaaaggcctacataaaagatatgcagcgaggaatagaggttccttttcctgtttccttcaggaaatttcccctagggcagacagagcaagagygatggacagaggaatgggagcaggacccagggggaggtctggtcatatgtgtgcctttctgcctccccgtctgtcattgtccttcctcaccaggcctgca

SEQ ID NO: 32974 - DNA, 201 bp, Homo sapiens
gggggaggaaaagcagaggcacgaaattgaaatgtcttctctgccatctgctggggatatgcttgaataacaggaaaggcctacataaaagatatgcagcsaggaatagaggttccttttcctgtttccttcaggaaatttcccctagggcagacagagcaagagcgatggacagaggaatgggagcaggacccaggggga

SEQ ID NO: 32975 - DNA, 201 bp, Homo sapiens
aaacacattatgaactgatattttcagttttgtttgcaagaaaatgattaataaggtgaaataattgaagtatcacggaagatacattaaaaaaaaaaaaagcctttgtacagtttgctggagccacagatgtcctactccagagcagaacaatgcctgaatcttcagggtccatttgtgccgcattcactagcaaccaca

SEQ ID NO: 32976 - DNA, 201 bp, Homo sapiens
gttttaactgaatgctcagcacctcttagattctcaataaaagaaagcagcagcccagagccaaggagcccagggaggcacatcatggtttgattttgtgrctgttttcagggcagtatctgtcatctctgaatggttacactggacatttctattcccacccttgcaatgggactccccagctcagagaaagggaaatta

SEQ ID NO: 32977 - DNA, 201 bp, Homo sapiens
aactgacaaaatatattttcaaatgcaattaaggcagaggacaatgcaggaacccttgagtcccgttttaactgaatgctcagcacctcttagattctcartaaaagaaagcagcagcccagagccaaggagcccagggaggcacatcatggtttgattttgtgactgttttcagggcagtatctgtcatctctgaatggt

SEQ ID NO: 32978 - DNA, 201 bp, Homo sapiens
cggaaaactcacgtggctggagtagcagggttggtgacgacaagggtgaatcccactaagcattgcaactgtttgcggtgtgaggggtgagggggattctyatcattctcagaattgctgtggataaagggttttgggttggagagagactgggtgcactcaaaggactgaaagatggcgacgacacattccctcagagga

SEQ ID NO: 32979 - DNA, 201 bp, Homo sapiens
ttcagcttctttaaaaagagaaacagagacgggcaggagaaggattgaactgacaaaatatattttcaaatgcaattaaggcagaggacaatgcaggaacycttgagtcccgttttaactgaatgctcagcacctcttagattctcaataaaagaaagcagcagcccagagccaaggagcccagggaggcacatcatggtt

SEQ ID NO: 32980 - DNA, 201 bp, Homo sapiens
ctgggccaaaattccatcacagggacacacaggatggcagaagcgcaaggcctcatacccgctggggcagcctcctggagatggcctcagaagggcttctrggagcttctttaaaacctgcactacaggcaccaatttccccagttatcccatccttaagtgaaaaatcaaccacagagatgatttattgtaatagcctta

SEQ ID NO: 32981 - DNA, 201 bp, Homo sapiens
agaaagtatgaagtgacccacctgaatttagaggagggaagtgaggaatttggagacatctaaaaacattttgtccctgtggtttgacttcaaattattatctatttttattggagatttgtttgaaattataaccggtatctcatgattattcagcatatgccatgccccctggtaaccctggttcttatttttttaaac

SEQ ID NO: 32982 - DNA, 201 bp, Homo sapiens
aaatggatggcattcctgcctggccaggtcatgaagctggggcagccctctcctcatctgtggagacctaggcacgtttcaccagaagtttcccatgccaycactcctgcctgaaagctgctgcctgtgctcaccattgtggggcaggcttggggatccagctctactcagctatgtccccctctctggtgctgagcaggg

SEQ ID NO: 32983 - DNA, 201 bp, Homo sapiens
gagaaagtatgaagtgacccacctgaatttagaggagggaagtgaggaatttggagacatctaaaaacattttgtccctgtggtttgacttcaaattattatctatttttattggagatttgtttgaaattataaccggtatctcatgattattcagcatatgccatgccccctggtaaccctggttcttatttttttaaa

SEQ ID NO: 32984 - DNA, 201 bp, Homo sapiens
agacatttaaatggtgagctgaggagaagacatctttaatgagtctcaactacattgcagttggagatagagagtagtgtctggtcaatttgagtttcccygatgccaggactagggaatgacagggaaatggatggcattcctgcctggccaggtcatgaagctggggcagccctctcctcatctgtggagacctaggca

SEQ ID NO: 32985 - DNA, 201 bp, Homo sapiens
ggagaaagtatgaagtgacccacctgaatttagaggagggaagtgaggaatttggagacatctaaaaacattttgtccctgtggtttgacttcaaattattatctatttttattggagatttgtttgaaattataaccggtatctcatgattattcagcatatgccatgccccctggtaaccctggttcttatttttttaa

SEQ ID NO: 32986 - DNA, 201 bp, Homo sapiens
ggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagttgcccag

SEQ ID NO: 32987 - DNA, 201 bp, Homo sapiens
tcgagaccagcctgaccaacatggagaaaccctgtctctactaaaactacaaaaacaattagccaggcgtggtggcgcatgcctgtaatcccaggtactcragaggctgaggcaggagaattgcttgaacctgggaggtggaggttgcggtgagctgagatcacgccattgcactccagcctgggcaacaagagcaaaact

SEQ ID NO: 32988 - DNA, 201 bp, Homo sapiens
catctacatgtcccaggttatggttcttaaacaaaggctacaggaggtagcctgttgtccccatcagatgtgaaggggccatacctgggaccaactcaackctttctcattcccacacatcagccagaatctttctgcataagccagagctaatcaccaagcttgagcaagaagaggaacagtggagagagtttgtccatc

SEQ ID NO: 32989 - DNA, 201 bp, Homo sapiens
taccaaaatctgtattattctggattcaacagagaaacagaaccaataaggggtgtgtgtgtgtgtgtgtgtgtgtgtgtgtgtgtgtatgtgtgtgttttattcgtgttatgaaactgactcatgcaattattacggtggcaagtgtgaaatctgtaggatacgccagcaggctgaaaatgcagacagaagttgatatgg

SEQ ID NO: 32990 - DNA, 201 bp, Homo sapiens
aaggcgggcggatcatgaggtcgggagttcgagaccagcctgaccaacatggtgaaacactgtttctactaaaacaacaaaaattagccgagcatggtgtygcgcgcctgtaatcccacctacttgggaggctgaggcaggagaatcgcttgaacccaggaggcagaggttgcggtgagccgagatcacaccattgcactc

SEQ ID NO: 32991 - DNA, 201 bp, Homo sapiens
tggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagttgccca

SEQ ID NO: 32992 - DNA, 201 bp, Homo sapiens
gtaccaaaatctgtattattctggattcaacagagaaacagaaccaataaggggtgtgtgtgtgtgtgtgtgtgtgtgtgtgtgtgtgtatgtgtgtgttttattcgtgttatgaaactgactcatgcaattattacggtggcaagtgtgaaatctgtaggatacgccagcaggctgaaaatgcagacagaagttgatatg

SEQ ID NO: 32993 - DNA, 201 bp, Homo sapiens
ttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagttgccc

SEQ ID NO: 32994 - DNA, 201 bp, Homo sapiens
aatcactctaagtaccaaaatctgtattattctggattcaacagagaaacagaaccaataaggggtgtgtgtgtgtgtgtgtgtgtgtgtgtgtgtgtgtrtgtgtgtgttttattcgtgttatgaaactgactcatgcaattattacggtggcaagtgtgaaatctgtaggatacgccagcaggctgaaaatgcagacag

SEQ ID NO: 32995 - DNA, 201 bp, Homo sapiens
gttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagttgcc

SEQ ID NO: 32996 - DNA, 201 bp, Homo sapiens
tggctataaacgttttaaaaggattctcttcctctagaatcactctaagtaccaaaatctgtattattctggattcaacagagaaacagaaccaataaggkgtgtgtgtgtgtgtgtgtgtgtgtgtgtgtgtgtgtatgtgtgtgttttattcgtgttatgaaactgactcatgcaattattacggtggcaagtgtgaaa

SEQ ID NO: 32997 - DNA, 201 bp, Homo sapiens
tgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagttgc

SEQ ID NO: 32998 - DNA, 201 bp, Homo sapiens
tgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtttcactctagtt

SEQ ID NO: 32999 - DNA, 201 bp, Homo sapiens
gaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgagacagagtt

SEQ ID NO: 33000 - DNA, 201 bp, Homo sapiens
gttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttgag

SEQ ID NO: 33001 - DNA, 201 bp, Homo sapiens
tgttaggctgaatggagtgctgtgttggagttcttcttcttcctcttcttcttcttcttcgtcttcgtcttcttcttcttcttcttttcttttcttcttcttcttcttccttcttcttcttcttctccttctcttctccttctccttcttctccttctccttcttcttcttctttttctttctttctttttttttttttga

SEQ ID NO: 33002 - DNA, 201 bp, Homo sapiens
ttgttcataaccatttgaataagggcaaggtgtatggaaacacattatgaactgatattttcagttttgtttgcaagaaaatgattaataaggtgaaatarttgaagtatcacggaagatacattaaaaaaaaaaaaagcctttgtacagtttgctggagccacagatgtcctactccagagcagaacaatgcctgaatct

SEQ ID NO: 33003 - DNA, 201 bp, Homo sapiens
gaagatacattaaaaaaaaaaaaagcctttgtacagtttgctggagccacagatgtcctactccagagcagaacaatgcctgaatcttcagggtccatttstgccgcattcactagcaaccacaaatgtgacttaattttactttggaaataatgcttacctattgtgagatgctgtaatatgaaccatcattacatgtta

SEQ ID NO: 33004 - DNA, 201 bp, Homo sapiens
gttattttcaactaaatcctagacaatatattatttcacatgttagcaattttcttttgaaggtgccaatgttcagcttctttaaaaagagaaacagagaygggcaggagaaggattgaactgacaaaatatattttcaaatgcaattaaggcagaggacaatgcaggaacccttgagtcccgttttaactgaatgctcag

SEQ ID NO: 33005 - DNA, 201 bp, Homo sapiens
tccagagcagaacaatgcctgaatcttcagggtccatttgtgccgcattcactagcaaccacaaatgtgacttaattttactttggaaataatgcttaccyattgtgagatgctgtaatatgaaccatcattacatgttaacatggcacatggaattttgagtgtctaagttacatttttagagttgtttcttagtagcca

SEQ ID NO: 33006 - DNA, 201 bp, Homo sapiens
agtttattggcattgactctgggtcaaggcaccgtgtctccctcccatcgagttttccatcatctacacgagacctagatgactactttgatatctactgmaggccacagccttgtcaaagccagccccagctgaaatgcactcacctgcattcccacacaattttacatacaattcgggggaggttatgggatctatgaa

SEQ ID NO: 33007 - DNA, 201 bp, Homo sapiens
tctactgcaggccacagccttgtcaaagccagccccagctgaaatgcactcacctgcattcccacacaattttacatacaattcgggggaggttatgggayctatgaagaccaagggtctgtggtcctgtgacactttctctcagagggtgaagaaggagttccttggggcagcaactccccaggggtctcctgcctgcct

SEQ ID NO: 33008 - DNA, 201 bp, Homo sapiens
caatcctctttcctgctgttgatcatcatgcagtttttaaatccctactccctgccccaccaaggttgggctctaggacctgcctattgggaacctgcggytgggagaaagtatgaagtgacccacctgaatttagaggagggaagtgaggaatttggagacatctaaaaacattttgtccctgtggtttgacttcaaatt

SEQ ID NO: 33009 - DNA, 201 bp, Homo sapiens
agaggagggaagtgaggaatttggagacatctaaaaacattttgtccctgtggtttgacttcaaattattatctatttttattggagatttgtttgaaatyataaccggtatctcatgattattcagcatatgccatgccccctggtaaccctggttcttatttttttaaacttgtacaaatattttaagcaaacacagaa

SEQ ID NO: 33010 - DNA, 201 bp, Homo sapiens
gacactgtgcagctgtgtcctccggggtccctaaagctggcacgttctgctgtgtacccagaggtggggacagatgctgccagctccaccttacagctgcyacatgaaatttgaggtcagagaattctcttgtctttaagggcacccacatttgccttcttcgatgtttcaggaaatcataactgaatttagaaaggttcc

SEQ ID NO: 33011 - DNA, 201 bp, Homo sapiens
attataaccggtatctcatgattattcagcatatgccatgccccctggtaaccctggttcttatttttttaaacttgtacaaatattttaagcaaacacaraagtagacagaagagtaaagtgaccttcactgtacccttcactcagtaacacccactcttgatttatctacatcctcaaccatagcccaacaccaggtta

SEQ ID NO: 33012 - DNA, 201 bp, Homo sapiens
tttttaataaagttttttattgttggctataaacgttttaaaaggattctcttcctctagaatcactctaagtaccaaaatctgtattattctggattcawcagagaaacagaaccaataaggggtgtgtgtgtgtgtgtgtgtgtgtgtgtgtgtgtgtatgtgtgtgttttattcgtgttatgaaactgactcatgcaa

SEQ ID NO: 33013 - DNA, 201 bp, Homo sapiens
  misc_feature (1)...(201): n = A,T,C or G, or insertion/deletion polymorphism (see Tables 1-2)
aagaaaggaaggaaatcaaattcatatcccaggaatgcacctttcatgacaacattttggagatccaattaactctattcctcgagggcgtttttccttgntggtattttcagttctattaacacttctcaaaaagtgaaaggaaaaaatagtcaacagggttttttggtctttattcttttctttctatctctagtaagg

SEQ ID NO: 33014 - DNA, 201 bp, Homo sapiens
ggctggaaagtggaagaataatccaagatctgcatgcctcataaaaggagtgcgaatggttttgaaagacaggaaaggaaagggagagagaggaaagaaakagagaggaagaaaggaaggaaatcaaattcatatcccaggaatgcacctttcatgacaacattttggagatccaattaactctattcctcgagggcgttt

SEQ ID NO: 33015 - DNA, 201 bp, Homo sapiens
tctcaagttttgttctctgcctcacactcaatgtgtttgaggctctgattccagtccctcggcctccacttaggtcagggccagaagtccctgctcccccstcagagactctaactttccaaggaataggagattttcccaggtgtctgtgtccaggctggtgtctgggttctgtgctcccttccccaccccaggtgtcct

SEQ ID NO: 33016 - DNA, 201 bp, Homo sapiens
cagtgtcttgggccgccggaaggtgggtgacatgtggatcttgttttttttgtggctgtggacatctttcaacactgccttcttggccttgcaaagccttygctttggcttcggctttaggaggggcaggagcttccttcttcgttcttggcaccatcttatgaaaagggtccagattaagatttttgactgagtcattct

SEQ ID NO: 33017 - DNA, 201 bp, Homo sapiens
gatccctgagattgttgggatattgtggtcaggagcctatgagggagctcacccaccccacagttcctctagccacatctgtgggctctgaccaggtcctrtttttgttctaccccaatcactgacagtgcccagggctctggggtgtctctcacagctaataaaggtgacactccagggcaggggccctgatgtgagtgg

SEQ ID NO: 33018 - DNA, 201 bp, Homo sapiens
cccatctccccagagtttctctttctctcccaacccgtgtcaggtccttcttcctggatactcataacgcggccccatttctcactcccattgggcgtcgsgtttctagagaagccaatcagtgtcgccgcagttcccaggttctaaagtcccacgcaccccgcgggactcatatttttcccagacgcggaggttggggtc

SEQ ID NO: 33019 - DNA, 201 bp, Homo sapiens
caccctgcacaggagggggagggggagggggagggcaaagtcccagggccccaggagtggctctcaagggctcaggccccgaggcggtgtctggggttggraggctcagtattgagaattccccatctccccagagtttctctttctctcccaacccgtgtcaggtccttcttcctggatactcataacgcggccccattt

SEQ ID NO: 33020 - DNA, 201 bp, Homo sapiens
tcaggccccgaggcggtgtctggggttgggaggctcagtattgagaattccccatctccccagagtttctctttctctcccaacccgtgtcaggtccttcwtcctggatactcataacgcggccccatttctcactcccattgggcgtcgcgtttctagagaagccaatcagtgtcgccgcagttcccaggttctaaagtc

SEQ ID NO: 33021 - DNA, 201 bp, Homo sapiens
aggttctaaagtcccacgcaccccgcgggactcatatttttcccagacgcggaggttggggtcatggcgccccgaagcctcctcctgctgctctcaggggycctggccctgaccgatacttgggcgggtgagtgcggggtccagagagaaacggcctctgtggggaggagtgaggggcccgcccggtgggggcgcaggact

SEQ ID NO: 33022 - DNA, 201 bp, Homo sapiens
gacctgcagttagagagaagggacaactcaatttgggactgcagcagaaacccctacatcatggggttcctggaagggaccctctcccttcagcgacgcaytgtgaggccatttctaggtaaaaaggtagaatttccttggattcctgaggtttattttacacttactgcttattctttgactttatagaagccaacttca

SEQ ID NO: 33023 - DNA, 201 bp, Homo sapiens
gagtgaggggcccgcccggtgggggcgcaggactcagggagccgcctccggaggagggtctggcgggtctcagcccctcctcgcccccaggctcccactcmttgaggtatttcagcaccgctgtgtcgcggcccggccgcggggagccccgctacatcgccgtggagtacgtagacgacacgcaattcctgcggttcgaca

SEQ ID NO: 33024 - DNA, 201 bp, Homo sapiens
gaggggaacgaggggtcatgtcttttctcagggaaagcaggagcccttctggagctcttcagcagggtcagggctgaggcctggagatcagggcccctcaycttcccttcctttcccagagcagtctccccagcccaccatccccatcgtgggcatcgttgctggccttgttgtccttggagctgtggtcactggagctgt

SEQ ID NO: 33025 - DNA, 201 bp, Homo sapiens
taaattagactatcaaaatttaaaaaccttttttatatatcaagggacactattaagagagttaaaagaaaatgcacagaatgggaggaaatatttgccarttatatacctgataaagaattaatatccagaatacataaagaactatgacttaacaacagaaaaacaaacaatctcattcaaaaatgagtgaacaacatg

SEQ ID NO: 33026 - DNA, 201 bp, Homo sapiens
ggagcctatgagggagctcacccaccccacagttcctctagccacatctgtgggctctgaccaggtcctgtttttgttctaccccaatcactgacagtgcycagggctctggggtgtctctcacagctaataaaggtgacactccagggcaggggccctgatgtgagtggggtgttgggggggaacagaggggactcagct

SEQ ID NO: 33027 - DNA, 201 bp, Homo sapiens
ggagtggaccacagggtacgccaaggccaacgcacagactgaccgagtggccctgaggaacctgctccgccgctacaaccagagcgaggctggtgagtgamcccggccgggggcgcaggtcacgaccaccccccatccgccacggaccgcccgggtccctcagagtctccggatccgaaatctaccccgaggcagcgggac

SEQ ID NO: 33028 - DNA, 201 bp, Homo sapiens
gactctaactttccaaggaataggagattttcccaggtgtctgtgtccaggctggtgtctgggttctgtgctcccttccccaccccaggtgtcctgtccaktctcaggttggtcacatgggtgctgctggggtttcccatgaggagtgcaaagtgcctgaattttctgactcttctcagatcctccaaaggcacacgttgc

SEQ ID NO: 33029 - DNA, 201 bp, Homo sapiens
gttctctgcctcacactcaatgtgtttgaggctctgattccagtccctcggcctccacttaggtcagggccagaagtccctgctcccccctcagagactckaactttccaaggaataggagattttcccaggtgtctgtgtccaggctggtgtctgggttctgtgctcccttccccaccccaggtgtcctgtccattctca

SEQ ID NO: 33030 - DNA, 201 bp, Homo sapiens
gcacagactgaccgagtggccctgaggaacctgctccgccgctacaaccagagcgaggctggtgagtgaacccggccgggggcgcaggtcacgaccacccsccatccgccacggaccgcccgggtccctcagagtctccggatccgaaatctaccccgaggcagcgggacccgcccagaccctccacccgggagagtccca

SEQ ID NO: 33031 - DNA, 201 bp, Homo sapiens
tggaataccgatccgcggtcccctttgagccctccaacagccttgggccccgtgacttttctctcaagttttgttctctgcctcacactcaatgtgtttgrggctctgattccagtccctcggcctccacttaggtcagggccagaagtccctgctcccccctcagagactctaactttccaaggaataggagattttccc

SEQ ID NO: 33032 - DNA, 201 bp, Homo sapiens
ccgatacttgggcgggtgagtgcggggtccagagagaaacggcctctgtggggaggagtgaggggcccgcccggtgggggcgcaggactcagggagccgcstccggaggagggtctggcgggtctcagcccctcctcgcccccaggctcccactccttgaggtatttcagcaccgctgtgtcgcggcccggccgcggggag

SEQ ID NO: 33033 - DNA, 201 bp, Homo sapiens
aggagacgctacagcgcgcaggtaccaggggccatgggcgccttccctatctcctgtagatctcttgggatggcctcgcacaaggttgggaggaaagtggrcccaatgctaggatatcgccctccctctagtcctgagtaggaagaatcttcctggctttcgagatccggtaccagagagtgactgtgagagtccgccctg

SEQ ID NO: 33034 - DNA, 201 bp, Homo sapiens
cgatacttgggcgggtgagtgcggggtccagagagaaacggcctctgtggggaggagtgaggggcccgcccggtgggggcgcaggactcagggagccgccyccggaggagggtctggcgggtctcagcccctcctcgcccccaggctcccactccttgaggtatttcagcaccgctgtgtcgcggcccggccgcggggagc

SEQ ID NO: 33035 - DNA, 201 bp, Homo sapiens; identical to SEQ ID NO: 8530

SEQ ID NO: 33036 - DNA, 201 bp, Homo sapiens
tggagaggaacagagatacacatgccatgtgcagcacgaggggctgccccagcccctcatcctgagatggggtaaggagggagatgggtaaagaggggaaygaggggtcatgtcttttctcagggaaagcaggagcccttctggagctcttcagcagggtcagggctgaggcctggagatcagggcccctcaccttccctt

SEQ ID NO: 33037 - DNA, 201 bp, Homo sapiens
aaggagggagatgggtaaagaggggaacgaggggtcatgtcttttctcagggaaagcaggagcccttctggagctcttcagcagggtcagggctgaggccyggagatcagggcccctcaccttcccttcctttcccagagcagtctccccagcccaccatccccatcgtgggcatcgttgctggccttgttgtccttggag

SEQ ID NO: 33038 - DNA, 201 bp, Homo sapiens
ttgtgcctcacgaacatacataaattttaaaaataaagaataaaaatatatctttttatagatacaggtagatatgtttttatagcatgcacgtaaatgtgtgtgtgtgtgtgtgtgtgtgaagagaaagagtgaatagagagattaagattcttttaatggtgaaaagatatacatatatttggaattagccagcttgac

SEQ ID NO: 33039 - DNA, 201 bp, Homo sapiens
tgtgcctcacgaacatacataaattttaaaaataaagaataaaaatatatctttttatagatacaggtagatatgtttttatagcatgcacgtaaatgtgkgtgtgtgtgtgtgtgtgtgaagagaaagagtgaatagagagattaagattcttttaatggtgaaaagatatacatatatttggaattagccagcttgact

SEQ ID NO: 33040 - DNA, 201 bp, Homo sapiens
gcctggctaaaatttttgtatttttggtagagacaagggttttgccatgctgcctaggctgatctcgaactcatgaaatcaagctctctgcctgactccayctccaaaagtgctgggattacaggcatgagccaccaccacacccaacctaaattaattataaaatattaaacatgtcatttggttttaagaggtaagagg

SEQ ID NO: 33041 - DNA, 201 bp, Homo sapiens
ggtaaggagggagatgggtaaagaggggaacgaggggtcatgtcttttctcagggaaagcaggagcccttctggagctcttcagcagggtcagggctgagrcctggagatcagggcccctcaccttcccttcctttcccagagcagtctccccagcccaccatccccatcgtgggcatcgttgctggccttgttgtccttg

SEQ ID NO: 33042 - DNA, 201 bp, Homo sapiens
gcagcgggatggggaggaacagacccaggacacagagcttgtggagaccaggcctgcaggggatggaaccttccagaagtgggccgctgtggtggtgcctyctggagaggaacagagatacacatgccatgtgcagcacgaggggctgccccagcccctcatcctgagatggggtaaggagggagatgggtaaagagggga

SEQ ID NO: 33043 - DNA, 201 bp, Homo sapiens
cgggactcatatttttcccagacgcggaggttggggtcatggcgccccgaagcctcctcctgctgctctcaggggccctggccctgaccgatacttgggcrggtgagtgcggggtccagagagaaacggcctctgtggggaggagtgaggggcccgcccggtgggggcgcaggactcagggagccgcctccggaggagggt

SEQ ID NO: 33044 - DNA, 201 bp, Homo sapiens
gaggttctgagctccagaccttcaaccatcaggccaggcccctccagacctagactcccttcctgtcttctccagccccactctgctttgtatctacttcyggatcactttccctctacaggcccagctcctgagtgtctctacctctcaaacaagtattctcatccaggagcaattttcccaccagaggacattagctat

SEQ ID NO: 33045 - DNA, 201 bp, Homo sapiens
ccgaggcggtgtctggggttgggaggctcagtattgagaattccccatctccccagagtttctctttctctcccaacccgtgtcaggtccttcttcctggwtactcataacgcggccccatttctcactcccattgggcgtcgcgtttctagagaagccaatcagtgtcgccgcagttcccaggttctaaagtcccacgca

SEQ ID NO: 33046 - DNA, 201 bp, Homo sapiens
gcctgtttgatctggtgcttgttggctttaacatccacagtgaacacaagtaggctgttgttttctatcttcttcacagcctactcagtggtcagcggaawcttgatgataacatggtggtcaagcttatttctcctgggggtgctcttccaaggatatttgggctgcctccggagtcacagtgtcttgggccgccggaag

SEQ ID NO: 33047 - DNA, 201 bp, Homo sapiens
cgggtgacagagcaaagaccttcacccccactccctacccgtctctaaaaaaaacaaaaacaaaaacaaaaaaacccttgggcccagcgccgtggctcacrcctgtaatcccagcactgtgggaggccgaggtgggcagatcacaaggtcaggagatcgagaccatcctggctaaaacggtgaaaccccgtctctactaaa

SEQ ID NO: 33048 - DNA, 201 bp, Homo sapiens
aaacaaaaacaaaaaaacccttgggcccagcgccgtggctcacgcctgtaatcccagcactgtgggaggccgaggtgggcagatcacaaggtcaggagatygagaccatcctggctaaaacggtgaaaccccgtctctactaaaaatacaaaaaaaaaaaaaaaattagccaggcatggtagcaggcgcctgtagtcccag

SEQ ID NO: 33049 - DNA, 201 bp, Homo sapiens
gaggcagagttttgctcttgtcacccaggctggagtgcaatggcgcgatctaggctcactgaaacctctgcctcccgggttcaagcgattctcagcctccygagtagctgggattacaggtgcccgccaccacacccagctaatttttgtatttttagtagagactaggtttcaccaggttggccaggctggcctcgaact

SEQ ID NO: 33050 - DNA, 201 bp, Homo sapiens
aagtacactcctggtttccatccactggctcctggttttggtgtatcttctggtggcgtttgagctcagactggtcccggaagctcttcccacacacagarcatgaatggggccggtaacccagatggacgcggcggtgacgacttagtccagaagcatcacagtaggtcttgtcacagagcgtgcaacagaagggcctct

SEQ ID NO: 33051 - DNA, 201 bp, Homo sapiens
gcaaagtgcctactacaaatccagtcacaaagtagctagctactcactaaatgttcagctcctccctcctcattcagatgggaagtggctttagataaacaaagtggcaacgcagtgggctggagcagctctgtgaactgagaatccaagaaaaggggcgaagagcagctgggatgtattggatgcttgtgctggcttgga

SEQ ID NO: 33052 - DNA, 201 bp, Homo sapiens
tagctgagggacttggggctccgaaacaacttcccacactgactgcagctgttagtcagcttgggattgtgaacaaactggtggctatagaggtaggagcrcctgctgaaacatttgccacaggtgtagcaaaaaaagggtggcccagcctgggatgcttgaagcacccgggtcctgtccatagtcccagctggggcagat

SEQ ID NO: 33053 - DNA, 201 bp, Homo sapiens
cccagtaactgggcagatggagaggcccagcaaaggccccagggtttgatgtggcttcctgtgacaaatgtatctgctccaagaggctgtcttcctttttygttctgctgtccaaattctcctcttccacaattgagaacaattttgcttccctcaaagctgggccaccgagttcagggccctggtcacccttggctcacc

SEQ ID NO: 33054 - DNA, 201 bp, Homo sapiens
tctggagagataggatttcttgctaaaagtcaaagaacaatgggggcaacagaagacattgagtcttgagggcttcactggatgagagttggatctggcawcctgacagagggttccagtgatgggtgcctgggtcctggtcacaggtgcttggttcttaagtacagatgcctggttctgggccataggaccctcagttct

SEQ ID NO: 33055 - DNA, 201 bp, Homo sapiens
tgtcaaatgtcagtcctgcctttcagatcctttctactgggtgagccctggagtgctggttctcctcgcggtgctgcctgtgctcctcctgcagatcactsttggcctcgtcttcctctgcctgcagtacagactgagaggtacagggcagagggtgggtggatcaggatcctttctttaaatgagctggcttcttggagc

SEQ ID NO: 33056 - DNA, 201 bp, Homo sapiens
acagcttgaaggattgtaattatacctaagcaaccctcctggaccagtttaatgttattagctgtgatgtatccctacctttgatgtcattatccttactyagctcccttaaagcagagatcaagatgaaaagggcttcagctgcagcatggcacatggagattagagtggggcttttggatgctgaggagcagacctaga

SEQ ID NO: 33057 - DNA, 201 bp, Homo sapiens
tttctattttaggaaaacttcgagcagagataggtgagttccagtcatcgtttctcccaattcttgccttttggttttttggcataacggaaatggtcccrttcttggaccgtctctccctctcaataccctgttttcccctcagtttccctttctctacagtgggtgtgtcgtgcctagaacaagttttaagtaattaaa

SEQ ID NO: 33058 - DNA, 201 bp, Homo sapiens
acaacttcctagctcagtaactgcctctcccaacaaactccctcagtttcaccacaccaaaaaaggaagacaagccggttgcggtggctcacacctataaycccaaaactttgggaggccgaggcgggtggatcacctgaggtcgggagttcgagactagcctgaccaacatggagaaaccctgtctctactaaaaacaca

SEQ ID NO: 33059 - DNA, 201 bp, Homo sapiens
taggaaaacttcgagcagagataggtgagttccagtcatcgtttctcccaattcttgccttttggttttttggcataacggaaatggtcccgttcttggaycgtctctccctctcaataccctgttttcccctcagtttccctttctctacagtgggtgtgtcgtgcctagaacaagttttaagtaattaaataacaaaga

SEQ ID NO: 33060 - DNA, 201 bp, Homo sapiens
tttcttttttttttttttttttttgtattttagtacagacggggtttcacatgttggccaggatggtctcgatctcttgacctgctgatccgcccgcctcrgcttcccaaagtactgggattatgggcgtgagccactgcactaggcctaatttttttatttttagtagagatggggtttcaccatgttggccaggctggt

SEQ ID NO: 33061 - DNA, 201 bp, Homo sapiens
ttctgagaaactgtgaagagaaccacttactggatctgtgggatcccccagtggaaagggcagtgtgggtcactccaaatgtccatagggaggatgtgggraaggtgctattcatcttccactaatcacatatttgtttctttttgttttcagggcaattccttgaagagctacgtaagttctcttctctctgttataagc

SEQ ID NO: 33062 - DNA, 201 bp, Homo sapiens
ttcagcagtaaggggacatgcaccccaagggcctccacttggcctgaccttgctgcgggggctctctgtccccaggaacagtagagatggcaagcttatcragaccctctctgcccagctgcctctgctccttcctcctcctcctcctcctccaagtgtcttccagctatgcaggtaagacatgttttttttcctgccctg

SEQ ID NO: 33063 - DNA, 201 bp, Homo sapiens; identical to SEQ ID NO: 8561

SEQ ID NO: 33064 - DNA, 201 bp, Homo sapiens
gctccttcctcctcctcctcctcctccaagtgtcttccagctatgcaggtaagacatgttttttttcctgccctggggagaccctgaaaacagaaaggctrgtttcctggggcttagctccttcaaacatcctcaagttgctatattatctttctaaaacatagacctactgacatgcctcccttcctcagaaaccttccg

SEQ ID NO: 33065 - DNA, 201 bp, Homo sapiens
gaggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcaccttt

SEQ ID NO: 33066 - DNA, 201 bp, Homo sapiens
aggttgcagtgagccaaaatccttccactgcactccagcatgggggacacagcgagactccgtctcaaaaaaaaaaaaaaaaccctgtatttgtgagcgcacacacacacacacacacacacacacctgtgcttggtcctagtgaataagcaagtaaatcaaatgtctaaatataattatagaaaggagatgtcacctttt

SEQ ID NO: 33067 - DNA, 201 bp, Homo sapiens
gttgcagtgagccaaaatccttccactgcactccagcatgggggacacagcgagactccgtctcaaaaaaaaaaaaaaaaccctgtatttgtgagcgcacrcacacacacacacacacacacacctgtgcttggtcctagtgaataagcaagtaaatcaaatgtctaaatataattatagaaaggagatgtcaccttttgg

SEQ ID NO: 33068 - DNA, 201 bp, Homo sapiens; identical to SEQ ID NO: 8562

SEQ ID NO: 33069 - DNA, 201 bp, Homo sapiens
aggaggtttcacctgcttcttccgagatcattcttaccaagaggaggcagcaatggaattgaaagtagaaggtgagtagtgccatataatattaggtattwactgttgggtggccaagaacaattattctctcaactgagatgagatccctcaacccaaacatctcagtcctgggaatgatttccataaaaatgtacacat

SEQ ID NO: 33070 - DNA, 201 bp, Homo sapiens; identical to SEQ ID NO: 8542

SEQ ID NO: 33071 - DNA, 201 bp, Homo sapiens
ttaaaactcccccagcctgacccaatacacaatcttgactttaaaccacttgtcattctaaatcactagcatttcctggaaaaaaaagccatttttccttyagggctaagctcagggaccaattctgtgtcaccttctttgaatcctgatgatattcacttctttatttgacctgatttattgggccccagacaccatgct

SEQ ID NO: 33072 - DNA, 201 bp, Homo sapiens
caagatgaccccaagggcttttcttctccctagttcaatggttttatgatacaaactactgacatacgtttttcaagttattttctccttcttctaggaamtcccttctgagtgatgtcacatcttggcaggggtggaggagagcctggttgcccagggatttgtccttggggacatctcatccatcaagttgcacactca

SEQ ID NO: 33073 - DNA, 201 bp, Homo sapiens
ttgctcaacctactccacatctccaggtctgcacatctgttcagttactgaatcctgtgtaagctaccttctttttcttttttcttttatttatttatttwttttttttttgagatggagttttgctcttgttacccaggctggagtgcaatggtgcaatctcggctcactgcaccctccaactcccaggttcatgcaatt

SEQ ID NO: 33074 - DNA, 201 bp, Homo sapiens
ctcttctgagaaactgtgaagagaaccacttactggatctgtgggatcccccagtggaaagggcagtgtgggtcactccaaatgtccatagggaggatgtrgggaaggtgctattcatcttccactaatcacatatttgtttctttttgttttcagggcaattccttgaagagctacgtaagttctcttctctctgttata

SEQ ID NO: 33075 - DNA, 201 bp, Homo sapiens
ggatcttggctcactgcaacctccgcctcccaggttcaagcgattctcctgcctcagcctcctgagtagctggcattacaggcatgtgccaccacgcccasctaatttttacatttttagtagagatggggtttcaccatgttggcctggctggtcttgaactcttggcctcatgatccacccgtctcggactcccagagt

SEQ ID NO: 33076 - DNA, 201 bp, Homo sapiens
tcattagggcacagatggtaccttctctgagcaaacttccttcacagctcctcctcccgaggctgtaggtgactctactcttgtcacctggcacacagagktctatcgtacgatttaggaaattagaccagtgtgtggaccacacacacacacatctttacacacccaaagaggaggaatagtatctttgttttggaggac

SEQ ID NO: 33077 - DNA, 201 bp, Homo sapiens
tcagtcctgcctttcagatcctttctactgggtgagccctggagtgctggttctcctcgcggtgctgcctgtgctcctcctgcagatcactgttggcctcrtcttcctctgcctgcagtacagactgagaggtacagggcagagggtgggtggatcaggatcctttctttaaatgagctggcttcttggagctacaccact

SEQ ID NO: 33078 - DNA, 201 bp, Homo sapiens
aagtgatccacccaccttggcctcccaaaatgctgggattacaggtgtgagccaccatgcccgctgtaaactaccttcttaaaagctctagaagagggctyttaaccttttgttgtgtgtcatgcaccttccgcaagctgatgaagttgatagacccatctcagaattttttttttttttttgagacagtgtctcactctg

SEQ ID NO: 33079 - DNA, 201 bp, Homo sapiens
gcgcacacacacacacacacacacacacacctgtgcttggtcctagtgaataagcaagtaaatcaaatgtctaaatataattatagaaaggagatgtcacyttttggctgtacctccactatttcattctgcagaattgcagaatttcttttttttttcctttctttcttttctttttttttttgacacagagtctcgctc

SEQ ID NO: 33080 - DNA, 201 bp, Homo sapiens; identical to SEQ ID NO: 8545

SEQ ID NO: 33081 - DNA, 201 bp, Homo sapiens
gctggagtgcaatggcaagatctcggctcacctcaacctccgcctcctgggttcaagcgattctcctgcctcagcctcttgagtagctgggattacaggamtgtgccaccacgtccagctaattttgtatttttagtagaaacagggtttctccatgttggtcaggctggtcttgaactcccaacctcaggcgatccgccc

SEQ ID NO: 33082 - DNA, 201 bp, Homo sapiens
tgccctggggagaccctgaaaacagaaaggctagtttcctggggcttagctccttcaaacatcctcaagttgctatattatctttctaaaacatagacctrctgacatgcctcccttcctcagaaaccttccgtgggtggttcttacagccttcaagatggagtccagactcttttttttttttgagacagagtctccctc

SEQ ID NO: 33083 - DNA, 201 bp, Homo sapiens
acctcagcctccctggttcaagcgattctcctgacttggcctcccaagtagcggagactacaggcgcctgccaccacacccagctaaattttttcttttcttttttttttttttttttttgtattttagtacagacggggtttcacatgttggccaggatggtctcgatctcttgacctgctgatccgcccgcctcggctt

SEQ ID NO: 33084 - DNA, 201 bp, Homo sapiens
actgtgaagagaaccacttactggatctgtgggatcccccagtggaaagggcagtgtgggtcactccaaatgtccatagggaggatgtggggaaggtgctrttcatcttccactaatcacatatttgtttctttttgttttcagggcaattccttgaagagctacgtaagttctcttctctctgttataagcagagaataa

SEQ ID NO: 33085 - DNA, 201 bp, Homo sapiens
ggaggctaaggcagggtggatcacttgagctcaggagttcgagaccagcctgggcaacatggtgaaaacctgtctctaccaaaaaattaattaattttttwaaaaaagcctgggcgcggtggctcacgcctgtaatcccagcactttgggaggccgagatgggcagatcacgaggtcaggagttcgagaccatcctgacca

SEQ ID NO: 33086 - DNA, 201 bp, Homo sapiens
cagtttcccaggcagagacaaccaccactccccttgtctggtcccactgacctgaaggtggaaacatctccacattatttgaaggctctagattctgtctycagccatctatgttcccctggacaagaggagaaacaaagacactccaattcaattttcaggccaccttccaaagagaaagcccctacaataacaaagtca

SEQ ID NO: 33087 - DNA, 201 bp, Homo sapiens
gtggatcacttgagctcaggagttcgagaccagcctgggcaacatggtgaaaacctgtctctaccaaaaaattaattaattttttaaaaaaagcctgggcrcggtggctcacgcctgtaatcccagcactttgggaggccgagatgggcagatcacgaggtcaggagttcgagaccatcctgaccaacatgttgaaacccc

SEQ ID NO: 33088 - DNA, 201 bp, Homo sapiens
cagctttgcccctgggtggttgaagcgccaggctggaatgagtaaggtctccacaagaccttgctgcctgcctcccatactcccatcagattggatggatrgtcgtggtccagaccttcatcttcccaccagaagtgtgcacagtcagaagctctctgccagactgaccctttttggtcccgtttagctcatacaggacct

SEQ ID NO: 33089 - DNA, 201 bp, Homo sapiens
cctggaagaccacagcagccaaggtgagcattaagcagggcagctttgcccctgggtggttgaagcgccaggctggaatgagtaaggtctccacaagaccytgctgcctgcctcccatactcccatcagattggatggatagtcgtggtccagaccttcatcttcccaccagaagtgtgcacagtcagaagctctctgcca

SEQ ID NO: 33090 - DNA, 201 bp, Homo sapiens
tccgcccgtgccagagcctctagctccatggcctgggcctctagcctcatcttctgctgcagcgaggtctcccgcaggagccggacctcctcctccagccrccgcagctcttgcagctgccgaacgatcacctcagcctgctggctcagggcctgtgacccctccagcccccaggaccttcaaagacaggttagtgcaggt

SEQ ID NO: 33091 - DNA, 201 bp, Homo sapiens
ttattctggtcctgaccctcacccccatctctcaatagcctgccctcgccccctgtacgctagccggctctactctcccaccactgctcccctagataccmgaggcttcacccagttagcccgtgagctctaaggctgttctgatctcttcatctgtcccttcacctggcccctgtacccccttcccctttggaccccttg

SEQ ID NO: 33092 - DNA, 201 bp, Homo sapiens
tcagctcggccggccttctccgcccgtgccagagcctctagctccatggcctgggcctctagcctcatcttctgctgcagcgaggtctcccgcaggagccrgacctcctcctccagccgccgcagctcttgcagctgccgaacgatcacctcagcctgctggctcagggcctgtgacccctccagcccccaggaccttcaa

SEQ ID NO: 33093 - DNA, 201 bp, Homo sapiens
aagtgctaggattacaggtatgagccactgtgcccagcctgctcattgctcttatgggaaagtagcaagttctgaagtggccaaagccttgtgccctgggycctgggctctgcagcacactcagtgcccctcatctctgtgccccagccttctggcctcctgtccccgccttcacctgttgtcccaccaagtgtcttccag

SEQ ID NO: 33094 - DNA, 201 bp, Homo sapiens
ccccatctctcaatagcctgccctcgccccctgtacgctagccggctctactctcccaccactgctcccctagatacccgaggcttcacccagttagcccrtgagctctaaggctgttctgatctcttcatctgtcccttcacctggcccctgtacccccttcccctttggaccccttgaaccctcccaggacccccgctc

SEQ ID NO: 33095 - DNA, 201 bp, Homo sapiens
tcccgctgcctcccctcttccaagttcttccggacaacctcagccccagccaaagcagcacgcaggccctcagcctcagctcggccggccttctccgcccrtgccagagcctctagctccatggcctgggcctctagcctcatcttctgctgcagcgaggtctcccgcaggagccggacctcctcctccagccgccgcagc

SEQ ID NO: 33096 - DNA, 201 bp, Homo sapiens; identical to SEQ ID NO: 8595

SEQ ID NO: 33097 - DNA, 201 bp, Homo sapiens
ggaagctactgcccagctctccgttatgaatttgaatcctttctacccctgcattcacctgctcttggtgcagcctctgaacctcttccagctcccgctgsctcccctcttccaagttcttccggacaacctcagccccagccaaagcagcacgcaggccctcagcctcagctcggccggccttctccgcccgtgccagag

SEQ ID NO: 33098 - DNA, 201 bp, Homo sapiens
ggtggccaagacagaagagatggtttcctgccaaagatattgccacctccaggaaattgccagtgagctggaagttcccactattacaagccataaggccrtgttgccatggacaccagaatatctgtagtcagagcacctatcagttgcaaaagccatgcctgcaaccgatggaaaatgtaagagggagttcttaaggtt

SEQ ID NO: 33099 - DNA, 201 bp, Homo sapiens
cgcccgtgccagagcctctagctccatggcctgggcctctagcctcatcttctgctgcagcgaggtctcccgcaggagccggacctcctcctccagccgcygcagctcttgcagctgccgaacgatcacctcagcctgctggctcagggcctgtgacccctccagcccccaggaccttcaaagacaggttagtgcaggtga

SEQ ID NO: 33100 - DNA, 201 bp, Homo sapiens
ggccccagcccctcaccttctcccctagttggggtggaccaaagagcctgcctgttcccgccccacctggggaagtggggaccacgccttctgctccaccvcaacgcaatcggaggaaatctgttcaccgagtgttggcggaactggatgatgagagtgagcctcctgagaacccgccaccggtccttatggagcccagga

SEQ ID NO: 33101 - DNA, 201 bp, Homo sapiens
cttgaacccgggaggcggaggttgcagtgagctgagatcgcaccactgcactccagcttgggcgacagagcgagactccatctcaaacaaacaaacaaacmaaaagcttgcccagggtcacataactggtaagtggtagagctaggatctgaacgagctggagctgggggagagtgagcatgtttgaaaactggaccttag

SEQ ID NO: 33102 - DNA, 201 bp, Homo sapiens
gctctccgttatgaatttgaatcctttctacccctgcattcacctgctcttggtgcagcctctgaacctcttccagctcccgctgcctcccctcttccaarttcttccggacaacctcagccccagccaaagcagcacgcaggccctcagcctcagctcggccggccttctccgcccgtgccagagcctctagctccatgg

SEQ ID NO: 33103 - DNA, 201 bp, Homo sapiens
aaggtccaccgccaaggcaccatcggacacacctgcccatgagtagacacagcagcgagcaaataggtctgataaataccccccttcccttccctccccargagggaatgactacagggaagaaggatggattgatgtggactcattcagggcctggagcagaccctggtggccaagacagaagagatggtttcctgccaa

SEQ ID NO: 33104 - DNA, 201 bp, Homo sapiens
tggttccatgtggcctgtgttggctgcagcatccaggctgccagggaggccgacttccgatgcccagggtgccgggctggcattcagacctaaggtccacygccaaggcaccatcggacacacctgcccatgagtagacacagcagcgagcaaataggtctgataaataccccccttcccttccctccccaagagggaatg

SEQ ID NO: 33105 - DNA, 201 bp, Homo sapiens
aggtggtgcagagggggcaccgcccatgctgccctgcttccaactgctgcgcatagggggcggcaggggcggtgatctctacaccttccacccccccgccrgggctggctgcacctatcgcttgggccacagggccgacctgtgtgatgtggccctgcggccccagcaggagcctggcctcatctctgggatccacgccga

SEQ ID NO: 33106 - DNA, 201 bp, Homo sapiens
gggctggcattcagacctaaggtccaccgccaaggcaccatcggacacacctgcccatgagtagacacagcagcgagcaaataggtctgataaataccccscttcccttccctccccaagagggaatgactacagggaagaaggatggattgatgtggactcattcagggcctggagcagaccctggtggccaagacagaa

SEQ ID NO: 33107 - DNA, 201 bp, Homo sapiens
cccaccatcaacaggtactttggtcaataatgtccgactcccaagaggtcacaggctggaattgagtgatggagacctcctgacctttggccctgaagggyccccaggaaccagcccctcggagttctacttcatgttccaacaagtacgagtcaagcctcaggactttgctgccattaccatcccacggtctaggggaga

SEQ ID NO: 33108 - DNA, 201 bp, Homo sapiens
tagcctgccctcgccccctgtacgctagccggctctactctcccaccactgctcccctagatacccgaggcttcacccagttagcccgtgagctctaaggctgttctgatctcttcatctgtcccttcacctggcccctgtacccccttcccctttggaccccttgaaccctcccaggacccccgctcagccccttcccgc

SEQ ID NO: 33109 - DNA, 201 bp, Homo sapiens
tgcttataaaacaaccggagtgagcatgtcctgctttttacattcatatggctttaaccccattcttctagtgcctaaggatggggaactttcaggctcayactagaggtttttaggcccaccctatgtgtttttaaggacagagtccaggctcaccttagttctcagaccactgtgcctctgtggcctcaccctatgacc

SEQ ID NO: 33110 - DNA, 201 bp, Homo sapiens
gagcaggagtggaagtttattattaaaaagttatagggcagggaaaaaaggaaagtgcacttggaagagatccaagtgggcaacttgaagaacaagtgccraatagcacttctgtcatgctggatgtcagggctctttgtccactttgtatagccgctggcttatagaaggtgctcgataaatctcttgaatttaaaaatc

SEQ ID NO: 33111 - DNA, 201 bp, Homo sapiens
gcttatctatttctctaatctcaaaacatccttaaactgggggtgatacttgagtgagagaattttgcaggtattaaatgaactatcttctttttttttttctttgagacagagtcttgctctgtcacccaggctggagtgcagtggcgtgatctcagctcactgcaacctccgcctcccgggttcaagtgattctcctgc

SEQ ID NO: 33112 - DNA, 201 bp, Homo sapiens
tatgacacctgttacttttttgctgtgtttgtgtgtatgcatgccatgttatagtttgtgggaccctcaaagcaagctggggagagtatatactgaatttrgcttctgagacatgatgctcttcctttttaattaacccagaacttagcagcttatctatttctctaatctcaaaacatccttaaactgggggtgatactt

SEQ ID NO: 33113 - DNA, 201 bp, Homo sapiens
aactgctctagggctgttggctttggatagaatgtccaagcagagtcaggcccgtctctcagctcattgtctaatgtcattctcctttctgtcattcactkgcaggtggtccgagtgtggttctgtaaccggcgccagaagggcaagcgatcaagcagcgactatgcacaacgagaggattttgaggctgctgggtctcct

SEQ ID NO: 33114 - DNA, 201 bp, Homo sapiens
ctcgtgatctgcccacctcggcctcccaaagtgctggaattataggcatgagccaccgcgcccagcaaagaacttctaaccttcataacctgacaggtgtkctcctcgaggccagggtctctctttctgtcctttcacgatgctctgcatcccttggatgtgccagtttctgggggaagagtagtcctttgttacatgcat

SEQ ID NO: 33115 - DNA, 201 bp, Homo sapiens; identical to SEQ ID NO: 8611

SEQ ID NO: 33116 - DNA, 201 bp, Homo sapiens; identical to SEQ ID NO: 8605

SEQ ID NO: 33117 - DNA, 201 bp, Homo sapiens
gggttctcaggaggctcactctcatcatccagttccgccaacactcggtgaacagatttcctccgattgcgttggggtggagcagaaggcgtggtccccayttccccaggtggggcgggaacaggcaggctctttggtccaccccaactaggggagaaggtgaggggctggggccggagcttgctgaggctgcctatggag

SEQ ID NO: 33118 - DNA, 201 bp, Homo sapiens; identical to SEQ ID NO: 8608

SEQ ID NO: 33119 - DNA, 201 bp, Homo sapiens
gggagggagagaggggttgagtagtcccttcgcaagccctcatttcaccaggcccccggcttggggcgccttccttccccatggcgggacacctggcttcrgatttcgccttctcgccccctccaggtggtggaggtgatgggccaggggggccggagccgggctgggttgatcctcggacctggctaagcttccaaggcc

SEQ ID NO: 33120 - DNA, 201 bp, Homo sapiens
aaccttaagaactccctcttacattttccatcggttgcaggcatggcttttgcaactgataggtgctctgactacagatattctggtgtccatggcaacarggccttatggcttgtaatagtgggaacttccagctcactggcaatttcctggaggtggcaatatctttggcaggaaaccatctcttctgtcttggccacc

SEQ ID NO: 33121 - DNA, 201 bp, Homo sapiens
tcctgggctccataaggaccggtggcgggttctcaggaggctcactctcatcatccagttccgccaacactcggtgaacagatttcctccgattgcgttgbggtggagcagaaggcgtggtccccacttccccaggtggggcgggaacaggcaggctctttggtccaccccaactaggggagaaggtgaggggctggggcc

SEQ ID NO: 33122 - DNA, 201 bp, Homo sapiens
ggagtagggagagggagaagatgcttgggctttgagctccctctgggaagaggtggtaagcttggatctcagggtcacaagggccctgcgtgctccctcaytttgcttctcttttgactggcctcccccagggaaggtattcagccaaacgaccatctgccgctttgaggctctgcagcttagcttcaagaacatgtgtaa

SEQ ID NO: 33123 - DNA, 201 bp, Homo sapiens
ctccagcaaaagccagccagaaccaagcagagctgcagaaggagagaagggaaggaaacaatccttcctgacctagagctgcgtctaccctctccggaaayacctgaaagctggggtgggaccacggcccaccgtaggtgtgataggtgcggactggttcatgtggggaaggtggaggagctgagggcactgtgggaggga

SEQ ID NO: 33124 - DNA, 201 bp, Homo sapiens
cctgggggttctatttggtgggttcccctctgcagattctgaccgcatctcccctctaaggagtatccctgaacctagtggggaggggcaggggcagactctaccctcacccatgaagaggagtagggagagggagaagatgcttgggctttgagctccctctgggaagaggtggtaagcttggatctcagggtcacaagg

SEQ ID NO: 33125 - DNA, 201 bp, Homo sapiens
cattccctcttggggagggaagggaaggggggtatttatcagacctatttgctcgctgctgtgtctactcatgggcaggtgtgtccgatggtgccttggcrgtggaccttaggtctgaatgccagcccggcaccctgggcatcggaagtcggcctccctggcagcctggatgctgcagccaacacaggccacatggaacca

SEQ ID NO: 33126 - DNA, 201 bp, Homo sapiens
tcggcgtggatcccagagatgaggccaggctcctgctggggccgcagggccacatcacacaggtcggccctgtggcccaagcgataggtgcagccagcccyggcgggggggtggaaggtgtagagatcaccgcccctgccgccccctatgcgcagcagttggaagcagggcagcatgggcggtgccccctctgcaccacct

SEQ ID NO: 33127 - DNA, 201 bp, Homo sapiens
cagtcaggcctgtctcagctcattctctaatgtcctcctctaactgctctagggctgttggctttggatagaatgtccaagcagagtcaggcccgtctctcagctcattgtctaatgtcattctcctttctgtcattcactggcaggtggtccgagtgtggttctgtaaccggcgccagaagggcaagcgatcaagcagcg

SEQ ID NO: 33128 - DNA, 201 bp, Homo sapiens
tctcccctagaccgtgggatggtaatggcagcaaagtcctgaggcttgactcgtacttgttggaacatgaagtagaactccgaggggctggttcctggggrcccttcagggccaaaggtcaggaggtctccatcactcaattccagcctgtgacctcttgggagtcggacattattgaccaaagtacctgttgatggtggg

SEQ ID NO: 33129 - DNA, 201 bp, Homo sapiens
aagcagaaaccctcgtgcaggcccgaaagagaaagcgaaccagtatcgagaaccgagtgagaggcaacctggagaatttgttcctgcagtgcccgaaaccsacactgcagcagatcagccacatcgcccagcagcttgggctcgagaaggatgtgagtgccatgtctctctgcgggctccatctctttcccctgtcaccac

SEQ ID NO: 33130 - DNA, 201 bp, Homo sapiens
gcagtcaggcctgtctcagctcattctctaatgtcctcctctaactgctctagggctgttggctttggatagaatgtccaagcagagtcaggcccgtctctcagctcattgtctaatgtcattctcctttctgtcattcactggcaggtggtccgagtgtggttctgtaaccggcgccagaagggcaagcgatcaagcagc

SEQ ID NO: 33131 - DNA, 201 bp, Homo sapiens
gaatttgttcctgcagtgcccgaaacccacactgcagcagatcagccacatcgcccagcagcttgggctcgagaaggatgtgagtgccatgtctctctgcrggctccatctctttcccctgtcaccacctcgctttccctagctctggctcctccaactgctctagggctgttggctttggacagaatgtccaagcagtca

SEQ ID NO: 33132 - DNA, 201 bp, Homo sapiens
cacatctagtcacagacccctgtgatgctgttactcagcaagtccaaagcttgcccttgtcacccccttcccacctgcacagatatgcaaagcagaaaccytcgtgcaggcccgaaagagaaagcgaaccagtatcgagaaccgagtgagaggcaacctggagaatttgttcctgcagtgcccgaaacccacactgcagca

SEQ ID NO: 33133 - DNA, 201 bp, Homo sapiens
ctgggggttctatttggtgggttcccctctgcagattctgaccgcatctcccctctaaggagtatccctgaacctagtggggaggggcaggggcagactctaccctcacccatgaagaggagtagggagagggagaagatgcttgggctttgagctccctctgggaagaggtggtaagcttggatctcagggtcacaaggg

SEQ ID NO: 33134 - DNA, 201 bp, Homo sapiens
gaccaggctagtcttgaactcctgacctcaagtgatctacccaccttggcctcccaaagtgaagggattacaggcatgaccactgcgcccggactgctttrcttttttccataatatatatatattttttaaatagaggcagcaggggtgggagaaggggcggcacgggtctcactatgttacccaggctgctttctaact

SEQ ID NO: 33135 - DNA, 201 bp, Homo sapiens
attataggcatgagccaccgcgcccagcaaagaacttctaaccttcataacctgacaggtgttctcctcgaggccagggtctctctttctgtcctttcacsatgctctgcatcccttggatgtgccagtttctgggggaagagtagtcctttgttacatgcatgagtcagtgaacagggaatgggtgaatgacatttgtgg

SEQ ID NO: 33136 - DNA, 201 bp, Homo sapiens; identical to SEQ ID NO: 8602

SEQ ID NO: 33137 - DNA, 201 bp, Homo sapiens
gagagaggggttgagtagtcccttcgcaagccctcatttcaccaggcccccggcttggggcgccttccttccccatggcgggacacctggcttcagatttygccttctcgccccctccaggtggtggaggtgatgggccaggggggccggagccgggctgggttgatcctcggacctggctaagcttccaaggccctcctg

SEQ ID NO: 33138 - DNA, 201 bp, Homo sapiens
ccctcctgcgatcaaacagtggggaggggtggtgggttccgtctccaggaagcagaccctgggcagacttgttccagtcggaacagttagctccttacaakctccagataccttcagaaacagaaatcagacactgactcatgatcggttttcagcacatcagggcacaagcaaacaaaatgccttatttgctgagctgca

SEQ ID NO: 33139 - DNA, 201 bp, Homo sapiens
gagctccccagagcacctgagcctcacgctgctgcttcttccacagacccgctgacattcttcaacacctgcctggacacctcccagaaagaagcggtttyatttgcgctgtctcagaaagaacttgccatcatccatggacctcctggcactgggaaaaccacgactgtggttgagatcattcttcaagctgtgaaacaa

SEQ ID NO: 33140 - DNA, 201 bp, Homo sapiens
tgggcctggtgggggacctgggtaagagaccagcatacagtaccaggtgttgagtgctctgaggaagaaaacccagggccagggtggcagcagggtcaccyacccagatgcagcagtcagggtgggcttcctggaggaagtaacactggagctgagacctgtgggacagaaggtgggagctgggctgggaaggacagggcc

SEQ ID NO: 33141 - DNA, 201 bp, Homo sapiens
agagttgaggctgggcatgtcctggcgagctgcctggaggagtcaggcctgatctgaaggcagtggggtaccctctagggtgtcagcagggctgtgatgtyaccagtcttggctgcagtgtggattaggtaggcggaggctgggaggcagtgggaagtggccgcagggactgtgtggtcagtcagggtggtgccatttcct

SEQ ID NO: 33142 - DNA, 201 bp, Homo sapiens
gaattgattttaaaaccttaaatgaggggccaggtgttgtctttccgtttgcctgagtgacgcgggtcttctccaggacatccggccacagatctgcccamggaggaggactttgaggccctggtttctgccgccgttaaggctgataacacctgcggctttgccaagtgcacagccggcgtcacaaccctgggccagttc

SEQ ID NO: 33143 - DNA, 201 bp, Homo sapiens
actgtctgcaggatctgtcatgatataacctgtattattcctgatactggtttgtgtgctcttttttttcctgctcttctggctggagggttttttttttwaaatttagattttatatatacatacatatatattttaagagacagggtctctgccaggcgcagtggctcacacctgtaatcccagcattttgggatgcca

SEQ ID NO: 33144 - DNA, 201 bp, Homo sapiens
ctctactaaaaatacaaaaattagctgagcatggtggcgggcacctgtattcccagccacttgggaggctgaggcaggagaatctcttgaacctgggaggtggaggttgcagtgagccatggtcactccactgcactccagcctcggtgacaaagcaagactccgtctcaaaaaaaaaaccaaacattttcctgggtgtct

SEQ ID NO: 33145 - DNA, 201 bp, Homo sapiens
ttgagacagggtttcatcatactggtcaggctggtcttgaattcctgacctcaggtgctctgcccgcctcggcctctcaaagtgctgggattacaggcgtragccaccatgcctggcctttgtttttgtttttttttttgagatggagtctcgctctgtcacccaggccggagtgtagtgctgctgtcttggctcactgca

SEQ ID NO: 33146 - DNA, 201 bp, Homo sapiens
ctgctcagacctgcaggggagcatacagatgggcaggctgtgggctctgacctcatggcagtgtctaggggtgaatgtttacagctctgtgagttacaggrtgctctcttagtttgccgtctataggtggcttatgttaaccaactcaattagatccccttccttgtcacaaggacagagggctttctgtatcctgggttc

SEQ ID NO: 33147 - DNA, 201 bp, Homo sapiens
cgcgccaccacgtcctgctaattttttgtatttttagtagagacagggtttcaccatgttggccaggatggtctcgatctcctgacctcgtggtctgcccrccttggcctcccaaagtgttgggattacaggcgtgagccaccgtgcccggccgcagtgtaggtttctgttactgtcattttccgtctaaggagatggaga

SEQ ID NO: 33148 - DNA, 201 bp, Homo sapiens
cccgagagctacttcgacgtggtggtcattgacgagtgtgcccaggccctcgaggcgagctgctggatccccctgctgaaggccagaaagtgcatcctggygggcgatcacaagcagctgccccccaccacagtctctcacaagtaagacccctttgcctcacatgcccttctctgcccccgccctcctgcggtccttcca

SEQ ID NO: 33149 - DNA, 201 bp, Homo sapiens
gtgcgtaacgcacgggcccggcggggaacaccggtccgctgtaacaccggcccggcgcagaagcgggacgtcggcttctaggggcccaggccggcggcggygatggcctcggcagctgtggagagcttcgtgaccaagcaactggacctgctggagctcgagagagacgcggaggtggaggagcgcaggtacgggaggccg

SEQ ID NO: 33150 - DNA, 201 bp, Homo sapiens
catatgtgggtaggatttgtctgagatgcttttgatcatggcaatggagagcttttgcagttatgttgagtttcttagaatcccagctgtttcatttatgsctgtgtgactttgcaggttctgtctctgagccttacttacttcatctgtaaaactgggatgattcccacctcacaggcttgctctgagaatgaaacgatc

SEQ ID NO: 33151 - DNA, 201 bp, Homo sapiens
agaggagagggccaggaggggaacctgtaggttggagtcagacctgagcagagtttgagattttttttttctgagatggagtctcactctgtcgctcaggycggagtgcagtggtgcaatcttggctcactgcagcctcagcctcccgagtagctgggaccacaggtgcccgccaccacgcctggctaattttttgtattt

SEQ ID NO: 33152 - DNA, 201 bp, Homo sapiens
taattttttttagaattaatagagacggggtctcactctgtcactatgttgcccaggctagttttgaactcctggccgcaagcagtcctcctacctcagcytcccaaaatgctgggattacaggtgtgagccaccgtgcttagccatgaattgattttaaaaccttaaatgaggggccaggtgttgtctttccgtttgcct

SEQ ID NO: 33153 - DNA, 201 bp, Homo sapiens
tttggggctgtgattcagccaaacccgccccttggttacttctgggtcagaatccaggggagagttgggtcctgaggtttggggcctgtcctcctcacttsctgtggttcacacctggactctggggctcaggcctgccttccccctttctccctcctgggcgcagggctgcgctggcaggactgtcactcagcctgatgg

SEQ ID NO: 33154 - DNA, 201 bp, Homo sapiens
acgggtgtgcccctgctcttggtggacaccgccggctgcgggctgtttgagctggaggaggaggacgaacagtcgaaagggaaccctggtgagcttgcttscagatggccagcttttttgtttaaacatacctccagctctttaaaaataaaaggcactttaattgcctaattccgggaggagctgagagcagttgttgat

SEQ ID NO: 33155 - DNA, 201 bp, Homo sapiens; identical to SEQ ID NO: 8636

SEQ ID NO: 33156 - DNA, 201 bp, Homo sapiens
tagagacaacatggtttcaccatgttggtcgggccggtcttgaactcctgacctcaggtgatctacctgcctcggcctcccaaagtgctgggattacaggmgtgagccaccgtgcccggtctgtgcactttttatgtcctttgctgttcttggagaacgtcatttttgggaggagtttgttgtctcatccagtcactgccc

SEQ ID NO: 33157 - DNA, 201 bp, Homo sapiens; identical to SEQ ID NO: 8638

SEQ ID NO: 33158 - DNA, 201 bp, Homo sapiens; identical to SEQ ID NO: 8641

SEQ ID NO: 33159 - DNA, 201 bp, Homo sapiens
gctgtgggaggcatttgtgtaatgatgctcttgggggatgagggcaccattggaagcatctcccggttgacacagcacacagggacaggtgttcttcctgygggggcgggggtgcctgcttaagctccccaacttcccagaatccaaacagctgataagagtcctgccctggggttgacacggatgctgaaagatgttggc

SEQ ID NO: 33160 - DNA, 201 bp, Homo sapiens
tttctctttatccaaaaacaactgtccatgggactattgagccggtttctccatgatcctgccactgcgctccagcctgggccatagagcaatttgtttcaaaaaaaaaaaagaaagaaagaaaaatatagtggagctacagtgttcgggagacaactgtgagtccatttgaaacgggaagggttcccttgtccccctcgc

SEQ ID NO: 33161 - DNA, 201 bp, Homo sapiens
agttgaggtcaggagttcgagaccagcctggcccacatggtgaaaccccgtctctactaaaaatacaaaaattagctgagcatggtggcgggcacctgtawtcccagccacttgggaggctgaggcaggagaatctcttgaacctgggaggtggaggttgcagtgagccatggtcactccactgcactccagcctcggtga

SEQ ID NO: 33162 - DNA, 201 bp, Homo sapiens
taagccttttcctcgtgggaggggtcggttctgttgggtggggcctcagtgctgcactgtggccccctgatgtgctccctctctgcctgtgtgccagggamctcccaggtgtggctgccacagaagagacgggtgtgcccctgctcttggtggacaccgccggctgcgggctgtttgagctggaggaggaggacgaacagt

SEQ ID NO: 33163 - DNA, 201 bp, Homo sapiens
ttgctcagctgacaccaccatctccccagttccacgttgaacaggatgcacggccataggagtcaaaaggccttcattgctgatgtgaaattcaagttagytgggcatggctggtcctggggccctgggacacagatgattagctcccaggaagccacctgagtggaggatcagctggccatgatagacagaaacgtgccc

SEQ ID NO: 33164 - DNA, 201 bp, Homo sapiens
gaaacctgcttctcactcccctctggccttttgtaggtgaagttggttttcttgctgaggaccggaggatcaacgtggctgtcacccgtgcccgacgccaygtggcggtcatctgtgactcccgtactgtcaacaaccatgcatttttgaagaccctggtggagtatttcacacagcatggggaagtacgcacggcctttg

SEQ ID NO: 33165 - DNA, 201 bp, Homo sapiens
tcagtgtcctgctgctcagacctgcaggggagcatacagatgggcaggctgtgggctctgacctcatggcagtgtctaggggtgaatgtttacagctctgkgagttacagggtgctctcttagtttgccgtctataggtggcttatgttaaccaactcaattagatccccttccttgtcacaaggacagagggctttctgt

SEQ ID NO: 33166 - DNA, 201 bp, Homo sapiens
ggttacttctgggtcagaatccaggggagagttgggtcctgaggtttggggcctgtcctcctcacttgctgtggttcacacctggactctggggctcaggmctgccttccccctttctccctcctgggcgcagggctgcgctggcaggactgtcactcagcctgatggaacgcctggctgaggagtacggcgcgagggtgg

SEQ ID NO: 33167 - DNA, 201 bp, Homo sapiens
taagtaccatcttccttcaacacagctaatccattcttacatgcctgtcgcacaaaagagagcaacaagtcatggtgtgggtgtggccctcatgggagttkgtggcagcattggggcagaggctcgggcactgaattgcaggtgttctaattttagttttctcccttggcagagccctgattgctctaaagaagtatcatt

SEQ ID NO: 33168 - DNA, 201 bp, Homo sapiens
caggctatcatgcgctgggcctcagacaccatgtaccttgggcagctcacagcccactcttccgtggcaaggcacctcctgaggtgagtagctcggcaccrcccgccgccccatccttctgccctggctaatcctctgcgtcacctgtttctacgcagcaagctaaagtgaagctttctgcatgaaagtcgactctgaggc

SEQ ID NO: 33169 - DNA, 201 bp, Homo sapiens
gaaacgtgcccgaaacacgtgttggtggtggatgcccacttggggcgaccttgtgctgctcacccgttctttctttccctccaggcgaagtccgcctcgtyagtttgcacatccaggctctggtggacgctggtgttccagcccgtgacattgctgtggtctcgccatacaacctccaggtacgagggtttccttttgtcc

SEQ ID NO: 33170 - DNA, 201 bp, Homo sapiens
gagctgagagaggccaggcagtggaagcagacacccatgaccctgcagggatggtgtgggggttgtccttcctggggcgcctgagggtgcaggctgcagaktgggagggcagctacagctgcacccaagagctcccgacccaccacctcagaagaggccaggctcctgcttgttcccggctcctgcctgcttcgtggagca

SEQ ID NO: 33171 - DNA, 201 bp, Homo sapiens
cggctgtcataagccaaaagaaatgatcaaatgccagggacagggtgtggtattggcgtgcatgcgtgcccgtgaggagggcgaacgggaagcctttcccyatggggctcctgcaggctccgcttcccaggtcctggctgtttcacagcgtgaggccctctgctgagctgaagggcagggtcttgctgcgctggcatgggt

SEQ ID NO: 33172 - DNA, 201 bp, Homo sapiens
ggccagaaagtgcatcctggcgggcgatcacaagcagctgccccccaccacagtctctcacaagtaagacccctttgcctcacatgcccttctctgccccygccctcctgcggtccttccacgctcagccaggagccccaggctcaccaggagcccctgcggtgcctcctcggtttctcggcacagctcctaccccgtctt

SEQ ID NO: 33173 - DNA, 201 bp, Homo sapiens
agtcctttggggacagcacagaagtgaatttattgattgaggggcatattgggtgtctgctgggtgccacactggtttctggcagtgtgctcatggtgcascttctgtccttagtaagttcacgtcaggcaaagcacaggcaagagagtctgcagaggctcagaggcgtgagtgtgctgtcagggagcaggtggctggggt

SEQ ID NO: 33174 - DNA, 201 bp, Homo sapiens
tgctatctcatttgccttttggttttttagaagtgttatatagtttctagatagttgggaaatgtccagatatctttctgttgttgatctctcctctcctctcccctcccctccccgtccccgtccccgtcctgtgtgggatctcactgtgttgctcctctcctctcctctcttcttctctcctctcctcatccctgtccc

SEQ ID NO: 33175 - DNA, 201 bp, Homo sapiens; identical to SEQ ID NO: 8633

SEQ ID NO: 33176 - DNA, 201 bp, Homo sapiens
tgacctcaagtgatctgcctgcctcggcctcccagagtgctgggattggtgtgagccaccacgcccagtctcctataatattcttgtgcttggttttgggaagcagtaaagttacttgtaaacagtttaatccttttgagtcttgcttttgagatgtgttagggtctggatcagtgcttagtccagggttaatattcccct

SEQ ID NO: 33177 - DNA, 201 bp, Homo sapiens
ggttctttttttttttttttttttttgagacagcatctcactctgttgcccaggctgtagtgcagtggcacaatcttgattcactgcagcctcctcctccygggttcaagtgattcttgtgcctcagcctcctgagtagctgggattgcaggcgcatgccaccaggcccagctaattttttttgtatattttgtagagact

SEQ ID NO: 33178 - DNA, 201 bp, Homo sapiens
ctaggattacaggagtgagccaccacacctggctagattctaattggctttgtagttattgctttatccagttgtgttttaaatcagacaggagaaaaaargggtcacaagcagaaaatacatttatggggtcttttatatctacccatgtagttgcctttatttcttcatgtagatttgagttactctctccaaaggact

SEQ ID NO: 33179 - DNA, 201 bp, Homo sapiens
attttaaaaaaattttaaataactggctgggggggttgttatttgagatgggagagtaaatgcagtccctgctattccatcttgggcagaggtggaggacrcacattctctcttgtagccaggagagagcactcccgttacagagctgtgtaccttgtgactgttgtgggaatcttgtcaaccactcttttggggtttagg

SEQ ID NO: 33180 - DNA, 201 bp, Homo sapiens; identical to SEQ ID NO: 8634

SEQ ID NO: 33181 - DNA, 201 bp, Homo sapiens
ccgccgctctcccgccaggcagcctgcagggtgaaggactgacatggcgggaggagtggccttctctgttggggcgcctgtggccccccagctctttgatrggcagagctgcaggatctgcctccttgcccctgtgagcccagcagtgattcttgtgtcctccccagatccatggctgcggtgagagggctcgcgcccatg

SEQ ID NO: 33182 - DNA, 201 bp, Homo sapiens
tctcatctgaaacttgcctggaaaggatctttcttcaggctcacgtggttgttggcagcattcagttccctgtgggttcttgctgggtgttggctggaggscgctcttagctgtttgcccttaggccttgccaacatggctgcttgcttcctaaaagccagcaagagacacagtctcctagcacaatgggttatcgtctta

SEQ ID NO: 33183 - DNA, 201 bp, Homo sapiens
tgtgcagccacagccagggttccctgctgcagccggcatgatggcagcagccactgccatcagaacctccctgggagcagggaggacaggcgtgggaggaygcttattcagtggcttcttccagggagaggttctcgagatgtccttaaaggaggtcttcatcctctggaaagcctttgggtggaggaagtttggaactgt

SEQ ID NO: 33184 - DNA, 201 bp, Homo sapiens
gtgtgcacctgtaatcccagctactcaggaggctgaggcaggagaatcgcttgaacctgggaggcagaggttgtagtgagcccagatcatgccactgcackccagcctgggcgacagagggagaccctgtctcaaaaaaacaaaacaaaacaaaacaaaactttatatagcctggatagaagtcttttatcagatgtatga

SEQ ID NO: 33185 - DNA, 201 bp, Homo sapiens
tttgggggaggacgttgggtgacgttgcgctgagtgttttgggtttgcagttggtactgatcatcgcgtcctgtcctcattttgttggaattaaaaatacrttaatcacagaggtctggtaagtttccagagggaaggtctctgaagtggagctgggtactgccccagggttttggtggggttggtgagccgtagtggtgc

SEQ ID NO: 33186 - DNA, 201 bp, Homo sapiens
ttaattttttggagatggagtctcactctgttgctcaggctggagtgccgtagcgtgatctcggcctgctgcaacctccgtctcctaggttcaagcgattstcctgccttagcctcctgagtagctgggattacaggcgtccaccaccacgcctggctgatttttgtatttttagtagagatggggtcaccatgttggcca

SEQ ID NO: 33187 - DNA, 201 bp, Homo sapiens
cactgtccccttccactcaggactctgtctgcctcccgctgccattcatggccctggggcttggctccaatcccactctgagatccgagtgggtgctgggmgctgagagaggccaggcagtggaagcagacacccatgaccctgcagggatggtgtgggggttgtccttcctggggcgcctgagggtgcaggctgcagagt

SEQ ID NO: 33188 - DNA, 201 bp, Homo sapiens
agctgcctgctgtagacggtatgtaaatcaatgggtgtggctgtgctccagtaaaactcaccaaaaccggcagctgactggatgtggcccacagtttgcckattcctgttcaaggagaaaccttgtgaaaataaagcagacttaattttgtgttgattgggttgcccctggggaggtccggcgtgttcctgacaggcatca

SEQ ID NO: 33189 - DNA, 201 bp, Homo sapiens
agatgctgccatggccgccgccatcttcccgcagcctcggccggaaacggaaacgacgcgaaccgcgtgcgtaacgcacgggcccggcggggaacaccggyccgctgtaacaccggcccggcgcagaagcgggacgtcggcttctaggggcccaggccggcggcggcgatggcctcggcagctgtggagagcttcgtgacc

SEQ ID NO: 33190 - DNA, 201 bp, Homo sapiens
ttactctagagcaggggtttttcctgtaaagggatggattgtgaatgttttgactctgtgggccatatcatacgtaccgtctacagctgcctgctgtagayggtatgtaaatcaatgggtgtggctgtgctccagtaaaactcaccaaaaccggcagctgactggatgtggcccacagtttgccgattcctgttcaaggag

SEQ ID NO: 33191 - DNA, 201 bp, Homo sapiens
ccctgcttggccacctcccgagttgtcagtctcatcacttcctgggcagcgcgttccgtttggggacccttaagaagcactttgatttcccgacccgagaycccccactaagcttacactcctgggccctggccccgaccccagttccacccgcagcgagttagcagccctttcccttattcattcagtaaacatggtttg

SEQ ID NO: 33192 - DNA, 201 bp, Homo sapiens
ggtggctttggccaagcctcatgcaagggttaccccacagctattttctatcatactgtgctaggcaagccagtgttgtgttagcttcaaacacacaggaygactttgtagcactctttcagcatgcagtccctcaagatgtgttgtttttaaatactcattttctttctgcattttcctttggaaattctaaatgcagtc

SEQ ID NO: 33193 - DNA, 201 bp, Homo sapiens
cttccaggtcctggcaggagaacatctctctgaaagagctccagagccgaggcgtgtgtttgctgaagctgcaggtatccagccagcgcactgggctgtayggacggctgctggtcacctttgagcccaggcgatacgggtccgcggcagctcttcccagtaacagctttacttctggtgtgtgcgtattgacctagacag

SEQ ID NO: 33194 - DNA, 201 bp, Homo sapiens; identical to SEQ ID NO: 8623

SEQ ID NO: 33195 - DNA, 201 bp, Homo sapiens
tgatattgaagctttccccagtgtcttgtgtcactgagtctttgtttttgcaggtgatatcgtgggcctgtacgatgctgctaatgagggcagtcagctgkccactgggatcttgacccgggtcacccagaagtcggtcacggtggcctttgatgagtcccacgatttccagttgagcttggaccgagagaattcctacag

SEQ ID NO: 33196 - DNA, 201 bp, Homo sapiens
tcacagccggtcccagcatggccagtgagggtcgggtgttaggagtgctcagtctcagcagctatagcactgcggtccccagccacttcccctccccaccstcaggatgccaagcttggtgcgggcaatgccttttttttttgagacggagtctcgctctgtcacccaggctagagtgcggtggcatgatctcagctcact

SEQ ID NO: 33197 - DNA, 201 bp, Homo sapiens
cgccccctccaacatcgccgtggacaatctggtggagcgcctggctctgtgtaagcagcggattctgcgcctgggacaccctgcccgcctcctggagtccrttcagcagcactccctggatgcggttttagcgcggagcgacagtgcccagattgttgcagatatcaggaaggacatcgaccaggtctttgtaggtgtcat

SEQ ID NO: 33198 - DNA, 201 bp, Homo sapiens
tcatttatggctgtgtgactttgcaggttctgtctctgagccttacttacttcatctgtaaaactgggatgattcccacctcacaggcttgctctgagaaygaaacgatcccctgtcagtcaggtgctcagcgtggtgccaaggacagagtcagcccccatggcagtggctctttctgaggatgctgagcagactggcagg

SEQ ID NO: 33199 - DNA, 201 bp, Homo sapiens
tttgtgactctcagctttcacttcccgtttgtgcagtgcgttgagctgagccacagatgagagctgagggcctcccgaggtctttcctgagccctgtacawgtgtgtggccttctagattcccaggaatatgttggagcttttcaaagccccctgaggatatctcattccccagcttaaaactttggttatcctatcattt

SEQ ID NO: 33200 - DNA, 201 bp, Homo sapiens
ttttcaaagccccctgaggatatctcattccccagcttaaaactttggttatcctatcatttgctccgaccattattctctgtcttagaaaactgtgatgktcaacaattacctctgattgtttttgacagacaccaccagggaaaaggctgtttgtattacatgagctcagataaagtcttttgagtgtggtctaccaga

SEQ ID NO: 33201 - DNA, 201 bp, Homo sapiens
caacacagctcgcccccgccctgtgccgagcaggccaagggtgggccaagggcgggcctagggcaggcctgctctgtttaccttggtttgtttggagctgccccagagggatcccagagtgggctgaagggcaccacgctgctttgggaggttttaggcccacgttatagccctggcacttaaaaggaattgtggtcacca

SEQ ID NO: 33202 - DNA, 201 bp, Homo sapiens
cctctggctgtcctctcgccttctctgactgagcccagggcttttatggacctcaagagggaaggaaggatgtgccaattggtccatgggtggccatgggygggcctggaataggtaccatgagtcctcactctggtccacaggactggcagcccagctgccagccttcaggcccttcctggccttccactgtccccttcc

SEQ ID NO: 33203 - DNA, 201 bp, Homo sapiens
gtcgtcttttgtcttttgagtgtgtgattatcatgtgttaggtgtggatctctgtgagtaaattacatggagtttgtggaccttcttggatgtttagattsgtgtttttcatcaaatttggggagttttcagccattattttttcaggtattctttctgcccttattctactctcgtctccatctacaactcccattatga

SEQ ID NO: 33204 - DNA, 201 bp, Homo sapiens
ctgcagctgcacgcggaaaggcagatcctacctgttcccggctcccctaagagcaccgggagacgcagatccacagctgcagtttgggcggctgtagcccygcccttctggagcaggaggcctgggtctgtagctgtgaccctgtgtctgggctgcagcggccactctacctcagaaggggcggggctcccactggcttca

SEQ ID NO: 33205 - DNA, 201 bp, Homo sapiens
cccatctcctggtcttttccggctcctagaggccattgcttgacttgttgccctttcctctgtctatgaagccagccgtgttacgtcttcaaatctctccyctcggtgaccttctctgactgaccctcgcatgcccccttataagacccttgggttatcacctgggtcatccagggtcgcctccccatcccaggatcctta

SEQ ID NO: 33206 - DNA, 201 bp, Homo sapiens
cagactcaccggcttaaaatcaaggtgtgggtggggttgcttcttctggaggatccaggggaaaacccatctcctggtcttttccggctcctagaggccaytgcttgacttgttgccctttcctctgtctatgaagccagccgtgttacgtcttcaaatctctcccctcggtgaccttctctgactgaccctcgcatgccc

SEQ ID NO: 33207 - DNA, 201 bp, Homo sapiens
gagagcagttgttgatggccgtgaaaaaacggagccccacactgcaagaggctgagcagcatcgttttctccagggtgagcagaccgctcctgggtgagaygggcctggcagcattttacggccttctcctgaatggtggcccagctctgcctggctggtctggtgatgggaactgtcattgctcagctgacaccaccatc

SEQ ID NO: 33208 - DNA, 201 bp, Homo sapiens
atggtgggccacgcgcaggggactacacttttggtggtggttactgataagggcgtaggagcctgactgtgtttcttagtctgaaacctgcttctcactcmcctctggccttttgtaggtgaagttggttttcttgctgaggaccggaggatcaacgtggctgtcacccgtgcccgacgccacgtggcggtcatctgtgac

SEQ ID NO: 33209 - DNA, 201 bp, Homo sapiens
aggagtcaaaaggccttcattgctgatgtgaaattcaagttagctgggcatggctggtcctggggccctgggacacagatgattagctcccaggaagccayctgagtggaggatcagctggccatgatagacagaaacgtgcccgaaacacgtgttggtggtggatgcccacttggggcgaccttgtgctgctcacccgtt

SEQ ID NO: 33210 - DNA, 201 bp, Homo sapiens
aatgatcaggacatcctgccgaggaggtgaagccccctgcagcccagagctggcctttagcctccatgcacggagccgcggggtgtggtggtcgtggctgyggtttctgtgctgctgtggtgtgtgggctttcccatttgggatgagcattgttcccagaagcaggtttagtgaacgggctttgtgagacattctcagaag

SEQ ID NO: 33211 - DNA, 201 bp, Homo sapiens
ccggcagctgactggatgtggcccacagtttgccgattcctgttcaaggagaaaccttgtgaaaataaagcagacttaattttgtgttgattgggttgccyctggggaggtccggcgtgttcctgacaggcatcactcatcccccggggcacacactctctgaggaggaacacccacagagctccccagagcacctgagcc

SEQ ID NO: 33212 - DNA, 201 bp, Homo sapiens
ctcccggctccctgtttccaccaggtgcgtctgccgatggccccctgaagttgctgcccgagagctacttcgacgtggtggtcattgacgagtgtgcccargccctcgaggcgagctgctggatccccctgctgaaggccagaaagtgcatcctggcgggcgatcacaagcagctgccccccaccacagtctctcacaagt

SEQ ID NO: 33213 - DNA, 201 bp, Homo sapiens
ccagtctggagtgcagtggcatgatctcggctcactgcaacctccgcctccggggttcaagtgattctcctgcctcagcctcccgagtagctgggattagrggcatgcgccaccgtgcctggctaattttgtatttttagtagagacggggtttctccatgttgttcaggctggtctcgaactcccaacttcaggtgatcc

SEQ ID NO: 33214 - DNA, 201 bp, Homo sapiens
gagactctgcctcctctgctggttgccacctcctcttttttttttcctcagagatggggtctcactatgttgtccagggtggtcttaaactcctgacctcscaccttggcctcccaaagtgctgggattacaggcatgagccaccgtacttggccagcgtctcacttttaatagtggagctgtggctgggtgcagcggctc

SEQ ID NO: 33215 - DNA, 201 bp, Homo sapiens
cccctgcgcagacagagcagcctcccagggagcagcgtggcccagaccagcctgatctgaggacgctgcacctggagagactgcagagggtcaggagcgcrcaggggcagcccgccagcaaggagcagcaggcctcagggcagcagaaacttccagaaaagaaaaagaaaaaagccaaaggtaagtcaactaataagaact

SEQ ID NO: 33216 - DNA, 201 bp, Homo sapiens
atcgtgggcctgtacgatgctgctaatgagggcagtcagctggccactgggatcttgacccgggtcacccagaagtcggtcacggtggcctttgatgagtyccacgatttccagttgagcttggaccgagagaattcctacagactgttaaaacttgccaatgatgtcacttacaggcgactgaaaaagtaagtggatggg

SEQ ID NO: 33217 - DNA, 201 bp, Homo sapiens
gagccgaggcgtgtgtttgctgaagctgcaggtatccagccagcgcactgggctgtacggacggctgctggtcacctttgagcccaggcgatacgggtccrcggcagctcttcccagtaacagctttacttctggtgtgtgcgtattgacctagacagacattgaaatttactggcattcagaccgtgacttgtaccctcg

SEQ ID NO: 33218 - DNA, 201 bp, Homo sapiens
cttccatcacgtctcctttgctcactcttcaaggccccagctgctcactgttttggtcaccttgtctctactcgcttcactgtgtgtctttctctcctaaygcgtgagtctgtacttgaacatagcattggaggggtggtttcatgtaggtaggtagaatggagtaagtcccactgcttttgtaaaaactttcctgcctac

SEQ ID NO: 33219 - DNA, 201 bp, Homo sapiens
ctgccgaggaggtgaagccccctgcagcccagagctggcctttagcctccatgcacggagccgcggggtgtggtggtcgtggctgtggtttctgtgctgcygtggtgtgtgggctttcccatttgggatgagcattgttcccagaagcaggtttagtgaacgggctttgtgagacattctcagaaggcagaaagcaggtga

SEQ ID NO: 33220 - DNA, 201 bp, Homo sapiens
ggtcggacccaggcacatacgtggcgagaccgcagggagcagcgctcgctctgcgtcctcccttcctcccatatcccaggtctcacctgctccgggccccraaggtctcaggatgctgtggctgcacgcggacgccagccgccctaaggtgaccgtcagggaagatgctgccatggccgccgccatcttcccgcagcctcg

SEQ ID NO: 33221 - DNA, 201 bp, Homo sapiens
gtgaagccccctgcagcccagagctggcctttagcctccatgcacggagccgcggggtgtggtggtcgtggctgtggtttctgtgctgctgtggtgtgtgrgctttcccatttgggatgagcattgttcccagaagcaggtttagtgaacgggctttgtgagacattctcagaaggcagaaagcaggtgaggcctggctag

SEQ ID NO: 33222 - DNA, 201 bp, Homo sapiens; identical to SEQ ID NO: 8635

SEQ ID NO: 33223 - DNA, 201 bp, Homo sapiens; identical to SEQ ID NO: 8637

SEQ ID NO: 33224 - DNA, 201 bp, Homo sapiens
aagttgtcctgggcaaaatgctcagaaccacaggggctggctgagcgcaaaaccattcttgcccttgggccatgtggagtccctgggtgggctctgccccrtttgccacatcctgcattgtgcccaccccgcaggagctggctaggcgtgcagtgggagttggccaggcatacgctggcagagcgtgtagcggtcttgggg

SEQ ID NO: 33225 - DNA, 201 bp, Homo sapiens
agaagcgggacgtcggcttctaggggcccaggccggcggcggcgatggcctcggcagctgtggagagcttcgtgaccaagcaactggacctgctggagctygagagagacgcggaggtggaggagcgcaggtacgggaggccgccggcgccgctccctcgcggtcggtcccgccgtgtcccgggcagagtctccgaggggc

SEQ ID NO: 33226 - DNA, 201 bp, Homo sapiens
tgaggagtacggcgcgagggtggtgcggacactgacggtgcagtaccgcatgcaccaggctatcatgcgctgggcctcagacaccatgtaccttgggcagytcacagcccactcttccgtggcaaggcacctcctgaggtgagtagctcggcaccacccgccgccccatccttctgccctggctaatcctctgcgtcacct

SEQ ID NO: 33227 - DNA, 201 bp, Homo sapiens
gggaggagctgagagcagttgttgatggccgtgaaaaaacggagccccacactgcaagaggctgagcagcatcgttttctccagggtgagcagaccgctcytgggtgagatgggcctggcagcattttacggccttctcctgaatggtggcccagctctgcctggctggtctggtgatgggaactgtcattgctcagctga

SEQ ID NO: 33228 - DNA, 201 bp, Homo sapiens
gggaagacacatgagctgctttttaattttttttagaattaatagagacggggtctcactctgtcactatgttgcccaggctagttttgaactcctggcckcaagcagtcctcctacctcagcctcccaaaatgctgggattacaggtgtgagccaccgtgcttagccatgaattgattttaaaaccttaaatgaggggcc

SEQ ID NO: 33229 - DNA, 201 bp, Homo sapiens
ttttgtatttttagtagagatggagtttcaccacattggccagtctggtctcactcctgacttcagttgatctgcctgcctcagcctcccaaagtgctackattacaggcatgagccactgtgcccggcccagttacatttttaatggctgaaaaaggatcttttatcatcatctgcatcagcttgagtcattgtggatct

SEQ ID NO: 33230 - DNA, 201 bp, Homo sapiens
gggttgcagcttgaagggagaacagcagacagaaggaagcctttccagcttgaccaggcaggcagctgtgaggtgctatggtgactgagagcaaaaaccartgggatcccagctcatctacttcctagctgtgtgtctttaggccggtcacttcacctctctgaacttcattttctttgtctgaaaagggagggtagcaat

SEQ ID NO: 33231 - DNA, 201 bp, Homo sapiens
gcccagtcaacccctccagatgcttggctacctgtcagccaggggtgtagtaagtattcttcacagcctcctctgccagccttggccacgacacttggggratgtggaggcacaagttcagggcagtgtatggtacactttaattcaatttctgacaaaatatcccactggctccagacctcattaatgatgaaccaaatg

SEQ ID NO: 33232 - DNA, 201 bp, Homo sapiens
aagctaagggtgagccaatgaagggggaaaataaagactagagttgagggttgagataaaattccatggcaagatatgggctctggaggtaaagaggagcmcaagcatgaaggattttctatgccatatttggttacagatatttcacatgcacagcttttttaaaaactcaaggacagttgcataatatcaaggggctta

SEQ ID NO: 33233 - DNA, 201 bp, Homo sapiens
ctatgaaaagacatggaggaaatgtaaatgcatattactaagtgaaagaagccaatgtgaaaaggtcacacactgcatggctccaactgtatgacattctrgaaaaggcaaaactatggagaaagtacaaagataagtggttgccagagggtgaggggacagagggatgaataggcagagcacagaggatttttagggcaa

SEQ ID NO: 33234 - DNA, 201 bp, Homo sapiens
aaaataagcaactactgtactgaggaacagggctgtggcaaacaaatgacactcatttttgaatgagtgagtgaattcaagattcagtgaatgaatgaagygcagtgtattgtgctatcctggtctggaggatgagagaaggctttctagaagaggtgataggacacctggaggatgaataaatttagccatgtgaagtgg

SEQ ID NO: 33235 - DNA, 201 bp, Homo sapiens
ttattcctcaacttgtttatcaggcaagtcctctctgccagacactcagcctggtgctggggatttaaaaatggaacagtcctttttctcaggagcttataattaatgaggcagatgcacagttgcgggatgggtggaaaagctttgctggtgccctctgtcatgctaacagtgaggtttttctacttctgagggtgggag

SEQ ID NO: 33236 - DNA, 201 bp, Homo sapiens
tattcctcaacttgtttatcaggcaagtcctctctgccagacactcagcctggtgctggggatttaaaaatggaacagtcctttttctcaggagcttataattaatgaggcagatgcacagttgcgggatgggtggaaaagctttgctggtgccctctgtcatgctaacagtgaggtttttctacttctgagggtgggagt

SEQ ID NO: 33237 - DNA, 201 bp, Homo sapiens
attcctcaacttgtttatcaggcaagtcctctctgccagacactcagcctggtgctggggatttaaaaatggaacagtcctttttctcaggagcttataattaatgaggcagatgcacagttgcgggatgggtggaaaagctttgctggtgccctctgtcatgctaacagtgaggtttttctacttctgagggtgggagtt

SEQ ID NO: 33238 - DNA, 201 bp, Homo sapiens
ttcctcaacttgtttatcaggcaagtcctctctgccagacactcagcctggtgctggggatttaaaaatggaacagtcctttttctcaggagcttataattaatgaggcagatgcacagttgcgggatgggtggaaaagctttgctggtgccctctgtcatgctaacagtgaggtttttctacttctgagggtgggagttt

SEQ ID NO: 33239 - DNA, 201 bp, Homo sapiens
attgtgcaaggcttctaggcttggaagtaattagcatcccttctgctattctattagccatagcaagtcacaagaccagtacagattcaagggtattcctytcagtgaaaggagctgcaaagtcacattgcaggggatgtggacactgggagaagaaaaattatggccatttttgcattctgctacccagtttcaatagct

SEQ ID NO: 33240 - DNA, 201 bp, Homo sapiens
aattcctaaacccttgggaggccaaggcaggcggattgctggatctcaggagtttgagacctgcctaggcaatatgacaagaccctgtctctaccaaaaayacaaaacactagccaggcatggtggtgtgcacctgtggtcccatctacttgggaggctgaggtgggaggatcatttgagcctggagtggggtggaggttg

SEQ ID NO: 33241 - DNA, 201 bp, Homo sapiens
agatgtgatcactgaattttagagaagtggcttgggaaactggagtcattttttttctttttaatttttatttcattattattttttaacttttattttasgtttggggctacatgtgaatgtttgttgcgtaggtaaacatgtgtcatagggatttgttgtatacattattttattacccaagtatcaaacccattaccc

SEQ ID NO: 33242 - DNA, 201 bp, Homo sapiens
ccagaatatgacagccactaagtggcagagtgaagttttgaactccagtctctctgatcttaaatccttgactaaaacccactccattatcctatggatgytactgaaaaacaaaaaaaaaattatcccctgcctcctgttttcagcatatgcttataaagtctggcccatctttggcctctgggaaatctatttctagaa

SEQ ID NO: 33243 - DNA, 201 bp, Homo sapiens
tccctggagggctgagagagactcccagtgaaacgccagggagctggagttcgtggtggggggatttaactacttattagaaaaacctgaatgtgaacackgagtatattaaggaacaaggagatgaggcgaggtttggagtggagagagagagagagagagagagagagagagaggagatactggagcttcacattggaa

SEQ ID NO: 33244 - DNA, 201 bp, Homo sapiens
tgtctcaggagtttcaggtctctgcatgttttcttttactcagttgtttaaccagtactttttgagcacccactgtgtgatggcactgtactagcacacawatgcagagagcactgtatacacatactccataaaaatactgtatactcagcattttactgaggctgggagaagtaaagtgagttccccagaatatgacag

SEQ ID NO: 33245 - DNA, 201 bp, Homo sapiens
gcaggactgcttcagcccagaaaaaggtgtactatctcttttctaatctttctggccagaaagggcacctttttctaattcttgacccataaggagcacctttttttttcatttaaaaaatttaattattatggctacataatagttgtatatatttacagggtatatgtgatgtttccatacaggcatacactatgtaag

SEQ ID NO: 33246 - DNA, 201 bp, Homo sapiens
ttggaatcgttgatgttcaatggggacactgagacctccagcttccagatgtgaggagctgcttttttctttctgaaatgcatctcacacttgactctccrttcacatcacaagggtagattttaaaatgtcattgccctggccccacttttcccaaataaagcagaatatctataggaaaagggaggaggagccaggtac

SEQ ID NO: 33247 - DNA, 201 bp, Homo sapiens
attgccctggccccacttttcccaaataaagcagaatatctataggaaaagggaggaggagccaggtacaatgtctcgcgcctgtaatcctagcactttgsggggccgaggtgggcagatcacctgaggtcaggagttagtgatcaccctggccaacatagtgaaaccttgtctctattaaaaatacaaaaattagccagg

SEQ ID NO: 33248 - DNA, 201 bp, Homo sapiens
ggcagaaccaagaaaactcgaatctgaatcagtcagcttaggctgtgggggccagggtgggatggtgtggaagagatgctatttgtgaagtaggcaggacsggggtgtaaaaaacactgtcatccatgtcaaagagtttagatccattcaaagaaatgggatttttaaacatgcaggagaggttggtattttcaggcacca

SEQ ID NO: 33249 - DNA, 201 bp, Homo sapiens
tgtatatgtgccacactttcctaatccagtctatcattgatggacatttgggttggttccaagtctttgctattgtgaatagtgccgcaataaacatacaygtgcatgtgtctttatagcagcatgatttataatcctttggttatatacccagtaattggatggctgcgtcaaatgatatttctagttttagatccttga

SEQ ID NO: 33250 - DNA, 201 bp, Homo sapiens
tgtagacgtgtgtgttatttctgagggctctgttctattccattggtctatatctctgttttggtaccagtaccatgctgttttggttactgtagccttgyagtatagtttgaagtcaggtagcgtgatgcctccagttttgttcttttggcttaggattgtcttggcaatgcgggctcttttttggttccatatgaactt

SEQ ID NO: 33251 - DNA, 201 bp, Homo sapiens
tgcctccagttttgttcttttggcttaggattgtcttggcaatgcgggctcttttttggttccatatgaactttaaagtagttttttccagttctgtggaraaagtcattggtagcttgatggggatggcattgaatctataaattaccttgggcagtatggccattttcatgatattgattcttcctatccatgagcatg

SEQ ID NO: 33252 - DNA, 201 bp, Homo sapiens
accaacactttataattggaagattctgcaatacagaaatacagttttctagttcctctgtagagtcagaaggtctgtcttctctgggcctattttcccaygagcaaccatcccctggagctgaggagttgccaagcatttagacagagtgctccagttggccttaggacctgtccagcctgctctacccacttacaaagc

SEQ ID NO: 33253 - DNA, 201 bp, Homo sapiens
gcctccagttttgttcttttggcttaggattgtcttggcaatgcgggctcttttttggttccatatgaactttaaagtagttttttccagttctgtggaaraagtcattggtagcttgatggggatggcattgaatctataaattaccttgggcagtatggccattttcatgatattgattcttcctatccatgagcatgg

SEQ ID NO: 33254 - DNA, 201 bp, Homo sapiens
gtgtctctgccaggctttggtatcaggatgatgctggcttcataaaatgagttagggaggattccctctttttctattgattggaatagttacagaagaartggtaccaactcctttttgtacctctagtagaattcggctgtgaatccatctggtcctggactttttttggttgctaggttattaattattgcctcaatt

SEQ ID NO: 33255 - DNA, 201 bp, Homo sapiens
ttgggagggtctatgtgtccaggaatttatccatttcttctagattttctagtttatttgtgtagagtgtttatagtattctctgatggtagtttgtattwctgtgggatcggtggtgatatcccctttatcattttttattgtgtgtatttgattcttctctcttttcttctatattagtcttgctagtgatctatcaat

SEQ ID NO: 33256 - DNA, 201 bp, Homo sapiens
gagggtctatgtgtccaggaatttatccatttcttctagattttctagtttatttgtgtagagtgtttatagtattctctgatggtagtttgtatttctgwgggatcggtggtgatatcccctttatcattttttattgtgtgtatttgattcttctctcttttcttctatattagtcttgctagtgatctatcaattttg

SEQ ID NO: 33257 - DNA, 201 bp, Homo sapiens
aagtccagtttggtcccatccacagcccggagctcacccatgaaagggtgttcccgcagctcctcctatgccagcacccgatcctccagtcactcgtcccratccccaaatcccagggcttcccccaggtacacccaaagccgatccacctcttctgaaaaaaggtgagtgtggttttgacctttgctctgcagcaccttt

SEQ ID NO: 33258 - DNA, 201 bp, Homo sapiens
tctgccttcatttcgttatgtacccagtagtcattcaggagcaggttgttcagtttccatgtagttgtgcagttttgagtgtgtctcttaatcctgagttytaatttgattgcactgtggtctgagagacagtttgttgtgatttctgttcttttacattttctgaggagtgctttacttccaactatgtggtcaattttg

SEQ ID NO: 33259 - DNA, 201 bp, Homo sapiens
gagcttgggggagtagacaggaggcatccaaccagcctgagggactcagaaaatgttacaaggagaagacggcctccaactggagcactgaagaatgagamgaagctacatgggtgatgctgtttgactctgagcaacttaatcaacttctctgatcgtcagtgtttttgtaaaatggttgttaatagtactccacagggc

SEQ ID NO: 33260 - DNA, 201 bp, Homo sapiens
gtcttggagttgctcttcttgaggagtatcttgtggcgttctctgtatttcctgaatttgaatgttggcctgccccgctaggttggggaagttctggatartatcctgaagagtgttttccaacttggttccattctccccgtcactttcaggtataccaatcagacatagatttggtcttttcacatagtcccatatttc

SEQ ID NO: 33261 - DNA, 201 bp, Homo sapiens
ccatggcaaggcagagttatttaaaaacatggaattattaattcgtggtcacatcatgtccctgagatagtagtaattacttaaatgtttctgagctgtastttcctcatctgtaagaaataataataaaataataataatatagataataacagtctcttcttcagaaggcagctgttgagcccagtacttgatacaggt

SEQ ID NO: 33262 - DNA, 201 bp, Homo sapiens
aattttcatagtctctgaaatctaagagaggaggaggattagctaggtgtcccgaccccctgtagcgtgatcacaaacatgctgataccttcataccaggaaaaaaaaaaactttcaaactcacctatatttacgttttcccctccctcccttccttcaccatccctccctttcttccttcctcctttctctccttctctc

SEQ ID NO: 33263 - DNA, 201 bp, Homo sapiens
ggaggaaccaaagtacagaaggtggatgaaatgagatttggggattttctgggccattggtttttgtttgttttgttttgttttgttttgtttaatgggargtgacatagcattgtcaacttttacttttgccaaggaagaacagaaaaaaccaccattttctatcactaaagggagattttaccatcagaagaagtagga

SEQ ID NO: 33264 - DNA, 201 bp, Homo sapiens
agcgctcagcagtgtccaacgggtctttttgctttcagatcactgggtcggggtctgctgctgacctctttaccaaaacagccagcccgctcaccacctcrcgaggacgttcccaggagtacgactcaggaaatgacacgtcctcgccaccctccacgcaaaccagctcagccaggtctcggggccaggagaaggggagcc

SEQ ID NO: 33265 - DNA, 201 bp, Homo sapiens
ctagtccaggtgcttgcacattctgcaaagcctttgagctcttgctcaactgggagacacaatatccaacattcaataccatcatcatagttgagagaagrgaggaaccaaagtacagaaggtggatgaaatgagatttggggattttctgggccattggtttttgtttgttttgttttgttttgttttgtttaatgggaa

SEQ ID NO: 33266 - DNA, 201 bp, Homo sapiens
gtggattggatgatggagaggctcatggctccaaggattagccaagccctttccctgtgatatggggctctctatcaagtctatcataaccagagaggaawtctagaaggaggctgatcaagtctggagctgggccaaagataatggcaggtttcttgttcctcttcttgcctccagcctgggccaatagttgctaatcct

SEQ ID NO: 33267 - DNA, 201 bp, Homo sapiens
taggccctgtgaggtgctggtacctaggaatgtaacaaaattgggagaaaggggaactgttatgagttgtggtttgtgccttgaaagcttaccctgatagytggcatggagggtgggctggatgatgggaaggtggattggatgatggagaggctcatggctccaaggattagccaagccctttccctgtgatatggggct

SEQ ID NO: 33268 - DNA, 201 bp, Homo sapiens
atgttgagatgtaattctcaaggtcaggatgaggattaagttagactaggcatgtacagattgtggcagtgagactagagcagaggaaatcctaagatatrttagtgagagtttcatgaagccagaagagaagattctggttatgaaaatctgaaaaaatgatgccatgtcatacagcatctctattgtagagctgttgta

SEQ ID NO: 33269 - DNA, 201 bp, Homo sapiens
gaggcaggagaatcacttgaacccaggagacggaggttgcagtgagccaagattgcaccattgcactccagcctgggtgacaaaagtgaaagtctgtctcaaaaaaaaaaagaaaagaaaagaaaagaaaggaagaaaaagggagaaggagaaggtagaagggggagaaggagaaagaggaggcaggagaggaatatttac

SEQ ID NO: 33270 - DNA, 201 bp, Homo sapiens
gaaaatttcaggtagatggtgcctaaggaagggtgaggtggaagcaaggaaaagttcaggggtgcttgtggggatgtcaagaaagggaaagcaatgacaayggttgggcctggttgacacaataattatctgcagtgcattccaggaatcttctttaccagtcaaggcacccagcataaccaaggtctaattttacccaaa

SEQ ID NO: 33271 - DNA, 201 bp, Homo sapiens
ctagccatcccttctctcccttggcactttctggatcttctcaaaatcctgaaacagaaaagtgacacttacttcccttcagcatcaaagccagcttcctytgtggtggggcagtacccacaacgaactagttatcgaatattgtgaatgtcactcctggcagtgatgaaagcaactacagtgtgtaatggaagcacagag

SEQ ID NO: 33272 - DNA, 201 bp, Homo sapiens
atgttagtgagagtttcatgaagccagaagagaagattctggttatgaaaatctgaaaaaatgatgccatgtcatacagcatctctattgtagagctgttktactctagtgtacagcatctgggcctctcactcccttctatctgtgactgaccctctgatgtgacaaaaccacaataatgatgataataataataacagt

SEQ ID NO: 33273 - DNA, 201 bp, Homo sapiens
aagtctaccccaccacctaggctgccctctcagctacaggctttagttatgctgcaatttcaaagagagagaaacagttaagccctatcaacttggagaaytgaagttcaacctcatgtctggagagttctcccaaggaaacaggaagaaagttgtttccatgataggcagagggagataaagagagaagtgagaaggaag

SEQ ID NO: 33274 - DNA, 201 bp, Homo sapiens
aacagttaagccctatcaacttggagaactgaagttcaacctcatgtctggagagttctcccaaggaaacaggaagaaagttgtttccatgataggcagarggagataaagagagaagtgagaaggaagggaatttccctacttttaaaacattgggccaggcatgctggctcacgcctgtaatcccaacactttggaagg

SEQ ID NO: 33275 - DNA, 201 bp, Homo sapiens
agaaagaggaggcaggagaggaatatttacccaaatcctgctctgtgtcagacactgtgctaagattttcaatacattttctctctcatcattctgataayactacgtgctatgctggtgcttgtctacttcggctgcccttttcaatcacttgggaagttttaaaagatgccaatgcctggatcccaccctctcaacatt

SEQ ID NO: 33276 - DNA, 201 bp, Homo sapiens
cttactctatgccagaccagggcacattacctaagtcagctcctttattcctggaagcaaacttaggacacaggtaccatgtttcttcccatcttgttgaygatgatcaagatgagactcagagaggtctctgagccctgttggaagtaagagagttagactttaaatctaggtttgtcagcttctggaccagcattcctt

SEQ ID NO: 33277 - DNA, 201 bp, Homo sapiens
gctctgtgtcagacactgtgctaagattttcaatacattttctctctcatcattctgataacactacgtgctatgctggtgcttgtctacttcggctgccsttttcaatcacttgggaagttttaaaagatgccaatgcctggatcccaccctctcaacattctgatttaatccagatgagatgagaccagaacagtgaga

SEQ ID NO: 33278 - DNA, 201 bp, Homo sapiens
tctgtaaatgctccccaaaccacctatcaccagcccaaagcctataataggttctttttaacacccccttacagagacgcctgaaacttccctatggtatsaaggagtgacaacaatgtttgttcaaccccaggtggactcctggtggcctttttctggaggacattggccaaatgagctaaaacacatctctgatctgtt

SEQ ID NO: 33279 - DNA, 201 bp, Homo sapiens
gtgaaactgcttcgagaggtgtatacataccttgcaaatccataatgtgctatttttattactttggtggctcagataactaataagatatgcagagtctragcatgccctttctaagaagtcagacatgcctttggtttttactgcagaccaagcagccagatctagacgtgacaaacttgcagaaggcatctctgtcat

SEQ ID NO: 33280 - DNA, 201 bp, Homo sapiens
tattgtctcttgtgtcttctgctgactgcagattaaagggtgtcaaccaaggaaggaaacaaaaaagtagggcctggacttcatttgcagaatgaggtcayagtcgttgagtcccacagtcatatatgggagacctcaagttgctgtcaccttgataactcttgtatcctgggttaaagccctctgtatttagtttgaact

SEQ ID NO: 33281 - DNA, 201 bp, Homo sapiens
tgcacacacacacacacacacgtgtatgtttacaggggaaggaaaagactaaaaggatactgtagtcctggcactttgggagaccaaggtgggcagatcaygaggtcaggaggtcgagaccatcctggccaacatggtgaaacccagtctctactaaaaatacaaaaattagccaggtgtggtggcacgtgcctgtaatcc

SEQ ID NO: 33282 - DNA, 201 bp, Homo sapiens
ttttcaagacatactagcactaagctgagacttttactttgatgtgttctcagcactgcaagagaagtggaaagggagtattttttcctaagggactgggraaagggaggatattggtttcccttgggacaagactggggctcgctgcggggaggcacggaggggccggccctcatccctcctctctctggtctctgcagt

SEQ ID NO: 33283 - DNA, 201 bp, Homo sapiens
ttagtcaatctcaaataattcatcttgattaacccattcagtgtttcccaatctttagtcattcaccagtatcttgaccacatatgacttgtctgtttatsaactgtactattcttaattttctttaaatagatatgactcttttcaaaggttcatacatttatttctaaaggaaacgatacagtacagtaaatggaaaat

SEQ ID NO: 33284 - DNA, 201 bp, Homo sapiens
taggttggggaagttctggataatatcctgaagagtgttttccaacttggttccattctccccgtcactttcaggtataccaatcagacatagatttggtyttttcacatagtcccatatttcttggaggctttgttcatttctttttactcttttttctctaaacttctcttctcacttcatttcattcatttgatcttc

SEQ ID NO: 33285 - DNA, 201 bp, Homo sapiens
gccattcgtctaatcttttttcaaggtttttagcttctttgcgatgggttcaaacatcctcctttagcgcagagaagtttgtaatcactgatcatctgaargcttcttccctcaacttgtcaaagtcattctccgtccagctttgttccattgttggcaaggagctgcgttcctttggaggagaagaggctctctgatttt

SEQ ID NO: 33286 - DNA, 201 bp, Homo sapiens
gcttcttccctcaacttgtcaaagtcattctccgtccagctttgttccattgttggcaaggagctgcgttcctttggaggagaagaggctctctgattttyagaattttagcttttctgctctggtttctccccatctttgtggttttatcagcctgtggtctttgatgatggtgatgtacagatggggttttggtgtgga

SEQ ID NO: 33287 - DNA, 201 bp, Homo sapiens
aggtgcctcccagttaggctagttgggggtcagggacgcacttgaggaggcagtctgtccgtttgcagatctcaaactctgtgctgggagaaccactactrtcttcaaaactgtcagacagggacatttaagtctgcagaagtttctgctgccttttgttcagctatgccctgcccccagaggtggagtctacagaggcag

SEQ ID NO: 33288 - DNA, 201 bp, Homo sapiens
agtctgcagaagtttctgctgccttttgttcagctatgccctgcccccagaggtggagtctacagaggcaggcaggcctccttgagctgcagtaggctccrcctagtttgagcttcctgaccactttgtttacctactcaagcttcagcaatggcggacgcccctgccccagcctcgctgccgccttgcagtttgatctca

SEQ ID NO: 33289 - DNA, 201 bp, Homo sapiens
ccctgcccccagaggtggagtctacagaggcaggcaggcctccttgagctgcagtaggctccacctagtttgagcttcctgaccactttgtttacctactyaagcttcagcaatggcggacgcccctgccccagcctcgctgccgccttgcagtttgatctcagactgctgtgcttgcagtgagtgaggctccgtgggcat

SEQ ID NO: 33290 - DNA, 201 bp, Homo sapiens
atgtgtcatagggatttgttgtatacattattttattacccaagtatcaaacccattacccaatagttatcttttctgctcctctccctccatccaccctytctcgtcaagttgtttccttctttgtgttcataaattcttataagtgggagttaagtggagtaattttcaaaaatgaagtctaccccaccacctaggctg

SEQ ID NO: 33291 - DNA, 201 bp, Homo sapiens
accatggctcatgcctgtaatcccagcactatgggaggccaaagcaagtggatcacctggggtcaggagttcgagaccagcctggccaacatggtgaaacmctgtctctactttaaaaatacaaaaattagcctggcttggtggcgggggcctgtagtcccagctactaggaaggctgaggcaggagaatcgcttgaaccc

SEQ ID NO: 33292 - DNA, 201 bp, Homo sapiens
atcctactcctggtccagcctctccaggctcttgaaatgtttggtgaatgatagctgacacttttggagatgggacctaggggtagcgaaagcactgagattttttttttttttttttgtctctcctcagttagcaaggcttctgagtttttaaaaatttttcatttttctagctaatgcatgctgcacttaatacctagg

SEQ ID NO: 33293 - DNA, 201 bp, Homo sapiens
tcctactcctggtccagcctctccaggctcttgaaatgtttggtgaatgatagctgacacttttggagatgggacctaggggtagcgaaagcactgagattttttttttttttttttgtctctcctcagttagcaaggcttctgagtttttaaaaatttttcatttttctagctaatgcatgctgcacttaatacctaggt

SEQ ID NO: 33294 - DNA, 201 bp, Homo sapiens
acatggctactctgccccacttaaggttgcctggctcctggaagaatcacatggccccagatctggttctttgagtactcctcatgcatggccctttctcrtcttctctattacaaaagcagagatggaagaagtttccagattggatcaaaggttttccaaggttcctagccccaagtttttctctctgttaaagctaac

SEQ ID NO: 33295 - DNA, 201 bp, Homo sapiens
accattccaggctgcaagttaagcaggtggtttaaactctctgtgcctcagtttcttcatctgtaagatgggaataataagagaatctatttcataggttrttatgaagaatagatgaatccctttaagaaaagtgcttagaatacagtgcctggcatgaagtatgtgttagatgtgggttacctgtcatcatcaccattg

SEQ ID NO: 33296 - DNA, 201 bp, Homo sapiens
gtaatagtagtattgttccaggcataggctgggctgggactagagccaagacccctgcttcccagaccaatttctttctatcctaaatggtagctgcagcycacatggctactctgccccacttaaggttgcctggctcctggaagaatcacatggccccagatctggttctttgagtactcctcatgcatggccctttct

SEQ ID NO: 33297 - DNA, 201 bp, Homo sapiens
gtagggaggtattcaaacaagatgctcccagagtagtgggcagtcggtgctcatggacattttcccacctgcaggggatttcagtcaccgtgtctggaatrtgccgaagtgaagaagtccagtttggtcccatccacagcccggagctcacccatgaaagggtgttcccgcagctcctcctatgccagcacccgatcctcc

SEQ ID NO: 33298 - DNA, 201 bp, Homo sapiens
gcgcctgccttgagtgatgcagaggagacatggggaagtgactttctgcctagggtgtcatctggggagcagggagggccctgagtcatccacactccctycagaggacccctttctgctcacccgtattcagtaccattggttacggaaccctccacccaatacccaggcaggaagctggactaacgcatggggttgagg

SEQ ID NO: 33299 - DNA, 201 bp, Homo sapiens
ctaagaagtcagacatgcctttggtttttactgcagaccaagcagccagatctagacgtgacaaacttgcagaaggcatctctgtcatttttgtcagccatttttttttcactaaagttttgggtgacagtcaacaggatgtctttatttcacagatggcaaagtcacatacacaaagacacacagttatacacagttaca

SEQ ID NO: 33300 - DNA, 201 bp, Homo sapiens
catacacacacatgcagacatacctaggaacaatatcacatatgaacatatacaaacacccccaaacacactttatcatcctcagatcctgttggtcctgsatacatctccctaccatgctccccttcaaaagaccctcaggtctctctcccccatccccaggcaccgcggccggtcccctgaggaagggcagaagtcccg

SEQ ID NO: 33301 - DNA, 201 bp, Homo sapiens
cctgtcagccaggggtgtagtaagtattcttcacagcctcctctgccagccttggccacgacacttgggggatgtggaggcacaagttcagggcagtgtayggtacactttaattcaatttctgacaaaatatcccactggctccagacctcattaatgatgaaccaaatgatcattcaccagactttggcaacactggct

SEQ ID NO: 33302 - DNA, 201 bp, Homo sapiens
tctctcctccagctgtttaaataaaatgacatctgataatttttaaaaagtggctctcttgaaaatattataaatatagctatatgattcttatttgctgragatagagaccctggcatatattctaaccattttatcattctttctactaaccacaatgatccagattcttaaaatggaattaaatacagcagtacttta

SEQ ID NO: 33303 - DNA, 201 bp, Homo sapiens
ctatgccagaccagggcacattacctaagtcagctcctttattcctggaagcaaacttaggacacaggtaccatgtttcttcccatcttgttgacgatgaycaagatgagactcagagaggtctctgagccctgttggaagtaagagagttagactttaaatctaggtttgtcagcttctggaccagcattccttactgct

SEQ ID NO: 33304 - DNA, 201 bp, Homo sapiens
aacggcccagggaaacgaaatcatctgccaaggtcacacagctagtaagtggccaggatagtaggcacaaaatagaagttgttggtattattattaaccacccggtggggaggggctttcattctttgatcggggcccagttcctctgcctggcttccagaaagaaaaaggtcactgcccagggacccgctgaataaagct

SEQ ID NO: 33305 - DNA, 201 bp, Homo sapiens
ttacccacgcaccagggcctgcgtaacattcacgtcctcacccctgcagcacctgccctgctatgatgcccacctgcaaatgctgacacccctgcacaagcccagcccccacccctacggtactaacaaccctcgcagactcttaccgcagccccgtcatcctccctccggtctcccttgcggcaacgtgcagaccccatc

SEQ ID NO: 33306 - DNA, 201 bp, Homo sapiens
cacgcaccagggcctgcgtaacattcacgtcctcacccctgcagcacctgccctgctatgatgcccacctgcaaatgctgacacccctgcacaagcccagcccccacccctacggtactaacaaccctcgcagactcttaccgcagccccgtcatcctccctccggtctcccttgcggcaacgtgcagaccccatcccgtg

SEQ ID NO: 33307 - DNA, 201 bp, Homo sapiens
tcacccatgagatattggaagaaataactcccagaagcatgaggatgaaatgaaaaggggcaaaaagatgtgaacgtgctttgtaaacttgaatgcagagyacacaatgtgccattgttgattgaatggtcagaataggtggataccgttcctggaacaggtaaggcctcagaagagaaaagctctagcagagaagtctga

SEQ ID NO: 33308 - DNA, 201 bp, Homo sapiens
aggatgggaaaaggggcaaagagggttctatgagagcaccacagcctaggccaaggtagggaggtattcaaacaagatgctcccagagtagtgggcagtcrgtgctcatggacattttcccacctgcaggggatttcagtcaccgtgtctggaatgtgccgaagtgaagaagtccagtttggtcccatccacagcccggag

SEQ ID NO: 33309 - DNA, 201 bp, Homo sapiens
tgtgtttagcgaagtgcatcatctctctgtgcctctgtttccccatctataaaatgaaattgataatagtacctaaccctaagatgtgttgaggattaaayaatacacacaaagcactggttcaatgtctggcacataataaaatatgtcatagtcatagctaacatttcctatgtcctgtctaattgatacttagcatag

SEQ ID NO: 33310 - DNA, 201 bp, Homo sapiens
tgactctttcttatatctctcaatgcatagccaaagcataagttggcaaaagcacatttttccagtgaccatagctggacactgctgagggcactgagaakggaagagctattcctgcccctgttttctaaaagtgggaggcattaacagaaagcaaagaagactaggaggagcataaggattagtcatgtagatgcacaa

SEQ ID NO: 33311 - DNA, 201 bp, Homo sapiens
accaacaacaggtcatcttgatttttaccatatccatgtactactgatattcctgtttactttaataaactcatttttaatatataagtaaaaggaaaatwacagtactatctgaaatagaaaattagaatcaaatgtccttggccgggcacaggggctcacatctgtaatcccagcactttgggaggccaaggcgggtgg

SEQ ID NO: 33312 - DNA, 201 bp, Homo sapiens
aatggaccacgttggtggaggatgctgatagtggggaataaggctgtgcgtgtgtagcagcaagaagtatatgggagctccctgtgctttccattcaatcrtgctatgaaactaaaactgctctaaaaaataaagtttattaattatagatacagatataccatagtataatttatcaacatatcagagaacattgagatt

SEQ ID NO: 33313 - DNA, 201 bp, Homo sapiens
atggtactgctggcagaggccagcatcaaacttaactgtgtcatcccagccacaacaggtctgaatatttaaagaaacccctcgccatcctgcttctaaaygcgtgcccgccttcccaagtgctggctttccatcgcctcctttactccttcattggtcctagatcagccctagacagggttctcggggcccctctttatt

SEQ ID NO: 33314 - DNA, 201 bp, Homo sapiens
ctttctgctcacccgtattcagtaccattggttacggaaccctccacccaatacccaggcaggaagctggactaacgcatggggttgagggagatggagarcttcgggagggatggtgaccagtgcaaaggaaaaacgggtgtcacaagatcaaatctctcactctcccttttttactctctctctcctctcctctgactc

SEQ ID NO: 33315 - DNA, 201 bp, Homo sapiens
agctggactaacgcatggggttgagggagatggagaacttcgggagggatggtgaccagtgcaaaggaaaaacgggtgtcacaagatcaaatctctcactytcccttttttactctctctctcctctcctctgactcgttccttctcatccccccaagatctcgaagccggccccgaaagtctcaccgccaccgccatcac

SEQ ID NO: 33316 - DNA, 201 bp, Homo sapiens
tcgaagccggccccgaaagtctcaccgccaccgccatcaccgctgcccctcgcggtcccagagctcggagtcccgcccctcaagctgtgagagcaggtaaccccttgccccaggatcctcttctgtcagccacagccgagcccaggctaagacactgttaacactagcttcgcctccacacttccagcacagggtttggcc

SEQ ID NO: 33317 - DNA, 201 bp, Homo sapiens
tcaccgctgcccctcgcggtcccagagctcggagtcccgcccctcaagctgtgagagcaggtaaccccttgccccaggatcctcttctgtcagccacagcygagcccaggctaagacactgttaacactagcttcgcctccacacttccagcacagggtttggcccccttcctcagactcagcagctggcaccacttccct

SEQ ID NO: 33318 - DNA, 201 bp, Homo sapiens
ggggttttataaatagacaatcatgtcatctgcaaacagggacattttgacttcctcttttcctaattgaataccctttatttctttctcctgcctgattkccctggccggaacttgcaacagtatgttgaacaggagtggtgagagagggcatccctgtcttgtgccagttttcaaagggaatgcttccagtttttgccc

SEQ ID NO: 33319 - DNA, 201 bp, Homo sapiens
caccgcatattctcactcataggtgggaactgaacagtgagaacacatggacacaggaaggggaacatcatactctggggactgttgtggggttgggggasgggggagggatagcattgggagatatacctaatgctagatgatgagttagtgggtgcagcgcaccagcatggcacatgtatacatatgtaactaacctgc

SEQ ID NO: 33320 - DNA, 201 bp, Homo sapiens
cacatggacacaggaaggggaacatcatactctggggactgttgtggggttgggggaggggggagggatagcattgggagatatacctaatgctagatgakgagttagtgggtgcagcgcaccagcatggcacatgtatacatatgtaactaacctgcacattgtatacatgtaccctaaaacttaaagtataataataat

SEQ ID NO: 33321 - DNA, 201 bp, Homo sapiens
ggaacatcatactctggggactgttgtggggttgggggaggggggagggatagcattgggagatatacctaatgctagatgatgagttagtgggtgcagcrcaccagcatggcacatgtatacatatgtaactaacctgcacattgtatacatgtaccctaaaacttaaagtataataataataaataaatttaaaaaaaa

SEQ ID NO: 33322 - DNA, 201 bp, Homo sapiens
acagatggcaaagtcacatacacaaagacacacagttatacacagttacatttatagacaaacacatggaaacacagatggacacacccagacatacacayagtcacatgacagacaatcagagaggtacacaagtgacattaaactgaataactgaatctggatggggaccttttctgtttttaaagctgcatcctcaga

SEQ ID NO: 33323 - DNA, 201 bp, Homo sapiens
ccacatctcagtgctggttgctagagtggcctcaaactcagttggctctcactggttatgtcaaccacctgcccagacttcctgactgatgttatctgagyttgtgtttactacaaggcatgggcaaactaattagtgaaatgttgttaatttggtgtcagcaatctttccccaagtggagtcctttgtagaggcaatggc

SEQ ID NO: 33324 - DNA, 201 bp, Homo sapiens
agtaccattggttacggaaccctccacccaatacccaggcaggaagctggactaacgcatggggttgagggagatggagaacttcgggagggatggtgacsagtgcaaaggaaaaacgggtgtcacaagatcaaatctctcactctcccttttttactctctctctcctctcctctgactcgttccttctcatccccccaa

SEQ ID NO: 33325 - DNA, 201 bp, Homo sapiens
gtaatgctagcactttgggaggccgaggtggccaaattatgagatcaggagttcaagaccagcctggccaatatggtgaaaccctgtctctactaaaaatwcaaaaaattagctgggtgtagtggtgggcacctttaattccagctactctggaggctgagacaggagaatcgcttgaacccaggagatggtggttgtggt

SEQ ID NO: 33326 - DNA, 201 bp, Homo sapiens
actctctctatgctaatacattggttgtcccaacctgagaaggcatcttgttgatgagaagaaggaggaagggaaggagaagagcaagaataagaactggrgctttaactataaatcatgctgctataaagacacatgcacacgtatgtttattgcggcattattcacaatagcaaagacttggaaccaacccaaatgtcc

SEQ ID NO: 33327 - DNA, 201 bp, Homo sapiens
tgaacacaaatagttattacttacagggtcctgactccaaactggatcctgagctaagtcccttccatgtgtagatgtttttaattctcattaatccctaycacaaccttgcacagtggatatgtttattgttcccattttacagatgaggaaactgagactaagatagaatgtcacaggaatgtccacagatagaaccag

SEQ ID NO: 33328 - DNA, 201 bp, Homo sapiens
atggccccatttcacggttgaagaaaccaggttttaaagggacgggtaactaccctgatgtcacacagcagctaagaagcagaggcggatcttgggtccarttgaatttggatctgtcagcaaggtcctgggctctcccactgcctagggtgagtctcaacatgaagatagatcctgtggctggcttcaaggtgtaagata

SEQ ID NO: 33329 - DNA, 201 bp, Homo sapiens
ctcccatccgcagctaagcatggtactgctggcagaggccagcatcaaacttaactgtgtcatcccagccacaacaggtctgaatatttaaagaaaccccycgccatcctgcttctaaacgcgtgcccgccttcccaagtgctggctttccatcgcctcctttactccttcattggtcctagatcagccctagacagggtt

SEQ ID NO: 33330 - DNA, 201 bp, Homo sapiens
cttgggtccagttgaatttggatctgtcagcaaggtcctgggctctcccactgcctagggtgagtctcaacatgaagatagatcctgtggctggcttcaasgtgtaagatagttagatgaaataaaattgccccttcccaggtcctaggccagtcataggttcttggtgaccctctgcaaccagtctagcttaaactacca

SEQ ID NO: 33331 - DNA, 201 bp, Homo sapiens
catcttgttgatgagaagaaggaggaagggaaggagaagagcaagaataagaactggagctttaactataaatcatgctgctataaagacacatgcacacrtatgtttattgcggcattattcacaatagcaaagacttggaaccaacccaaatgtccaacaatgatagactggattaagaaaatgtggcacatatacacc

SEQ ID NO: 33332 - DNA, 201 bp, Homo sapiens
accctcatgaccaattgctgagaaggcagaaatagttcttaagaaattccagaagtagaagtcccccctcctttagggccaagatgcacaagataaagttkggggaaagagtaggctttttatggtgaaagctgccctaacatttgtggggtcagagcaaaggtatagaagaagacccacaaattagatgtctaaatgttt

SEQ ID NO: 33333 - DNA, 201 bp, Homo sapiens
ctagggtgagtctcaacatgaagatagatcctgtggctggcttcaaggtgtaagatagttagatgaaataaaattgccccttcccaggtcctaggccagtmataggttcttggtgaccctctgcaaccagtctagcttaaactaccaaatagtgtgttcatcctccctgatctctatttgattacactgagaccccaagtc

SEQ ID NO: 33334 - DNA, 201 bp, Homo sapiens
tgctaaagctagactatcaccttgcctgtatgcaaagcctcctgggagaatctacaaaggaattcctgcctccccagccccaggagctgacatcctgaccrcaggagttatgctattctcacagttccaatgtgtctgtgtttcaccctcatgaccaattgctgagaaggcagaaatagttcttaagaaattccagaagta

SEQ ID NO: 33335 - DNA, 201 bp, Homo sapiens
tcccctgaggaagggcagaagtcccgccgaaggcactcccgccgctgctccaagaccctctgcaaggacagccctgaggcccagtccagtcgcccgcccartcaacccctccagatgcttggctacctgtcagccaggggtgtagtaagtattcttcacagcctcctctgccagccttggccacgacacttgggggatgtg

SEQ ID NO: 33336 - DNA, 201 bp, Homo sapiens
gaaccaagaaaactcgaatctgaatcagtcagcttaggctgtgggggccagggtgggatggtgtggaagagatgctatttgtgaagtaggcaggaccgggstgtaaaaaacactgtcatccatgtcaaagagtttagatccattcaaagaaatgggatttttaaacatgcaggagaggttggtattttcaggcaccaaatt

SEQ ID NO: 33337 - DNA, 201 bp, Homo sapiens
ccgcggccggtcccctgaggaagggcagaagtcccgccgaaggcactcccgccgctgctccaagaccctctgcaaggacagccctgaggcccagtccagtygcccgcccagtcaacccctccagatgcttggctacctgtcagccaggggtgtagtaagtattcttcacagcctcctctgccagccttggccacgacactt

SEQ ID NO: 33338 - DNA, 201 bp, Homo sapiens
gcagaaccaagaaaactcgaatctgaatcagtcagcttaggctgtgggggccagggtgggatggtgtggaagagatgctatttgtgaagtaggcaggaccrgggtgtaaaaaacactgtcatccatgtcaaagagtttagatccattcaaagaaatgggatttttaaacatgcaggagaggttggtattttcaggcaccaa

SEQ ID NO: 33339 - DNA, 201 bp, Homo sapiens
gtgaatgctggggtgcaacattgaaccagtcatggccctgccctcagcaagctccaaacccagtcagagagacggccaataaaataagcaactactgtacygaggaacagggctgtggcaaacaaatgacactcatttttgaatgagtgagtgaattcaagattcagtgaatgaatgaagtgcagtgtattgtgctatcct

SEQ ID NO: 33340 - DNA, 201 bp, Homo sapiens
cagagaatactctaaaaaaggaaacctcagatattaagattcactaattgactcgttcatccagtgaatattcactgagcatgtgtctggggacaaatgtyatgattccttgaaggctgaattgtttctcagccattcccttctgcagacatgttttgtttgacctgcaaagtgatttgattttttttttaattggtggtc

SEQ ID NO: 33341 - DNA, 201 bp, Homo sapiens
ctgagtgcctactctgtgccaggcattggtgaatgctggggtgcaacattgaaccagtcatggccctgccctcagcaagctccaaacccagtcagagagayggccaataaaataagcaactactgtactgaggaacagggctgtggcaaacaaatgacactcatttttgaatgagtgagtgaattcaagattcagtgaatg

SEQ ID NO: 33342 - DNA, 201 bp, Homo sapiens
ttcccaaagctggcagacacccagctggatcccacctgggcctgatcacccagttgtctctacaataaatgaagtcaggcaggcccacagaggctttcaarggaccggagagcaaacttgttcattaggcaaaatttactgagtgcctactctgtgccaggcattggtgaatgctggggtgcaacattgaaccagtcatgg

SEQ ID NO: 33343 - DNA, 201 bp, Homo sapiens
caaattcccaaagctggcagacacccagctggatcccacctgggcctgatcacccagttgtctctacaataaatgaagtcaggcaggcccacagaggcttycaaaggaccggagagcaaacttgttcattaggcaaaatttactgagtgcctactctgtgccaggcattggtgaatgctggggtgcaacattgaaccagtc

SEQ ID NO: 33344 - DNA, 201 bp, Homo sapiens
tgaggcccagtccagtcgcccgcccagtcaacccctccagatgcttggctacctgtcagccaggggtgtagtaagtattcttcacagcctcctctgccagmcttggccacgacacttgggggatgtggaggcacaagttcagggcagtgtatggtacactttaattcaatttctgacaaaatatcccactggctccagacc

SEQ ID NO: 33345 - DNA, 201 bp, Homo sapiens
agcacctttttttttcatttaaaaaatttaattattatggctacataatagttgtatatatttacagggtatatgtgatgtttccatacaggcatacactrtgtaaggatcaaatcagggtaattgtgcatccatctcctcaagcatgtatcatttctttgtgttagaaacattccaattacactcttttagttattttaa

SEQ ID NO: 33346 - DNA, 201 bp, Homo sapiens
cctactcgcctatgagaaagcgccggagagactccccgagccacctggaggcccggaggataaccaggtgaggccagggggcaagggggacccaccttcaycctcgttcccactcccattcttactcattcgagcctcaggctctccctaggcctccttggggctgggatttaggattgtgcgagcttatggtccccccaa

SEQ ID NO: 33347 - DNA, 201 bp, Homo sapiens; identical to SEQ ID NO: 8648

SEQ ID NO: 33348 - DNA, 201 bp, Homo sapiens
cattttatttatttatttatttatttgagacagagtctcgctgtgtcaccaggctggagtacagtggcacgatctcggctcactgcaacctccacctcccrggttcaagtgagtctcctgcctcagcctcgcgagtagctgggactacaggtgtagaggtgcatgccaccacgcccagctaatttttgtatttttagtaga

SEQ ID NO: 33349 - DNA, 201 bp, Homo sapiens
tgcatgccaccacgcccagctaatttttgtatttttagtagagacgggatttcactatgttggccaggatggtctcgatctcttgacctcatgatccaccygcctcaggctcccaaagtgctgggattacaggcgtgagccaccgccaccagcctgttcacccatttttaagccagattgttggggagtttttttgctgtt

SEQ ID NO: 33350 - DNA, 201 bp, Homo sapiens
gcatgccaccacgcccagctaatttttgtatttttagtagagacgggatttcactatgttggccaggatggtctcgatctcttgacctcatgatccacctrcctcaggctcccaaagtgctgggattacaggcgtgagccaccgccaccagcctgttcacccatttttaagccagattgttggggagtttttttgctgtta

SEQ ID NO: 33351 - DNA, 201 bp, Homo sapiens
gatctcagctcactgcaacctccacctcctggattcaagcaatcctcgtccctcagcctcccaagcagctgggactacaggtgtgtgccaccaggcccagytaatttttcgtattttcagtaaggatggcatctcaccatgttgcccaggctggtctcaaacgccttagctcaggtaatccacccaccttggcatcccgaa

SEQ ID NO: 33352 - DNA, 201 bp, Homo sapiens; identical to SEQ ID NO: 8650

SEQ ID NO: 33353 - DNA, 201 bp, Homo sapiens
tctactaaaaatacaaaaattagccgggtgtgatggtgggcatctgtaatcccagctactcgggaggctgaggcaggagaatcacttgaacccgggaggcmgagatttcagtgagccaagatcacacaactacactgcagcctgggcaacagagtgagactctgtctcaaaaaaaaaaaaaaaaaaaaggaaaaagaaaaa

SEQ ID NO: 33354 - DNA, 201 bp, Homo sapiens
gtgttgcaaagataaaaaaaaaaaaagttatatttttagtatcccaaacaaccactgaagtttatccagaccgttaatgaaacccatttttctttgcaacrtcacctttgtccagaatgaattacttggctcctagaacttaagattcaaaaagcaaaaccaaaaatcccagatcttttaatgcatccttccagtctcaag

SEQ ID NO: 33355 - DNA, 201 bp, Homo sapiens
ggcacatatgcagtggtagggctttcttgacacatgcattccagaataatctagtaatttgcaattattcacctgttatgtcctctcgtttttcaaaagasctacattcaatgtggatttagattatgctaataaacacagcattcttatctgtgtgtagatcatctcaaaacaaaatctgtaactgagcacggtggctta

SEQ ID NO: 33356 - DNA, 201 bp, Homo sapiens
tgatttctgagggatctgctccatgtctattctgttatctgcatgaaaacaaaatgtatgccaatttcagtatgtcaataatcaaggttttaaatgtttgraagaaaatacaaacaagattgctgatctgttctgtattagtgacattctggtacttctagatttgcaataaatttatggattttttatttaaagagaccg

SEQ ID NO: 33357 - DNA, 201 bp, Homo sapiens
cagcactttgggaggctgaggtgggcggatcacctgaggtcaggtgatcgagaccagcctggccaacatggcaaaaacctgtctctacttaaaacacacamaaaaaggccaggtgcagtggctcatgcctgtaatcccagtactttgagaggccgaggcaggcagatcaggaggtcaggagatcgagaccatcctggccaa

SEQ ID NO: 33358 - DNA, 201 bp, Homo sapiens
ccacagcccggtccacatggtgagaccctgtctctacaaaaaataaaaattatgccaggcgcggtggctcacatctgtaatcccagcactttgggaggccraggtgggtggatcacgaggtcaggagttccagaccggcctggccaacatggtgaaaccctgtctctactaaaaatacaacaaattagctgggcatggtgg

SEQ ID NO: 33359 - DNA, 201 bp, Homo sapiens
ttcggacaccgtctggtagtgatgttgggggggctacttgtcagcaccgggatggtggccgcctccttctcacaagaggtttctcatatgtacgtcgccaycggcatcatctctggtaagtgttcctctttggctcagaagttgtctagacacttagtttgaagaacaaggaaggggaaggaggaaattaaagccaaacta

SEQ ID NO: 33360 - DNA, 201 bp, Homo sapiens; identical to SEQ ID NO: 8654

SEQ ID NO: 33361 - DNA, 201 bp, Homo sapiens
gaggcagaggttgcagtgacctgagattgcaccatcgcactccacctggggcaacaagaataaaactctgtctaaaaaaaaaaaaaaaaaaaaaaaaaaamcctaaagtgaactcaagtgaaaataatacagttccttcctaccgaagaatattaccttttcaaagaagtatgcatcgaaatgtcccaggttttaggtcct

SEQ ID NO: 33362 - DNA, 201 bp, Homo sapiens; identical to SEQ ID NO: 8657

SEQ ID NO: 33363 - DNA, 201 bp, Homo sapiens
agccctcttgatttaaatatgaggaaactgaaggccaaagaattgaagctaaaggtcagatggtaaattagtggtcgattcaggactggaagctgtgtctrtagtccagattgaccctggccttttttttttttttttgagatggagtctcgctctatcacccaggctggagtgcagtggcgcagtctcagctcactgcaa

SEQ ID NO: 33364 - DNA, 201 bp, Homo sapiens
acctccggggttcaagcaattctcctgcctcagcctcccaagtagctggggttacaggcacccaccagcacacctggcctttttttttttttttttttttttttagtagagatggggtttcactatgttggccagactgctctcaaactcctgacctcatgatccacccatctcggcctcccaaagttctgggattacagg

SEQ ID NO: 33365 - DNA, 201 bp, Homo sapiens
cgtgcctcagcctcctgggtagctgggataacaggctcgtgctactactaatttttgtatttttagtagagacagtgttttgctatgttggccaggctggkcttttttttttttttttttttttgagacggagttttgctctttttgcccaggctggagtgcaatagcacgatctcggctcaccacaacctctgccttcca

SEQ ID NO: 33366 - DNA, 201 bp, Homo sapiens
gctgcagtgagctatgatcgtgccactgcactccacgtctctctagggtctttatcaaattttatcactatatgttttgtttcaaggtggtcctgagcccyccattaaaactcttaagaccttctgggcacatttctgggttagaacaactgtgccaatttgaccttggtcttagtagctactgagtcctgactgcttgtc

SEQ ID NO: 33367 - DNA, 201 bp, Homo sapiens
gaccttatattatttcttcttcactcctgcctattcaagcaatcatggctctgaaggagcgcattggctggagatacagcctcctcttcgtgggcctactrcagttaaacattgtcatcttcggagcactgctcagacccatctttatcagaggaccagcgtcaccgaaaatagtcatccaggaaaatcggaaagaagcgc

SEQ ID NO: 33368 - DNA, 201 bp, Homo sapiens
atatagtcactgtctaagaagcaacatcaaaaagttgctgatggccgggcacagtggctcacacctgtaagcactttgagaggtcaaggtgggtggatcasttgaggtcaggagttcaagaccaggctggccaacatggcgaaaccccatctctactgaaaatagaaaaattagccaggcacagtgttttgcacttgtaat

SEQ ID NO: 33369 - DNA, 201 bp, Homo sapiens
agggttctctcttctgttccattggtcagtgtgtctgtttttatgccagtaccatgctgttttgattactgttgtgttgtcatatattttgaggtctgttmgtgtgatgcctccagctttgttctttttttcaggatggctttggctattcatgatcttttgtggttccatacaaattttaggatttttttcttctatttc

SEQ ID NO: 33370 - DNA, 201 bp, Homo sapiens
catacctatagtcctagccacttgagaggctgagtagggtcacttgagcccaggagtttttttgtttttgttttttgagacggagtctcgttcttgtcackcaggctggagcgcagcggcacaatctcagctcactgcaacctctgcctcctgggttcaagcagttctcccaccgcagcctcccgagtagctggaagcaca

SEQ ID NO: 33371 - DNA, 201 bp, Homo sapiens; identical to SEQ ID NO: 8656

SEQ ID NO: 33372 - DNA, 201 bp, Homo sapiens; identical to SEQ ID NO: 8658

SEQ ID NO: 33373 - DNA, 201 bp, Homo sapiens
  misc_feature (1)...(201): n = A,T,C or G, or insertion/deletion polymorphism (see Tables 1-2)
actcttcggccttgccttcaaagggcttagaaggattaaagcaagtgacggtcaaaggctgtcatagaagtatagactattagggcaggaagagatctaanctcatcagagtctagttcaactcccttttttacatttaccttgattttacattgacattgaaaatggggaagtgaagtgatttgcctaaattccatcatc

SEQ ID NO: 33374 - DNA, 201 bp, Homo sapiens
acattcatactgctgagtataataaatttccacagaacttataacaaaatctggatccatatttcttcttgatggcttctcctgggtcttgagtccattaytgaccttatattatttcttcttcactcctgcctattcaagcaatcatggctctgaaggagcgcattggctggagatacagcctcctcttcgtgggcctac

SEQ ID NO: 33375 - DNA, 201 bp, Homo sapiens
  misc_feature (1)...(201): n = A,T,C or G, or insertion/deletion polymorphism (see Tables 1-2)
gaaaatggggaagtgaagtgatttgcctaaattccatcatccgtaaagcaggggttgatgggcaggatgactcagctcgcctcaccagttagatccctacncagctgaaaaatatccctacccgtcagataaattcacatggccacagaccaaagtggacagataaacttttatattctggaacttacagaggcttctgca

SEQ ID NO: 33376 - DNA, 201 bp, Homo sapiens
gccgggcatggtggcgcatgcctgtaatcccagcttcttgggaggctaaggcaggagaatcacttgaacccgggaggtggaggttgcagtgagctgagatygtgccatggcactccagcctaggcaacaagagcgaaactccatctccaaaaacaaaaacaaaaagtccaccatcttctaaacagctgtcatagaatagat

SEQ ID NO: 33377 - DNA, 201 bp, Homo sapiens
tagctaacatactgaaacctcatctctactaaaaatacaaaaatcaaccgggcatgatggtgggtgcctgtaatcccagctactcgggaggctgaggcagragaatcgcttgaacccgggaggctaaggttgcagtgagccaagatcgtgccactgcacttcagcctaggtgacatagcaagactccatctcaaaaaaatt

SEQ ID NO: 33378 - DNA, 201 bp, Homo sapiens
aggtgggtggatcacgaggtcaggagttccagaccggcctggccaacatggtgaaaccctgtctctactaaaaatacaacaaattagctgggcatggtggygggcgtctgtaatcccagctacttgggaggctgacgcaaagaattgcttgaacctgggggatggaggtggcagtgagccgaaatcatgccactgcattcc

SEQ ID NO: 33379 - DNA, 201 bp, Homo sapiens
aatattttagtccatggaggcagagaccatctcttggtcttttcactgtagtgcccctatagtgaaagcgaggacctggcacctgataggtattttgttgmaaaaataaatacaagctgtgtacaaggtacaggcagggtccggggacatggggttgtacaaagagaaatagacctcagattttgtgagcatataatttat

SEQ ID NO: 33380 - DNA, 201 bp, Homo sapiens
tttgagacggagttttgctctttttgcccaggctggagtgcaatagcacgatctcggctcaccacaacctctgccttccaggttcaagtgattctcctgcytcagcctcccgtgtagctgggattacaggcgtgcgccaccacacccggctaattttgtatttttttttagtagagacagggtttcaagactatactttca

SEQ ID NO: 33381 - DNA, 201 bp, Homo sapiens; identical to SEQ ID NO: 8652

SEQ ID NO: 33382 - DNA, 201 bp, Homo sapiens; identical to SEQ ID NO: 8647

SEQ ID NO: 33383 - DNA, 201 bp, Homo sapiens
  misc_feature (1)...(201): n = A,T,C or G, or insertion/deletion polymorphism (see Tables 1-2)
taaagattgagtacattcatactgctgagtataataaatttccacagaacttataacaaaatctggatccatatttcttcttgatggcttctcctgggtcntgagtccattattgaccttatattatttcttcttcactcctgcctattcaagcaatcatggctctgaaggagcgcattggctggagatacagcctcctct

SEQ ID NO: 33384 - DNA, 201 bp, Homo sapiens; identical to SEQ ID NO: 8651

SEQ ID NO: 33385 - DNA, 201 bp, Homo sapiens
ccagctccttctcgcaggagatggtttctaccccgggaatgagatttctcagtgatctgattgtttttgcaaatcatggtaagataggtgtcttgcttgtwaaaaagatgccaagtgcttatgctgaaatctctaaaccatgcatctccccatgtcccaagcaccgttatgtggcatttttggggtcaacaatacatccgg

SEQ ID NO: 33386 - DNA, 201 bp, Homo sapiens
ggactacaggcacccaccaccacgcctggctaatttttgtatttttagtagagatggggtttcaccatgttggccaggatggtctcaatctcttgacctcrtgatccgcctgccttggcctcccaaagtactaggattacaggtgtgagccaccgcacccgccaacccaggctttttctgtcaccttgccttctctcatgc

SEQ ID NO: 33387 - DNA, 201 bp, Homo sapiens
ggctggagtgcagtggcgcagtctcagctcactgcaacctccacctcccagattcaagtgattctcctgcctcagcctcctgagtagctgggactacaggyacccaccaccacgcctggctaatttttgtatttttagtagagatggggtttcaccatgttggccaggatggtctcaatctcttgacctcgtgatccgcct

SEQ ID NO: 33388 - DNA, 201 bp, Homo sapiens
cttctaacttggtgagttggtttattattttacatgtttaaaagtttgattgtgggatgtgggttgttttttaaaaaatatgtgttggggcctttttttgmgatgggaggcggaggagaccactgaacatcttcacattttggagaggttattcccaaaaatattcgctctgacagttaggaatgcccagggccaccggga

SEQ ID NO: 33389 - DNA, 201 bp, Homo sapiens
gtatatatacccagtaatgggatggctgggtcaaatggtacttctagttctagatccctgaggaatcgccacactgacttccacaatggttgaactagttkacagtcccaccaacagtgtaaaagtgttcctatttctctacatcctctccagcacctgttgtttcctgactttttaatgattgccattctaactggtgtg

SEQ ID NO: 33390 - DNA, 201 bp, Homo sapiens
gatttgcatttctctgatggccagtgatgatgagcattttttcatgtgttttttggctgcataaatgtcttcttttgagaagtgtctgttcatgtccttcrcccactttttgatggggttgtttttttcttgtaaatttgtttgagttcattgtagattctggatattagccctttgtcagatgagtaggttgcaacctac

SEQ ID NO: 33391 - DNA, 201 bp, Homo sapiens
taggaatttaaaaattttaactgtaataatttcaacaaatagatacttccccaaagaaccagattctattaaaattaatcaagtggatattctagaactgmaaatatagaatttactgagatgaagaactcaataaatcaattcagcagattacatacagcagaagagagtattagtgaactgaaagatggatttgttttt

SEQ ID NO: 33392 - DNA, 201 bp, Homo sapiens
tgtggaaatagcaaaattactcagaaaccataacatacattgctacccactacctcttatatttaagtatatgatacactggactagttccttagatagamcctagagatatgtcttcccaagtgactgccagtcttccctattccagtttgcaagagcgtgccttataacaatgcatttttaatttcctgttcccttctg

SEQ ID NO: 33393 - DNA, 201 bp, Homo sapiens
gtacaatatgtattagaactttgaggtataaaaaaaatgcttaactaaattaaaaacttttcctctcaagttctacatcaaacagttcgttaactgcagaygtaaattctggatttgccaaacgtgttcgacaagataattcaagtgagaagcacttacaagaaaacaaaccaacaatgggtatgtctcagcttttaattt

SEQ ID NO: 33394 - DNA, 201 bp, Homo sapiens
tttaatgcatcatgttaaactgcttttcataatttttttctgtacttagtacccatgagagtaactgtttcatctttacctaaaccaaaaatagtaacaasagcaataataatgcatagtcttttttgttttgttttttttgttttgttttgttttgagaccgagtctcgctctatcacccaggctggagtgcagtggcgc

SEQ ID NO: 33395 - DNA, 201 bp, Homo sapiens
aagcttttatgtacatttaattcatttagctagggacagtggctcatccctgtaatcccagcactttgggaggtggaggcaagaagatctcttgaggctargtgtttgagaccaacctggacaacatagcaagaccccatctctaccaaaaaataaaaaaattagtcagtgtagtggcacacatctgtggtcccagcaact

SEQ ID NO: 33396 - DNA, 201 bp, Homo sapiens
tcctgaactgcttgttccagaatcgagaagaaattagacaagaatatctgaagttggaaatgttacttaaagaaaatgaacttaaatcattctaccaacarcagtgccataaacaaatagaaatgatgtgttctgaagacaaagtagaaaaggtaattaacaattttataattaaattttagaaagtataaaaacatgggg

SEQ ID NO: 33397 - DNA, 201 bp, Homo sapiens
gtgccataaacaaatagaaatgatgtgttctgaagacaaagtagaaaaggtaattaacaattttataattaaattttagaaagtataaaaacatgggggcttttttttttttttttttttcagaaggagtctcttcttctgttgcccaagctggagtgcagtggcacaacctcagctcactgcaacctctgccttccggat

SEQ ID NO: 33398 - DNA, 201 bp, Homo sapiens
tcctcctcttctccctttcccctctgccactctccttaagtgtctgaagatgagcatgttattgtcatcttaagaaaaatgttcccaggctcattatatarttaattgtaaaaggtcatactatatgggtgtacagaaaggtttgtaacacatgattttcatgtagcccttacactagccccttgaggaatgaattcttag

SEQ ID NO: 33399 - DNA, 201 bp, Homo sapiens
ttttcttacatcagtgttttatagttttcattatggagctcttttacttctttggttaactcctacttattttatttttagcttttgtaaaggggattactttttttttcaaattatttcagtgtttgtatatagatatgctactgatttttgtatattgattttgtattctggaactctactgaatttgtttctaggttc

SEQ ID NO: 33400 - DNA, 201 bp, Homo sapiens
tcttgtccttcactggtagtatgttgtgtttactaagatgtcacaaatgtttatagataagaataatttttaaatatgaacttagctattataaaatcaawtagtttttcaggaaatgtccaggtatgtgaattgtgtatttggagtgattttagataagttaaagggcttccacatgaacaactaatattgtgaaataat

SEQ ID NO: 33401 - DNA, 201 bp, Homo sapiens
agacaaaacagcaagtatcaatcaaaatgtccgtattgccaagatgtcactcattgacctggcaggatctgagcgagcaagtacttccggtgctaaggggrcccgatttgtagaaggcacaaatattaatagatcacttttagctcttgggaatgtcatcaatgccttagcagattcaaaggtaggcattatatgtttatt

SEQ ID NO: 33402 - DNA, 201 bp, Homo sapiens
tagtacctccacttctgtgagatttcacaacttaatatttttgtgttttatttctttaatcattgtcgcatgtacaatatgtattagaactttgaggtataaaaaaaatgcttaactaaattaaaaacttttcctctcaagttctacatcaaacagttcgttaactgcagacgtaaattctggatttgccaaacgtgttcg

SEQ ID NO: 33403 - DNA, 201 bp, Homo sapiens
acagcttttaaaccaaaggtattaatgtctctttgttgttgttatattttaaattatgttaactaacaactatgaatttcaagagtaaatttttctttctrtggtcataatttttataagttgaacgatgaaaactttttgaatgatatttatgccatatttatgcatctttttatttcttctctagaacataaaagaaac

SEQ ID NO: 33404 - DNA, 201 bp, Homo sapiens
tctgtacatatttcctatgaaatatttatcagtttgacaaaactgcagtaaagtcagtgttttgtggcttatattcattcccaatagagtttcattaagarctactgacgtaaattggcagtgtttttaccgctgatccttatgagtatatctaaaattctggccagtttagaacattttttttaaatgcatgtacttgat

SEQ ID NO: 33405 - DNA, 201 bp, Homo sapiens
ctttaaataattgaacctttctttctggtaaggccctcctctcaggagggaagggcctgagctatgaaataagtatttatttggatgtttttcatatttcmacctgacttttgaccaacaataaaagctttgattttaattctggcaatatgttaagtaacttacttgtatttatgaagaagttaatgataaaaattatgt

SEQ ID NO: 33406 - DNA, 201 bp, Homo sapiens
tttatttttgctaagcaataggattacatatagatgtaagcatagacaaaatgcagtatgttagcaataccagacaccttatgatgcccatatctttcagyaacatgatcttccttgggtgagaaagaaacctaatgtagtataagtaaagttaataactttttctaaacattttttataataggaaatagtcatttttac

SEQ ID NO: 33407 - DNA, 201 bp, Homo sapiens
tttttataattgtaatgaaagtattaattcaggttatgtttctacataatgagttaggcagctgagggttacaagggtctttgctaacctgcttagtcgarcattaatttagacggttaaaccataaagcatcttgattatatatatatatataatagatactattattcgatcttttgggtactatggtacttgagtggc

SEQ ID NO: 33408 - DNA, 201 bp, Homo sapiens
tttgttgtgaaggtattgtctgcatatgatttttataattgtaatgaaagtattaattcaggttatgtttctacataatgagttaggcagctgagggttasaagggtctttgctaacctgcttagtcgaacattaatttagacggttaaaccataaagcatcttgattatatatatatatataatagatactattattcga

SEQ ID NO: 33409 - DNA, 201 bp, Homo sapiens
tatcttttttcccaatgtatgttcttggcagctttgtcaaaaataagtttattgtaaatatgtagatttattttggggctctctattctgttccactggtytgtgtgtctggttttatgccagtcccgtgcttttttggttactatagctctgtagtgtaatttgaagtcaggtaatgtgattcctccagttttgatcttt

SEQ ID NO: 33410 - DNA, 201 bp, Homo sapiens
gatataatttttctaaggataacatgaaagctattgttagtttttttctgtcgatgccctttgattagagtaatataaaattcctcagtaactttgtcaamctatattggtaaatgcctgcttcctgtagtagccagtgtttaccttaagttcaatggaaattgaagcatcagacagcaaattgaaacatcagacagtaag

SEQ ID NO: 33411 - DNA, 201 bp, Homo sapiens
taaaaaattaaatttaatttttttaaaaaagctttggcttgttaaactgttcaaaatgttacctttgatttagaataagtatattaaaataattggagcargttttttttttaaaaaaaggcaaattactgaaatcacatgaagattgcaaaagcaagatgtcttttatattctgagttaaaatctcaaacttgtaagcag

SEQ ID NO: 33412 - DNA, 201 bp, Homo sapiens
ggacatgaactcatccttttttatggctgcatagtcttccatggtgtatatgtgccacatcttcttaatccagtctatcattgatggacatttggattggktacaagtctttgctattgtgaatagtgccgcaataaacatacgtgtgcatgtgtctttatagcagcatgatttataatcctttgggtatatacccagtaa

SEQ ID NO: 33413 - DNA, 201 bp, Homo sapiens
ttatttagtcatcacaaataaaatattgtcccttgctacttgatatattaaagatgtagattttaaagtgtttcattttcttgtctcattactaccccttwcatactctaaaccagtggtccccaacctttttggcaccagggactggttttgtgaaagacaaaacctcagactgagagtagggggtggtttcaggatgat

SEQ ID NO: 33414 - DNA, 201 bp, Homo sapiens
aaagatactgttcaggatatccagatggaactatccactagatagtagatataatagagttatatttcataacaaagagttttgatccctttcttaaaaaytcagtacttgcctatggtgccactggtgctgggaagacccacactatgctaggatcagctgatgaacctggagtgatgtatctaacaatgttacaccttt

SEQ ID NO: 33415 - DNA, 201 bp, Homo sapiens
aggaagggatccagtttcagctttctacatatggctagccagttttcccagcaccatttattaaatggggaatcctttccccatttcttgtttttgtcagrtttgtcaaagatcagatggttgtagatgtatggtattatttctgagggctctgttctgttccattggtctatatctctgttttggtaccagtaccaggct

SEQ ID NO: 33416 - DNA, 201 bp, Homo sapiens
tatgtatttcatttattttgcataaaatggcattagagtttgaaagcactggatattccaaaacctacccaacagatttgtttaaataattgagtatattrgatttttaatcttaacaatttatttaatatttctctagcacactattttactaaattgattagcctatcaaatatttaaatataatgcatacataatgtt

SEQ ID NO: 33417 - DNA, 201 bp, Homo sapiens
agatggaagatgaagactaatctgtagggagattttaagattgctttgaaagagtagttgttagagtggggggccgggggtagtgataccatttatcagartaaagaacataggagtaagagtagatttgtggtaacattcccaggttttaaggataagactataattttggatttgtagggtttaaagatactgttcagg

SEQ ID NO: 33418 - DNA, 201 bp, Homo sapiens
gatcctctttaggactaggaaggattgctgtttttcaggacccagatcaaattcattgcatccacaaaatttccattattctttcttactctacactcaakaatctatagctccttgtattatggaaaccttggcactatatttttactttaccttatattatttcatgtatttatcttatttttttctcatctccactgt

SEQ ID NO: 33419 - DNA, 201 bp, Homo sapiens
tccgcttggtgagagtttttatcataaagggatgttgaattttatcaaatactttttcagcatctattgaaatgatcatatggtttttgttcttcattctwttgatacaatgtatcacattggttaatttgcatatgttgaaccatcttgcatccctgggataaatcccacttggccatgatgaatgatctttcaggtttg

SEQ ID NO: 33420 - DNA, 201 bp, Homo sapiens
taagatatgttacaaaatcactcgtttacatcctcaatttttttgtgttaagactccatattcaaagtctaaaggcacaactgggacattaagacaaaatrtaaacatacgtttcaggaattagtacagggcaattgtttttgaaatgtatatgcagagcactaagcttgtcgcctcctatgacttcccccaaagagtagt

SEQ ID NO: 33421 - DNA, 201 bp, Homo sapiens
agatagggaaatacatgatactttaaaaattaacatccatgtctttgttaaaatatgcaactagttgtgaaacaaagttatatttgacattatacttaaaytctattgactgaaagagtcaaactctgtaaaatatttgaagagatttattctgagccaaatatgagtgaccatggcccatgactcagccctcaggaggtc

SEQ ID NO: 33422 - DNA, 201 bp, Homo sapiens
aggtagagaccagcctgggtgtatcactttccacggccaaggggcttgcagccaagatcacttttactaaaaatagttcacaagctaaggctctccaatcwtaccttgatatggttctgggagatccttttctattcattcccatgacctaagctgaaatagtgctggagggcttgtgaaaatcaaatctgggttttagga

SEQ ID NO: 33423 - DNA, 201 bp, Homo sapiens
ccttattcagaatcaactaaatgctcatttcttttagtcagccatcctagaaaacaaagaaggcaccacataataatgtaggaacgatctcattaattccwgcagatgtaagtatatttgaacatagattaatttttacatttgatgattctgttgaccttaggcatttttattaagaaaattctatccacatatttgttt

SEQ ID NO: 33424 - DNA, 201 bp, Homo sapiens
ttacttatctctgtttcaccatagtcatcaaggcaggaattatgagtgaggggatgactccaactttaagtttcaatttcaaacctaggtaatcaaactcytcaattttctggaatgatagaaaattaatggcaacatgagatcgaaggtatgaggtgaataaaagtgaggtgctgcttgtctttaggataaaattctaat

SEQ ID NO: 33425 - DNA, 201 bp, Homo sapiens
gcaagaagaagcaggagtggggcagataggaagagaattggtatttactgaataccttaatacttaccccttttagcctttgcaacaaacattgaggtatkattatctcttttatacaaatagaaacctgagactcatggggttaagtaacttgtccaaggtcataaaagtgaggtgtaggtgctttgtgacacttggcta

SEQ ID NO: 33426 - DNA, 201 bp, Homo sapiens
cttcctaggaggtgaacttcattttcaatactgtctctatctgctacttttgttctaggactgtttcctacttatccttactccttttctttcctttcccstacctcagcataataataacactcatcgtctctgaataagaaatcacagcctcaaaccccaaagagtttctactgcctcaagtctctatgagtgtccaaa

SEQ ID NO: 33427 - DNA, 201 bp, Homo sapiens
gatatgcagcatatactaagggctgaagtgaaagagtggatgtgtctgcctaggacaatgagggaaggcagagaaaaatgatatttgtgctgagcatttaraagcaggtggaagttttccagctggatcaagtagagggactcctcagaacaaagacagcagagtagaaaggagcagcaaatgctgagagtattgaataat

SEQ ID NO: 33428 - DNA, 201 bp, Homo sapiens
tgcaatttcacattatatttatacatatgttaatatgtgtaacatttagagcctacttaaggaaatattttataattaaataaaatattatttaaaacatytattagaagtaagaatatactgacatttcttaaaactaattttagggaaacagacatgaagcatctctttttttttttcctttttttctgctttttactg

SEQ ID NO: 33429 - DNA, 201 bp, Homo sapiens
taatgcagactcctatgccccattattggactgctacgtttggtccttctgctttcgttcatgttctactgcaattcattctctccactgcaaccaaagcragtttttaaaacgcaaaactgatcttgttgttcttcactgccttctccctagaataaattctccattgtgatttaccaagcctagcatggtctggcacct

SEQ ID NO: 33430 - DNA, 201 bp, Homo sapiens
atttttgctcaggaggtttgtgcgctttgatttggtttttgtttttgtttttgttttgtcaaaattgggatcatactgtatactacctcattaatgaacatttttttatatcatcaaataatctataaaatatagttttaaatatcagtgtaattgtggatgttcatgttcatttagttatttagtcattgcctaagtgat

SEQ ID NO: 33431 - DNA, 201 bp, Homo sapiens
gaaccctgacacagagtttcaagagtcttcctccagtggaatcacacagaatgtgcacaattcctccagcaaaaagttgtggcagcacatgtgaaatgttstctgctttggaagctcttttgagttccatgtcccaggtttttattgggagctggttgcataggcactttctgccaggatgtatcaaaattccagactttt

SEQ ID NO: 33432 - DNA, 201 bp, Homo sapiens
ccctttactgatatctgccagtgtcttttacttaactccttgggatagcactgaagggtaaaggatagggagtactataagtcattctcctccatgccttyccttaagagtctgagctatacaatactctttagaaagtcctctaatgttctggcactcagatgataatgttttcccattaccaacattaggtcaagttta

SEQ ID NO: 33433 - DNA, 201 bp, Homo sapiens
aatgcagattccaggactcctacagttacatggatcagaactcctgaatagaggacaggatcccaagcttgatgagtgggagtagagggaaggggatgtcaaaaaaaaaagaatgccaaagttgagggaatgacatgcataaatggttcatggttttatggagcattgtcaatttctcttaatttacttatgtagaattaa

SEQ ID NO: 33434 - DNA, 201 bp, Homo sapiens
ttgggagtgaagggctaatatgtaagaccttattcacagagaataatagtctgttgaagtcagattttatgttaagtgttgcccctctgaatacaatctgwcttctggcttattgaaatatttcctcagtctttggcttgtaatagttttattatgttatgcctagttgactttatttttacttctcttaagtgggttcct

SEQ ID NO: 33435 - DNA, 201 bp, Homo sapiens
tcttaactgtcttgtttaccactgtacctagcatggtatggtaggtacttaataaatattgggtgggatgaacagtgaattctttttatgcaggtgtactycttttagattgttgcttttgtaccatagctgactacaactttttttcataaataaaacatatgttgatcctggattcaaaatagtagtagtgattttttt

SEQ ID NO: 33436 - DNA, 201 bp, Homo sapiens
gccttagggacctttaaaagtatttactagattaactatattctttttacttaaatacacacacatgcagtgcttttaagaatctgggccagggacagtgkcttacgcctgcaatcccagtattttgggagactgacgcaggccgatcgcttgagtcaggagttcaagaccagcctgagcaacagggcgaaaccctgtctc

SEQ ID NO: 33437 - DNA, 201 bp, Homo sapiens
ttatatttttatgctagtcttgcgcagttcttcatttatagaattttataatcttaattgtccaaaaatttaacatatttttctattaaaattaaaatctrgttaattcagttattttttacagctaaatttggctgtggccatgtaaatgacttcttttgtattttaactagtgatttctctctactagattttattgtt

SEQ ID NO: 33438 - DNA, 201 bp, Homo sapiens
agttgaggctgcagtgagccgagattgcaccattgcacttcagcctaggcaacaaagcaagactctgtctcaaaaaaaaaaaaaaaatctgatgagattawctataatgaatatagtctatattgttgggcatttgggttgtttaataaattttcactattattgccaataatgttttagtaagcaaatatgtatatttat

SEQ ID NO: 33439 - DNA, 201 bp, Homo sapiens
atttaatttgtaggaactgagctcctaaaatgtgttctttttcttattgagtaaatgtctttcataagacaactattattgcctcataactctgagatttmatttacttttaaatgttatttctaagtgattgcatccttttataaggtagcttttaggttaaaataaacaattctatttcaacctgcacttgaggattca

SEQ ID NO: 33440 - DNA, 201 bp, Homo sapiens
tcagggaggatctcactgataaaacttgaaggacttcacaggactagctatatgaatatctgggagaagaaacttttttaggtagagggacacaatcacagtgcaaaatctctaacataggaatttgcctgacatattcaaaggctggtgaggatatataactggtacaaagaaaaagagaatgaaagtagtgaggagatc

SEQ ID NO: 33441 - DNA, 201 bp, Homo sapiens
cagatgaactccgtgctctcacagtgcttacattctagagggaaaacaagcaataaatatgtaaccagataacatatactttccaattagtgctaaactcaagaaagaaaaataaacctagtaagggattggagaagcaaaggcagggtgacactattttagatagattctttagggaaagcctctgtaaagtggcatttg

SEQ ID NO: 33442 - DNA, 201 bp, Homo sapiens
agatgaactccgtgctctcacagtgcttacattctagagggaaaacaagcaataaatatgtaaccagataacatatactttccaattagtgctaaactcaagaaagaaaaataaacctagtaagggattggagaagcaaaggcagggtgacactattttagatagattctttagggaaagcctctgtaaagtggcatttga

SEQ ID NO: 33443 - DNA, 201 bp, Homo sapiens
gatgaactccgtgctctcacagtgcttacattctagagggaaaacaagcaataaatatgtaaccagataacatatactttccaattagtgctaaactcaagaaagaaaaataaacctagtaagggattggagaagcaaaggcagggtgacactattttagatagattctttagggaaagcctctgtaaagtggcatttgaa

SEQ ID NO: 33444 - DNA, 201 bp, Homo sapiens
tgaagaaagtatcagtgcatacaatcaatgaattaaataaaatttattgtacttgcatataattaggggtgaatctttaatctgggatgagcactagctayatatgttataagttaaaaattgacctgttcaacttggcttattaccatgcaagtattcaggataaatagattttaatacctcattaaacattgcagaggc

SEQ ID NO: 33445 - DNA, 201 bp, Homo sapiens
atactcagaagtgggattgcaggatcgtcctaagtctcaccttttggtccttactcagatcttgttgttttggggtgttttattttgttttgtggtttggtttttttttgtctttttgttgttgttgttgtttgtttttttgttttggtttttgggtctgcagattctagagtattttctggatagttgagacttccaaat

SEQ ID NO: 33446 - DNA, 201 bp, Homo sapiens; identical to SEQ ID NO: 8677

SEQ ID NO: 33447 - DNA, 201 bp, Homo sapiens
ccatgttaattatctcatgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttatt

SEQ ID NO: 33448 - DNA, 201 bp, Homo sapiens
aatttcccccattgtctcataaattatttgtttctatgatttgtttgaattaagatacaaacaaggttcatgcctatgcagtcttttttaatcttggacactctctcccacttttgtctttgctaatttttaggttagtgcagaagtaattgtggttttcatcattgaaagtaatggcaatgcttgttgatactttgccaa

SEQ ID NO: 33449 - DNA, 201 bp, Homo sapiens
catgttaattatctcatgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttattt

SEQ ID NO: 33450 - DNA, 201 bp, Homo sapiens
ctcatgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttatttttgtaattatta

SEQ ID NO: 33451 - DNA, 201 bp, Homo sapiens
aataccccatcattctttgaggccttctaccctcttaatagtcaacaaatggtaactaagtggcagacactctaactttgcattcaaatagtgtttcagawaccagtgcagaaacataaaaaccctgatttcattgcctatttatttctggtgccataaaatttctctcttattaacatcttgtagtttggtccctactga

SEQ ID NO: 33452 - DNA, 201 bp, Homo sapiens
gagttattcttcaatcctgtctctctctttcactctacatctacctgtcagtaaattctgtcacctttaccctcagaatacacccataatctgaccacttrccacctctgctgccactaccctattctgagctgacagagttgtctcttgtctacattacttcaatagactagtctattatattatccacatagcagtgag

SEQ ID NO: 33453 - DNA, 201 bp, Homo sapiens
tgtatgcttagattatcccagaggacacgtggatatttcttcagtgttctaccagaagactgtgatttttatcactctttactagcagtagggaaaatgtsgtccaccatgatgggaatttgcccagttgccactcccagagattatacctgctaagtatgtattttaaaaaataatgactctataattcttgtcccttga

SEQ ID NO: 33454 - DNA, 201 bp, Homo sapiens
cctgctaagtatgtattttaaaaaataatgactctataattcttgtcccttgagatttcatgttccattgtattttaaagtttaaaatgttattataaggyctgcatttgcaaagaacatatatacctgtttcaataatacctgtggtttatattaatcatcagccttgataaactggatatctgataaactgaaagtgaa

SEQ ID NO: 33455 - DNA, 201 bp, Homo sapiens
aatgtcatgttaaagggagtggaaaattattttaagatctggatctcatttatctagttctcagaaaagtaaaattcctcagtagaacagggatcatattkttcttctgtttttgaattttatttcctagagggtaattgtcaacctagccaaagcagagcatattgtcaactaatataataagaatagtgcttgtactgt

SEQ ID NO: 33456 - DNA, 201 bp, Homo sapiens
tctggatttgccaaacgtgttcgacaagataattcaagtgagaagcacttacaagaaaacaaaccaacaatgggtatgtctcagcttttaatttgatattyaatggtatgactctgtaacacacatatagtactttacgttttttattgtgttttcataagaatctccctttattcatcacctttactatgtggtagaaca

SEQ ID NO: 33457 - DNA, 201 bp, Homo sapiens; identical to SEQ ID NO: 8678

SEQ ID NO: 33458 - DNA, 201 bp, Homo sapiens
aatttattttttagctccccaaaataagtgagaacatgccaagcttatctttctgtacctggcttatttcacttaacataattaccatcagttccatccaygctgttgcaaatgacagggtctcattcttgtttcatggctgaatggtactctattgtgtataggtactatattttctttttctattcatctgttgattgg

SEQ ID NO: 33459 - DNA, 201 bp, Homo sapiens
attatggagctcttttacttctttggttaactcctacttattttatttttagcttttgtaaaggggattactttttttttcaaattatttcagtgtttgtrtatagatatgctactgatttttgtatattgattttgtattctggaactctactgaatttgtttctaggttctcatagttttttgtggactctacgttttt

SEQ ID NO: 33460 - DNA, 201 bp, Homo sapiens
cataggtatagatgtgctgtggtggtttgctgcacctatcaactcgtcatctatgttttaagcccggcatgcattaggtatttgtcctaatgctctccctycccttgccccctacccctgacagcctctggcatgtgatgttcccctccctgtgtccatgtgttctcattgttcaactcccacttgtgagtgagaacgtgc

SEQ ID NO: 33461 - DNA, 201 bp, Homo sapiens
ggtaatgacagtatcatattagaattatgttctgctacaaggttgcagtagtctaactttagtgccttaactagtgtgggctgtcttttgttctcttaacrataagtcttggaagtatgcagttcatttctaatgcagtacctttaaaatgtcattatcgtgcttgtcgtttcatgattgtaatattactgtttcatatct

SEQ ID NO: 33462 - DNA, 201 bp, Homo sapiens
catgccctttagctcattgttagcccaagaagcatctttagtgctttttttggcctttcaagaaagccatgttgatttcctttttaaaaaaaaaaaaagagagagagagagagagatacccaagatgcaaaatggccagtttttcagtgcctaccaggcactaaacaccattattaatatcttatttttgtaattattagt

SEQ ID NO: 33463 - DNA, 201 bp, Homo sapiens
ttataaataattaaatgttaaataataattaaaataaaaattatgtgtggttacataaataattttattttctcaaaaatagtgaaaatagaagagtggcrttgttttacatgtttgcaaatttctttaatgcctggcttttcatatcagctctattctcataactgctgaattgttattctgttgtgatgttacacatca

SEQ ID NO: 33464 - DNA, 201 bp, Homo sapiens
atttagtaatattatcctaataatcaatgaggaaaccaaaatacaagtcattttgtccaaggtgacacagctcctaggtgctgagttctgatttgatctgyagcatgccagatctagagcctgtgctcttatgtttatgcttttttacatgagctgggagacagatttgagaaaattacaccaaatgcaggataaagataa

SEQ ID NO: 33465 - DNA, 201 bp, Homo sapiens
ttggattctctccaatagaggtttgttatcagaagtgctgaaagaatctcataacatcgattcagctataaatagttctggagtatggattttgaaattastattaaagggaagctcctgggtaatttcatgaccccataaaaataatctgtaagattgtttttaatgtaaaaatatgaatttaccatattagcaattatt

SEQ ID NO: 33466 - DNA, 201 bp, Homo sapiens
gtctcccctggcctcccaaattgctgagattataggcatgagctgctgtgcctaacccattttatctatttttgatggaacaattttgcttcccatccttytttaaaatgtaacctctattaagggcaggaaattataattaatcatatcatattttataataataatctgttcttaagatcaactaacagtgtagagttt

SEQ ID NO: 33467 - DNA, 201 bp, Homo sapiens
gactatgtaatcccaaagtaatttagataattgttattttactgtcttaattcctccattgaattttgaatgtggttatctagaaagattaagacatagartaatagaatgggtttgactggttttatggttttgttttttttttttctgttttcatccttatttttctgcacagtagcttagacttttttcaacccaatt

SEQ ID NO: 33468 - DNA, 201 bp, Homo sapiens
aaagaatcagcatatcccttacagaaatagtaagcttactcgcttgttaaaggattctcttggaggaaactgtcaaactataatgatagctgctgttagtycttcctctgtattctacgatgacacatataacactcttaagtatgctaaccgggcaaaggacattaaatcttctgtaagtctgtttactctgcctttgtt

SEQ ID NO: 33469 - DNA, 201 bp, Homo sapiens
tctctcagaatttgaaagtagccagaaccacaatgaatggactggagttggcacatgatgttaaacatatttgccatgttaggaattattaacaatagatwgggaaggtaggatattggtatagattgtgaaattgttggttgctaggagtctaaaatctatttttgtagccaaaatgcagtctttcaagcaagggagtag

SEQ ID NO: 33470 - DNA, 201 bp, Homo sapiens
tccctgtgtagggtattactcaagaaatctttgtccagtccagtgtcctggagagtttccccaatgttttcttttagcagtttcatagtttgaggtcttamatttaaatttttatccattttgatttcatttctgtatattgcaagagatagggatctagcttcattcttctgcatatggataaacagttttccagcactg

SEQ ID NO: 33471 - DNA, 201 bp, Homo sapiens
tgactggaaaaaattagaaaaatattttgtgacacctgataattataaaacattcaaatttcagtgttaataaataaagttttatttcaaaaaacaaaacmaaaaaaagtagatctcagacagcacatcatttcttccatttacatcaagtgtgtataaaagaaaaatgtcatcaaatatctaatgtgtgcaaatttcccc

SEQ ID NO: 33472 - DNA, 201 bp, Homo sapiens
acccacagcaaatttcactgatctgtggccataccttctctcagaatttgaaagtagccagaaccacaatgaatggactggagttggcacatgatgttaarcatatttgccatgttaggaattattaacaatagattgggaaggtaggatattggtatagattgtgaaattgttggttgctaggagtctaaaatctatttt

SEQ ID NO: 33473 - DNA, 201 bp, Homo sapiens
actactaagccaattcttcgtagttttttgaatggatataattgcacaggtatttgtttcaatttgggatttaatttctctatccgatttcacttttgcaytaggacggacatctacttgacccttctaaatataatcaaatttaaggagcttgtatgctaaaaattcttaagaaattcaatagacttgaactgtaaatat

SEQ ID NO: 33474 - DNA, 201 bp, Homo sapiens
atttcccccattgtctcataaattatttgtttctatgatttgtttgaattaagatacaaacaaggttcatgcctatgcagtcttttttaatcttggacactctctcccacttttgtctttgctaatttttaggttagtgcagaagtaattgtggttttcatcattgaaagtaatggcaatgcttgttgatactttgccaat

SEQ ID NO: 33475 - DNA, 201 bp, Homo sapiens
taatgtatcattgataccagtttgtcagtagctattaaactatattatcaaaattagtaatatatttattgagtgtgtgctttttatgccttaatgaaatkttcttttcaattttgtgttttgagatgcatttaagatgttccttgcattcttttaaggcagaaaggaaacaatttatttcttcgaatttatatcttgctg

SEQ ID NO: 33476 - DNA, 201 bp, Homo sapiens
ttttagggtacttaagtgcatatgtgtgtatgtgtgcatatatttgtgtgtgtgtgttgtgtgtgcctacgtatgtatgtatttttcccccagtgtttacytagtgagtgaaacagaattattaacatcttttttgaatgaatactacatgccagttgttttgcatgaaagtaaaaactgatattaaaactttattttctt

SEQ ID NO: 33477 - DNA, 201 bp, Homo sapiens
tttcccccattgtctcataaattatttgtttctatgatttgtttgaattaagatacaaacaaggttcatgcctatgcagtcttttttaatcttggacactctctcccacttttgtctttgctaatttttaggttagtgcagaagtaattgtggttttcatcattgaaagtaatggcaatgcttgttgatactttgccaata

SEQ ID NO: 33478 - DNA, 201 bp, Homo sapiens
ttgttagcctatgaaatgggaaagatacgctgtaccggaaattaatcataaagcattcagtaatgtatcattgataccagtttgtcagtagctattaaacwatattatcaaaattagtaatatatttattgagtgtgtgctttttatgccttaatgaaattttcttttcaattttgtgttttgagatgcatttaagatgtt

SEQ ID NO: 33479 - DNA, 201 bp, Homo sapiens
ttcccccattgtctcataaattatttgtttctatgatttgtttgaattaagatacaaacaaggttcatgcctatgcagtcttttttaatcttggacactctctcccacttttgtctttgctaatttttaggttagtgcagaagtaattgtggttttcatcattgaaagtaatggcaatgcttgttgatactttgccaatag

SEQ ID NO: 33480 - DNA, 201 bp, Homo sapiens; identical to SEQ ID NO: 27410

SEQ ID NO: 33481 - DNA, 201 bp, Homo sapiens; identical to SEQ ID NO: 27535

SEQ ID NO: 33482 - DNA, 201 bp, Homo sapiens; identical to SEQ ID NO: 27538

SEQ ID NO: 33483 - DNA, 201 bp, Homo sapiens; identical to SEQ ID NO: 27542

SEQ ID NO: 33484 - DNA, 201 bp, Homo sapiens; identical to SEQ ID NO: 27545

SEQ ID NO: 33485 - DNA, 201 bp, Homo sapiens; identical to SEQ ID NO: 27548

SEQ ID NO: 33486 - DNA, 201 bp, Homo sapiens; identical to SEQ ID NO: 27254

SEQ ID NO: 33487 - DNA, 201 bp, Homo sapiens; identical to SEQ ID NO: 27255

SEQ ID NO: 33488 - DNA, 201 bp, Homo sapiens; identical to SEQ ID NO: 27550

SEQ ID NO: 33489 - DNA, 201 bp, Homo sapiens; identical to SEQ ID NO: 27346

SEQ ID NO: 33490 - DNA, 201 bp, Homo sapiens; identical to SEQ ID NO: 27347

SEQ ID NO: 33491 - DNA, 201 bp, Homo sapiens; identical to SEQ ID NO: 27257

SEQ ID NO: 33492 - DNA, 201 bp, Homo sapiens; identical to SEQ ID NO: 27256

SEQ ID NO: 33493 - DNA, 201 bp, Homo sapiens; identical to SEQ ID NO: 27286

SEQ ID NO: 33494 - DNA, 201 bp, Homo sapiens; identical to SEQ ID NO: 27288

SEQ ID NO: 33495 - DNA, 201 bp, Homo sapiens; identical to SEQ ID NO: 27332
  misc_feature (1)...(201): n = A,T,C or G, or insertion/deletion polymorphism (see Tables 1-2)

SEQ ID NO: 33496 - DNA, 201 bp, Homo sapiens; identical to SEQ ID NO: 27333

SEQ ID NO: 33497 - DNA, 201 bp, Homo sapiens; identical to SEQ ID NO: 27263

SEQ ID NO: 33498 - DNA, 201 bp, Homo sapiens; identical to SEQ ID NO: 27268

SEQ ID NO: 33499 - DNA, 201 bp, Homo sapiens; identical to SEQ ID NO: 27269

SEQ ID NO: 33500 - DNA, 201 bp, Homo sapiens; identical to SEQ ID NO: 27570

SEQ ID NO: 33501 - DNA, 201 bp, Homo sapiens; identical to SEQ ID NO: 27360

SEQ ID NO: 33502 - DNA, 201 bp, Homo sapiens; identical to SEQ ID NO: 27361

SEQ ID NO: 33503 - DNA, 201 bp, Homo sapiens; identical to SEQ ID NO: 27271
  misc_feature (1)...(201): n = A,T,C or G, or insertion/deletion polymorphism (see Tables 1-2)

SEQ ID NO: 33504 - DNA, 201 bp, Homo sapiens; identical to SEQ ID NO: 27362

SEQ ID NO: 33505 - DNA, 201 bp, Homo sapiens; identical to SEQ ID NO: 27273

SEQ ID NO: 33506 - DNA, 201 bp, Homo sapiens; identical to SEQ ID NO: 6799

SEQ ID NO: 33507 - DNA, 201 bp, Homo sapiens; identical to SEQ ID NO: 27274

SEQ ID NO: 33508 - DNA, 201 bp, Homo sapiens; identical to SEQ ID NO: 27311

SEQ ID NO: 33509 - DNA, 201 bp, Homo sapiens; identical to SEQ ID NO: 27453

SEQ ID NO: 33510 - DNA, 201 bp, Homo sapiens; identical to SEQ ID NO: 6803

SEQ ID NO: 33511 - DNA, 201 bp, Homo sapiens; identical to SEQ ID NO: 27396

SEQ ID NO: 33512 - DNA, 201 bp, Homo sapiens; identical to SEQ ID NO: 27399

SEQ ID NO: 33513 - DNA, 201 bp, Homo sapiens; identical to SEQ ID NO: 27407

SEQ ID NO: 33514 - DNA, 201 bp, Homo sapiens
ggggacaggtttgtgggggactgaggggacaggtaggctccagtcatctcctccacagtcagtctggggcgagtcttttcaccaccagtggtcttggcacwccccaacctatctagactgtcgcggactccaagcagagccaagcctgtttgtctctttatcccccacaagccaggatgggccttagtcactttgcaactg

SEQ ID NO: 33515 - DNA, 201 bp, Homo sapiens
ggaatttggccggggcgggagcagggggtagacaagattcagcccataacagaccctgttgtttactgggcctgggacgcagagtctttgctagagtccastgtgaaagcattctgcagcagcacccaccaggtgacagttccaaatcttgtcttttagaatttcattttcatgggtgacttcaatgccggctgcagctac

SEQ ID NO: 33516 - DNA, 201 bp, Homo sapiens
catagaaagggggtaatgataacactctcctcataaggcaagaaataatggctgtaaagatcgtggcagatgccacattccagccaatcaatggtggctcytctcattggactcaaaggttatgatgaacagtggcccttccacatgatgccattgggcgtatggaggcagattggaaagaaaggaacatgtacagtaggg

SEQ ID NO: 33517 - DNA, 201 bp, Homo sapiens
  misc_feature (1)...(201): n = A,T,C or G, or insertion/deletion polymorphism (see Tables 1-2)
gcagattggaaagaaaggaacatgtacagtaggggaatgtttactcttcaagatgcagtgttaaatctttgttttctagaaattcaaggagaggcataacntacaactatgtgattagctctcggcttggaagaaacacatataaagaacaatatgcctttctctacaagtaagtatcacctatgctccctggaacatggc

SEQ ID NO: 33518 - DNA, 201 bp, Homo sapiens
atagagtgagactcttgtctcaaaaaaaaaaaaaaaatcctaagcaatggcttaggtgaacccctagcctagaggctcactctccctccagtcactgcatygcagactcctccacaggccgcagcgggtgaggaaatccaaatggattgctccctgaactctaacaacagtacttgtactggcccctgattaagtgccagc

SEQ ID NO: 33519 - DNA, 201 bp, Homo sapiens
gggtgaggaaatccaaatggattgctccctgaactctaacaacagtacttgtactggcccctgattaagtgccagcctcctgtaatccttgcaatgactayaaggtagggagtaggattatctccactttacatttcaggaaactgaggtttaaaaaggcatggagtcacccagctactgaaatggacaggccagggttgt

SEQ ID NO: 33520 - DNA, 201 bp, Homo sapiens
ctcgctatgttgcctaggctgttcttgaacccctgagctcaagccatctgcctgccttggcttcccaaagtgctgggattacaggtgtaagccactgtgcscagccagtggttaacatgcagtgttatgcaatgctcgatggagtcaagaatcaaatattttttcagtacctactatgtaccaggctctgttgagggcact

SEQ ID NO: 33521 - DNA, 201 bp, Homo sapiens
cctttcttaaataggtaaaggcaagggagaacaaaggaaaagaggaagttgcttatgccaaatagggaaggggcaaaggctgtgagctggaatgtgcctgygagctggaatgtccagcacaaatatcttggttaaggtacaaggacatagaatgtactatgtgcctgtgagcatgtctaacagctacataggatagagctt

SEQ ID NO: 33522 - DNA, 201 bp, Homo sapiens
  misc_feature (1)...(201): n = A,T,C or G, or insertion/deletion polymorphism (see Tables 1-2)
ctggatccagggctcagacaaggtaatcagagcttgatttgtctcttcctttctatctcctggttgccctttcctctgtgtggctccattctcaggttggntccatccctgggatggcaggacagccaccagcagcctccagaccaaaataaattttctttcccacaaggcaacaaatagtgtgggactgagtctcattgg

SEQ ID NO: 33523 - DNA, 201 bp, Homo sapiens
aaggtgaggaaaagggcacagagaagtttggttatttgtccagggctgaacagccagtaagtaaaagtgtatatgctttaacgtcatcagcattcccgacrtgagatgacccccaagcccccggagatatttggcaacatctgtcgaaatttttggttgtcacaactgggggatgtgattggcatctagtgggtagaggca

SEQ ID NO: 33524 - DNA, 201 bp, Homo sapiens
aacatgatgagactccatctctatgaaaaattcaaaaaaattagctgggcatggtgatgcatgcctatggtcccagctacttgggaggctgaggtgggagkatcacttgagtccaggaagcggaggttgcagtgagccaagatcgcaccactgcactccaggctgggcaacagagtgagatcctgtctcaaaaaaaaaaaa

SEQ ID NO: 33525 - DNA, 201 bp, Homo sapiens
  misc_feature (1)...(201): n = A,T,C or G, or insertion/deletion polymorphism (see Tables 1-2)
aggagtggagactttcccacagacttcttgtttcttcttgctgcttttgggtgactcagcctatgacacttttgctcctcctgaaatctccatatcttgcntttctcaaattccaaggtagcctttgcgcaacatatcactctccactgactcttgtcccatcagggcccatagtggatggctgtatgggggccatgtgac

SEQ ID NO: 33526 - DNA, 201 bp, Homo sapiens
gccttccctgggtcctccagtattacatggaggggttggagtgaaccttctggaggtggggtcaatgactcttggaggtaggggaaagcttcctttgaccmagttgcacacaaagacagaaaacgtgtttgcatgggcattgtttaacctgcttaaaagaatgaaaagattttagcacttttttctttttctgtaattact

SEQ ID NO: 33527 - DNA, 201 bp, Homo sapiens
agtgaaccttctggaggtggggtcaatgactcttggaggtaggggaaagcttcctttgaccaagttgcacacaaagacagaaaacgtgtttgcatgggcawtgtttaacctgcttaaaagaatgaaaagattttagcacttttttctttttctgtaattactaaagaagtacatgtttttgcaaaaaaaaaaaaaaaatca

SEQ ID NO: 33528 - DNA, 201 bp, Homo sapiens
  misc_feature (1)...(201): n = A,T,C or G, or insertion/deletion polymorphism (see Tables 1-2)
gaagaaattattttaataagcactcagtgcaatacttaaaaacagtaagtgtccaataaaaggttttatttatctgtggtaaatgacctcaaacccctggnaattctctttcttgcaggtcatcaaacgctgtgacatcatactcgtgatggaaatcaaggacagcaacaacaggatctgccccatactgatggagaagct

SEQ ID NO: 33529 - DNA, 201 bp, Homo sapiens
acttcgtgattatccccctgcacaccaccccagagacatccgttaaggagatcgatgagttggttgaggtctacacggacgtgaaacaccgctggaaggcrgaggtgaggactgctgtgtcagacgaattcccatctagcaggggcaggctctggtccctgagtgggatgagtacctctccagggagggggaggaggaagg

SEQ ID NO: 33530 - DNA, 201 bp, Homo sapiens
aaaccatagaaagggggtaatgataacactctcctcataaggcaagaaataatggctgtaaagatcgtggcagatgccacattccagccaatcaatggtgrctcctctcattggactcaaaggttatgatgaacagtggcccttccacatgatgccattgggcgtatggaggcagattggaaagaaaggaacatgtacagt

SEQ ID NO: 33531 - DNA, 201 bp, Homo sapiens
tggctcagatcttcagctcccagattcgcaacagctccctggctgttgagaagagttgacttagccttgttctcaggaaaacgatcctgtgcttgagcctkctctggcttctgagaaagccatgggaacctacatctctgcttcatgaaagtagtaagaaaagggctgactcagctgggaggacttccttttccttcttat

SEQ ID NO: 33532 - DNA, 201 bp, Homo sapiens; identical to SEQ ID NO: 8708

SEQ ID NO: 33533 - DNA, 201 bp, Homo sapiens
attgtttaacctgcttaaaagaatgaaaagattttagcacttttttctttttctgtaattactaaagaagtacatgtttttgcaaaaaaaaaaaaaaaatmaaacaatatacaagtatatagagtaaaaagtggaagtcctcctttcatctcctccctgcatccctccctgcaccctggagtgttccatattaaggttttg

SEQ ID NO: 33534 - DNA, 201 bp, Homo sapiens
ccctttgcctctcggtcctgtgtcctcaccatgcacccttgtggtcagcctggaaaggccaacttgatagttacaggctgcttcagatctgccacccacgkggtgacaagtcctggcgcgttggcatgggtggtactgaaaaaggctatggatccagggcagtgcagcggccagtggcaagggatgaggcggggtctccaa

SEQ ID NO: 33535 - DNA, 201 bp, Homo sapiens
ttcccaagtcaaacagtgtttttgacttccagaaagcttacaagctgactgaagaggaggtaaggttgccatcttgtctttctatgccattgtcctggaargatgagttagcttgggcaacatgatgagactccatctctatgaaaaattcaaaaaaattagctgggcatggtgatgcatgcctatggtcccagctacttg

SEQ ID NO: 33536 - DNA, 201 bp, Homo sapiens
ctgggcatggtgatgcatgcctatggtcccagctacttgggaggctgaggtgggaggatcacttgagtccaggaagcggaggttgcagtgagccaagatcrcaccactgcactccaggctgggcaacagagtgagatcctgtctcaaaaaaaaaaaaaaaaaaagatgggttgatgccaccctttgaggtcaccactgaag

SEQ ID NO: 33537 - DNA, 201 bp, Homo sapiens
ccttctccagcgccattcttctcccctggcaaatgagtgggaagtgattgaaaatgatacagaagaatcagaaggcaacatggccacagtagatcaggtcwggggtagaacaggttagaaaaagatgtttactaaaaggatcctgattttatacacatgtatcccaaaggatggtgggattacatgtgacattttaaagat

SEQ ID NO: 33538 - DNA, 201 bp, Homo sapiens
tcaaggaacttaaagttggcccttagggggaatgtagaagctggcttggaacaataaccacttcaactctctgtacctcctgccgtcatcttaaaacaggrgtgataacaatggttccctccagggttgctggggggactacaggagttggcaaatggaaagctcttaatgtagtatctggctcattatacgttccagata

SEQ ID NO: 33539 - DNA, 201 bp, Homo sapiens
agacgcagatgtgttttccagggagccctttgtggtctggttccaatctccccacactggtaagacccacacaggcctttctgtctgggacctccccaacrgcccatgaatgcgcagcagccttgagcatgagcccattaaggaggcattaggctggatgtgacagtgcattgcttctaatacttcaatgtagacgatgca

SEQ ID NO: 33540 - DNA, 201 bp, Homo sapiens
acctgcttaaaagaatgaaaagattttagcacttttttctttttctgtaattactaaagaagtacatgtttttgcaaaaaaaaaaaaaaaatcaaacaatmtacaagtatatagagtaaaaagtggaagtcctcctttcatctcctccctgcatccctccctgcaccctggagtgttccatattaaggttttggtatgcct

SEQ ID NO: 33541 - DNA, 201 bp, Homo sapiens
attatccccctgcacaccaccccagagacatccgttaaggagatcgatgagttggttgaggtctacacggacgtgaaacaccgctggaaggcggaggtgakgactgctgtgtcagacgaattcccatctagcaggggcaggctctggtccctgagtgggatgagtacctctccagggagggggaggaggaagggcatgtgc

SEQ ID NO: 33542 - DNA, 201 bp, Homo sapiens
tccatattaaggttttggtatgcctggttcagtgggtgagaagattaatctggagtcagcactctgagattgaatctcagctttgccacatgctagctctstttccttgggcacaagcctcactttgctcatctctaaaataaagtagccgtaggaagggcttggcaggtatgggatgagatgaaacacagaaagccctaa

SEQ ID NO: 33543 - DNA, 201 bp, Homo sapiens
aaataaagtagccgtaggaagggcttggcaggtatgggatgagatgaaacacagaaagccctaatgcagcacctgaacctagttggattcagttaaatttrgccgttagaattttccttccagaatccaggcattttttaaaaggtccaatttcattcaatggatgtgctaattcgagaatggggtccatctcttaatctg

SEQ ID NO: 33544 - DNA, 201 bp, Homo sapiens
ctaaatcatttgaattctaataaagtaaacaaacaaaacattgatgataacctaaagtgtttataaatgttccagaactgtattcagacaaaggtttcaamgtaaagtcatgaacctgaatcaaaccctaccaagtgcacattttataagagagttacaagattttctatatagttggcccagcagctctcattaagtcca

SEQ ID NO: 33545 - DNA, 201 bp, Homo sapiens
aaggtttcaacgtaaagtcatgaacctgaatcaaaccctaccaagtgcacattttataagagagttacaagattttctatatagttggcccagcagctctyattaagtccatgaaataccgcatattccatcttaaaacacacaaaaagagtataccatggctctgagtctcttaaacatttctacactttaattctaaat

SEQ ID NO: 33546 - DNA, 201 bp, Homo sapiens
  misc_feature (1)...(201): n = A,T,C or G, or insertion/deletion polymorphism (see Tables 1-2)
tgtcccccagcagaaggttccgtcaccccaggtgccctctagggtggaccacttccgagttcatccactgtcaggaaaaggcacatggcatgcaaccgcangaccgatgactagatgtcagagctggctcccggttgggatatgagtgactttgtggaggatggcgcctaaatgaggcatgccaatttctgcaccagggtg

SEQ ID NO: 33547 - DNA, 201 bp, Homo sapiens; identical to SEQ ID NO: 8705

SEQ ID NO: 33548 - DNA, 201 bp, Homo sapiens
tctttcccacaaggcaacaaatagtgtgggactgagtctcattggctctgactgggtcaggtgtccatccctgaaccaatcattgtgatcagggtgttgasctactctgattgactaaatctgtgtccaccccagctccaccccaaactcagtttgaggtggaggagggatgggtggtctcccaaaggaacttggggtgct

SEQ ID NO: 33549 - DNA, 201 bp, Homo sapiens
ctttcccacaaggcaacaaatagtgtgggactgagtctcattggctctgactgggtcaggtgtccatccctgaaccaatcattgtgatcagggtgttgagmtactctgattgactaaatctgtgtccaccccagctccaccccaaactcagtttgaggtggaggagggatgggtggtctcccaaaggaacttggggtgctg

SEQ ID NO: 33550 - DNA, 201 bp, Homo sapiens; identical to SEQ ID NO: 8687

SEQ ID NO: 33551 - DNA, 201 bp, Homo sapiens
ttaaggtacaaggacatagaatgtactatgtgcctgtgagcatgtctaacagctacataggatagagcttaacaaagagttattagcacaaagcaaggagrcttgaaggaagttagtctttaaaggaaactattatttctaacacttatgatttattctttaataagaagggaaactttgaagaggaaacttttttacttt

SEQ ID NO: 33552 - DNA, 201 bp, Homo sapiens
tacagtaggggaatgtttactcttcaagatgcagtgttaaatctttgttttctagaaattcaaggagaggcataacgtacaactatgtgattagctctcgscttggaagaaacacatataaagaacaatatgcctttctctacaagtaagtatcacctatgctccctggaacatggccaccaataaatcgtgaattgaatc

SEQ ID NO: 33553 - DNA, 201 bp, Homo sapiens
atcgtggcagatgccacattccagccaatcaatggtggctcctctcattggactcaaaggttatgatgaacagtggcccttccacatgatgccattgggcrtatggaggcagattggaaagaaaggaacatgtacagtaggggaatgtttactcttcaagatgcagtgttaaatctttgttttctagaaattcaaggagag

SEQ ID NO: 33554 - DNA, 201 bp, Homo sapiens
  misc_feature (1)...(201): n = A,T,C or G, or insertion/deletion polymorphism (see Tables 1-2)
atgcaaccgcaagaccgatgactagatgtcagagctggctcccggttgggatatgagtgactttgtggaggatggcgcctaaatgaggcatgccaatttcngcaccagggtgacgaacataagggctccttaaaggctagcccaatgtatctgtatttccttggggattaaaacccatgatcttcagttcctcagagaact

SEQ ID NO: 33555 - DNA, 201 bp, Homo sapiens
tgagtccaggaagcggaggttgcagtgagccaagatcgcaccactgcactccaggctgggcaacagagtgagatcctgtctcaaaaaaaaaaaaaaaaaaagatgggttgatgccaccctttgaggtcaccactgaagacacaacattgggcactagaccttgaccctcaatgcctatgattctgtgatttgaggcccctc

SEQ ID NO: 33556 - DNA, 201 bp, Homo sapiens
ttctgccagggtcccaccctgaacccctgctccaggaggatgtcctccgccctgcataccccatgctctccctccctgggggccttggctctgccccccccatgccctgccctattccagagcccgggccaagtgcccccagccctcatgtgcgccctacctctattgcaacatccaccacattatatttgtcaccaaggt

SEQ ID NO: 33557 - DNA, 201 bp, Homo sapiens
agatgaaatctcgctcttgtccccaggctggagtgcaatggtgcaatctcggctcactgcaacctccacctcccgggttcaagtgattctcctgcctcccragtagctgggattacaggcatgtgccaccacgcctggctaatttttatatttttaatagaaatggggtttcaccatgttggccaggctggtcttgaatgc

SEQ ID NO: 33558 - DNA, 201 bp, Homo sapiens
cccttcctcctcttgagttctgctgctcaaatgcaaaatgaatcaaataaagtgtgaacatagtccatcagagctggggcatggaaaagaccaggggtgtrtttcattgcttattaataaataggtcaaaagaaagattcattctttccaaaaattatgaaatcattcacttattaaacaagaatgtattgagcatctatt

SEQ ID NO: 33559 - DNA, 201 bp, Homo sapiens
ctctaccaaaaaaaaaaaaaaaaaaaaaaaacaaagctagccaggcatgatggtgcatgcctgtaatcccagttacttgggaggctgaggcaggagaatcrcttgaacctgggaggcagaggttgcagtgagccgaaattgtgccattgcactccagcctgggcaacaagaacgaaactccgtctcaaaaaaaaaaaaagg

SEQ ID NO: 33560 - DNA, 201 bp, Homo sapiens
gttttccagggagccctttgtggtctggttccaatctccccacactggtaagacccacacaggcctttctgtctgggacctccccaacggcccatgaatgygcagcagccttgagcatgagcccattaaggaggcattaggctggatgtgacagtgcattgcttctaatacttcaatgtagacgatgcagttcagtgtgat

SEQ ID NO: 33561 - DNA, 201 bp, Homo sapiens
  misc_feature (1)...(201): n = A,T,C or G, or insertion/deletion polymorphism (see Tables 1-2)
gcctaatgaccccaagatcattaaaatctcggccactggctggaccctctgggaactggggacccagataatgcagcctgtgccttctggaggggacagcnggtttccctccagcagtgtttatgagaccttgacaggggaagtgtgtgacccccgcctctttcctgtttctcagctgtcaaagacttcgtgattatcccc

SEQ ID NO: 33562 - DNA, 201 bp, Homo sapiens
tctctacaaaaaatacaaaaattagccaggcatggtggcacacacctatactcccagctactcaggaggctgaggtgggaggatcgcttgagcccagaagrtggaggctgcagtgagccaggatcgcaccactgcactccagcctgggtaacagagtgagactttgtctcaaaaataaaaaataaaaataaaaataagaaa

SEQ ID NO: 33563 - DNA, 201 bp, Homo sapiens
taggggggccaggagccctgggtccagattccacctaccagacttgtgagcttgggaggccctgcccctccctgaaccaccagctcccctagtaaaatggygaccacatccaaataccacctgtagcactggctggtgaagagaactcagggtgcctgaggcacccagcagagcctgcagcaaggtgggtatccatgagcc

SEQ ID NO: 33564 - DNA, 201 bp, Homo sapiens
taaaatggcgaccacatccaaataccacctgtagcactggctggtgaagagaactcagggtgcctgaggcacccagcagagcctgcagcaaggtgggtatycatgagccagagccgctgctgttgctgtcactgggaaggaggattggagtgaggactggcaggctctgttcttccttggacgagcctctcagacccaggt

SEQ ID NO: 33565 - DNA, 201 bp, Homo sapiens
attggagtgaggactggcaggctctgttcttccttggacgagcctctcagacccaggtggccctgccctttgggaggtaaccaaggccttctagatggtgktgtttagccaggatagcaatgccaagcctgtgggagccatgacaagattgttcaatgggaaaccctgacatgcaaggcaatgattttccccacttcacac

SEQ ID NO: 33566 - DNA, 201 bp, Homo sapiens
  misc_feature (1)...(201): n = A,T,C or G, or insertion/deletion polymorphism (see Tables 1-2)
acttcacacatggcccgtggagcctgggtagccactgagttcccatctccttcctcactgatgaaacccggctgtctttttgttccttggtgagtccatcntgggggcttgaactctgcatctcccctgagcagctgtgtcctgcagagcatgtccgaagtccttgtcaaggctgcctcaccctccccatcctaccaagag

SEQ ID NO: 33567 - DNA, 201 bp, Homo sapiens
gaaagcttacaagctgactgaagaggaggtaaggttgccatcttgtctttctatgccattgtcctggaaagatgagttagcttgggcaacatgatgagacyccatctctatgaaaaattcaaaaaaattagctgggcatggtgatgcatgcctatggtcccagctacttgggaggctgaggtgggaggatcacttgagtcc

SEQ ID NO: 33568 - DNA, 201 bp, Homo sapiens
  misc_feature (1)...(201): n = A,T,C or G, or insertion/deletion polymorphism (see Tables 1-2)
atttttagtagaggcgggtttcaccatgttggccaggctggtctcgaactcctgacctcaggtgatctgcccatcttggcctcccaaagtgctggtattanaggcgtaagccaccgtgcccggctgggactgtattttaacagttcaacatggtgggctttgtagtcacgcagacctaagttcaaatcctgactctaccac

SEQ ID NO: 33569 - DNA, 201 bp, Homo sapiens
tcaccatgttggccaggctggtctcgaactcctgacctcaggtgatctgcccatcttggcctcccaaagtgctggtattacaggcgtaagccaccgtgccyggctgggactgtattttaacagttcaacatggtgggctttgtagtcacgcagacctaagttcaaatcctgactctaccacctatcctggctgtatgactt

SEQ ID NO: 33570 - DNA, 201 bp, Homo sapiens; identical to SEQ ID NO: 8710

SEQ ID NO: 33571 - DNA, 201 bp, Homo sapiens
ccaagcactgctgtcttctcacagagtcttgaagccagagcagcgccaggatgtcacgggagctggccccactgctgcttctcctcctctccatccacagygccctggccatgaggatctgctccttcaacgtcaggtcctttggggaaagcaagcaggaagacaagaatgccatggatgtcattgtgaaggtgagcccct

SEQ ID NO: 33572 - DNA, 201 bp, Homo sapiens
ccaggtgacagttccaaatcttgtcttttagaatttcattttcatgggtgacttcaatgccggctgcagctacgtccccaagaaggcctggaagaacatcygcttgaggactgaccccaggtttgtttggctgatcggggaccaagaggacaccacggtgaagaagagcaccaactgtgcatatgacaggtaggaggccct

SEQ ID NO: 33573 - DNA, 201 bp, Homo sapiens
cttgaaccagggaggcagaggttgcagtgagccgagatcgtaccactgcactccagcttgggcgatagagtgagactcttgtctcaaaaaaaaaaaaaaaatcctaagcaatggcttaggtgaacccctagcctagaggctcactctccctccagtcactgcatcgcagactcctccacaggccgcagcgggtgaggaaat

SEQ ID NO: 33574 - DNA, 201 bp, Homo sapiens
ggcaaggtcaatgggacttcatggctgtatccccagcacccaggatataaacaacagtgaattgaaatcgtggtcccaaagcttgtaaaaaaatgcctgawggctttcagaggagagaatattcctgcttatcataaatgctcaggagtggttcgtggacacggacaggtggcctgatgacatttattccaccagaaagca

SEQ ID NO: 33575 - DNA, 201 bp, Homo sapiens
gggcaaggtcaatgggacttcatggctgtatccccagcacccaggatataaacaacagtgaattgaaatcgtggtcccaaagcttgtaaaaaaatgcctgrtggctttcagaggagagaatattcctgcttatcataaatgctcaggagtggttcgtggacacggacaggtggcctgatgacatttattccaccagaaagc

SEQ ID NO: 33576 - DNA, 201 bp, Homo sapiens
cagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttcctt

SEQ ID NO: 33577 - DNA, 201 bp, Homo sapiens
gctgtcaaagacttcgtgattatccccctgcacaccaccccagagacatccgttaaggagatcgatgagttggttgaggtctacacggacgtgaaacaccrctggaaggcggaggtgaggactgctgtgtcagacgaattcccatctagcaggggcaggctctggtccctgagtgggatgagtacctctccagggaggggg

SEQ ID NO: 33578 - DNA, 201 bp, Homo sapiens
gcacatagtgaatgttcagcaaatcatgtctatattagcagaagctggtgatcactgaggttaaggatgacactctgtcctcaactgaacccatcaatcarggggaaaattgtgatcaccaaggtcaaaataaaatgttcttgaagaaaactctgaagtcagcaatgccccaccaaacaatagcacaaacaaggaaatctg

SEQ ID NO: 33579 - DNA, 201 bp, Homo sapiens
acagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttcct

SEQ ID NO: 33580 - DNA, 201 bp, Homo sapiens
tacagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttcc

SEQ ID NO: 33581 - DNA, 201 bp, Homo sapiens
atacagctactccttttcaccagcaaagcccagctcctttctctctctttccttttcttctttctttcttttctttctttctctctttctttctttctttctttttctttcttcctttttctttcttctttctgtcttttctttcttcttcctttctctttttctttgtttctttcttcctttcccttccttacttttttc

SEQ ID NO: 33582 - DNA, 201 bp, Homo sapiens
aaaaaaaaagaaaatgccatgcttttaagttcagcttacaaaagttctcattctttttataaatccagctagaatttccagataaaataaaagttgcccarttgaatacgaactaccccaaattcaaatctacctactgttctatatttttatttgttaaatctgccaatcctaaacccaacaaacctaaataattactta

SEQ ID NO: 33583 - DNA, 201 bp, Homo sapiens
tcaatatcctctgtgcattttgtgcaagtatttatgatttcctcaggaagcaaccctaaaaatgagaccaattagtgcaacggtatttatatttttaaagytttagctacatattcctaaatgcaatgcatacatttaagtcctagcattccctcgtgctttttaaagtcccttcagggattttcaaacagctttcatctt

SEQ ID NO: 33584 - DNA, 201 bp, Homo sapiens
aggggctctgggcttgaattacataggttcaaattctgcctccgccattttctagtagggtgattgggagtgtaatttactcaactttctctgagtctcaygctcctctttaaaatgtacataacaaaagcacctacctacctcagggagtccttcatttagttcagagaagaaattattttaataagcactcagtgcaat

SEQ ID NO: 33585 - DNA, 201 bp, Homo sapiens
ggcatgtgtaggacaattgtagggacaggcaagaatccatgtcagtctgcctaagggcttcccttatagtaagggaactgagtgggggacctgcctgagtyacccagccaggaagtggccaagcctacctttgaacttgcgtcacatctgatctcatagccagtgctctattctttgtcatctcagccttccttggagtgt

SEQ ID NO: 33586 - DNA, 201 bp, Homo sapiens
tcctggccaacatggtgaaaccccatctctactaaaaataaaaaattagctgggcttggtggcacgtgcctgtaatccccgctactcaggaggctgaggcmggagaattgcttgaacctgggaggtggaggctgcagtgagctgagatcgcaccactgcactctagcctgggtgatatagcaagactccatctcaaaaaaa

SEQ ID NO: 33587 - DNA, 201 bp, Homo sapiens
ttagtgatgaggccagatttcagccctgagtgcagatcgttgaggagagtgaagatcaaggtcatcagagttgaggttttcaggaaactgtgggaataggrttgaatgagtcatgaacacaaacactgaagtcaccccggatgatggtgggatttcatatagctcctgtgagccaaggaatgaagtcatcagtggatgtac

SEQ ID NO: 33588 - DNA, 201 bp, Homo sapiens
gagatcgcaccactgcactctagcctgggtgatatagcaagactccatctcaaaaaaaaaaaaaaaaaaaaagaaaagaaagtagtgtggagatgcccctragactggagacaaaaagatttagataatgaggttatttatgcaagaaagacccaatggcaccagttcttattttgcacctttacctactcaagcaaatgc

SEQ ID NO: 33589 - DNA, 201 bp, Homo sapiens
ccctcatggaagactatgagacacacaaatctaaaaggcgcgagagaatggatgatagtagtgtaagtttttcctcctttcctctttcacttctctgagcrcggccatcggtgtggcgtgtggcattccagttcaggcacaaatgtgtatgtcgttgtctggtcagcattagggttccagtatcagttttcatatatgtgg

SEQ ID NO: 33590 - DNA, 201 bp, Homo sapiens
atgaaggagaaagaaaagtgccaaacccacttcctgatcctaatgccatctggcttaagagcccatattcattgagtctgaaatgcaacggacaactaccrgtttgtctggaggcggtacaaatactcttctaatatttttttaaaaactataggatgtagtctattttcaactttattcaaccagatttatttaccccta

SEQ ID NO: 33591 - DNA, 201 bp, Homo sapiens
tgttgttctatttgacagtttttccttcaccattcataaaaaggattaacaaaattgcccaaaacaactctataaagtctaggagtggcacgtcagtctckgaaaaagcaaagggggttttgttattgttgctgatgatggtattgttactatttcaccactgtcataacagcaaagaggaacagctgccctatggtgtta

SEQ ID NO: 33592 - DNA, 201 bp, Homo sapiens
tttattcaaccagatttatttacccctaccgagttttctaaatcagtgaatcagtattttaaggaataaatcttaggcacataaaatgataggaataaaakatgtattataaagcttctttaatcaatacaagctattcttataagtctattggttaatgtctagattgccgtgcccacttaaaatgggaaaacattccag

SEQ ID NO: 33593 - DNA, 201 bp, Homo sapiens
atctcctattatttttaccaccttctattattcttactcttggcccacttcctttgtctgtatcacctgcctggcccctattggcatttgagcatgtgacscctaatctaccatcattcactcattttatggctgggtcaaataagtcctaggtggaaatgggacttaccttagcaagataacagcagactcagaactaaa

SEQ ID NO: 33594 - DNA, 201 bp, Homo sapiens
aagtagttgactttcaccctgagacacagacttatagaccatagatgaaaaatgacaatcaagatataatgcataagttgagcacggtggtatgtgcctgyaaatcccagctactcaggaggctgaggcaggaggattgcttgagcacaggaatttaagtctagtctgcacaacatagcaggaccctatttctttaaaaag

SEQ ID NO: 33595 - DNA, 201 bp, Homo sapiens
tatagatcattttctacgtgtgcttctatggttgtagtataaattcttggaagtataaccactgggtcaaaagcattgtgtattttaaagtggggtccacrttgccaaattgccatccaactttatggagttggatgagggtacctctctcattacatgctgataactaatatataggtggaaaacttgtagtttttgtgt

SEQ ID NO: 33596 - DNA, 201 bp, Homo sapiens
tctcaaagtgtatctctagagtaaaggcagccgatggcaggtttttctgggggcaaaatgaacactaccaatccaccttgctagagttctctctctactcmctgaggtcttagggaggcaaccgtacataagattttctgaaatttgggatctggtctacagccgtaccaccctgaatatgcccgacctcgtctgaaactt

SEQ ID NO: 33597 - DNA, 201 bp, Homo sapiens
caacctagtcagagaggacaactatttgcaccatgaattgaattatagccaaacaggtcttgagtaattcattgtgcatatatcctatgaaatgaagctcycaaggacccagaatgtaaactttaaaaagtaaccagtgttaatacattaaaatttcattaatttcgtattaatttacttaaagcatcatgtaatttcaag

SEQ ID NO: 33598 - DNA, 201 bp, Homo sapiens
agtatcatctgattgtccatcatgcccaacatctgtgtctctctgccagccaaatccaacaggtatcaaaagtggcttaaagcaggaggggttattagtcrgttaaaagcaaagcatgtcaaggaaataatctattcatgtaggagcaaagatttttcttctataaacttgcatttaagataaagctgacaatctccttgc

SEQ ID NO: 33599 - DNA, 201 bp, Homo sapiens
catggagtttgccttgtgcaaagtcatagaaacaaatccaggtgcactgtgggcaccagagctaataaagaagagaatcttgtagacatgaaagagagaargtaagagagataaaaggagatatgtggaaagagagagagagaaagggaggccataaactttggtggtttttgcctttagtttcacttatgtaggcctttt

SEQ ID NO: 33600 - DNA, 201 bp, Homo sapiens
tcatcaggattaatcacatttttaaattaaaatgttattactaaaacacttaaaactaaaatagcatttttaaactaaaatgctatgtctgttttctctcactcttgttatgaaatgtttcctaatgtgaagtgttttcttgatggaagactaaaatattgagacaacatatatatttatgtctcacatctccttcttatg

SEQ ID NO: 33601 - DNA, 201 bp, Homo sapiens
cagctacttacacagtgatttaaagtcatttcatatgtgaaaaacataagaccaatggatatccacatatagatttgatttgtgttgtgtaaggatatacmcaaatgcaggcaaaggaacccacatgctgtggatttgttcactcattcactcattcacagtggatgcattgattctttcaatgaatgtttactgagcact

SEQ ID NO: 33602 - DNA, 201 bp, Homo sapiens
cgtggttgaaaacaatagcaatttgttctctcacagttcaggagtcctgaagtctgaaattacagatggcagggttggttccttctggaggctttgagggmgaatccgttccatgcctttctcctagcttctcgtggttgctagcaatgtgtaacatttcttgacttgtaaatgaatcattccaaattctgcctccagatt

SEQ ID NO: 33603 - DNA, 201 bp, Homo sapiens
actcattcacagtggatgcattgattctttcaatgaatgtttactgagcacttactgtgttcctggcattattctaaccactagggatagagcagtaagcmaaacaggttacgtcccttccctagcggagttttactatggcacataccaccacacacaccactaaatactttagagcttgctctccaagagggagagcag

SEQ ID NO: 33604 - DNA, 201 bp, Homo sapiens
aacaaattctcacaaattacgtggttgaaaacaatagcaatttgttctctcacagttcaggagtcctgaagtctgaaattacagatggcagggttggttcmttctggaggctttgagggagaatccgttccatgcctttctcctagcttctcgtggttgctagcaatgtgtaacatttcttgacttgtaaatgaatcattc

SEQ ID NO: 33605 - DNA, 201 bp, Homo sapiens
tcttcacctggcatttgaaagcccctcacaatctgcccttgattatattatcaggcatatttctagaatatcacattttcccttgcacaagccgtctgctytgcccaccaagcacctcctgcctcatgtgtgattccatttaggtcctttcaaagccaagttgccaggttctagttccaattctacccaactcgcgttttc

SEQ ID NO: 33606 - DNA, 201 bp, Homo sapiens
gagggcgcctcaccatgtcctctccataagccaggctacataggtcatcatctgggatcttatttttctgaattgtttgtggctcagctcttcttaatatrgtactttctgaccagggcgggggggtggggagcctgtagtctcagctactcaggagactaaggtgggaggattgcttgagctcaggcattcaaggctgca

SEQ ID NO: 33607 - DNA, 201 bp, Homo sapiens
tatttcagaggtaacccctttagatcagtgccaggtccatcccagagaaaacctcttgggcctccgcaaagggctttctattcaggaattcaaatacacaygagagtgtcaacctgtctctcttgagtctcctccactacagtttctattaccagattaaaatgttaagctgaagcttcttgagaagcaagggtattctag

SEQ ID NO: 33608 - DNA, 201 bp, Homo sapiens
gtttaaaggcagatcattgttctgaagttccgctaagttctaatgcccaccctgctgagaaatcctccaagaacaaagtgagattttaaaaatccacaggkttacttggagccaaaggcaattaagaggaagagaaataactggccaagtctcaatgtgatggctgtctgtgcagagactctagtgaggaagagagctaac

SEQ ID NO: 33609 - DNA, 201 bp, Homo sapiens
gcgtgtactaattatttcttgagtgaacaaatgtgctaaagtggtgagcaaatgtcttgaggagacagaagttaccttgcaaaggagacttttggaactgrgtgttcaagaatgagtaggggctctcttgatgaaaggaaagaggagtaataggagaaaaagaattgtagtcaaggaaacagaatgcacaagggaatggag

SEQ ID NO: 33610 - DNA, 201 bp, Homo sapiens
ctgggcacaccagagcatattccctactcaagcaagggtggagatgtctgcaatctttctaaccaacaacatatcttgaatagcgctcatttgccagtggraaaaaaaaaaggataacataacatcccttatactaattaacaaaccatctggtgcatatttagataactattcctgaagtgctttcctttgctttccaac

SEQ ID NO: 33611 - DNA, 201 bp, Homo sapiens
tgtaattcataaaaacatataatttccctctaatatttcatttttcctaattataaaaataatgcatgcttattatagaaatgtagacataaaaaactatraaaagaagaaaagaaaactcaatccaaatcttaccactcagaaatgacgtgccactggtaacatttagacttatttcctcctaatatgtatattttaaac

SEQ ID NO: 33612 - DNA, 201 bp, Homo sapiens
gaaaaaaaagaagtggtactcatttactgagcaccaactatatataatctattgcacttgctatgaatttctttatatactcttatgtttccctcacagtrtatctgggaggtagaattactattcctctattaaagataaggaaacagtggtgtaaagtttcaagtgagatcttcaacccactttctcacagttgccccc

SEQ ID NO: 33613 - DNA, 201 bp, Homo sapiens
agaaacatttaaaaaaaaaaaaaagaaaaacttcagaagccttctgaggttcagaggtcatgtttcggaggtcatgtttcagggtgcggtatttggagccytcccggaaacacaaaagcctccctggtgacattcttagcccctaggaagggcagtaatgacagcccacaactgacaagtactgatgaatagttcttgaag

SEQ ID NO: 33614 - DNA, 201 bp, Homo sapiens
ctgggaggtagaattactattcctctattaaagataaggaaacagtggtgtaaagtttcaagtgagatcttcaacccactttctcacagttgcccccagakcctgccgctgagaacttacaatttggagaaacgacagctgccaccaggggcttactgattggtgtgctctttttgaagaatgaacagaagtaaaagtcat

SEQ ID NO: 33615 - DNA, 201 bp, Homo sapiens
cctctattaaagataaggaaacagtggtgtaaagtttcaagtgagatcttcaacccactttctcacagttgcccccagagcctgccgctgagaacttacartttggagaaacgacagctgccaccaggggcttactgattggtgtgctctttttgaagaatgaacagaagtaaaagtcatacagttaggaaaagagaataa

SEQ ID NO: 33616 - DNA, 201 bp, Homo sapiens
atttttagtagggatttctaatgcattcttttttcccattgatggttgttaatacttcccctacacacacacacacacacacacacacacacacacacacaagcataaatagggcacacgtattctcccatgtaagggctgctgtcccttctccctcccacttatagcgatgtgtgcctctctgtagctgaaggttgcctt

SEQ ID NO: 33617 - DNA, 201 bp, Homo sapiens
tttttagtagggatttctaatgcattcttttttcccattgatggttgttaatacttcccctacacacacacacacacacacacacacacacacacacacaagcataaatagggcacacgtattctcccatgtaagggctgctgtcccttctccctcccacttatagcgatgtgtgcctctctgtagctgaaggttgccttg

SEQ ID NO: 33618 - DNA, 201 bp, Homo sapiens
cagcagtctgagatcaaactgcaaggcagcagcaaggcttggtgaggggtgcctgccattgctgaggcttgagtaggtaaacaaagtggccgggaagctcraactgggtggagcccaccgcagctcaaggaggcctgcctgcctcagtagactccatctctgggggcagggcatagctgaacaaaaggcagcagaaacctc

SEQ ID NO: 33619 - DNA, 201 bp, Homo sapiens
agggagctgttaaaatgttcaacacagctttaaaatgacataagaagaggactgagacatatccatttggcattggggactttacagggagcagtggcagyggcatgggggaggcagaagccagaacgctaagcattgaggagaatggcaaagattactggttgtctgtcccccataccaattttccccttcttacatggg

SEQ ID NO: 33620 - DNA, 201 bp, Homo sapiens
ttctctttgtctgatgagagatagatgttaaatcagtaaatatgtgtgtatactgattgaatttctcctcagaaaaggggtttttcttttctatcacattktcaggctgcaaattttctcaacttttatgctctgcttcccttataaaaccgaatgcctttaacagcacccaagtcacctcttgaatgctttgctgcttag

SEQ ID NO: 33621 - DNA, 201 bp, Homo sapiens
acacctcacatggccgggtacccctctgagatgaagcttccagaggaatgatcaggcagcaacatttgctgttcagcagtattcactgttctgcagcctcsgctgctgatacccaggcaaacagggtctggaatggacctccagcaaactccaacagacctgcagctgagggtcctgactgttaaaaggaaaactaacaaa

SEQ ID NO: 33622 - DNA, 201 bp, Homo sapiens
ctctttgacttcctgttgagttggctcaatggaaggcaccagcaggagaaccatggatgagagaaaattgaggtcagtgtacggtttaatctatggtttcycttcctacagggcagtgggttggccagggcatctttcctcttctgaaggccacagcagcccttcctactgctacagctacagctctctcccactgctggt

SEQ ID NO: 33623 - DNA, 201 bp, Homo sapiens
cttgggagctcttcaaacacttggaggcagcaagtctattttcctttggttttctcttttcccagccttcatgctgcagatcaaaggaatggagctgaaartgggggctgggaaatatctaagtcagtgtctcctaaagtgtgggcatcaacaggtggtaagaaaggttatttttagatagcacatgcatgatcattttat

SEQ ID NO: 33624 - DNA, 201 bp, Homo sapiens
ataatgggagactttaacaccccactatcaacattagacagataacgagacagaaagttagcaaggatatccaggacttgaactcagctctgcaccaagcrgacctaatagacatctacagaactctccaccccaaatcaacagaatatacattattctcagcaccacatcacacttatttcaaacttgaccacatggttg

SEQ ID NO: 33625 - DNA, 201 bp, Homo sapiens
gaactcagggtggaaatggaacatcctggccacctacccaggagaggcctcatgtagtaagaaaagggagaggaaggagcagtgctagaaatcagattatmcagacagaaaaccacctcccagactgcctgatggcagggggtgggtctttccatcttaatctttccagcccaagcaccatgcctgcaacacaacagaaat

SEQ ID NO: 33626 - DNA, 201 bp, Homo sapiens
tgcaggtttgttacatatatatacatgtgccatgttggtgtgctgcacacattaactcgtcatttaacatcagggatatctcctaatgctatccctccccsctcccccgaccacacaacaggcccccggtgtgtgatgttccccttcctgtgtccatgtgttttcattgttcaattcccatctacaagtgagaacatgtgg

SEQ ID NO: 33627 - DNA, 201 bp, Homo sapiens
agagcttggcattcagaggtaacaatatgtgctttgttactctgcaggtttgccgtgaagtgtgctgtaatctttgccaggggtgtgctgctctctcccargagggttcacagcccgggaggaacacttcagactgcttaacgacttgctcgggccttgccttatatggaatttttccttctgcacaagagaatgacaacc

SEQ ID NO: 33628 - DNA, 201 bp, Homo sapiens
aacaccccactatcaacattagacagataacgagacagaaagttagcaaggatatccaggacttgaactcagctctgcaccaagcggacctaatagacatytacagaactctccaccccaaatcaacagaatatacattattctcagcaccacatcacacttatttcaaacttgaccacatggttggaagtaaagcactcc

SEQ ID NO: 33629 - DNA, 201 bp, Homo sapiens
acatcagggatatctcctaatgctatccctcccccctcccccgaccacacaacaggcccccggtgtgtgatgttccccttcctgtgtccatgtgttttcaytgttcaattcccatctacaagtgagaacatgtggtgttgggttttttgtccttgccatagtttgctgagaatgatggtttccagcttcatccatgtccat

SEQ ID NO: 33630 - DNA, 201 bp, Homo sapiens
accctcatggaagactatgagacacacaaatctaaaaggcgcgagagaatggatgatagtagtgtaagtttttcctcctttcctctttcacttctctgagygcggccatcggtgtggcgtgtggcattccagttcaggcacaaatgtgtatgtcgttgtctggtcagcattagggttccagtatcagttttcatatatgtg

SEQ ID NO: 33631 - DNA, 201 bp, Homo sapiens
ggttttttgaaaagatcaacaaaattgatagaccactagcaagactaataaagaagaaaagagagaagaatcaaatagacgcaacaaaattgataaagggkatgtcaccaccaatcccacagaaatacaaactaccatcagagaatactataaacacctctacacaaataaactagaaaatctagaagaaatggataaatt

SEQ ID NO: 33632 - DNA, 201 bp, Homo sapiens
ttttagactttgtggaccatatagtctttgtcacacattaattgttttctttctcttttctctttccttcccccatcttttcctccctctctttcttcttytccttcctcttcttttttcttccttctccttccccttctcttcttcttcttcttcctcttcttttttttttttttttttttttttaaagaaacaaccctt

SEQ ID NO: 33633 - DNA, 201 bp, Homo sapiens
ccttcttcttgggagctcttcaaacacttggaggcagcaagtctattttcctttggttttctcttttcccagccttcatgctgcagatcaaaggaatggarctgaaagtgggggctgggaaatatctaagtcagtgtctcctaaagtgtgggcatcaacaggtggtaagaaaggttatttttagatagcacatgcatgatc

SEQ ID NO: 33634 - DNA, 201 bp, Homo sapiens
aaaaccataaaaaaccctagaagaaaacctaggcagtaccattcagcacataggcatgggcaaggacttcatgtctaaaacaccaaaagcaatggcaacaraagccaaaattgacaaatgggatctaattaaactcaagagcttctgcacagcaaaagaaactaccatcagagtgaacaggcaacctacagaatgggagaa

SEQ ID NO: 33635 - DNA, 201 bp, Homo sapiens
atagcaaagacttggaaccaacccaaagtccatcaatgatagactggattaagaaaatgtggcagatatacaccatggaatactatgctgccataaaaaakgatgagttcatgtcctttgtagggacatggatgaagctggaaaccatcattctcagcaaactatcgcagggacaaaaaaccaaacaccgcatgttctcac

SEQ ID NO: 33636 - DNA, 201 bp, Homo sapiens
tttgtaatgcaagtgatgctagctcagaaactccatgcctggccctctctagacacccaagggaagggctgcagaacgtgggcaactcccagggcttttgaggccctggagcttcccacccggaacacaaaatacactgtcatgtgtcatcttgctttgtgacttctcatcttaaggtcttgtcaaagctggccacgtagg

SEQ ID NO: 33637 - DNA, 201 bp, Homo sapiens
ttcagcactgccacttactgccttgacccaggatgagttaatagctcacagcctcagtttactcatctgtccaattaggatagtagtactatctcataggrtttttgtaaagactgaagttaataagtgcataatcacatagagttgctcttggaaaatagtaagtgcctgtgaatattaaaaatttcctggccaggtgcc

SEQ ID NO: 33638 - DNA, 201 bp, Homo sapiens
tttgtcacacattaattgttttctttctcttttctctttccttcccccatcttttcctccctctctttcttcttctccttcctcttcttttttcttccttytccttccccttctcttcttcttcttcttcctcttcttttttttttttttttttttttttaaagaaacaaccctttacaagtgtaaaaccactcttagctc

SEQ ID NO: 33639 - DNA, 201 bp, Homo sapiens
taacgtagtcacacactgccatgtctctggtttctcacttgcctcctttgctgtggatctttgtttttatatcttgtgtggcaaaatgctgttggctctakccggttgctagtgtagccaaaagtggaccttacttagtctgtccgatctagggtgatgctttttgctgccttacataagcttccagattacagtattgtg

SEQ ID NO: 33640 - DNA, 201 bp, Homo sapiens
taggaggaacagtggcttcaatctgaaggactgtgccagcttagggtgagtatgactcagtctggaagcagaagcagaagggaatatggttttgtggatgracgtgggagacagcatggcatgaggttagtgctctgaggtctggtgcatctggcttcctgtctaggctctgctgctgactggctggatgacctttagcgt

SEQ ID NO: 33641 - DNA, 201 bp, Homo sapiens
ggcttcttgaggactcattttcatatagatgttgtcattcagtaaacattgataaagcatctactatgtgcctggcgctgtgctgggcattggaaacacastgatgtgcaagacagacactcttcctactctcatggagtttagagtccaaaggaagagagaggcagacaggacacatgtaaagtatgactggtatgtgct

SEQ ID NO: 33642 - DNA, 201 bp, Homo sapiens
agctgcaggaccttggttgcatttcctaactacatctggaaaagaaagatgatcataactagaacttaacctttgaaggttttatgagcatgaaaagatgwctggaaagaacttagcccaccaggacagggctccgtgaatgtcatctgtgactgtgggtacccttccttcaaatgagtgaacaataccctcctcattgac

SEQ ID NO: 33643 - DNA, 201 bp, Homo sapiens
tagcaaaagcaatatgccagtggtgctcaaacttcacagtgcatccagttcacctgaagggcttgtttaaaaaaaaaaaagcaagcagatttctaggccaycttagaatcagagattctcatttaggaggtctgaggtgaggccaagaatttttatttctaatgctgctggtcctgggaccagacacggagaaccactgta

SEQ ID NO: 33644 - DNA, 201 bp, Homo sapiens
gtgcagtggtgcaatcttggctcactgcaacctcctccgcctccctgtttcaagcaatcttcccacctcaacctccagagtagctaggactacaggcacgyaccaccatgcccagctaatttttgtatttttagtagagatgggatttcaccatgttggccaggctggtctcaaactcctgacttcaagtgatccgtccac

SEQ ID NO: 33645 - DNA, 201 bp, Homo sapiens
actgatgtgtgcaggatgctgtaggaagatatgaatggatgttattagcacacctaagctgcttagatgggcttgaagggttgagagaacagagaagtagyggaatgaaagcagctttgaatggcaggagcttgtctagggagcagaggcctaggtctagctgagctgctcacctggtccccatcgcccacaaagctttaa

SEQ ID NO: 33646 - DNA, 201 bp, Homo sapiens
gaaaaataacttatccaaaagatggaccttcctgtttctcaatgagctctcctaagagagagcagaagagggagagggaattgccctctatttggaggccrcagggcctggtcctcatagctatcctaaggaagagaaagctcaggaccaaggaagagccaccacctggagtggggagggtgggacggggttgcatcctgc

SEQ ID NO: 33647 - DNA, 201 bp, Homo sapiens
ggaggctgaggcaggagaatcacttgaatcaaggaggcagaggttgcagtgagccaagatcacgccattgcactccagcctgggtgacagagcaagactcygtctcaaaaaaacaaaacaaaacaaaaacaaaaacaaaaaactagatattttgcacgttacctttttaaaagcctgacatatctgtatgatatccctgca

SEQ ID NO: 33648 - DNA, 201 bp, Homo sapiens
tacataagaacatatgggccaggtgtggtagttcacgcctgtaatcccagcactttgggaggctgaagcaggtggaccacttgaatccaggagttcaagaycagcctggcgaacgtggtgagaccccatctctactaaaaatacaaaatttaactgggcgtggtggcatgtacttatagtcccagctacccaggaggctga

SEQ ID NO: 33649 - DNA, 201 bp, Homo sapiens
gctacatttctgaaaaataatgatggtcatggaatggaagacagatctgagctgaggaccttggaggcctgaactggtgcacttgccatgaggatggagargaaggatgaggcaggaaagatactgcaggtcccagcttctccatgaatccaagggctttgctctccactctgccttcagcctagtgacacaatttataca

SEQ ID NO: 33650 - DNA, 201 bp, Homo sapiens
gattctcttcaggttgattctcaaagtgtatctctagagtaaaggcagccgatggcaggtttttctgggggcaaaatgaacactaccaatccaccttgctrgagttctctctctactcactgaggtcttagggaggcaaccgtacataagattttctgaaatttgggatctggtctacagccgtaccaccctgaatatgcc

SEQ ID NO: 33651 - DNA, 201 bp, Homo sapiens
caggagaggcctcatgtagtaagaaaagggagaggaaggagcagtgctagaaatcagattatccagacagaaaaccacctcccagactgcctgatggcagsgggtgggtctttccatcttaatctttccagcccaagcaccatgcctgcaacacaacagaaatgcaaggaatgcagttgaggtggtgcattagtctatcct

SEQ ID NO: 33652 - DNA, 201 bp, Homo sapiens
tctttttctcccctcacatctctcttcatctctccctgtctctcaccctcttcctcctctccctcaagtctaggcagctcagcctctctcttttttctccyttctttttcctcctgcctctccagcttatctcttcctacttattttcccaattcagtattataaatacctagctactgggctggcaaatactgaactctc

SEQ ID NO: 33653 - DNA, 201 bp, Homo sapiens
gaattttggcatctttgattaaaaaaatgtctagttttttccacagcgcccctgcaattaattaaagtgtttccctgtgtactgcaaatgtaccttatctrctctttattccaagagcccaaaggttcaaaaattgtttccgaactctcagaatttccatttggctcttggttggcattcaaagtccaatagtataataat

SEQ ID NO: 33654 - DNA, 201 bp, Homo sapiens
tgtgccatcctgttgtcttgcccaacaatgaatggcaaggcaagcagctgggactatctactcgtagcttgtcacaaatgtgctccaactccagaggatgrtgcagtaatttcctccctttttctttcgggttgtgctttctgctactcaaaagttctgctctcctgtgatcaagatggtaagtcctgtttcatgctgttg

SEQ ID NO: 33655 - DNA, 201 bp, Homo sapiens
atatagtttattaaactttcccatgtattacctcatttggttctcacaataacttgtggataagaaatggttaaaattatctcaattttatagctgatgcrtagctagacccagatgaaaatctactttgaaaacatcaactcagaaagagcaccagactttgctgacatagacagggttttgttaattcaagtagttcat

SEQ ID NO: 33656 - DNA, 201 bp, Homo sapiens
ggacaccccatttaacaaactgccaaatgcccctctcccaagggcccctcccttcccacctttatctgaacatcgaagtgtgccatcctgttgtcttgccyaacaatgaatggcaaggcaagcagctgggactatctactcgtagcttgtcacaaatgtgctccaactccagaggatggtgcagtaatttcctcccttttt

SEQ ID NO: 33657 - DNA, 201 bp, Homo sapiens
attggtcttggaatccaattagagccagactccaggccagttctatgatacaccccaagctcaggaatttcttcctcctctttttaatttctatgagacastttcaataataactttgaggtctctagttctgagtggccatgattttgtaatgcaagtgatgctagctcagaaactccatgcctggccctctctagacac

SEQ ID NO: 33658 - DNA, 201 bp, Homo sapiens
tactcgaggaaagccattggaaacctgtcaagctgttccctagtactgaaagacagtttgtgacaaaacaggcttttctgcgcccttgggctttctgtgastttctcaagatgtttgcagttgatgatctgcatgcaagcaagccacgttgacagtttctgacctgtttccagcacctttgcaagtgtgtgtggaagaact

SEQ ID NO: 33659 - DNA, 201 bp, Homo sapiens
tgactttctcaagatgtttgcagttgatgatctgcatgcaagcaagccacgttgacagtttctgacctgtttccagcacctttgcaagtgtgtgtggaagmactgttcagattcattttggatgcttttccatatatcatggggaatttgatctatatatctcagagtcacttaaagttaactcatcgaggcagttagaga

SEQ ID NO: 33660 - DNA, 201 bp, Homo sapiens
ccagcagatttcacttggctgattttgtttttctgttctttttctgttttcctgatgaggcttctgtacttctccctttaaggaggcaactgaatagcatraaaataaggggtatgggtggtggtagttgctgaggggaatgacaatggatttggtaacacagcatgctaatatcatgcaaataatgagatgatataggaa

SEQ ID NO: 33661 - DNA, 201 bp, Homo sapiens
ctgcatgcaagcaagccacgttgacagtttctgacctgtttccagcacctttgcaagtgtgtgtggaagaactgttcagattcattttggatgcttttccrtatatcatggggaatttgatctatatatctcagagtcacttaaagttaactcatcgaggcagttagagattgtgcctatcgtttactaaattataaaaag

SEQ ID NO: 33662 - DNA, 201 bp, Homo sapiens
acagaaaaagtaccctctaaggtatccaaggtagcttggactcttatttgtaaaatcaagaccagttaagctacttctctaagatcacattagttaggaamtgagcaggactacaaagtagaacttatattaagtccattgttttggttactgtgaatcctataacagaatccaaaagctgagaactagaagtaattttag

SEQ ID NO: 33663 - DNA, 201 bp, Homo sapiens
ttggttactgtgaatcctataacagaatccaaaagctgagaactagaagtaattttagaaattatcaaattcaacttcttcattctctcttttttgtcttrttatggtaagaacacttaatgggagatctgccctcttcacagattaagcgtagtatacagtgttgttaattatagtcacagtgttctatggcagatctct

SEQ ID NO: 33664 - DNA, 201 bp, Homo sapiens
ggccaattttatcagtttgttcttttaggatatgtcctgttccttttacacccaaaagtcacttttcaccctgaaattaggtgtttactttttatgcttarctctctaatccatgtggagtttatctgagtgccagttgtgggatatggattcaaactgtagttaatttctccccagaagttaaccagatactctatgcac

SEQ ID NO: 33665 - DNA, 201 bp, Homo sapiens
gaacataacgtgttctatctatctgtatgtttgcgcctattcgccaaccactctttatccccacctaccctcatacacacccttcccagcttctagtaacyatcattctaatctctacctccatgagattaacttttttagctcccacgtatgagtgagaaaatgcaagatatgcctttctgtgcctggataattttactt

SEQ ID NO: 33666 - DNA, 201 bp, Homo sapiens
agcctggaatccctataggctagtggttagagacagtctcttaatcattcctgtttttactatgctgccttcttagtgcttaatacaaactaagcttgttstctccttttactatggttgggggtataaatctcagtccataaacaaaggcttacaaaaaaatagcattaaaaaaattttattttaagttccaggatacat

SEQ ID NO: 33667 - DNA, 201 bp, Homo sapiens
ccaacatgccagacaaatattattataattttttgttacagatgaagaaacagacacaagggtttagggcaagggtacacagctagtggcaaagccaagcytggaatccctataggctagtggttagagacagtctcttaatcattcctgtttttactatgctgccttcttagtgcttaatacaaactaagcttgttctct

SEQ ID NO: 33668 - DNA, 201 bp, Homo sapiens
ctcagatatttatatttctttttgtattctttcaataagtcgcatttttcaggaaatttttggtaatatcatctactttttaaaatttattgacataaagttttcataatgtcctcttaatctttttaatgtgcataggaatctatactgatgccccctttcattcctgatatttgttttgtttcttttctattaatttta

SEQ ID NO: 33669 - DNA, 201 bp, Homo sapiens
ttttactgagagtttttaacgtggatcaatgttgaattttatcaaaagcctttctgtatctattgagataataatgcggtttttgtctttaattctgtttstgtgatgaatcacatttattaatttgcatatgttgaaccaaccttgcatcctagggataaatcctacttgattatgatggataagctttttgatgtgctg

SEQ ID NO: 33670 - DNA, 201 bp, Homo sapiens
tgtcccttgtaaattggattcctaagcattttattctcttcgaagcaattgtgaataggagttcactcatgatttggctctctgtttgtctgttattggtrtataagaatgcttgtgaattttgcacattgattttgtatcctgagactttgctgaaattgcttatcagcttaaggagattttgggctgagatgatggggt

SEQ ID NO: 33671 - DNA, 201 bp, Homo sapiens
ctgagtcatctgtaagtctgtttcagtttactatttttttctttgtggctacaggtcacattttccttctttatatgtttagtgatttttaattatatgcygtacattaaaaataatatattgaggagacctgggatttatcttcctctgaagactgttgaactttcaggcagttaagttactggtggcctcccttaactt

SEQ ID NO: 33672 - DNA, 201 bp, Homo sapiens
cccagaagccgagcagatgccactatgctttctgtacagcctgcagaatggtgagccaattaaacctcttttctttataaattacccaatttcaggtattyctgtataacatagcaagaatggattaatacagatcttgagatgagatcattcttgatttaatccaatgtcagatatccttataagagaagtgcagaggga

SEQ ID NO: 33673 - DNA, 201 bp, Homo sapiens
tgtaaggattacaggcgtgagccaccacacttagccaccacacttggccaccacgtctttaagattatgaataaaaaggtgtcactttcgaagattctcaragggagtaactcctccccctaatactgagctgcagtccatcttaagccttgctggtatacatctcaaagaagaagatattgaggatagcttgtgcaacgt

SEQ ID NO: 33674 - DNA, 201 bp, Homo sapiens
tgatttggctctctgtttgtctgttattggtatataagaatgcttgtgaattttgcacattgattttgtatcctgagactttgctgaaattgcttatcagsttaaggagattttgggctgagatgatggggttttctagatatacaatcatgtcatctgcaaacagggacaatttgacttcctcttttcctaattgaatac

SEQ ID NO: 33675 - DNA, 201 bp, Homo sapiens
tcttctgcctcaagcccctaacttcagcctgaaatcatcaacatccatcacagtagcggaacaacctagaaggaattgtttcattctgaaaagactttgaratgattaaaatatgcaatacaaatgggtgaaaagaaataggtgataaaatcaagacaaatgggaaattaagtttgggaatattaattaaagctgggcaaa

SEQ ID NO: 33676 - DNA, 201 bp, Homo sapiens
ttttgtaggagcctctgagaagaccattatgaattttgatgttttcagattaagtttaatcagcacccctctccccatccctaatgtaagtgttgctcaargcattcaggtgactgggtttctcacaagaacagaagcatttaaatgccttctgttaccaacccaataatgctaacctgaagccctgctttgctgttggat

SEQ ID NO: 33677 - DNA, 201 bp, Homo sapiens
gatttggctctctgtttgtctgttattggtatataagaatgcttgtgaattttgcacattgattttgtatcctgagactttgctgaaattgcttatcagcttaaggagattttgggctgagatgatggggttttctagatatacaatcatgtcatctgcaaacagggacaatttgacttcctcttttcctaattgaatacc

SEQ ID NO: 33678 - DNA, 201 bp, Homo sapiens
tgtgtggtaagccagggcaggcattgcactaagcacaatgtcacagtggggttgtagagatgaaaaggattcctgcctgcagataacatacaatccagtarggtggaaagacatggatatgcctaattatgagacaaggtaaacaagggcaggctgggggatcagcatgacaaaagacactagggcaggatggagttttca

SEQ ID NO: 33679 - DNA, 201 bp, Homo sapiens
attacaaacatgagccactgcacccggcctttgagttttcttttattccggctgcatacctcccagttaatctgacatctttctcacctcattaaactggmtccaactgctaatacgtcatcaaattcaaaagaaatgcgacccgctaccaaaatccagatctgaaaacatttaaccttaggctgtggttcaaggtgcaaa

SEQ ID NO: 33680 - DNA, 201 bp, Homo sapiens
cctcccggattcattgattttttgaagggttttttgtgtctctatatccttcagttctgctctgatcttagttatttcttgccttcggctagcttttgaaygtgtttgctcttacttctctagttcttttaattgtgatgttagggtgtcaattttagatctttcctgctttctcttgtgggcatttagtgctataaattt

SEQ ID NO: 33681 - DNA, 201 bp, Homo sapiens
tttataaattacccaatttcaggtatttctgtataacatagcaagaatggattaatacagatcttgagatgagatcattcttgatttaatccaatgtcagrtatccttataagagaagtgcagagggagatttgagacacatgagagaaggtcatgtggaaatggaggcagagattggagttctcctgctacaagccaagg

SEQ ID NO: 33682 - DNA, 201 bp, Homo sapiens
ttctcttgatttagggtggagagttctgtagatgtctattaggtccacttggtgcagagctgagttcaattcctggatatccttgttaactttctgtctcrttgatctgtctaatgttgacagtggggtgttaaatctcccattattattgtgtgggagtctaagtctctttataggtctctaaggacttgctttatgaat

SEQ ID NO: 33683 - DNA, 201 bp, Homo sapiens
gaactaagcgagttcagtggttgactctgggtcttttaataacttctgatcttcaattttttcatctgtaaaatggaacaataccttcttttttcttttctttttttttttttttttagatggagtctggctctgtcacccaggctggagtgcaatggtgccatctcagctcactgcaacctccgcctgctgggttcaagc

SEQ ID NO: 33684 - DNA, 201 bp, Homo sapiens
catgttggccaggctggtcttgaactcctgccctcaaatgatccccccaccttggcctcccaaagtgctgggattacaaacatgagccactgcacccggcytttgagttttcttttattccggctgcatacctcccagttaatctgacatctttctcacctcattaaactggctccaactgctaatacgtcatcaaattca

SEQ ID NO: 33685 - DNA, 201 bp, Homo sapiens
tgggtcttgactctttgtctaatttgccagtctgtgtcttttaattggagcatttagcccatttacatttaaggttaatattgttatgtatgaatttgatyctgtcattatgatgttagctggtgattttgcccgttagttgatgcaatttctttctagcatcgatggtctttacaatttgacatgttttcgcagtggctg

SEQ ID NO: 33686 - DNA, 201 bp, Homo sapiens
tttatggaggaggttttctgagtgtgtcatgtgctgtggagtcctttcttgctggagagtaggcagccgagctcagactggtgtcttgcttctctctctcttttttttttttttgcaaatcttgtaaaactctcagcttttgtgctaagaggcaaagaggacgctcagtcctgcacatatagtgcaaagctatatgagtcg

SEQ ID NO: 33687 - DNA, 201 bp, Homo sapiens
gcaagtagaggaggagtgttctaccctggaataacacaaattagaggtgcctgtatgtatgtgtatggtgtgtgtgtgtgtgtgtgtgtgtgtgtgtgtgtatatgtattaaacttcatgctttttaaagcctccttctaaaatgccatctttcagatgtgcctatctgtgtcttattttggtagtttttcttttctttcc

SEQ ID NO: 33688 - DNA, 201 bp, Homo sapiens
acgacattggagggtggttagtgagtctgagttgaaggattatgagggccccaaggctggtcctgagtgtgctggttaaaggggtgcacaggcacctgacrtaacagagctgggagtccagcaactaacaggagagagaaaaggtggcatccttctccctgtgaaagtcgccttaagaaagcttaggctccacttatggca

SEQ ID NO: 33689 - DNA, 201 bp, Homo sapiens
tgcaccaccatgcccggctaatttttgtattgttagtgaagatggggtttcaccatgttggccaggctggtcttgaactcctgccctcaaatgatcccccmaccttggcctcccaaagtgctgggattacaaacatgagccactgcacccggcctttgagttttcttttattccggctgcatacctcccagttaatctgac

SEQ ID NO: 33690 - DNA, 201 bp, Homo sapiens
tcttagccatctagcatttgttcaagagactcagtcttgtggtctacagctagccttctgtttccatgctgtggaactcaccacattcacagggtggcctgggggaatatggttttggggggaatgtgtggtgcttgtctcttggaggtcccatgggtatggaaggagaccctcgccagctttgttcataggcacagaatc

SEQ ID NO: 33691 - DNA, 201 bp, Homo sapiens
tccctccagggaaatccttcggggtactctgaacacatttctgttggattaacagggcccttagtgagatggtgttaggctgtccagcgactgggatcttccatttctttcagagcaggagacagcaaaatcatggcttttgttatctatctatatatacttattaatgaagacattccaaatgaatgatgacttcctgag

SEQ ID NO: 33692 - DNA, 201 bp, Homo sapiens
gaaagaataatattagcccaagcagtggttctactcacttaaggagaatggagtatgtttatttaattttaactgaaaagtcctggccaatatttctaagsctggcttgggataacagaatgaatggccttgggggagagggaggagaaagaagatgactgattttagtgtctgctttatggtgtgtgctgtttaatcctc

SEQ ID NO: 33693 - DNA, 201 bp, Homo sapiens
atctctaaataatgaatatattcctgaagatttctttgtatttgtaattattgcagatcaaatattttatttccatagaaaactgaccttctaaagatgayacaaggtgtctctctttagtattaaagaatttatgctttaaaactttagatactgggtatggtggctcttgcctataatcccagtattgtgtgaagctga

SEQ ID NO: 33694 - DNA, 201 bp, Homo sapiens
attaacttttttagctcccacgtatgagtgagaaaatgcaagatatgcctttctgtgcctggataattttacttaacataataacctccagttccatcacrttgcttcaagagaacatttagtggcaaagaatactttgtaagaatcccatactgtatctccttctttcataccaatgcgtggtttaatatataataacct

SEQ ID NO: 33695 - DNA, 201 bp, Homo sapiens
tattaatctagatgtgtagggcagtatagatattcacctttaaattaattgatcgattatcctcactgaattgccaccccagacccacagaagggattatyggagctggcaatgtcttgaaatggcaatgtccacatggaagtggcattaatacagcagcctttgtgctttgtcattgcaacccaggccaatgtaagtcac

SEQ ID NO: 33696 - DNA, 201 bp, Homo sapiens
ttctgggagtgggaagtctgaaatcaaggtgtcagcagggttggttccttctggaggctctaaggaagaatctgtccttgcttctctcctagcttctggcmgctgctggaatttcagagatgcataggccctcaatgtggggtgggagggaagtaggtggaggtccttggctcatggacacattgctccaatctctgcctc

SEQ ID NO: 33697 - DNA, 201 bp, Homo sapiens
attgggtttaggtcccaccttaaattcaggatgatttatctcaatatccttaactaaattacttctgcaaagactctaagtgaagtcacattcacaagtasaaggggtaggacttggacagatcttttggacagccactattcacccaggtacagtcatcatagttattactttcaattcaggctcctattgtctcttgac

SEQ ID NO: 33698 - DNA, 201 bp, Homo sapiens
tcttcccaggagtgggaagcctgtgtttttccaccttaccatctgatctgctccagagggctctgcattagaaaaatagggagctatggggaatgactagsgggtggagatcatgagagcagtgtctatggaggattatcagttatgctcagaaagggaagatttggcacctggtcatcgatttttagtacagtaattgtc

SEQ ID NO: 33699 - DNA, 201 bp, Homo sapiens
ccatcttgtacatccttctccaaaacagggtgtctcccagaactctaaacacactgcgctcttttacacctcctggcctttgcacagcttgttctctctgmctatatactacctcccccctagcccccattgagagcctatgcatccttgaaattcagttcttatttcatctcctctgagatgccttcctggacccttctc

SEQ ID NO: 33700 - DNA, 201 bp, Homo sapiens
tcagttgtgccacctggaggctgggggaggaacgcaaataatgaataattggtaaagggaaccaaagcgctgtttctaccatcttttcctccctgcctgcrtggatccacacctcactgtttcttactcaactccttcaatgccacgacactgtagccacttccactggtggacacatatcctctctccctccttccttcc

SEQ ID NO: 33701 - DNA, 201 bp, Homo sapiens
ctcccagaactctaaacacactgcgctcttttacacctcctggcctttgcacagcttgttctctctgcctatatactacctcccccctagcccccattgasagcctatgcatccttgaaattcagttcttatttcatctcctctgagatgccttcctggacccttctctggcagttcccctagatcccaagaactgcctcc

SEQ ID NO: 33702 - DNA, 201 bp, Homo sapiens
gtttctaagcatgtactgagtacccaccattgagggtgctacaaggcaacattccctcccattcccaatcctgcctggcaacagtgccttctgtttcttcrttttattcctaagacttgccctggcctttgtcctacctttccgttctcaagcaggatatgctgggtcagttgtgccacctggaggctgggggaggaacgc

SEQ ID NO: 33703 - DNA, 201 bp, Homo sapiens
actgcgctcttttacacctcctggcctttgcacagcttgttctctctgcctatatactacctcccccctagcccccattgagagcctatgcatccttgaarttcagttcttatttcatctcctctgagatgccttcctggacccttctctggcagttcccctagatcccaagaactgcctccttatccttactgattcttg

SEQ ID NO: 33704 - DNA, 201 bp, Homo sapiens
cactttttggtaaataaaggcgactttagttgcagcctggctaccaggttatgttaaacacaggtctctgggaccaaattctggcactcatacagacttgwgttgaataaacatttataaaaaatgctatgaggaaatctcagctccctaaatttctagatgctccaaccccaccttgcctgaagacagatgtggcaactt

SEQ ID NO: 33705 - DNA, 201 bp, Homo sapiens
tgtttgttatctgaggccttattccttaggatgacagtccaagtacttaaaaaaaaagtatcccttttgcctctttcaaatgcatattttttattcttaawttttttattgatacataatgtttgtacatatgtatgggatttatgtgatattttgttacatgcataaaatatgtaatgattaagttagggtatgtgaggt

SEQ ID NO: 33706 - DNA, 201 bp, Homo sapiens
ctccagtaatctgcctgcctcggcctcccaaagtgctgggattataggcataagccaacatgccagacaaatattattataattttttgttacagatgaakaaacagacacaagggtttagggcaagggtacacagctagtggcaaagccaagcctggaatccctataggctagtggttagagacagtctcttaatcattc

SEQ ID NO: 33707 - DNA, 201 bp, Homo sapiens
catctgtaaaattcagataataatagtgctactctcataggctgatatgaggtttacattagttaatatatgtaaagcactttgaatgaattcagtaatayagtcagcaccatgtaagtgtgtattaaatttaaaaatagaccaggcaaggtggctcatgcctataatcctagcacttcaggaggccaaggtgggaggatt

SEQ ID NO: 33708 - DNA, 201 bp, Homo sapiens
tgcataagttgagcacggtggtatgtgcctgtaaatcccagctactcaggaggctgaggcaggaggattgcttgagcacaggaatttaagtctagtctgcrcaacatagcaggaccctatttctttaaaaagaaaaaaaagatgtaatgctatcttttggctcccaagagtcagtaggaaggatgggagaggaggggacag

SEQ ID NO: 33709 - DNA, 201 bp, Homo sapiens
catattagcatagatgtgagttgtaattttataggattatggaactgtaattgtggaactcctgcagggcagactctggaggctagctttttagaaaactraaacctccagtataaacttaatttctgtcatttgccccattttcttgaaagttaagtgccagaaaagaaaaggatcgagtctctcttttctttctacaat

SEQ ID NO: 33710 - DNA, 201 bp, Homo sapiens
ctgttcacaatttggacattttcctttcaaacacatttttcatgaatatattataggaaagttaaaaccatctctattctaaaaggaaaatctaccatttkgctcagagagaaagttactgagtttgtctatgtgattttaagtagtatttgattagagtattaaagaaatggggtacttcaagtaacataacacctgata

SEQ ID NO: 33711 - DNA, 201 bp, Homo sapiens
tggacacagttactggccttttggtctgatcagaggccaattttgagctaggagtttcccatgcatatgcatgatgtcctactatctgtgatacatgctgsgcatctgagcctgcctggtatgctaatgatcagaccagggaaatgcacatcactgtgagtcacaagggtagcacgtctaatctaaaaaattcaaacccct

SEQ ID NO: 33712 - DNA, 201 bp, Homo sapiens
ctgcgtcactcatgctgggagctatagactggagctgttcctattcggccatcttggctccacctcttttctttttttttctttcattctttctctctatrtctcttctctttcctctttctctcttttcctctcgcctgcctgccttccttccttccattttctctctctctcttcctttctttctttcctttccctccc

SEQ ID NO: 33713 - DNA, 201 bp, Homo sapiens
atgcaacggacaactaccagtttgtctggaggcggtacaaatactcttctaatatttttttaaaaactataggatgtagtctattttcaactttattcaascagatttatttacccctaccgagttttctaaatcagtgaatcagtattttaaggaataaatcttaggcacataaaatgataggaataaaatatgtattat

SEQ ID NO: 33714 - DNA, 201 bp, Homo sapiens
cttccattttctctctctctcttcctttctttctttcctttccctccctttccttccttcctttctttctttctttctttctttctttctttctttctttctttctttctttcttctctctttctttacaagatcttactctgtcatgcagtgttgcaaacacagctcactgcagcttctacctcctgggctcaagtgatg

SEQ ID NO: 33715 - DNA, 201 bp, Homo sapiens
gccgggatttaagaaaggtgcctcttggctgggtggcatgaactcagtcagctggctttccccaggcacctgattggccttaaacactgagtttttgtggygtgacttgacatacatcttgggctgatatcacgtgctgtttctactggggtgggaagtgctttgaaaatgtccttgctccagtggaactgtgagacatat

SEQ ID NO: 33716 - DNA, 201 bp, Homo sapiens
gtcatcacagaggaggtgactttaagcagggtgttgaagggtgagtagaagattgctaggcagaaataataaatctaggttgctgtagtgtttcagaagasaaaatatatctggagaggttttctctggcttccctaggcccatgtgttgccctaaaatcagaacagcagcaaaataatacaaataaccaacatttattga

SEQ ID NO: 33717 - DNA, 201 bp, Homo sapiens
gatctactatctacaagctggaggcccaggaaagccaatgatgtaattccagtccaacccagaaggccagaaaccaggggagtcagtggcacaagtcccartccaggtccaatggtccaagaaccaggggcaccagaagacggacatcccaggttaagcggagagagaaagttcacccttcctccacttttgtgttctatt

SEQ ID NO: 33718 - DNA, 201 bp, Homo sapiens
aggattcttaagaaaagcagaaccaataagatgtatgtagacatatggaaaaatattatgagggattggctcactcaattatggcggttgagaagccccaygatctactatctacaagctggaggcccaggaaagccaatgatgtaattccagtccaacccagaaggccagaaaccaggggagtcagtggcacaagtccca

SEQ ID NO: 33719 - DNA, 201 bp, Homo sapiens
agcctttgcaaattctggtgcagtgttacgaggagacaaagttcacaaacattaccttgcccctgggtaccacgtgacttttgtctccctatatctcctgyacaattgcaaggattaaacatgctaatatgtataacggacttagcaccctgctctccaataatggcttaataatgctctggtttctcttcagatcatata

SEQ ID NO: 33720 - DNA, 201 bp, Homo sapiens
atgagtgagaatggtaatcccagggactaataacaacaattgccatttattgaatattgttcattcagaaaggcacggtgtgaaatactttttgtttttcrcctaacgttatttatagtctaatggaagaaatagaaaagcacataagcagttactatccaggagtactatgaaaatgagcatccaggaggaacatgtaaa

SEQ ID NO: 33721 - DNA, 201 bp, Homo sapiens
attgggtaaaataaaatataaaataacatcataaccttcccaattaccaggaggcatttgtttattcgttatttgattattatttattcaggacatttagygtgagaaagggaaaggcaaaagcatgaagaagttaagtcagtagctaaagacacaaactcagagtgaacactgaaatgcttttcagcatgtattatctca

SEQ ID NO: 33722 - DNA, 201 bp, Homo sapiens
cttggaagggtgctttgatacgggctgaaactgcaactaagatcctgctggactaaaatcttctggctgggaggagaggagtgagcttggatgtgtctctrtggaatatgcccttgttaggatttcactttcggcctctttcattcttgaaattctcaccaaggggtcagctagtgagtttatggctttcatctgattcta

SEQ ID NO: 33723 - DNA, 201 bp, Homo sapiens
tccaaggatgtcatgcaggcttccctcacttgtctttgtaccatgcattttttgagctaacccttcatttttggaaggattctgcctcaccggatctcttrtatatcttaaaacacaaagcacagaggctgcactgtacaggatgaggcctaagagaacgtggagactgtaggggatgggccacacagcatggcggagttt

SEQ ID NO: 33724 - DNA, 201 bp, Homo sapiens
cagtctgggtttgaatggatctgaattttaatagctttttcctccaaaatattatttctatggcaaataagcagcccttccttataatgctgaaatcatakaagttagttgttttcccctcattttttgacaatcattctttttgcggtagtaacgaaatcaagcagttttcatttggctttttggtagttgaagttaatt

SEQ ID NO: 33725 - DNA, 201 bp, Homo sapiens
aaaaacctgtgctccatttactaccatctcatttggcactggaaacacaaatgtacaactagttataaaagtaggatcaagtccaaaacctgtggctatcwgtttcggggaggcagctgtcaatgcaagataaggaaaaaattcctcaatatttagagctgccccagtttggaattaactacttcatgggatggtgagcaa

SEQ ID NO: 33726 - DNA, 201 bp, Homo sapiens
ttttctatgttatagatatatttgtggatgctgagaatgttcatggtaaatacaagacagtctctgccctcacggagcttgcattctggtgggagactagrgaagaataatttatgaataaactattgaatatatactatgtttgtatagtttgtagtacagagacttggttgtgctggggagggggataccttcatagaa

SEQ ID NO: 33727 - DNA, 201 bp, Homo sapiens
gaaaaagttgagtcaaggctgaagctctggcatctctaaccactggtcagtaaattctattgaaattcaatagtataagagacaaacaggcaaaaaggatsgtgaaaccatttccaaataccaagataaaggaggctattgacattcaggaaccctgagaacagctgatgtcccattgtagacttcatcctcttccttggg

SEQ ID NO: 33728 - DNA, 201 bp, Homo sapiens
ttacatctcctctcattaatagcactattgatttttatttgatttaacacattatttcattgttattacaaattatgtgttttaaatgcctattttgatgyataattctataatgtacacttagttcagtagtacatgtgtattacttgtatttatcatgtgtgaatatatatatatacacacatggtatgtgctcaaaat

SEQ ID NO: 33729 - DNA, 201 bp, Homo sapiens
aaatctatggatggatcatgcctgctacagaaaagccaatgatgcttaatccagagatgacctttttgccattaagtaagaaccagagatcagtgagaaaygtcttactttggaaatccgtaaacatacaaatcatccatatggatggtgtaaaaccactagttgagctagagtaagcaaatgatctttgtggattctagg

SEQ ID NO: 33730 - DNA, 201 bp, Homo sapiens
cagctacttgggaggctgagggaggagaattgcttgaatccaggaggtggaggttttggtgagccgagattgtgccattgcactccagcctgggcagtaartctatggatggatcatgcctgctacagaaaagccaatgatgcttaatccagagatgacctttttgccattaagtaagaaccagagatcagtgagaaacgt

SEQ ID NO: 33731 - DNA, 201 bp, Homo sapiens
agcattccaaggtaagcggctgatcccaggaacctattccattattagacatgcagatcacactccggagagctgggcagtgcctgccctgccgtgaaggygctgccgccaaccaaaccagcctttttcattcaatcaggaaaccatctcttggcttttcttgtgaatttctcaaattcagggcattattacagcattcca

SEQ ID NO: 33732 - DNA, 201 bp, Homo sapiens
cttggctcatggacacattgctccaatctctgcctctgtctccatgtggccttcccctctgggtgtgtgtgtgtgtcttaaatctctttctcttatgaagmcattggttattgggtttaggtcccaccttaaattcaggatgatttatctcaatatccttaactaaattacttctgcaaagactctaagtgaagtcacatt

SEQ ID NO: 33733 - DNA, 201 bp, Homo sapiens
ctttattttcaaggaaaaaagaaagaggcagactgaaatagaaggcaagcgacaacagcttgacgagcagatacttctgctgcagcattccaaggtaagcrgctgatcccaggaacctattccattattagacatgcagatcacactccggagagctgggcagtgcctgccctgccgtgaaggcgctgccgccaaccaaac

SEQ ID NO: 33734 - DNA, 201 bp, Homo sapiens
gtcttacaccagagctgtgtctctcatggacatgacctgtctggtgcttacaggaatgagaggttttggccctagctaaattggtttagtggtgaagaagattgaaggtttttgatcagggcagattgtgccaaatgggctactgcaggcagaggcagaggcaggaaggccagtgagggagctattgcaggagaccagctg

SEQ ID NO: 33735 - DNA, 201 bp, Homo sapiens
tatatatatacacacatggtatgtgctcaaaatattttacagattagagtatgtgaaaaaaatttgaagaccactctgcataataaatgtgcaggggctgrcccatgagacatgttcagtaaatgcttgtttccatcctctttctccctggaaataaagtcgatagtgtgtgtgtggaccttgcttattaaaggaaagtgg

SEQ ID NO: 33736 - DNA, 201 bp, Homo sapiens
gttggccaggacagcacttcgtcatttgaacaatttccattttccacaagctctctgtgattgatgacctaaccaggcacatggcattccgttccaccagsaatgtggccagtggggagatggctatgtcagtaacacctgtttgtggtagaccaacaatggcgccctaaaagatatatccgcatcaaatccctgggacct

SEQ ID NO: 33737 - DNA, 201 bp, Homo sapiens
tgaaatttagtgtagcattgagacatttaaacacatttttgaagcacaaaacttatttatcctagttcaaagccagatttggtttgacctgtcttggtggygttttctgtggttctgagatccaacccccaacttcgtcccttttgacctagtttatcacccatgtccttgggttgaaaatagtagtgtaatcctaagaga

SEQ ID NO: 33738 - DNA, 201 bp, Homo sapiens
gagatggtttagaagggtgtttttaattgtataaaacacaactataagtcaatgcaaacaagaccatagactaacatatgccagtcttggatgtgcattcygaaagttgatggttaaaatagtctatgggggccggatgcggtggctcaggcctgtaatctcagcactttgggaggccgaagcttgcagatcacctgaggt

SEQ ID NO: 33739 - DNA, 201 bp, Homo sapiens
tgatagataccaaagggaagcaaagtaccacactgaagcaaagtaccatggaaggactgctccccacttttgatgcatgataaagaccaacctgcctgcakgaagatgatggtgcacttctcctgaacttcaccatcatgatcacagtcaaagccagtgatgatggagtataatcacaccagtaaatgaagttcccctgct

SEQ ID NO: 33740 - DNA, 201 bp, Homo sapiens
agcccacatctaatctgttacaagtcacactgattctacctccagaatgtaccaccatgccttttgattcttctgtctctcttctgtttcaagctaatatkctctgtcacttgaaccatgcaataaactcccatcacttgtactttgtaatcctgccccttgcaatgtgttcttcctattgggcttagaagacacagcaaa

SEQ ID NO: 33741 - DNA, 201 bp, Homo sapiens
actacagtgttcacccttgtattctcagatcttagtacactgccaggctcaatgggttttcaaacatatttacataaagaaagaaaacaatgacaaaagtrcagatgacatgcccatggatactctggacataaatgcttgtaatatttctctctgtaagcgtttccagtgggaagttcagcttttgtctcaattactctg

SEQ ID NO: 33742 - DNA, 201 bp, Homo sapiens
atcccagctccagaactggacctgagttactggataatgctgtcattaggaaactgtgaccacctaggagttggactgctaaatgggcaatgtcagcaggytgttacagatactctatgcagaccaagcttatttggctcttctcagctcagccacctgttgtaaacagctgagaggggcttagctccacgtggaggttgt

SEQ ID NO: 33743 - DNA, 201 bp, Homo sapiens
ctcattcactcacttgagcctgccttgcacatttctgcatcaaagcccctttgtccatgttatcatcctagcttgaaatgctgtctgaacacctctatgcyttgatcatttttctcttcaagatcctactgacatgttccaacctcctgaaatcctgccctgcctccccacaagcagagttactcagactctcttctttgc

SEQ ID NO: 33744 - DNA, 201 bp, Homo sapiens
aaccactctatgaattgcttagcagtcagcacttggactcatcaatgcctgagccctctgtgggaatcacaaactgtttctgatacctggcagctttactmatttatgttatctgtctggcttcctaaggtatttgagtttgcaatgcttgctcctaaaattaactaggcagtggtctaacaagaaaaggaaggaagggag

SEQ ID NO: 33745 - DNA, 201 bp, Homo sapiens
agctaggatacataatttttttcaggtgggcatgttgccatccccaaccaaataaggattctgttagtttggaagagggggagaatagatattgagaagascactcagcgtccccaccacacactcccaggcagaaccaactattctacagcatgttgttctttcctctattattgctatttttggtttgtattgtaattt

SEQ ID NO: 33746 - DNA, 201 bp, Homo sapiens
agcagcacctatctgaacccacagttctcgtctaggtgctcacctatctcatctcaaccactctatgaattgcttagcagtcagcacttggactcatcaaygcctgagccctctgtgggaatcacaaactgtttctgatacctggcagctttactaatttatgttatctgtctggcttcctaaggtatttgagtttgcaat

SEQ ID NO: 33747 - DNA, 201 bp, Homo sapiens
ggggattccctactcacagggtcattgggaagtttggataaaataatccacatgaattcttagctcagttcctggcacagaataagtgctcagtaaacackggtggtaattattatcatttcactgaaagaatatggctgttgagactttccccaaatcatagctgcagctgctattctggaatatttccagagtctcctg

SEQ ID NO: 33748 - DNA, 201 bp, Homo sapiens
aggtcaggattccaatccaggtcttctggctctctgttttttactgacattttgctataccgtaaaatgagaaaaatggcttgggcaacatgtaactttcytcctagttctaactttcatgtctctaacattttgatatgccttcacccatcccaagcatgtaaagaaaattccgaagtcaaacatagtagcagcagcagc

SEQ ID NO: 33749 - DNA, 201 bp, Homo sapiens
gaaaattcatgttttgggaaggataaaattgctggaacaatgtcctagaggagataagaagggagggatggcgaggctgagcgattttcctaaggtcacayagccagtaagtgacaggtcaggattccaatccaggtcttctggctctctgttttttactgacattttgctataccgtaaaatgagaaaaatggcttgggc

SEQ ID NO: 33750 - DNA, 201 bp, Homo sapiens
agccatgatcatgctactgcactccagccatagtgacagagtgagaccctctctcaataaataaataattttaaaaagaaaattcataatatacaatctaycctcttaaagtgttcatttagtacagtattattaactgtgagcacaagaaaaattttttttgatagaagaaatcacagcatatttgataaagtgaaagaa

SEQ ID NO: 33751 - DNA, 201 bp, Homo sapiens
agcacatggggagactgatggaccaaatggctggctccactataaaacactccagcgtttagcctttgttctgcctcctgggcgttagcaagctgactccygcacagaagacttcttggttgactcttgaagagtcagggatttagtcaatgcaagctgtaaactggctcagcactagagaagcagcagacatgagtagaa

SEQ ID NO: 33752 - DNA, 201 bp, Homo sapiens
tgcactgagccaagattgcaccactgcattccagcctgggcgacagagcgagactctgtcctctgtctcaaaaaaaaaaaaaaaaaaaaaaagtatatatrtatatatatatatatatatatatatatatatatatatacacacacacacatatatcttgccatttcttcaaacttttcaccaatgtagatcattttaact

SEQ ID NO: 33753 - DNA, 201 bp, Homo sapiens
gttattgtggtgtaatttatatatggcaaaattcactcttttcaaatgtacagttcaacgtgttttgacaaatgtatacatgcatataattacctccaaartgaagatacagaacatttccgtcaccacagtgttctcttggtacttctgttgtcaagccaccctcttcaccctcagcccctattgatcactgattcgatt

SEQ ID NO: 33754 - DNA, 201 bp, Homo sapiens
aaacatggcatcaaaacggtgattctttaaggtgcaagatagtgtgaatcatttagtctccagcaaatgcatccatcataatataagaccttttagaattrgaaaaataatcaaacctgtaacaaattttgcaagcaatttataaacaggtgctagaatctaagatattggtgacagtagagaagcaaacaaacaacaaca

SEQ ID NO: 33755 - DNA, 201 bp, Homo sapiens
aacccagatttttggaaccctattcccagcctcttacacttagatgtgatgtatcctcatttcttcattgcacatttcttcatttcatagaatggtagaawgttttgtaagtgtacatgtaaaaattaatcaattccagaatcaccacaaactcagaaaacatggcatcaaaacggtgattctttaaggtgcaagatagtg

SEQ ID NO: 33756 - DNA, 201 bp, Homo sapiens
gtgatgggcctcaaccacaaaacagcaacagcaaaaaacatttttctctaatatttgttactccaaataggttatcttcaatacgttattgtggtaagagwttcttctcaggagtgtttgctgctgtcaggggtaacatggtgaaggatagagcaagccctgccatgctccagtctcagctggctgtgtggattccaccca

SEQ ID NO: 33757 - DNA, 201 bp, Homo sapiens
caagtagaggaggagtgttctaccctggaataacacaaattagaggtgcctgtatgtatgtgtatggtgtgtgtgtgtgtgtgtgtgtgtgtgtgtgtgtatatgtattaaacttcatgctttttaaagcctccttctaaaatgccatctttcagatgtgcctatctgtgtcttattttggtagtttttcttttctttccc

SEQ ID NO: 33758 - DNA, 201 bp, Homo sapiens
gtaaagtcatgggatatttgagtagaaagggcttacaggctctctcatcaaattgtcttattttacagttaagattctgaggcccagagagaaaggacttraccaaggccatttgacgacttactactagacctgggatgggactcaggcccacacatttgttccacactgagtagtttttagggcacttgaccttttatt

SEQ ID NO: 33759 - DNA, 201 bp, Homo sapiens
atttagtggcaaagaatactttgtaagaatcccatactgtatctccttctttcataccaatgcgtggtttaatatataataaccttgtttgaaataaaagsctttgatgcctggtgcccttaccacttatgaagtaaccatcggtttccaccactaaaagtctcctatggtcacaaagtcctttgtgaaaaaatccaaagg

SEQ ID NO: 33760 - DNA, 201 bp, Homo sapiens
ttacaccatgcccagagatactaaataatttgcccaaatccacacaactagtaagcccaaaaactgggatttgaattttggcatctttgattaaaaaaatstctagttttttccacagcgcccctgcaattaattaaagtgtttccctgtgtactgcaaatgtaccttatctactctttattccaagagcccaaaggttca

SEQ ID NO: 33761 - DNA, 201 bp, Homo sapiens
ttatggcaaccctgggaaatgaatgcactcagattctgccaagaatcacacctatgcttcttgagtgcaaatgccatagaggctgataaaccaatattacraagatccacataattttcttattttactctacttacccttataaattgttttttacctgttcttgttttgggagaaccactaacttttttcagcctatat

SEQ ID NO: 33762 - DNA, 201 bp, Homo sapiens
tatttatcatccttcactggaagaaaagggtagctgtatctcagaatagcttctattttatatcctattctgttttgttgcttgtccagacattgaatttaaaaaaaaaaaaaaacaggtatggatcagtatttcttgaaatgcctgaccctgagaatcacctgcagcaatgtagaaaacaacaataacacagcttgccag

SEQ ID NO: 33763 - DNA, 201 bp, Homo sapiens
aacctccaatatggacaacaggcaaaaatatggtgattattcccagtttgggcatttgtgaaagatgtggctgaggctgtatggatgcgtgtgcacacacmcacacacacacacacacacacagaggccgatgggaaaatctaactcagcaggaaagctatcacagagcgctggatttaggcacaatgagtaaacagggat

SEQ ID NO: 33764 - DNA, 201 bp, Homo sapiens
tagagagtggcagaagaggtggttctttaagggaaattgagggacatgtatgtcagatcaagaaaacacatgtcctctgcagggacgttcaggccatgtasccagttgttgtctttgtttttaaataatttttataaacacctaccctaggctaaccttccaaataagcaaaagtttcagaattgatagttgattgattga

SEQ ID NO: 33765 - DNA, 201 bp, Homo sapiens
gaatgttaagtcccctttttgacggctgggctttttttcttatgccaagtttaagtgcaaagcagcagttcccttgtgccctgggacttttgcctaggaayaagggactgccagaaaacctcagaaaatccccatggagatgtctctgaaaaccatgtaaacagggacattgtctaagtgggtcatcctgaatatatgatg

SEQ ID NO: 33766 - DNA, 201 bp, Homo sapiens
agatgacaactgtttactggatgtgagatgtaatattttgggaggaaaatagtggaaattgagtgactgcgggactcggctaagatgggtagatggggcaygaggagaactggtcctgtgtctgtcaagggatcaatgagtaaggaaaaatgggcttcaaggacaaaaagccaggagaaaagaaaaagaagataccagaga

SEQ ID NO: 33767 - DNA, 201 bp, Homo sapiens
tagactcttgcttgctgtatcaaggtgactgacagcagcttccggcttttattctactttctcaattccgtacagttccaacaagtctcagaatggggtcwcatgggctctgattgcttctcctgctccttatgacccccagggatggggtgggggtgagcggcagtgctctgattggtcagacttaggtcacctgctcac

SEQ ID NO: 33768 - DNA, 201 bp, Homo sapiens
tgcttctcttagaagtcaaagagttggtgaggtaactgcaatcctgtctatatcagtgtagtgataatgcagtagtgtaatgaagaatggagctgcacgtrtgaggtttttcaagtccacaaagatcaggtattgtctacggtcaataaagatttttttaaaaaaccctcttaactaaagagaggtaacttccttttcaaa

SEQ ID NO: 33769 - DNA, 201 bp, Homo sapiens
ggccggttcacattgcagcctgtgtgcttcctggggcagcgtccaccaggtgtgtgcgggcaggtacaggatgcgagctcagtcctgcttcccctgaaatyctgtgacctggcagagggctgtgttcctgtgtccttacatcggatgtcctactgaagaaagggaaactgggacgaagctgtaggcacagtgggttctgaa

SEQ ID NO: 33770 - DNA, 201 bp, Homo sapiens
tgtggaagattggcttaaaaaaagatgcttgctgctgggctttggggaaggactaaacagaggcttggggtggggggacgactccaggaatattatgaccraatgctcaggcatacgttggcttcatagcctggagaaccaagagaagggtgacctgaacggtggctgccatcctctctgcggaagctgtcctcctgttaa

SEQ ID NO: 33771 - DNA, 201 bp, Homo sapiens
tgctcaggcatacgttggcttcatagcctggagaaccaagagaagggtgacctgaacggtggctgccatcctctctgcggaagctgtcctcctgttaagtrgaaaaccaggagtcagcgactcagccagccacgcggtagaacctcctcccagaaaccgggaatgttagttttcccttctctgtttgatattgacaagggc

SEQ ID NO: 33772 - DNA, 201 bp, Homo sapiens
ggtaggtgtattgatttcctagggcagctataacaaattctcacaaattacgtggttgaaaacaatagcaatttgttctctcacagttcaggagtcctgamgtctgaaattacagatggcagggttggttccttctggaggctttgagggagaatccgttccatgcctttctcctagcttctcgtggttgctagcaatgtg

SEQ ID NO: 33773 - DNA, 201 bp, Homo sapiens
ttctcccttgatcttcctgctctccctctctctttatattcacatctttggctcaaatattccctcctccagtggcacattcttttctttttttttctttwtttttattttattttattttattattattatactttaagttttagggtacatgtgcacaatgtgcaggtttgttacttatgtatacatgtgccatgtttg

SEQ ID NO: 33774 - DNA, 201 bp, Homo sapiens
aacaaatatttattgagcatctgtatgtacagggaagaatgtgaggtacagtaacacaaaatatatagtcctatctcttaataagcctgcacttgggagarggtatagatagggttgggaaggataaatatatttttaacactctaatacaaggcagagtgtaccaaaagttagaaatgctgtggagaatcagaatgaatg

SEQ ID NO: 33775 - DNA, 201 bp, Homo sapiens
tgtaatcccagcaccttgggaggccaaggtgggcagatcacaatgtcaggagatcgagaccatcctggcgaacacagtgaaaccccgtctctactaaaaawacaaaaaagtagctggccgtggtggcgggcgcctgtagtcccagccactcgggaggctgaggcaggagaatggcgtgaacccaggaggcagagcttgcag

SEQ ID NO: 33776 - DNA, 201 bp, Homo sapiens
aatttttattaacaaaacatctattttgcatatctagcattctgtatccttttcgtataatgctttgcaatgaagcatctatcataaaaaccactaaaccrtacagatggtgtttatgcaacacaatttaatgtcccagcaagaactagtgatttgttacatacattatgcatcattgtgatgtatatatccagattttaa

SEQ ID NO: 33777 - DNA, 201 bp, Homo sapiens
tcaagggactggttacagaattgtctggggtttaaataccctttagagatttcccattggttacttggtgtatgccctatgtaatgaagtagtggctcatkattagtctgattggttgcaggaggggaccaatcagaggctgaagttacaaagctacaccctatgcaaacatctgattgtggaaagcaaccaatcagaggc

SEQ ID NO: 33778 - DNA, 201 bp, Homo sapiens
agctggttcatttcattcattgactcaacaaatatttactaagtgtctgccataggccagttactgttctaggcatgtaggagacagtagtgaggaagatrgatgaggtttctgtcctcagggacctgagatcgtagaggagggaagcaaacacagagccatttggagtggtaataagtgctgagaagggaagaaagggaa
